United States Patent 10,870,889 (IMMUNOGLOBULIN EXPRESSION LEVELS AS BIOMARKER FOR PROTEASOME INHIBITOR RESPONSE) - sequence listing, part 9

SEQ ID NO: 648 - DNA, 140320 bp, Homo sapiens
ctcggtgtcctcccgcggaggggcgtagggtgtaaacaggcgacgcgctgggggaggtgcggccttgctgcgtccacgtctcgggcatgctcgaggcgggccagggcggtagcgccgccagctcagagcccacctgaggtaactcctgcggcctctaggatcggagtcccccacgccgcgcgcagccgccgccgctggccgccaataagggcggccgagcccccggcccgggcagggggtgtggctgccggcagcgcgtcggctacaggtgggctgggctgggctgggctgggctgggctgggtgggggcggccgccaaggacccatccctgcgctgcgggcccggcgtggagcccgcggagaggcagcgcgactccaggcagtgggtctctctgccccggtgctcgcgtctgcccctggggccgggccgagcggaaccaggaatcgcagaaacggtcagcgcccagggctctaggccggccgccccgggtgccaggtgaattcctttccctgaccggctgtgagacgttggcccgtcagccgtcgtctttggcctgagtgtgcacatctgtaaaatggaagctcggactagtgatccgtgaggaccttccacgtctgacgtgtgatctcgagagacctgcgtacattcggggtgccagaaggaaagcataggtaactattttgtcctttaattgctaacttttctttggtctttaaatctgttttcatcttaaacgattcgtattcctgtccacctgggtgaagtttttaatagaaaacttattgggtgggggttataatggtttatgttaccgttttcatgtttctttaatgcaacaaaacctttttttcttaaaacctatttggaagcccaaattgtaaaaataaataaataaaaatggaacccttttctgcctcactatcactattctcaccacccatccccacgctaactacccttgaggacccctgcaagtcataggttgaggagctctgtatggagttgaggaaatgttttgtgtattttttaatttgatgggatctggaaaatgaattctttgcatgtgtggagttttctgttatttttctctttattttgttcgattgcatgctatgtaattagacagctagcataaccctcacataccatacttcggggcctttttggccccaaaatttctgataaagacgtttctctttccatgtttccttgcatcccagtccctggggaagtaagtgtatgtttataatagtgagacttcattcctcattgctgatttagttgctccgatacagaatgggaatgggagacttttgaggccaaccgaatgggttaggacatatctgaaaaacatgaaaacgctaaaaagcatgaaaactgaaggagtatacgaactcaagtcgttgagagtcatgaaataatgtgaacatgctcttgtgtgaaatcttgagaccctggagcaagagaattttggattttgagagaactgagttcaggagagaaggatgtcctgtttcatatggtgagtgaaaatataaacagtatgaggtggtagtgtgtagacaaaattatcaggttttttttttttaagagtagcacatagtttcctaattgattttggagactagggttttaagagatgtactgaaacttgaagtttaatgttacaagagggaaaccatactcttttacaccttgtctgcttggtgcttctgtgagttgagcaagaattggaagtggaatgtactgtaagtggtacccaaggtgacctagtggaaaggttttctcttttcaaaaccaacttacttccctgatctttggcttaagcttaagcaagtcagttcctttctttggttctcagtttctgctgaaaaatgaggaaattggattgattactattctaccttttggctccagctaggtttgccagataaaatacaggatgcctagttgatatgaatttcagataaacagtgaatttttgtaaaatttttaaaataaatttttactataaatattacgtgggagcatacttgtactaaaaaaaagattcgttgtttgtctgaaattaaagtgtaactgggcttgctgtatttatatttcctaaatctggcagccttagctccaacatttttgtctcctttaaattagtgccagctcaaagcagagctgggaatgaattgattcaagcagccaagaaaccctaatggttgtcagtagtagcgtctggttcttgagggttgtcgttgattcacttgtggtttgtttctttttcccttatgtagtagttccatttctgctataatcacataatgtttaggtttatacttctggtggtaagtagtttaaaatatctgaaagcaagttaaaaatattgctgaaatttctaaaagtaacctcattttttcgagccttgaaatggtatgtgctttttcccccccgtaaaagacactttacaaccctacctgttccctaggtttgtggttgactgcaagacattttctaaagccgtggactgttctgatgccaagtaatcaggaagttattcttatggcttctaattttgttccctgtgaatatgaaaaattatcactgtatacactataaacattttatattttatctgactgttgtcagctttgtctttgctgtattgaagggttttcaattttgaaattctttttcaaggagtgtaattttaaactctttctttctttcttgtccagaccaatttcttaactcacttggaaatgcctgaattttctaattcattttttaaatcaatagtcaacaaaaaatttggtgtgtttggagagccaggttgatgatgtgactggtgttctagttctccaggtgctaatttctgatagaggagttaaaacgtgtaatctgaggataatatgatgaaggctttgaagaggtacaaatgctatggaaattgagaggaaggatgggtgcccttcagattgatatatggaagaaaatctctggaggaggtagaagtggattctggacatggaagtagaggtgggatcaggaagacagaggtggacagaacggtggaaagaagtggataagggcaaggaatctgtcttctcagttctacaaagcatacactttgctggatttaaaatactttacaatattgtgtatgtgtggtgtttggttcactgtgatgctctcatctcctttatatttactttgaactgctctggtgtctttctgtattagaaagaccttcagttgtcagtgaagctctttgaaaaaatgtttattaaatgtgtcacgcatataagagtatgtattgaaaaaagtagaatattaccaatagcattgagacctcctgtgtacttcttccttcctctcaaaggtaaccagcatgctgaattctgtgtctgtcatttctttgcttgctgctgctgctgcttttttttttttgagacagagttttgctctgtcactcaggctggatggagtgcagtggcaccatcttggctcactgcaactctgcctcctgggttgaagcaattctcctgcctcaacctcccaagtagctaggactatgggcacacgccaccatgccctactaatttttgtatttttgtagagacaggctttcaccatgttggccagactggtctgtgtctcaggcgtccatgtgaagagaccaccaaacaggctttgtgggagcagcaaggctgtctgtttcacctgggtgcaggcagactgagtccgaaaagagagtcagcaaagggtggtggattatcattagttcttataggtttctcaacacctataaggtggtggagttaggagcaatgttttgcgggcaaggggtggaactcacaaagtacattctcaagggtggggagaattacaaagaaccttcttaagggtgggggagattacaaagtacgtttatcagttagggtggggcagaaaccaatcacaatggtggaacgtcatcagttaagactattttcacttcttttgtggatcttcagttgcttcaggccatctggatgtataagtgcaggtcacaggggatatgttggcttagcttgggctcaggcctgacagtcttagactcctgacctcaagtgatctgcctgccttagccttccaaagtgctgggattgcaggtataagccactgcgcctggcctgctttcttgataatgttattttacgttgtatatgtatatccccccaaaatattgtttgcttatgcatatttttaaactttatataaatggcatcatgctatgtggactttttttcctgcaactttttaaattagttactaagtttcatccatgtttttcttcaaaggtaagaatttctctggaatatacatctaggattggagttgttgtttgtcaggtgcgtacaccagtaactactagatacaaattgctttccaatgtagctgtacggttttattgtcctacaagcagtgggagagttcctgtttttatcctgtctacatgctccccagtgtttggtatgagaaaaccatgtatctattaaaggtctagtatccagagtaagtatccagagtatttaaggaactcttatacctcagtcataaaaagaaaaggaactcaaaaaaatcgacaaaggatttgaataggcagttcttcagataagacatacaaatagccagtaagcacatgaaaagatgttttacatcattagctaccatgtaaatggaaatcaaaaccacagtgaaataccatgttacaccaacgaagtaactaagacggttactaagtgactgtctaagtgaccatcttagtaaactaagatggctatgtataataaaaaagacaggtaataataagtgttggtgatgttgtggagaaattggaatctacatgttggaatgtaaactggagcaactgctttgagaaacagtctggcagttcttgaaatggctagatttgggataagggatgataaagcagttccactcctaggtatatacccaagagaaatgaaaacatatatttatgccaatatttgtatgtacatgttcacagtagcggtagccataatagccaaaaagttgaaacaactcaaacatatatcaactgatgaatggtttaaataatgtggtctatccatgcagtggactattattcaggaataaaaaggaatgaagtactgactcatgctacaaatggatgaaccttgaaaacattctaagtgataaaagaaacagtcacaaaaggcaacacattgtgtgattacatttatatggaatgtccagaatacaaatatagaattagatagtagattactggttgcctagaactggtgttggggtagggggtggggaaaaatgggggtttgacagctaaagaggactaggtttctttttggggtgataaaatattctaaaattgattgtggtgatggttgtacagttctgtgcatttgctaaaaactattgaattgcacacctgcaaaaaagctattagtggaaagaaggaaattttttttaacaaagatgccatgttgtatgcctcctggagaatcctaggtggtagggactgagacttgcttatagccatgtgactgagatgggaaccatatccttttaatacatggaggccttcagaggatcccacagcttggccagcagcttgactgcaaccccatgatagactttgacccagaagtacccagctaagctgtgcctagatttctggcctatggtaactatgaggtaataaatgtccattgttttaaactactgagttttgggttaacttgtgtgcaacagtaaacactcataagcagcagtgttgcaatgtgtattttttaaattttagttttctggaaaactatggtgattaaattactaaattataatatggattcttttttttttttttttttttttgaaacgtagtcttgctctgtcacccaggctggagtgcagtggcgtgatcttggctcactgcaagctccacctcccatgttcatgccagtctccctgcctcagcctcctgagtagctggaactacaggcacctgccaccatgccaggctaattttttgtatttttagtagagacggggtttcactgtgttagccaggatggtctcgatctcttgacctcgtgatccacccaccttggcctcccaaagtgctgggattacaggcatgagccactgcacccggcctataatggattcttttattcattattttgttaaccacaattcataaccaatagtcaatgatacatttattgagatatcctgccaattattggggataaattatacttaaaatggctaaaatttcttttattacagtttgaaaaaatgtgtaatctctgtataatacaagtctttatcaaccaaaacaggcaattttaagacaatatagcagtacataacatttcacatattggtatggttttctggtaacttttatatttaaaacataagtggtattaatatgttgggagatttatttatttatgacttcagcaaaggcactcaaaaaagaatcatcaaggcaaaactaccgtctcatagaagccaacccgttcttgtaggaactatatgaaaggaggttaaaaagatttttgttcttttcctttgaatatttctgttcttcagttgaagaaatgttgtatgactgtatggataaggaaagtgtttcgaaatttcatttaagaaatgaagacatgttttcacagtttgtaaggattttctttttttttttttacttttgacaaaatgaaaaaatatatttattagcatgtaaggatagctgaaatattgtgtgaaaaaaagcctactgaattttctcctatgttctagaggttttatagctccactattaaggttcatgatcaatttttaggggttgatagggtgtttggtatgagctatgggtctaggttctttactttcctttatgaatacacagttttttaattttaattttattttttgtccgaggaggccttgggctcaagctagctggtctaatatacattttttaatatcatttgttgaaaaggtaattctttccctattgagtttcttcccctttctctatcctttgcccattgagttctcttggcatttttgttgaaagtcaactggtgatgtatgtgtggatctgcttttggactctctcctgttgcttttgctgtctgttcttatgtcggtaccatattatctttatctataactttatatgaggtttgaaattggttagtgtaaatcctccaactttgttccttattttcaaaaattttctgggtattataggtcctttgtgttttcaaaagtattttaaaatcagcttgttaggttttttaaaaaagaaaacaacttgtggtttcaattgggattgtcttggttctatagatcagtttgtggagaattgctattttaatgtcatcgaacctttcaatacatgaacatggtatagctctccatttatttagttctttaatttcttgcaacatgttttttagttttgcagtgtacaggtcctatgcatattttgttgaatttatatcttaatatcttacatttttaatgtcattgtaaataggattaaaaaatcatttctcaagtattccttgctaatgtgtaaaaatacagctgatttttgtatattgtctttgtgtcttgtagcctttctgaatccacttactagttctggtagtcttttggttggattttctccacatacagtcattgaataaagacagttttacgtcttcctttccactcatgtgctttctatttctttttcttgccttatgacactgatgaggacctcaagtccaatattatgatagaagtggtgagagcagatgtccatgtcctgttgtcaatttgagggagaaagcatttagtcttatatgtggtacaaaaagcactaactacaacattttaaaaatgttaaattggacttaataaaattaaaacgtatgcactttaggagatgttaaggaaaagaaacagtatactatagactgggagcaaatgttggcaatttatgtatctgacagaggacttttatccagcatatataaagaacttcagtaaattaagaagaagctagagaactcaaattgcaaaatcggtaaaaaaaaaatttgtggagcaacttcacaaaataaggtatttgaaattctagtagacatactaaaaattcccaatatatttattaaaggaaattatgagcaactttttgcctacaagaagggtcaaaatgaaaaagactaacaataccaagtgttggtgaggatgtagagcaatcagaattttacataaattgctgataggaatgtacaggcactttggaaaactgtttgacagtttcctattaacttaaacatgcacttactgtatgacctagacatttacacccctgggtgtaaaataaaaccttaaattcacaaatgacttgtactcagtgcttaacaccggaaagagtataatctttcaacaagtctgcaatgggatattaggagaaaaaaggagtgaattgcacagtgtcactatatgaaattaaaaacattatgctgagcaaaagaagccagacaaaacactacattctgtatgatttgattgatgtgtaattctagaaccaccaaaacattaagagagcagattagtggttgcctgaggttataggtaggggtggggaatgactgcagaggagcaaaagagaactttctgtggtgatggaattactctgtattttgattgggtggtggttatactacgtatacactttttatacacttttgtcagaacttcacattatgcttaagatgggtgcattttattttatgtaaattatgtcttaatagagttgtttttaaaaagggtctaaaaagcatttacagactgaacatatacctatgtgtatatatactgagattttatgtaaaatatttaaatgtatgtatactcataggaaatgtctagaaggatgttaagcaaattgttactaattatgtccaggtggtgagaattttaggtgattaaaaaaatgattggactctttatatcatttgaattattcctttcaatgaacacatctttgccaaagaaaagaagttttttttgttatgtagaagtttgattatctagatgttttcatttttcaaatattgaatagatattacaatatttataaattatgtatagaatgtaagtgctgttattctgtaatcaccagttaggaacaatctacattacttttgatgcccttcatctctcttctctgatcccattctgttatgttcccagagacataactgctaccctgaattttgtttttattatttcattgctatagttttaccacatttgtatctctaagctgtgttgttttgccctgcatgctgttgaactttatgactagaattgtattgtgggtaaacttctttcatttgcttttttattccgtatgagatttgagactcattcatatttttgtatggccgtagttcattggtgtctccttgtcttattgtgttacattatgaatattccacaatttgtcctttgtagtactgatgaatgactggattgtccattttttttctatcatgagcagtggtgatgtgaacattgtgcatgtctttttatgctcttgggcaagagtttctctttgtgtatggtcaggtgtatagctgctgggttgtaggataatgcatttcttcaacttttctagaagtagtagttttctgttgctgtgtaactaattaccacaaacttagaggcttaaaacaacacacattttaaaatctcatggtcctataggtcagaaatgcagtaggcttggctgggttatctgctctgggtcttaggaggctgaaatcaagttgtcagtaggactgcattcttttctggaggctctggagataaatcaactcccacacttatttgggttgttggtagaattcagttcatatggttgtaggactgaggtccatgtgtccttgctggatgttagctgatggtcgttctcagcttctacaggccatacatttcttgccttgtgatcctctttctttcttcatcttcaaagccggcaataggaggttgaatctctctcatgctttgaatctctctgactcatatttttttccttctctagatggagaccattctctgcttttaagggctcatatgatttgattgggtccactgggataatctagattactctattttatctccgtggtcctttcacagctatactcaaattagtgtttgaataaccaggggcaggaatcttggaggactatctttagatttctgactaccactgtatataatgttgttttccatagtggtggtaccagtatgcatttaccttagcagacattggagttcttgttccatgtccttaatattgtcacttaatattgtcagatatttaggctgagaagtggtatctcatggtgtttttaatctgtgggtccataatctgtgggtccatatttatccataagtaaagatagttttattttgttgctttttaaaaagttttacataaataattttattctgtatgtattctctaacatgtgagattttccctcagatttgtgcttttgtggtttgagttttaataactactgtatggtgttttattgtatgaatagatcacaatttgttcattctttcattgatgaaaatttagattgtttcttagttcttgtgaatgtgtgagagaatttcttgatatatatatatatatatatatatatatatatatatatatatgattgtatatatgttggtagaatctagaagtggaaatcatgtgcatcttccctgttttactatatagacttacaaaaagtagattctttcctttcctcctttttttttttttttttttttggaaatgaagtctcgctctgtcacccaggctggagtgcagtggcacgatcttggctcactgcaacctccgcccctccaggtttaagcaattctctgcctcagcctccggagtagctgggattgcaggcgcgtgccatcaccttccctccattcttttttgctttcttttgttactgcttttatccaatctgacaagcatatgtctttattgtctttaaaagagctacacaggtaatgtcacaatgctaaaaaagtcaaatactgtaagtacataaagaaaaagtctcatctagttatactgggtattttaataaaagtagcatcatactacatactatattttgaaatatgctttttcacctagatcaatacatacagatccgcattcttttaataatgatgtagtattcctttgcaggttgagttttatttactattctatacttagtacctagcaatcaataaatatttgtgggatgagtgtgaagaatatatgggtacatatattcatgaattattcagcccttcccctgttagttgatatttagtgtgctctgatttgtatcttttaaaatggtgtcacagtgatcattctcatatatatatctttgaacatttatgggtgtattcttagtctagagccctagaagtggaattgcctggtcaaaggagatttaaattggatagtggcaattggttgtcccgtttttatttcagtctgtactcccactaatggtgttttggtgttctttcccctattcacttgcctacaacattatctattaccgatcccttatttttctgtatcttaaaattaatgttgaaatttttatcaaaataatacttggacattgtttaaaaatagcgagcataaagtcttgcaatgaaaaatagaggcaaactctattcttgttataatacctatttttaatatttctaaacattttattccactgttatttgtttatccactttaaatattatgcattgccttcccagtttgataggtgaggatttggacatcttaaactcctcatttaccatttcccactctctgactgtggttacatccgtatttttagtgaaatcaataagaaatatttagttagtgacaacttaactattcatctgcaaagccaggtagtagtctatgactacatttcctttcttatgtattttttaagttaagttacctagtttttttcacctgcatcactttttaatacagattcttggtagatggatcatcttttctctcagtatttatatttttataaaacaaaaactgtcaatcctttcacacaacatctgtacaacttgatacagttctgaggggcgaaagagttaggaaacttgaattctgctcctgacttttctgaatagcttgacctctggcaagcagccttgcctcacctctctctgccttgtttactcatttataaaaatgggattgggtttgaactggctggtctctgattcctttcagttctgccattctggtttttttggtctcctgtttaatcttaattgtatcacttaaatagctaactgtaacagcttgtggggggagtgcattttacaacttggagaagaaaaaggcttggatgagaaagacaagataatatggaaacttgaagggctgctgtatagagaataattaggctggtttcatgtgattcaaaactaatagctgtagttgaacgggaggtgctctggattcagcataatggacacactcctaacagttaattcctgtccaacattgaagggggccaccttaagtggtgggtatttcctaacactgaaaggacagaggtcaaggtagataggcaaaatgatgctttagagacaggttgaagttatttaagtcccagccagccagggatagtactggatggcttctctaaccttttggcctcccataggtggacattatggcatgataaggttgttaaaataattttaaaaaacatattgtggcgtgactcattggtcattactttaaccaaattataataatgatgattcatatacttttttgaaaatctgctttttttttttttttggttgaagtgcctaagtactgttctcagttttgaaaatgttactcctttaagtcttgtgtagttcttgatgattcatctgggaaagcagcccttttcttctttttgagtgatctttgaaagcttgacactttccccgtaaactaagctgggaactttgagtttgagtttttagttgccacaactgtgggggtgctaatggcacctagtaggaagggcctgttgagatacacagctaaattaaatttgtcattgattatgtgggtgtgttgccaagttttctggagatgtttaccagtctgggcaattttgatagtattatcttcttacagtttctgctgtgaagcagtctttgaagaaatataagatatttataggagcaagcccttggggaaaaaagcattcttactagttttatttgattaattaattaattacaatgccctcattcccaattcttgaggtagaattttgatcaccttagcatctgagtgaggaggtaatgtgtgtgtttacatttcctgaactacctcaggtctcctctaaccactgggtgtcttgttcctgctgaattgtactgtgcagtagactccactgtattagtggatgcatcagtctgtggtaggatttcttgaccttagctctgctgacagttggggttggataattctttgttgtggggaactgttctgtgtattgtaggatgttcagtagcatccctggcctcttcctactaggtgccattagcaccaccacaattgtggcaactaaaaatatctccaagacactggcaaaatcccctggggtgataaactgcccctgttgagaaccacagacttacgaataccgctcagctggtcctctgccatggttaaggtcttcctactcttgtctggtttctccgtgttcccagccttgctcacagcctcctcttacctgactgtgctctgcttagctaattaggcagaaagttgccaagtagaaggtggaatcagtggggaatagggcagagctggagtcaggtgtggccctgggtaggggctaagctctggcagcacacagatgggtgtgtttttttgtggtagctaagattagactgctaaagcaaatgatctttgacatgaaaataaactgacaataccaccggtggtcctagcgcacaatactaatcaggtatgtggtatctttatattgtctcaagcctgccttggagtctgttgttaacgaaagctccaagcatgtttcctccttaatgtttttatttgaaagaagcaaagaaaagtgaaactggttcttgacgaacttcatattcaatatagtttcagttttcaggtgacttaaatagctagatacattttttacatatatgaaatgaggtgggagagtttgtaaatttgaagcagcaaatgtttactgaatgcagccaggtatggtgccatggcctcaagaaatacttggagtgcacagggagtgagacaggcaccatcatgtaagcggtggtagttcacagatggtgaggggtgagatctcataaactggagactgggacaggtgttcatattccctacttattttcattttcaaacagtcactgtttataatatgtctgttctgagctttatgaatttttttttttacttaagatcatcctaactgcccattttgtaaactttattctcttaacatttattatgtcatatttcctgattttaaataacttctaatgactgcatattgcgttttgtggttatatcctaagttgtttacgtaatgatttcgctattgtttaatgtggattattttaagaattttgctattatagttatcatttgatgaatatcttcagcataaattttagtccacagtttagattatttctttcagatagtgtcatgaagtagaatactgtggattttttttttttttttttttttttttttggagacggagtctttcaggctggagtgcagtggtatgatctcggctcactgcaacctccgcctcccgagttcaagcaattctcctgtctcagcctcccgagtagctgggattacaatgcccgccaccacgtccggctaacttttgtatttttagtagagacagggtttcaccatgttggccaggctggtctcgaactcctgatctcaggtaatccacccacctctgcctcccaaagtgctgggattataggcgtgagccaccacgcctggcctggtgtggatatttttaaggctcttgattcatattgctgaactgctttcctaaaagattctaattaatgcttccactagcaaggtgttgagtggccattttaggacatccttgccaatgttgatgttttctaaaaagaaaattaccgatttaacaggtggaaaacatctcatctttcattgactttttgtttttgctttcctttaaaacttcattagcttcttttgtgcagttggctgtacatgtccttttcctgttaatcttttggaggggttatagtgctttttaaaagaaatttgctttatatagcttgtttatatatgaaaggtagtgactttttgtctgtcatttttgtaaaaaaaaaaagcttacctagttttctagttatgtcttttgctttatgtgtaacttacagaaaaaatacacaaagaatatagagaattactacatataatttactaagattcaccagttgtttgtattttacctcattagctttatcactctttccccctttctttttatgcatatatgtgaatgtattttttgtgattcatttgagtttaagttgtataagtcctaagaatacttcaacatgtatttctaagagccagggtattctcttgcataaccacagtaaaattagcagtcaagaaatttaacaattggtacggtgttgttatctaattcatagtgcagtttcaacagttgtccctataatgtcctttattgcccttttgttttccatgtccagtatccagtcctgaatcgccatgaaattatcatatttctttagtctcctttaatctggagtactttgttaacctttcattgtcattcttgacattgatcttttggaagagtacagatcagttatttttttagaatgtccctcactttttacttgtctgaaatttcctcatggttagattcagttcatgcattttatgcaaggataacaaaaaagtgatttttatttttctcagtgcagcatattaggagcaacctgatgtcagtttgttctaatattgctgataacatcaaacagttggtttagttggtatctgccagatttctctactgccatgatactgtttttctctttgaagttaatatttgttgacaatgtgttaatatcctgttcctcatcaaactttcacccactagttttagcgtccagtgatgactttccaactgcatgcttccttctgtagctattgattggcattctactgtaaggaagacctttccctcctccctccacatcccatttatttatttgttcaattatttatttgaatgattcatatacatattcttatttagtggtctgtaactcattactgttattatcttgatactaaaatcatcccaaatttggtctgtgtaaactctttcaaactggcttctgtgttttcatatgtctccagaattctttgagtacctatttactttctggtgcaacaagatgatctgggctcattttgtatggcccacccctcaaatcagcttttcttcgaggagtattgttactattagtgaggaaaaaatggtatttggaaatcaagatctggatatatgatgtgcttattgtgactgatgtgtcattatttctaggcctactcagtggccacagctaggatatgtttgtttgtgtgtaaatagatatatgtatatccatattttaattttttattaaacaatttttttagagacagggtctcactctgtctcctaggctggaatgcagtggtatgatcatagctcactgtaacctcgaactcctgggctcaagcaaatccccctaccttggtttcccaagtagctaggactacagacatgggccaccatgcccagctatttttaaaatttttagtagagatgggatcttgctgtattctccaggctggtcttaactcctagccacaggcagtcctctgctttggcctccttaaagtggtaggattacagatacttattttaaatttatatatcttagttcgttatgctgctataacaaaatacctgagactgggtaatttataaacagtggaaattgatttcttatggttctagcagctgggaagttcaaggcaccagcattcattctctggtgagggccttcttgctgtatcttcgtgtgatggaaaagtggaagggcaaaagggctgactagctcctccagcccttttttaaataatatttttaatttttaatttttgtgggcacatagtaggtatatatatatttgtgaggtgcatgagatattttgatacaggcatgcaatgtgaaataatcatatcgcggcaaatagggtatacatcccctcatgcatttatcctttgtgttacaagcaatccaattacactcttattttaaaatgtataattgttactattgactgtagtcatcctgttgttctatcaaatagtgagtcttattcatcctttcaattttttttttgtgcccattaaccatccccaccttccccacagccccccattaacttcccagcctccagtaaccatccttctactgtctatgttcattagtacaattgttttgatttttagatcccacaaataagtgagaacatgtgatgtttctctttctgtgcctggcttatttcaccctctggctctttgatgagtccctaatcccattcatgaagtctctgccctcatgatttaatcacctcataaagtcctcaagtcttaatattagcattggcaattaagtttcttttttttttttttttcttttctctttttgtttagagacagagtctcactttatcacccaggctggagtgcagtggtgcaattgtagctcactgtagccttgacttcctgagctccagtgatcttcccaccttagcttcgtgcgtagctgggacttttaagctgggatgctttaaggtgcttgccaccatgcctggctagttttttttttttttttttaatttttatttgtagtagagatgaagcctcactgtgttgtccaggctagttttgtattcctgagctcaaacaattctcctgccttggcctcccagagtgctaggattacaggcttgagccaggacaccagggcgtgattaagtttcaacatgagaattttggggacacgttcataccctagcaacatctatgtatacacacatatattaacaactattaacaatatgatttcatattgattctaccagtgttattctaacaccatgagggggtggtacttcttgcatcttccttaggttgaatttcatcaaatgcttttcttgcatcttgcctacactctgtgcaaagatatgctgtatttatttctagaagttttatagttttggctttaggttcagatctatgatcaatctcaaattattttttattcatggtgtgagatggggttgaagttcatcattgttctgtattggatatccaactgatccagcactatttgttgaaaagcaattccccattgaattgctttgatgcctcccctgaaaatcatttaactgtatatgtgtgagtctgtttctggactttgtattctgttctcttgatctgtttgtttgtctttaggccagcacagtactctcctgattattgtagctctgtaagaagccttgaagtcagatagtttaaatttcactcatgtccctgtgaagagaccacggaacaggctttgtgtgagcaataaagctttttaatcacctgggtgcaggcggtctgagtccgaaaagagtcagcaaagggagaaaggggtggggccattttataggatttgggtaggtaaaggaaaattagtcaaagcgggttgttctttggtgggggtcacaaggtgttcattgggggagctttcgagccaggatgagccaggagaaggaatttcacaaggtaatgtcatcagttaaggcaggaacaggctattttcacttcttttgtgattcttcagttacttcaggccatccggatatatatgtgcaggtcacagggcatatgatggcttagcttgggctcagaggcctaacattcctgtagtcttatattaataagaaaaataaaacgaaatagtggtaaagtgttggggtagcgaaaatttttggggctggtatggatagataatgggcgatgtttctcagggcgggattaggagcggcatgggaacctagagtgggagagattaagctgaaggaagattttgtggtaagaggtgatattgtggggttgtttgaaggagcatttgtcgtatagaattattggtgatggcctggatatggttttgtatgaattgaaaaactaaacagaataagaggagaaaaacaggtattaaaagacgacagaatagagtgggcctgtgaggctggaaggatatattttccttggtccaaaaacccttgccttgtgtgggaagagattgataggtggaagtttcagtgggggagtaggtgggagtggccagatgagaaggagaaaaactgctctgtgagatagaagttggaacgctggctgctttttttagttgccctattagcataagcattgtcctgggcgatgggatctgatactttttgatggctgcttttttagctaccttatcagcataagcgttgtcctgagcaatgggatctgatgccttttgatggcccttgcagtgaatgaccccagcttccttcagaagtaaagcggctttgagaagagtttttattaaagaggtattagtgatggaggacccttgcatagtgaggaatttttttttttttttgcctatataacagcatggtggtgcaggatatggaaggcatatttagagtcagtataaatattgatgtgtagtccttttggaagagtgagggctcaagttaaggcaatgagtttggcttgctgagaggtagtggggtgggcagaaagtatatgcatcaggtgtgagaaagaaaatagattttggaagttatgagaactgtagagagtgagttgagcatagtttgtgattttgaaagcctctgaaagtattaaggcagcggtagccgccacatgcagacaggagggctaggctaaaacagtaaggtcaaattgtttggataaaaaggctacagggcgcggtcccagctcttgtgtaagaacactggcttgactgaggtgatgggggctgtctgtgaagccttgtggcagtacagcccaggtaatttgctgagcctgatgggtgttagggtcagtccaagtgaaagcgaagagaggctgggatgaagggtgcaaaggactagtaaagaaagcatgtttgagatccagaacagaataatgggttgtggaggggaggtattgaggataggagagtatatgggtttggcaccacggggtagataggcaaaacaatttggttgataagatgcagatcctgaactaacctgtaagacttgtctggtttttggacaggtaaaatgggggaattgtaaggagagtttataggctttaaaagtccatgctgtaacaggtgagtgataacaggctttaatccttttaaagcgtgctgtgggatgggatattggcattaagtggggtaagggtgactaggttttaatgggatggtaagaggtgcatgatcggttgccaaggagggagtagaggtatactatactacggtttaaggtggggagatacaaggggaggatgtgtgaaggaggctttgaactgggggaaaaggcaacaatgaggtgtggctgtagcccaggaatagtcagggaagcaaataatttagttaaaatgttttgacctattcagggagctgggcaggtggggataactaaaaaggagtgcttaaaagagtattgtccaagttggcaccagagttggggagtgtaagaggttttagaagcgtggtcttcaatacccacaacagttatggaggcaaaggaaacaggcccttgaaaagaaggtaatgtggagttggtagcctctgtattgattaagaaggggatggacttaccctccactttaagagttacctaaagcatctgtgatggtccaggaggcttctgtggtgatcgggcagcatcagtctttagccacgaagctgagaagatctgggaaggagtcagtcagagagccttgggccggagttccaggggctctgggagtggctgctgggcgagttggatttccagtggggtcccgcacagatgggacaaggcttaggaggaatcccgggcttcaggcattccttcgcccagtggccagatttccggcacctgaagcaagttcctgggggaggaggttctggaggaacccctggcagctgcagttcaggtgtttggagttcttgtgtgctggagatgtggctggggtttttctcacagtggaggcaaggaattgcaactcagaaatacattgctacttggctgcctctactttattattgtacaccttgaaggagaggttaattaagtcctgttgtggggtttgagggccggaatttaattttaggagttttatttaatgtcaggagctgactgggtgttaaaatgcataattagaatgagatggccttctgacccttcagggtctagggctgtaaagagtcttaagggttgctgctaaatgggccatgaactgggctgggtttttcatatttgatgaaaaagagcctaaacgctaactgatttgggagaggtccgataaagaaaaaggagcattaacctttactatgcctttagctccagccacctttttaagaggaaattgctgggcaggtgggggagggccagtcgcagaacgaaactgtaagctggaccaggtgtgaggagggggaggtgataaaaggattgtagggtggcggggcggaggctgaggaaaaaatggaaagacttgggactgtcttcccaagtccatgaccagcgctggagttttgggtccacggataaaacacgtttcctatgtctctaccagaaaagcagcctggggaggaggggagaggtcagatgggtcagtagaaaaggaagattcaaaagactcagagacgcttggggttgggactgaagggacaggcgggagggaaagaaggaagatttgggacgagttgcattggggaacagagactagggatggaccgatgtgtaaaagaatgcctggacgtcaggcacctcagaccgtttgcctattttacaacaagaattatttaggtcttataggatggagaaatcgaaaatgccgttttctggccatttagagccgttatcgagtttgtattggggttaagtggcattgcagaagaaaatattgcagaagaaaataaggcatttaggttttaggtcaggtgtgagttgaagaggttttaagttcttgagaacacaggctaagggagaagaaggaggaatggagggtggaaggttgcctatagtgaaggaggcaagtccagagaaaagagagggtagagacatggagaaaaggggtgggggtgcttgccccccaggaaagtggagagaaaagagagggtagagacacagagaaggggtgagggggtgcttgccccccaggaaagtggagaaggggtggggacacagagagaaggggtaaggggtgcttgccccccaggaaagtggagaaggggtggggacacagagagaaggggtaaggggtgcttgccccccaggaaagtggagaaggggtgggtgagcagccaaagcaggtgtccctgcaattgacttgccaccaagggaatgtgggtgaatgacaaaggcaggcgtccccgcggtgataagacaccaatgaaatgtgggtgaataatcaggtaggtgtccccgcgtgattaaacaccaagggaagactgtcttcctgagtctatgactggtgctggagttttgggtccacggataaaacatgtctcctttgtctctaccagaaaaggaaaggaactgaaattaagagaagggagagattgaagtgtggcgcgaagattgaaaggagaaagagattgagggatagtgagagaggttggagaagagagtaaaaagaggccgcttacccaatttaaaattggtgagatgttgcttgggctggttggtcagaggaccagaggtcgtaggtggacctttctcacagagcaaagagcaggaggacaggggattgatctcccaagggaggtccgccgatccgagtcacggcaccaaatttcactcacgtctgtgaagagaccaccaaacaggctttgtgtgagcaataaagctttttaatcacctgggtgcaggtgggctgagtccaaaaagagagtcagcaaagggagaaagggtggggccattttataggatttgggtgggtaaaggaaaattacagttaaagggggttgttctttggtgggcaggggtcggggtcacaaggtgctcagtgggggagcttttgagccaggatgagccaggagaaggaatttcacaaggtaatgtcatcagttaaggcagaaacaggctattttcacttcttttgtgattctttagttacttcaggccatcttgatgtataggtgcaggtcacaggggatatgatagtttagcttgggctcagaggcctgacattaactccttcaactttgttcttttttaagattgttttggccgttctaggtcttttgaattttcatatactttcatatttcatatacttttatatttcataggcttttagaatcaaaagcctaatttctataaaagtgcctggtgggaatatggttggaattgtgatttgggcagaatcaacatcttgacagtgttgaaattttcgaattacaaacatggtatatatcttcatttacttaggtatttctttcagcagtgttttgtggttttcagtatatggggcttccatatcttttgttaagtttattcttaagtaatctgctttttggtattgagaaacgtttttaaaatttcattttgttggtggaatatagaaatacaattgtttattgacctgccatcctgcaactttgccaaacttacttaaatgaatcttgttagattgacataattcttaaaaatttgtttgttaacaattatattgcctctgaaaagaaagttttataacttcgtttcaaatatttatgcgtagtatttcttttccttgcctattacattggctaggatcttctatataatataatgttgagtagacttgctgcgatttctatcactatctttgccatgttgccaatctttgagggaaagtcctcagaatttcattatttgctgaaggtttatatgatagaggaagtttctttctgtttgtaggtgtgctaaaatttttattttttttaacccggaatggatatggaacttcgtcaaatgctttcattgcatctggtattatagtaaatgaaattgccttttatatgtgaatccaaattttatattcctgggataaatactgcagtatcatgatatattattctttttgtaagttactgattttgatctttccattgttttgctgaggatgttttcatctgtgttaatcacctatggtcatgttttatagtttttttataaatgaaaaatattttggtaatgggtttatgcaaaccttctaaaatgaattgggaattgtttactcctttattttcttccacatgtgtctgatagacttcaccagtgaaaccatctgagttttgagtcttctttttgtaaaagggtaggctgagtattttaacttaataaatacatggctgtttagattttaaaagttttatcttgtgtcagttgtggaaagtgttgtgcttttcactctattattagtgctgtgtggtttatctttccatcctctttattttaacccgtgtctttatattcaaaaggtatctcttgtagacataattgggtcttgtttttttcttctccccaatctgaaaaaaagctacattttaattggaatatttagtctccttgatacacaattgatcctcattatttgaggattccatacatgtgaaaattgcaaattttatttgtaacccctaaatcaatacttgaagtgttcccgtggtcattcatagacatgtacagagtagcgaaaaatttgagtcatcttcacacattttttcccaactgaggtcaaataaggtgacgctctgccctcctgtttcagctctcatactttgaaaaacaagggtccttttccacacatcaaaaaaagaaaactgcaggccaatatctctgatgaatattgaggcaaaaatcctcaacaaaatactagtaaactaaattgagcaatacattagaaagatcattcaacatgaccaagtgggatttatccctgggatgcaaggatgcttcagcatatgcagatcagtctgtatggtacatgatatcaacagaatgaaggataaaaaccatataatcatttcaattagtgctgaaaaaaatttgatgaaatttaacatctctttatgttgaaaaaccctcaaaaaactggggatagagggaacatacctcaacgtaattaaagccatatatgacagactcacagctaatatcacactgcatggggaaaaactgaaagccttttgtctaaggcaggtttgttcaatccatggcttaagggctgcattcagtccaatacaaatttgtaaactttcttaaaacattatgatgtggtttttttttgcaattttttttttttttttttttttgagatggagtcttgctctgtcgccccggctggagtgcagtggcgccatctcggctcactgcaagctccgcctcccgggttcatgccattctcctgcctcagcctcccgagtagctcggactacaggcgcccactaccacacccggcttttttgtatttttagtagagacagggttttaccgtgttagccaagatggtctcgatctcctgacctcgtgatccacctgccttgggctcccaaagtgttgggattacaggtgtaagccagcacacccggcttgttttgcaatttttttaaagctcaccagctatcattagtgttagtggtttttttttttttttttttttttgaaacagtctcgctctgtcaccaggctggagtgcagtggtgccatctcaactcactgcaacctccgcctcctgggttcaagtgattctcttgcctcagtctcccgagtagctgggattacaggcacgtgccaccacacccagctaatttttgtatttttagtaggcatggggtttcaccacgttggccaggatggtcatgatctcttgacctcgtgatctgcccgtctcggcctcccaaagtgctgagattacgggtgtgagccactgcacctggcttagtgttagtgtattttatgtgtggttcaagacagttcttccagtgtggtccagggaaaccgaaaattggacacccttgctccaagatctggaatatgacaaggatgcccactgtcaccactgttattcaatgcagtactagaagtcctagctagagcagtcagacaagacaaggatataaagggtatccagattggaaaggaagaagtcaaattatcgttgtttacagatggtgtaattttatatttggaaaaacctaaagactccacaagaaaattattagaactggtaaattcagtgaagctgcaggatacaaaattaacgtaccaaaatcagtagcatttctatttgtcaacagtgaacaatgtgaaaaagaaataaaaaagtatcccatttggaagccacacataaaataaagcacctaggaattacccaaataaatgaaaggtctctataatgaaaactataaaacactgatgcaagaaattgaagaggacaccaaaaaatggaaaaatattacatgttcatggattggaagaatcagtattgttaaaatgtccatactacccaaagcagtctacagattaaatgcaaaccctaccaaaatatcaatgacattcttcacagaaacagaaaaaacaatcccaaaatttttatggaacaacagaagacccagaatagccaaagccgttctaagcaaaagaacaagactggaggaattacattacctgacttcaaattatactatggagatacagtaaccaaaacagcatggtactggcatgaaaacagatccatagaccaatggaacagaatagagaaccgagaacccagaaataaatccacacacgtacagtgagctcatttttgacaaaggagccaagaacatactctggggaaaagacagtctcttcaataaatcgtgctgagaaaactggatatccatatgcagaagaattaaactagacccctatctcttactgtataaaaaatcaaatcataatgggttaaaggcttaaagctaagacctcaaactatgaaactactacaaggaaacattaggaaaatcttcaagacattgttctgggcaaaaatgccttgagcaataacccacaagtacaggcaaccaaagcaaaaatggacaaatggggtcacatcaagttaaaaagcttctgcacagcgaaggatacagtcaacaaaaggaagagacaacgtacagaatgggagaaaatatttgcaaactacccagctggcaagggcttaataaccagagtatataaggagttctactaactctataggaaaaaataatgtaataatccaattaaaaatgggcaaaagattctagtagacattctcaaaagaagatgtacaagtggcaaacaggtatatgaaaaggtgctcaacatcaatcatcagagaaatgcaaatcaaaactacaatgagatatctcacctaattaatatgtcatatccaaaagacaggcaataataaatgctggtgaggatgtggagaaaaggaaaccctcatacactgttggtaggaatggaaattagtataaccactatggagaacagtttggaggttcctcaaaaaactaaaaattgacctatcgtatgatctggcaatcccactgctaggtatataccctccccccctccccccgccagaaagaaatcaatatatcaaagagatacctgcactcctgtttttgttgcagcactgtttacaatagctaagatttgccagcaacctaagtgttcatcagcagatgaatggataaagaaaatgtgatacacagtggagtacttactattcagctgtcaaaaataatgagatccagtcatttgcagcaatatggatggaactggagatcattatgttaagtgaaataagccaggcacagaaagacaagccttgcgtgttctcacttatttgtgggatctaaaaatcaagacaattgaactcatggacgtagagagtaaaagggtggttaccagaggctaggaagggtagtggggtgctgaagggaaagtaggattgttaatgggtacaaaaaaaaatagaatggataagacttactgtttgatagcacaataaagtggttatagtcaataataattgcacattttaaaataacttagagtataattggattgtttgaaactcagaggataaacgctttagggtatggataccctattcttcatgatgtacttacttcacattgcttacctgtatgaaaacatctaatgtacctcataaatatatacacctactgtgtgcccacagaaatctaagaaagggttcttttccagtctgttcagtgccacattttccacatttttatacttcttttggggtgactttgctgtttaaaatgaccctcaagtgtagggccgatgtgccacctggtgatcccaagtgcaagaggctgtgatgtgccaatggagaaaatacatgtattagataagcttcactcagacaagaattgtagtgctgttggccatgggtttaatataagtaaattaacaatagatattaaatgaggtgttttaaacaaaaacacatataaaacaagattatgtattgctcagctgactaaggtagcaggaccagaggcttgcacggacttaatactattttcccaagagcagtggttccatatttggtaactcagtgttcatgatgactttatagagcataactactatgaataaggagaattcactgtagttgggtttaggtctactagtttgctgtttgtcttctggtgtcctttttttttcctgctactctttttctactttagggctaattgaatattttttagtattccatgtaatgactttttttttttatttttttgcagttgcatccttatccttgcctacttagaattaacataccacttctcataaaattaagaattgcaataacacagttccattccctacccagtcattgtgctattgttgtcatatatgtttatatttatttttatttttatgatgcagggtcttactctctcgcccaggctggagtgcagtcacaatcttggcacactgtatcctctgcctcctgggttcaagcgatcctcctatctcagtttcctaagtagctgggactacaggcatgcaccactaggcccggttaatttttgtactttttgtagagttgggatttcaccatgttgcccaggctggtcttgaactcctgggctcaagtgattcaccccccttggcctcctaaagtgctgggattacagagatgacagcctactgtcatgtattttatgtacacctatgttataagccccatgatacagtgttgttattgctttcaacagccagcgtgtgtcttctaaagaaattaagagaataaattgaaaaatagttctttatatttatccacacatttaacacttccagtattttttttttttttttttttagtggatcctagtttttatatgttatttgctggggattaatttccttagtttttgtttatcagaccatgtctttattttgtcttcactgttgaaggatgtttttgctgcatgtggagttctgggctgatagttctctttgagcattatagatgttgttgcattacttcctggcttctttttctgattaaaaaaaaaatcagctggccgtcatattactgttattgtcgtcgttgttgttgtttattcttagttactgtcaatatttttctccttttggttttcagcagtttatctacagtgtgctcagttgtatttctatttgtattaatcctacttagtgttctctgagtcttttggatttataagtcagtattttttgctaaatttgggaagtttttggttattgcatcttcaattattttctctggtccagtttcactttcttcccctccacctgcatttctgattatgtacatgtcataatgattgatattatctcagaagtttgtgagagtttgttcatttttctccagtctttttttctgtttttcagtgtgggtaattcctattggtttgttttccagttcagtgactgtgtcatattcagtctactgttaagatcataaagtgcattttttgttttaattttcagtcttttctgtttttgaatttctatttggttctgttttatacttcttatttatattttttgagacggagtctcactctgttgcccaggctggagtgcagtggcacaatctgctcactgcagcttccgcttcccaggttcaagcgattctcctgcctcagcctcctgagtagttgggattacaggtgcctgccaccacatctggctgatttttgtatttttagtagagacagtgtttcaccatgttggccaggctggtttcgaactcctgacctcaggtgatccacctgccacggcctcccaaagtgctgggattacaggcgtgagacaccacgcctagccactttttatttctttgctgagatttcctacctgtttgctcaataagaccatgtgttgtcaactttctcttacttttggtgggtaatagctgaaataagccttattctgatatggtaattcttgttaacttttgactggtgcttacttaacctttttagtcctcactttaaactttttgtgctattcattgggtatgtcttatgtaaataatatgtaactgaaattaatttatgttttataaaataatcttatttgtcttttaattggcaagtttaattcatttacatagattatggttattgatatatttgtaatgaatatttgccattttactttttgctttctgttgacactttccgtgctcttttcttttttgttccttttaaaaatacaattaaggttttttcacttgatttttttcttatggtatttttcctctgaattggtttggaagtatttttgtggtttattcttgagatattatcatagacttacgttaacaaagctgaatgaaccttatcaatatcttaattgcctgctaagacaaagactttatcatctctcatatatacagaggattggttccagaacccttgcgtatactacagcctgcatatactcatatcatgctgttgacccagcagaacctgtctttaagaaaaatcggggctgggcgcagtggctcacggctgtaattccagcactttgggaggccgaggcaggaggattgcttgaggccaggagcttgagaccagcctggacaacaaagtgagacagtgtctctacaaaaaataaaaaaattacccaggtatggtggtgcaggcctgtagtcccagctaccccgaaagctgaggcagtaggatcacttgagcccaggagttggaggctgcagtgagctatgatggtgccactgcactccagcctgggtgacagagtgagactctgtcttggaagggaggggaaggagagaggaagggagggagggagagagactgtatatatgtgggttttgcatccctcatctatgtttggtttaaaaaaaaaaaacccacatataagtcaacctgcacagtggaaacccgtactattcaaagggtcaactgtactttaatgacctccccttcctcatgcccttaccttaaacactgatttttgagatttttattttctcactgttgtttaaatcctgttgctaattattattatttttagcatggggaatgtttgctgacacatacttgcgtgtttaatacttgaatgtcatttcatctgacatctcagatctctattctgagctcattttctgttttgctacagtatattcttttgaagtttcttttttttaaaaaaaataagcttatctaaggacgaggtttctttagtgatcatctgctggtcataaactctgttactttagctgggaatatcttgatttcatctttgttcttgaaggatagttttgttgtgcatatgatgacagttgacaagtttccttgatacttcgaagataatattctactgtctgctggcttgttactggtgagaattctatagtctgagctaattgtagtagtctgtcttctgtctttactctctgtgttttaaaatcttttctttggctttattttgcgatttaccacaatgcctgtgagtctaggggtggatttctttttgtttatattggtaggtgtatgttgtgcttcttaaatctagatttaagtcttttatctgtttttgaaaattctcagcccttaacctcttcatgtattgcttctcttctattctctgtattgtttcccactaggacttaaattagtcatgtgtgagtccatctcagtctattctttatgtcccttaatctctttagtgtttttcatttccctaactctgagtaatttattccaatttggcatgtagtttggtaatctctccttagctgtgactaatatgctatttaattaactcatttggttttcattttaatacttagatttttaatttgtgaaagcaatgttttattgtttgaaactggctgtttttagtactttgttgtttgctcattttaaaatttctttttttttttttttttttttgagacggagtcttgctccgttgcccaggctggagtgcagaggctccatcttggctcactgcaagctctgcttcctgggttcacgccattctcttgcctcagcctcctgagtagctggaactacaggcacctgccaccacgccctgctaattttttgtattttttagtagagacagggtttcaccgtgttagccaggatggtctcgatctcctgaccttgtgatctgcccgcctcagcctcccaaagtgctgggattacagacttgagccaccacgcctggcctaaaatttctttatttacataattcgctatttaataatctgtttcggctgggcgtggtggctcacgcctgtaatgccagcactttgggaggctgaggtgggcagattactgaggtcaggagttcaagaccagcctggccaacatggtgaaaccccgtctccactaaaaatacaaaaattagccggatgtggtggcacacgcctgtaatcccagctacttgggaggctcaggcagaagaattgcttgagctcaggagatggaggttgcagtgagccgagatcatgccactgcactccagcctgggtgacagatggagagtctgtctcaaaaaaaaaaaaaaaaattctgtttcataattacattatctgaaatgatagtgaaggcagtatctgatgtttgttctttctgcttgctctcactcatatttacttctctatgtatatagtaatttttttattgtgagcttatttttccagatttatttttattccctttttgacagatttcattattaccatatttgaatgcactagacaggtgccctgccatcatagagaactgaaattcttttcctgtgtatagagatgacatagttttatcataaagaactgggaaaggactgttaccttttttgtactcctttctctctttgccttatttcccttgcatgtttaaacatatcttatccttgtatgtatcttatacgaggcttttttgattttaaggaacagaaactcacatcagtgttctttaagaataaagtgtttattttcagatcacaaggaaactggagctgaatggctttcaggatccaacacagttctagggagcagctacacttactgcttattgcatttctgctgttctcttcatgtctgctacactcttcccacgaggacagatgtggggtccgacccgcagaccctggctgaacgacaggagaaaaaatgcactcacatgcaggtatccaatgaaacagtgagctaggggagcgggctaggggaccgggctgctcacagaccccgaggagggtgctgtaaagagtcagcagctgcggccttgacaagctggcactgtgggcatttattcagcacggatttaatgacaatggctttgagtcaacacacttgtgggtaatcaacatggtcgccctccccggagtgagcagtcctgtgtgcggatgatgaaaggccaggttcggaggcctaagtaaactaacttatctagatcagtttttttacatccccttgttatctaacctaagctttcaggcaccagataagagagtctagctgccttcagccaaatcgttttccaaagcttttataaaacctcttggccttccaagaaggtttgcatcgttctgcaattgttcctaccaccctgatggatctcctacagccagaaggcttcctcatctacaacattatcttttctctatttcatatctcgtttttctggttctcagctccctctcacctcatctttgcttgtgaatctttgaggatcttcctttatatattctttcagcctcacctcccttttagtgcctaatttgccagcttacctaattagcctcttcccagccagcagattggctgtccttggagcagctgcctgtctgtgtgttgcggggaggaaggattctgtgttcaaatctcactgccgaggcccgctcccttggaagggtgccgtgatgtatacttagtgtgtatacttacaaggtatttaaaattctttttgaagccacaaaggatataaaaataaaaggcctctaacttagaaaatgaatgacccagttgcagaaatatatttggtgaattaaaaatttttatgccattcatacttgtatgaaaactattgtgagtctaatgcacacttggaattttttttatgggtttctagccaagaaggaattgcaggtttccagttatatttatacaggttttaatctcaaagatttaatgttcatgtttatttaaatatcagtatacataagagcatcttcaattaaatgaaaacaaattcttatgtgtatgaattagtaatataagaaatggccaatgaaatcccgtctctactaaaaaatacaaacattagctgggcgtggtggcgcatgcccgtaatctcagctgaggctgaggcaggagaattgcttgaacctgggaggcagaggttgcagtgagccgagattgtgccactgccctccagcctgggcaacagagtgagactccgtctcaaaaaagaaggaagtagccttagggaccattgtatttcttaaaaattcattatactgtgttctgtaatataaagtcagataaaaaaattatagcacatttgtgatggtagaaacttaactatcatctatgtacataccaccgtatagtttgcaagtgattttcacatatgttatggcattcattcttacccagagccgtaaggtgaaaagcatacaggcaggttagatttacggtatgtttaccaacttctaatttccagatgatgacagggctaaagttattcattcctttcctaaaatacatattcctcctgaataattgaaattgccataaattactacatcttaaactataccttttctttctttaaagatgtatttacttggaatattacttggtttaaaaggcaagaattgtcaaagcacaagtgggactttattataaattcttttttctgattttactacatatttcttccctttaggcctcaatgtgttctgttctatttattcaaaatagaagttttatttgtggtactacataattataaaacagttaatattgaagaggtgaaagatcctttgtacctctgctcccattttctccccgcatgctctccggtctcactgtcagtagctgggtgttatacatacatacacatatgtatgtttgtatgtacacacagcctgctagtgctggaggcagaactgagagccaccaccgtgcgcctggcaccagaagtgcagccactgttgtcagtgcaaagatcgtttggttgataggtcaactgtcatggctgtggccatcaggatgttccttgttacccacgctgctgtcagtcctgtggcaacagctgctgctttccgtgctgctgattccttgaagtgttactgttcttcagagccttttgagaatgcctttaatttgattgttcttcttagaacaaatcacacaataccactatcatcccttgcttttatgtaggatagtgtgaatgacagataccatgttgtcctccaagccactactctcttctcatggtctgtggctttctttggattaacctgaactcttgctgtagaatgaatgtccgttccccaagatccctgccccctggagatttctaggtgcttttggtaaacaggtccttgtctgccttgactctgctattatcctcagtcatgtacaaaatctctatctttcctggagttgtcccagtgcagactcaggctaggagtcatgcttctgaagaataatgtatgaaaatgattttgaaaaaggagtgattgactaagcgttcatctattaccaaagataattagaactatagtaacacatggaaaaatatcagtgatcactggtcactgatactgatcattgacatttcttacataatatactaagttattattaccaaatttatagctaagtcattttttttgcaggcctgcataagcatatttaactaaaagtctgttgaatgagacttgcatagtgcttccccaggtacctgacctaaggcacctgtgagtctgtgtgcttaccaggggcctttccatcattgttatggggctgcctaagcagtggtaagcctttgttaaatgcagacatggaatgagtccttctgcagcccgtgtggcctcctcttagctgtgggcctgcctcttcctgttttggttcctcacttccgtttagagtgaccctgaaaccacattccagccctatcttcatttcctctgcacaggaggtcgtatggtcttctgttcacagtcagacttaagacccttcctattttctttaaggactggttgttttctatttgatgttattgtgctggtgatccacaatgtatattgtcagaaaataatactttgaaagctgtggtagctagaggtctgtgtaggatagaatagacaatgggtaggaagtattaagaataagcaccttttgggccaggcgtggtgtctcacgtctgtaatcccagcacattgggaggctgaggcaggtggatcacctgaggtcaggagttcaagaccagcctggccaacgtggcaaaaccccgtctctactaaaaatagaaaagttagccaggcgtgatggcgcacacctgtaatctcagctactcgggaggctgaagcaaggagaatcgcttgacccagggaggcggaggttgcagtgagccgagattgttccattgcactccagtccaggcaacaagagcgaaactcccgtctcaaaaaaaaaaaaaaaaaaaaaaaaaaagaataggcaccttttgttgttcaatgggtatagtttcagttttgcaagatgaaaaaattctggatatctgtttcacaaccatgtgaatatgcttaacactgttgaatgctgtacacttacagatagttaatttgataaattttatgttttgtgttttttaccacaagaaaaaaacaaccatttttttatggaacatagacttaaaaggttaagtacatacagggttttggattttttgtctttttaatacttgattctatttactcatcctttactacaagttggatcactagattagggttttggaaggtttagcagagcagagaagtatagcaaacagaattcgttcatttaacatttattgagcacttcctgggtagcaggccctatgctttaagttgataattcagagaaataagggacttgacccccagatgcctcttttgtggaaagaaccggagaagccgttttaacataaagcaggaaatcctgaaaaattttatatgccattaacattttattattaaagcatacagacatacagtcatacatcaaagtttcaaaacttttattatggagaatttaaaacatacacagaagtaaaggaagaataccgtgaaccgccttgtgcctggctctagctggcatccactcatagcgtcttttgtttctttatatccctctcccagtccatttttgggggtacattcttgttcttttcattttatctgtaaatattttagtactttcactgaaagataagggctgtttttcttagaatgaatcacacaataccactatcatcccaaagttatttcacagttttgtgtgtgtgtttgtgtgtactgtgatttgtttgcatcaggatgtaaacaaggtctacacattacattcggttgataggttttcttcaatatcttttaagctataggttttccttattttctgtcttattgaaatgttatttactgaaaaaatcatgccgtttatcttgtgcacttgctcatactattatatatgaattttgcgaaatgatttttttgctttgaaacagtagtgaccacttattcttcacatagatccattacttaatcatgggcatgcaagatgttgcaattctaatttcatcattcctttttcatttattcgctggaatactagtacagagaagactctttttacagactgttcagttacccagaggtatagcttatacagggaagtcaggttaaatgagtgactctttctctttacttacaactcttggagggtccctagcatttccaaaaatggccagtgctttttcctttatttaaaaagtatcattataaacacatactcttttctttttctttttctttttttttttttttgagacagggtcttacaatgtcgctcaggctggagtgcagtggtgtaatcatggctcattgcagcctcaacctcctgggctcaagcgatcctcctgcctcagcctcccaagtagctgggaccacaggcatgcaccaccaaacacagctaattaaaaaagaaatcgtttttggagagatgggatctcactgtgttgcccaggctggtcttgaactcttggccctcaagagattttcctacctcggcctcacaaagtactgagattacaggtgtgagccatcacgcccagccagcatgtgaatttaatatgtttgatgatttcttaagttcattgcagttattctttaatgagttaattacattaattaatgatagatctcactatgttgcccaggctggtctcaagtgatcctctctccttaccctcccaggtagctgggactataaggcacaaaccagtttacccagccacagttattcttattaatgatcaaattgtcccttctttttttcttgagacaagagtgttgcttttgttgcccaggctggagtgcaatggcatgatctcagctcactgcaacctctaccttctaggttcaagcgattctcttcccttggcctcctgagtagctgtgattacaggcatgcaccactacgcccggctaatgttttatttcttatttttatttttggagacagagtctcactctgtcgcccaggctggaatgcagtggcgcaatctcagctcacttcagcctctgcctccgggttcaagcaattcttctgcctcagcctcccaagtagctgggacaacaggtgcgcaccactacgcctggctaatttttgtatttttagtagagacggggttttatcacatcggccaggctggtcttgaacgcttgacctcaggcaatccgctagtcttggccttccaaagtactgggattacaggtgtgggcaaccacgcccggccctaattttatatttttactagagatgggattctccattttggtcaggctggtctcgaattcccgacctccggtgatccccctgcctcagtctcccaaagagctaagattacaggcatgagccactgcacctggtccacattgtctcttctttggccaatgggagtgccttcacattagctcctgggtcattttggcatgggtgcttctgatggcttcttgctttcttgtgtgacaagatgtccaggctcatcttgtacattaacagccatagatctggaattatccctttctttaaccagccctggttcctttcagagggaaattgtatttagtgaccacagtctggaaactacagattggttgttacttctaggccttttcagtgaatggggctaggaaatacgttatttttaaggtaaaatattttatgagtttcatactgatttttccattataaacttaggaacagatgattttgttgaatttctttaattttatctttgtctcatgctaaaaattttggttcttgatcataatcatattgataccattacttgtcagtgttactgctaacaatatgattactgaaaatagtttaagaattaaaagcactttcccaaattcttttcatttttaggatagattcctatagggatgtctggtaaaactgttttaaatcatttgaaataattcctttttgcatgattataccaccaattcaacaaatatttagggtcatttcattttgcttttgaattttagagatgacagtttttcaattattttttaaacaattatggaaaacatatacatggttccagagctaaatgtgtaaaacaaggcagaatcagagaaatccatctctgattgtggttccctctattttttttcctgcattccatttaaaacatgagcaagagtgtgtgtgtgtgtgtgtgcatgtccatgcatgtgcacacacgtatagtttctgcctcctaatcccgtcttaggtgaatggtagcacactatgtataattttcttcttgcttttttgtcttcctatttttcctgctgatcactccatagaagtatatagagacatttgtcatgcctttttgtctatttcattgtgtgaatttaccagtttattgtcagtcccatattaatggacatttggattgtctttagtgtcttgctgttagaaatagtgctgcagtgaataccttgtatatacatacttattttttgttgttgttgttgtcttttagagggatatttcagttttaaataaaacaacttgacttcaggaagtattcaagcgtaatgttactgctactgatggattgttctgggaatagtggaggatgcaaaaggccagtcttgtgatctagggtagtaatctttctttgagtattatgggtcctctcagttctgtattattgttcttgtaaaaaccacatttatagagtagcttctgtgttttctagtttcactctgtttaaagtagattgagactttaggaacatctgaagcagtcagagcatagaattctatctttttttttaaatgtaaattttttttgtagagatggggtcttgctgtgttgcccagactggtctcaaactcctggcctcaagtgatccttctgcctcagcttcccaaagtactgggattacaggtatgagccattgcacctagccaggattctggtattttagtgttgttttctagtcttttatagttgttttatatatactcaatttgtcaaaaaattttaaggaaagtaatatgcctgtatggatgctttccaaagtattcaacataggttttatagaaatagtaacttcttacttttgtagccacatgtttgtccatttgtgatcagtttatatagtattcaattaaattataccattgcagaatgagtacaactgacataaacaggtttggagatgaaacaataggtttttgataatgtgcacaattcaactggtagtagcagaaatatgcacattgttagagagtagcttaaatgtgagcattctttattttctgggcattcactaatctattttagggacgaatgatagcaccagttcacttctaaaattttccagttcctagtaggagcctggcacttggaagatgctcggaaaattgggtcagactatgagaatacgtccttgtccatttgtttgcttaggttaaatgaatgaaatattctaggtcttcccaaagggatttaaaataaactaaaaatctctaagacgtgatagctgactttaaaaactattcctgatttacgtttatattactttaaatttggtcttgggttattattttgatgattgactaaaacatttttttgcttttattatagttttttcactaaaagatgttttctaggtggagaaaattgaaaagaatggattccaggatcataaagcaaataatagtttatagtgtttttttttttttttaaattctaccacctgtgtgccagttagtaataaaactactagtttttaatagacattaaccacctttgggatttcaccatgggaaaatgggagcagtattccttttctttctttcaccttctttagtatgtatacatatcacagtcaatggtgcagaaaggttaggaaactggaaggatacaaagtttagtcataaggaagcacaaattcaagttcctggaatatttttacccctgctctgtatggaacaccgtagggaatactaaagaaacatgatggtacagaagactgtaggaattgccaaaaaatatgcaacactccagggatcatatagccttttaagtaggccaggctttgtaccctgcaaggaatgatctaaactatgtgatatattgtatcagtcagagttctgcaaagaaacaaaaccaatagggtgtgtgtgtctgtgtgtgtgtgtgtgtgtgtgtgtacagatatacctatatatatagatagatagctagatgagattgggagagagagatttattttaaggaattggttcatatgattgtggagactaacaagtccaaaatctgtagggtgggctggcaggctggaggctcagggaagagttgattctggagttcaaggctgaaggcagtctgctggcagaattccctcttcttctaggggaggtcagtcatttttatattaaggccttcaactgattggttgaggcccacgcacattatggaaagcaggatattttactcagaatccaccaatttagaagctgggtgtggtgacaggcacctatagtcccagatacttgggaggctgaggcaagaggatcacttgagcctaggagttaagtccagcctaggcaacatagtgaaaccccatctcctaaaaaaaaaaattgcatctctaaaaaaaatgttgaactcaaaccaggggcagttgacagaaactcttggtatcctttctgtgtatcttcccactcccaatctgcactgtgattttatgttcttaatgacagacttctgacttatgataatgttatgtgcacagggagggcctggtgaatatttactttctagttgtcagaagaatgagactaaaacagttttcttgtgcatatctgttttgagaagcaggtctggcattactctcattgtatatctaggagaggaagtttcagctgagtcatgtattgacctagagcaggtggatcacttgacctctctgagtgtttcctcgtctataaaatgggaataaatccggtcttgccttaaaaaaaagtctgccaatttaaatgtcagtcttatcttaaaaataccttcacagaaacattcagaataatgtttgaccaaatatctgcatattgtggcctagtcaagttgacatgtgaaattaaccatcacttatattgaaggactgtttttaatgtgactaatgtccacctgtaaagaaattgggtaactgctatgggttgtaaagaagggaaaggggaacatgttttgcttgtagagaagaaatgctttgaggtgtggtctgaaggccagggaattttgggcctgatgggcaaagaggaaagagcatcccaagaaggtgggacagaatgaacaagggtaaggttgtacatggcatgtacaggggtccttgagaagatttgtcctgcctgggcagacatatctcggatggtcagggggtaaggtgagtagtgaggcaaattctgctctggtttttctggtttactgcagtatgtggagaatatgcttgttctggcctgagatgacagctgactggtgcagagcagtgtgtgccactgtccttacatgctgcattgtacaatgacatgctgagaattctttctgcaggaagcacttcaaatgaagtataattgccttcgatttttctgttacaaactttggccacagtttcttcctctgtcagcctactaaagatgcttcacaagatccatgtgtttgttaaggaacgtgagatcttcaagcggtatggattgctagaaggaattcaagtatctaaaccttgggaatatttttggatctttattaatgttattctgtagtagaaatagagttgagcacctttttccccgtattataaagatcataattagctttgaatttataataggtgtgaaaacaccttataaaaacactctactgataaaaactattattatcagaggaaaaagcagcgaaaacaacatgtggtaaattgttacaaaacggctcctaatgaatcactgccccctgtccccgctcccagctctgcctgtttgcagtatgacttcacttgtttctcccattgtcttagtctgtgttgtgctgctgtaacagagtacctgagatggggtaattaataaagtacagagatttagttcttacagttctgcagcctgggaagtccaaggttgaggggctcacatctggtgagggctttcttgctgcatcatcccatggtggaaggcagatgggcaagagagcatgtgcctgggatggagagaagggaaggaggctgaacttattcttctgttaggaacccactcccatgataactaacctacttcctcaataacagcattaatccattagtgagggcagagccctcatggcttgatcacgtcttacaagtcccacctgtcaacactgttgcattggggattaagtttccaatacatgaacttgggggacacattcaaaccacaggacccatcaagtggtagagtctcttttcccccttcttgactttggtctcaatcagcagacacagtgcaagcagaggcaccatgtgtagtgggtgaactgtcttgggatgctgctgccaacatgtgaagaagcctagaagaaaaggccacatggagaaggccctgccttccctgctgagcccagcgaagcagcctttgtaagtcaggtaagggcagcagaagagctgcccagccaacccatggaattatgagaaataggaaatcatggctgttcaagcaacaaagttttgggtagtttgttacatagcaagagaaaatggaacatcttgtgataagtggctggaatccatgactgcaattctaatcatggcttcattactgagccttcaaggaggcagcaaagtaaacaggtttattctctaatgatgtgctgaatacccagggagaacgctgggctgctggagccttgacctctccttcatccccctttcgttatctatagggatcagacactgttctctgcagggcaagcactgaagagctcttgtaggagctcaagaaggtagactatttcttttctttctttttttttttttttgagatggagtcttgctcttgtcacccaggctggagtgcaatggcatgatcttgggtcactgcaacctccacttcccaggttcaagcagttctcttgcctcagcctcctgagtagctgggattacaggcgcctgccactactctcggctaatttctgcatttttagtagagacagggtttcaccatgttggccaggctggtcacgaactcctgacctcaggcgatccaccgcctcggcctcccgaagattacaggcatgagccaccgtgcctggccaaacgcagactatttctgtgcttgatggattgaaggtgttttccaagtgttgaaaacacctgttctgtttctcagacgtgaaatgctaaaagaaccctaacaaatcttctcttttcccttttcttaactttgagtgttttcagtatttttgcattctattaccaagggaatactgtggctattccataatttccctgagatgcaaaatctttcagaaagcccagacattagtccaggccctttttccagttaattgcacctggtttacctaattcacgtacctgccccggtggttgtactgaggtcttcccgagtcatggaaggtgtcctgatagcatgcactgtctggagccgagtcctgcctgccccacattagcatctcactctcatgcagctgtggtgtctctctgttactctacttctggggattctaaattgcatacactgcctttcagtctacagcctgactgctctctcttagccaagcacttgcatttggacaggacttcagcattaggctttgttgttttccttaggggcccagtttttatggaattttttcctactgggtagcattgttggcacaccttgaatccatccattctgccgctcttggcttcaacctctgaggttatgtgttggaaaattaccttgcatcttctactagaataaagatgaaagaacataaggatgtgggctatagtttttaaatgcagtgtttcttttctgtggcttgtgatacaaatttgcaagtgaactcaaaatgctacagttaaatatctgccatgaattcgacctaactatttgaggggtatcttagtgccttaaagtaacccacttttgaaatatctaatttattatctttgccaaattttaggcagatataaccattgctttggttaagttgtccctctatagacaaaaaagacaacaaaaggcctgtcactatttaatacttcaaatgtgaattccatgttgtcttctatatccatagggattataatagctcttctttactacaacaaagacaggaacatattatgttttatcttagtccttcccgtagcagtgccactgtgaaattaaaaaaacaaaaaacaaaaaaaccgctacatattttaggttcacctgatcggttgctgcacactatcacatttagtcaagcataagttgtgcatttttatccattctaacatctctgaaattggcaccttggaatccccgcttagtcagggataattatggtctagttgcataaaaactttttgttgacaccttctgtaaggtcaagcaaatgctggcagctgagagtccttgaaatatggctgtgaaagcttgggcaagttgattaatttctctaagccatgcatgaaagggagataaaagtttctctccctcctggcactgctgtgagatttaaatgaaatatgcatgtaaaatacttaagatttacaaatgctttcatctagttttttcctccattattattgacaggcagtatttttatactttttagtttcttcatatactttatctgtttaaattatttatgctttggattttattttccacttattttcagcattgcttatttactattgttttatttaacatttattgtaccctttattacctctagtaatgatctgaatttttttggtggggagacaaggtctttctatgttgcccaggccagtctagaactcctggcctaaagtggtcctcccacctcagcctcccaagtagctgggactacagatacaagccactgcaactggcaatgctctaaattactctaggagatttaaaaactaacaaacttcagtcttttgtttctggataaactttagtctgtgggatatgtttgtatgtcttatgatttcttcactattggtaattgcatatatattttctggtagttaactttttttttttttttgagacaggttctcctcctgtcacccaggctggagtgtagtggtacaatcttggctcactgcaacctctgtcccctgggctcaagtgatcctcccatctgtcgaccaagtagctgataccacaggcatgcaccaccacgcccagcaattttttttatatttttaggagagatggggtctcaccatgtggcccaggctggtctcaaactccggagcttaagtgatccactcgccttggcttcctaaagtgccaggattacaggtgtgagccaccactcctggcctgctttattcttgttgcattaaaaaatttcagctcatgaccgggcgctgtggctcacgcctgtaatctcagcactttggaaggccaaggcgggcggattgcctgaggtcaggagtttgagatcactctggccaacatggtgaaaccctgtctctactaaaaatacaaaaaaattagacaggagtggtggcgtgcacctgtaatcccagctactcgggaggctgaggcagcgcaatcgcttgaaccaggaaggtggaggtttcagtgagccgagattgcaccactgcactccagcctgggcaacagagcgagaccctgtctcaaaataaataaataaataaataaataaataaataaataaaaattcagctcatttttatattttaaaatgaactcgctgtttttaaagctaatagttttaacaggccaagcccaaataacaaaatttgcatcagactgttttttagtgggtaacatatggagaccttgtggtgtttctctgtcatcttccctgaaatttctcagagctttcaagtttaattttggtcttcgtttcagtaaaaggcaggagcagggcaatctttatagctttatagcttaaggttagccttgctaaccagtggttaagtgagagtgagacagagggcgagatgtgatgtggcagggggagccttctttcctggctgagtgaagggaagaaggctttgaggtgatactagtgcagtagcatatttgggctctcgttcagctgttggatagcaagcttccataacttgctatctatccagcattgcgtttttgactcaaaggttgaaatttcttatctgtaacttaggaaactcaagttttcctctgtcttaaaatgctttgatcagtaattcttaactacttatacttgtcatcttctaaaattattcttaaagatacttagattacattccactatatttgaaatccatttcaattttcaactaagtctgatgtggtcaatctgctgcagatatttaaagatcagtgggtttcttcccatctgaaatgaattgtaccaggttgacaaacatgaatttttgttagtttttccaaatctccactagggtacttgatcaggatttgagacagagaacagtgttgcttaatagtttgagttacaaatgaaattctcagccatttttgcctgctgtctcagggagattgatccaaccagcatttatttaatagatcttatgtgataggcattgggccacagaaagagagatacaaaggtgagcaaaatgagatatgctgcctttggggagcttacggctgagtaggggagaaagtcattaattaaagaactcaataaatgtaacattctgtgaacattgttaatgaagtagaggttcttcattgatcctataaagaactatgaatgtggaatttcctctgtcaggatggtcagatggttgaggaagagttagttagcccaaaaggggaaggaagagtgttgcaggcagagaataccatatatataggctgtgatggtaaggtgctgggaggtctgaggggactgaaggaacactgctgttgctggactatagagagaggggtagtacaaaatgaggtgggatagataacatagggccttgtaagctgtattaaatgagcatcttgaggtgtaatttaggcaccataaaattcacctattataagtgtacaattcagtgattaataaatttgaagtagtgcagtgtcattgtaatccagttagagacatttcctttgcccccaaagttccctcttgcccatttgcagatagtacccacaactacacccaacatgaggcaatcactgatctgccttctcaagacactttataaaaacggaattgtataatatatagacttttgtgtctgacttgtttcaatttgcataatctttgaggttcatccatgttgtagtgtatatgattggttttttccttttaattgctgaatagaatttcattgtatagataagccacatttttatctattctttagttggtggacatttggaatatttccagttttgggctattatgaggaatgctgctatgcacattcatgtatgtgtctttgtgtggacgtatgttttcatatctcttggatgaattccaaggactgcagttcctgggtcataggataagtttatgtttaactttttaggaaactgccagactattttccaagtatctataccaatttatattctcaccagcaatacatgagagatctaattttttctatatcaaacaattagtattgactgtctttttgattggagccattctagtgtttttggttgtagccattctagtgggggtatagtggtatatcattgtggttttaatttttagcatcttttcatgagtttattagctattcatatgtcttcattattttattttattttttagagacggggtctcatgctgttgcccagaatggagtacagtgttgtgatcatagctcactgtagcctcgaacacatgggctcaaacgaccctcttgcctcagcttcccgaatagctaggactacaggcacatatgagagcctggctctcatatattttctttgatgaaatgtctgttaatgtattttgcttattttaaaattatgttgtttgtcttaacgtaggagttctttattctagatacaagtctttttttttttttttttttttttgagacggagtctcactctgtcacccaggctggagtgcagtggcacgatcttggctcactgcaagctccgcctcccgggttcacgccattctccggcctcagcctcctgagtagctgagactacaggcgcccgccaccgtgcccggctaattttttgtatttttagtaaagacagggtttcaccatgttgaccaggatggtctcgatctcctgaccttgtgatccgcctgcctcggcctcccaaagtgctaggattacaggcatgagccaccgtgcccggccagatacaagtcttttatcagatatatgattgtcaagtatttttcccccagtcggtggcttatcttgagttttattaatggtatcttttaaagtgcaaaagttttaaattcaataaagtctgatttatcaatattttctttttaaataacatctgcaaaggtgggcattcaagccaaagttatggattaaatcacccaggaaaagggagcacagaatgagaatcagagagggttaaatggaactttgaggaatatctgtgtacaatgtcatgctataggggatagatctgcagaggtggagatggagcaggaggaacactaggacggtgttatgtcatttaagtcaaagaaaagagtattttaagactaggaagagagtaaaagtatcaagtcaaataacatgagggctgcaaaacaatttttaggcttaatatagagagcattgtagaccttactgtactgaagccagattgtagttagttgaaatgtgtatagaaagtgaagaaatgttgaatgtgagtgtagaccaccttttcctagaagagtaggatagatgggacagtagtgggatatgaatgaggagtcaagtgaagttttcttgccttctttttcaaatttctaattagacaatgtaacctctttatttattatcttaaataatgatccaggaataatgccacttttggaaagtgtgtggcattagatgttgatctgtttaaggtcacatgagtctcatacctgttattctttttatactttctctccattgaattcttcagaataccttcaaaatctaaaaaataaaagtaatacgtgtactaaaatacatgtaataaaagtaatacatttcattttgaaaaatgaattgtaagcccatactctcttattcaaaactcttggatcagaaatattttagaatttagaaattctcaggtttttaggaaagtagtctgctacagtactctgctacatatactataaattatcagatactcccatcgaggcttggagtaagatcccttactcaaatgcgctatttctgcattgaagtatatataatatttacactaagtagcataagtatagttttgaatagcttcctgttagttcaggtcaggttttggccccagggtgttcaatcaagtcttttttttttttttttttttttttttgagacgaagtcctgctctgtcaccaggctggagtgcggtaggacggtctcggctcactacaagcttcgcctcccaggttcacaccattctcctgcctcagcctaccaagtagctggggactacaggtgcccgccaccatgccccggctaattttttgtatttttagtagagatggggtttcaccgtgttagccaggatggtctcaatttcctgacctcgtgatctgcctgcctcagcctcccagagtgctgggattaccggcatgagccactgcgcccggcctaggagttcaatcaagttttagtgttaaataagtaaagaaagggtagagtggtttttaaaaaattttaattttggtagttttctgaattttagaactatggttaggagcttggtgtacccaatgtcctagaatgaaaaacagtagtcctttgctctggcacagtccaaagccttgttgttggaatggacagaatcttccccataggcagccgcatgtatcttctgagagttgcttccatgttttcaaataatatgttcataaacattagctattatctgttgacttccttttcttacccaacgttccctcttcccatcctcccaatttggttatatctgtgttgcttatatgattgtaatgtttataccattgtccgtgttgaaatttgtttcattttaaagccaaattattacattttctttcttctatagtttttgttgttgttagtaattgctttatattttcacttgcatttttttaaaattttattattattatactttaagttttagggtacatgtgcacaacgtgcaggtttgttacatatgtatacatgtgccatgttggtgtgctgcacccattaactcttcatttacattaggtatatctcctaatgctatccctcccctagccccccaccccgcaacaggccccggtgtgtgatgttccgcttcctgtgtccatgtgttctcattgttcaattcccacctatgagtgagaacatgtggtgtttggttttttgtccttgcaatagtttgctgagaatgatggtttccagcttcatccatgtccctacaaaggacatgaattcatccttttttatggctgcatagtattccatggtgtatatgtgccacattttcttaatccagtctatcattgttggacatttgggttggttccaagtctttgctattgtgaatagtgccgcaataaacatacgtgtgcatgtgtcttttataacagcatgatttataatcctttgagtatataccaagtaatgggatcactgggtcaaatggtatttctagttctagatccctggggaatcgccacactgacttccacaatggttgaactagtttactgtcccaccaacagtgtaaaagtgttcctatttctccacatcctctccagcacctgttgtttcctgactttttaatgatcgccattgtaactggtgtgagatggtatctcattgtggttttgatttgcatttctttgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagctgagtagattgcaaaaattttctcccattctgtaggttgcctgttcactttgatggtagtttcttttgctgtgcagaagctctttagtttaattagatcccatttgtcaattttggcttttgttgccattccttttggtgttttagacatgaagtccttgcccatgcctatgtcctgaatggtattgcctaggttttcttctagggtttttatggttttaggtctaacatgtaagtctttaatccatcttgaattaatttttgtataaggcattatttctgagggctctgttctgttccattggtctatatctctgttttggtaccagtaccatgctgttttggttactgtggctaagccttatggtatactttgaagtcaggtagtgtgatgcctccagctttgttcttttggcttaggattgacttggcaatgcaggctcttttttggttccatatgaactttaaagtagctttttccaattctgtgaagaaagtcattggtagcttgatggggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcacatcccttgtaagttggattcctaggtattttattctccttgaaacaattgtgaatgggagttcactcatgatttggctctctgtctgttattggagtgtaagaatgcttgtgatttttgcacattgattttgtatcctgagactttgctgaagttgcttatcagcttaaggagattttgggctgagacgatggggttttctagatatacaatcatatcatctgcaaacaggaacaatttgacttcctcttttcctaattgactttatccatttcttctagattttctagtttatttgcatagaggtgtttatagtattctttgatggtagttggtatttctgtgggatcagtggtgatatcccctttgtcattctttattgcttctatttgattcttctgtcttttcttctttattagtcttgctagcggtctatcaattttgttgatcttttcaaaaaaccagctcctgggttcattgattattttgaagggtcttttgtgtctctatttccttcacttctgctttgctcttagttatttcttgccttctgctagcttttgaatgtgtttgctcttgcttctctaattcgtttaattgtgatgttaaggtgtcaattttagatctttcctgctttctcttgtgggcatttagtgctataaatttccctctacacactgctttgagtgtgtcccagagattctggtatgttgtgtgtttgttctcattggtttcaaagaacatctttatttctgccttcatttctttatgtacccagtagtcattcaggggcaggttgttcagtttccatgtagttgagtggttttgagtgagtttcttaatcctgagttctagtttgattgcactgtggtctgagagacagtttgttataatttctgttctttcacatttgctgaggagagctttacttccaactatgtggtcaattttggaataggtgaggtgtggtgctgaaaagaatgtatattctgttgatttgggttggagagttctgtagatgtctattaggtccgcttggtgcagagctgagttcaattcctggatatccttgttaactttctgtctcgttgatctgtctaatgttgacagtggggtgttaaaactttcccattattactgtgtgggtgtctaagtctctttgtaggtcactaaggacttgttttatgaatctgggtgctcctgtattgggtgcatatatatttaggatagttagctcttcttgttgaattgatccctttaccattatgtaatggccttctttgtctcctttgatctttgttggtttaaaatctgttttatcagagactaggattgcaacctctgcctttttttgttttccgtttgcttggtagatcttcctccatccctttattttgagcctatgtgtgtctctacacgtgagatgggtttcctgaatacagcacagtaatgggtcttgactctttatccaatttgccagtctgtgtcttttaattggagcatttagtccatttacttttaaggttaatattgttatgtgtgaatttgatcctgtcattatgatgttagctggttattttgcacgttagttgatgtagtttcttcctagccttgatggtctttacaatttggcatgtttttgagtggctggtgccagttgttcctttccatgtttagtgcttccttcaggagctcttttagggcaggcctggtggtgacaaaatctctcagcatttgcttgtctgtaaaggattttatttctccttcacttacaaagcttagtttggctggatatgaaattctgggttgaaaattcttttctttaagaatgttgaatattggcccccactcttttctggcttgtagagtttctgccgagagatcagctgttagtctgatgggcttccctttgtgggtaacccaacctttgtactctttctatcgccttcttaaaactggaagggtgagtgagatagggcaacagtagccatctccatgtcatctagattagttagattagggataacacaaaggaaaaattaaaattttctctatctatcttagtccttttactatttctatggctttaatatactcgaaagttctgcaaccagcaccatagtcaattttagaatattttcattatcctaaaaataaatcattgaatccactgcttcctcccgtttacccattcctaccccagctcttggcatgcactgctctactttctgtctctatagatttatctcctctgggcattccatacaactgtcatcatgtaatatatggttctttgtgactggcttcttagtataatttttttcttttctttttttttttttttgagacaaggtctcactgtatcacctaggctggagtgcagtggcgccataccggctcactgtagcctcaaccttctgggctcaagcgatcctcccaactcagcctcctgagtagctgggaccacaggcatgagccaccacacccggctaagttttgagttttttgtagggatgtggttttgccatgttgcccaggctggtctggaactcctgggctcaagcgattcacccaccttggccccccaaagtgctggtgttataggcgcgaaccaccacacctggcctacttagcataactttttaaaggttcgtccatattgtggcatgtgtcagtactttatttctttttattgctgaatatgattccgttgaatggatatagcttatttgatttatccgtttatcatttgatggacgtttaggttatttccaccttttggctatcatgagtaatgtgatagaaacattcatggacaagttttcatatgaggagatgtttgcatttctctttggtgtatataccctaggattgaagttgttgggtcatatgataacatgtttaaccttttgagaaagagccagactatttttcaaaacgactgcatagatcctcactagcagtatatgagggtttcagtgtcacaacatccttgctaacacttgtttgtcttttattatgaacataattaaagtaatatctaatagttttgatttgtatttccatgatggctaatgatgttgattaacccatttttcattgggttatttgtctttattattattattattattattattattattattattattattattttggtagagatggggcctcgctatgtttcacacactggttttgaactcctggcctgaagcagtcctcccacctcagcctccgaaaatgctgagatgataggcgtgagctacttgcacctggccttgcccttatgttactgagttgtaagagagttgtttatatattctagatacaagtcccttattacatatatgatttgcaaactttttcttctgtcagttgtctttagacttttttttttttaacatttataaatagaggtagagtattgctatattgcccaggcctttcttgagttctggcctcaagagattctcttgccttggcctcccaaagttctgggattataggtgtgaaccattatgactggctgtgttttccctttctcagtggtgtcttttgaagcacaaaagtttttattctgatgatgtgtagtttgtctgtttttccttttgtgtgaggaagagatccaaatttcttttgcatgtggctatctagttgtcccagcaccatttgttgaaaacagtactctttccccaagaagtgatcttggcacccttcttgaaaatcagctgactatagatacgtgggtttatttctgggccctaaattctattccattgatatatctattcatattccagtatgacacagtcttgattactgttcctttgttgtaagttttgcaatctggaaatgtgagctctccaactttgttctttttcaaggttgttttggcagatctgagtcccttgaattttatataaattttcagatcagcttgtcaaatttctgtaaagaagtcagctcagtttttgatagagattgctttgactctctatgtcaacttgggaagaattgccattttaacaatattaaatcttctgatccatgaacatggacatccatttccaatttcttcaacaaccagctttggcagtatctcttctagatgtgaatgttcatgttaggtgggctgtattttgcaagttagcattagtcaaattgaagccctcatgcctggattgtgaggcatagtgctgaggtttaactgttattctgtgtaaagattaatttagttgatataaaagatgtttggaaattatgcaaagaaaataatgtaatatatgatttgtatttttcatgtaaatcttcacataaaaaatggcatggcctgttttatcgtttgtttgtaaactcatttttatcctaaatatgtgtggcataggagggagattgtttcaggcaaacttataggtctgttgctttgttgtggtggtacatatcaaaagactaacttcaatgacagtgaggagggatgtccttcaaaactgtaaaaaatttgagaccctcttgcatctgtgtttctgtgccataaatagcccttctcaggcttgtcatgggcatgtaccaatgatgtaataatgatgattatatcagaagcaccacaggtagcttttggcatggtaggtatagggctgtggatatcgtcagtttgaccaagtattccaagaggccccatggagtttgtcatctgtaatagaggacgttagtgcattagtgatgaaaaaactgcttaccactgactattgtgatctcccagggagtataaggcagctccgcagtaagtgcctcttgttttgtgtgacgtgcttgaatacaaacattcagactgtttcttgggcacagtagtgctccatcttatgccagcctcatcaaaggcttgaaatagagtaggtggtgtgtgatacctagacactaacatcccctattctattttcctttttttgttgttattatcaatggtcactcacttactgtaaaactagactttataaacagattattattttagctaattttcttctatgtgttgatccctcccagtttttgttcctttttgttgttcattgattctagagttgtgtgaaggaagccatttcgtgattcctggtgctcctctgcttgcttagtgacactactaagaattggcaccagccttacaaacacctgcctttgatccagagtagagtttggggagaggtagagtaagtgactgcttatcaaatgtgaccttggggttgtcaggccctgttgtttaccctaccttttcctactgcctcacctgtccccaccccctaccccagcacatggttaataaatgaaaatctccaaattcgagattcattcttttggttgaaggcttccattttctgttaaaatttgaacaacatgaaacattttactacattaaaccttctggataatttacgtttaattggttttgtatacagagtgggatagatctcagtgggtaagtggggagaaagaacaacacacaattcaattattagacattttgggggatgcgtaagagaaaaccagaaacagggcaggagtacctggaatcactgaagacagtttatgcatacactgttattttacctaaaggcagcctttctcatggttcttaggcatgtcatggtgacccttcatattccctaggaaaccctttacggcagtgtttggcaaactatagtctggtgggccaaatctagcctgctgcctatttttgtaaataaagttttattggaacataactatgctcattcatgtacatactcttttttttttggtgggggggaggttggggggttggagtctcgctgtgttacccaggctggagtgcagtggtgcgatcttggctcactgcgagctccgcctcctgggtttgtgccattctcctgcctcagcctcctgagtagctgcgactacaggcgcccgccaccatgcctggctaattttttgtatttttagtagagacagggtttcaccgtgttagccagggtggtctcgatctcctgacctcgtgatttgcccgccttggcctcccaaagtgctgggattacaggcatgagccaccgcacccggcccatttacatgctctctatgggtgctttcatgctacagtggcagagttaattagctggaacacacttggaccacagtgcctaaaatatgtatcttgccctttataggaatagtttgccaacagctcgtgtagagtctctacttttggaaggttaagtatggatcatagataccttgagtttaatttggacttcctaacctctgatctcaccattatgtggactcacagacagtggttttaaggaaagatcactgcttatttcaggacaaatgcttggtcatgataaaaaaaaaagtttaacttcaaaaatattcttaaaataaatggtggcactgctttgttttaatcctaagtagccaatggaagattatatctctgattatacatgtacgtgatccacctgcctctttcaggtgctcccatcttattatgagaaatgttagaattttccccttagacattcatcttctattgtttttgaagaccaaacatttatgttgccgtaacttatttaaatatacatatgaatataagtataaaatgttaagctcactcttggaaatttaaagtgttttagctgagttatgtttattctctcttcattttctctcagcttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacaggtactgggagagtatcttttttagtttcattatttttattaaatttttattaaagatgacctagaacagtgcttaaactctaaaggtcaggttttctctgataatatactgacaagcacacaaatagttgtactcagaaggaattgtctttttgtagatttctaggttttcagattttggtgtaaactactgtttataaatggttataaatgacttatcttcattggttaaatctacctgattatttttggttaatcactgtgactaagttctttggattctcagaacatgatgctgctagtttcctattcatcgtagtgtgaaatttggacaccagatggctggaatttcttaatatgtgtcttagtctgccctagctgctgtaacaaaatgccatagcctgggtggtttaaataacaagcatttatttctcacagttctggaggctggaaatctgagatcagggtgccagcatggttggattctggtgaggtcttacttcctgacttataaacagctgccttcttgctgtgtcctcacatggcatagagggaggaaggaagcaagctgtcatgtggctgttcatatagaaggactgatcccatggagagggttccacccctaggacctaattgtctccccaaggccccacctccaaataccattacattatggattagagttctggcataaaagttttgtgggaaacataaacatttagtccataatagtgtgtacatggggaagctatacaaacttgtttggaatagaaaaaggaaaatgtccaacagttaggccaggaagggagattctttttgatatacaccctcactgcaggtttactgtaggtggttatttaataaagccttattgaatttatctatttgatgggatttttaaggtctaaataaatagcattaatcaattatttgtagaatggggatttttattggtattgggaagaaagagaaaccattctgtcttaccttagtgtggggatggtttgaacacccagtggcagcctgacagttcagggtgtcgtggagcccagatgaggtggcagtagtggaagagcagttgaaccaggaacttgcagggccccgtgagagcttcagcagcaatggcacaggatgaaaatagtggttgtgtttctagggtctcaattgtggtatcaggtttgatttgaaaggtaaatttttgtccagtggagcccatttttatttatgcagtttttcctggcacaggttcaacccaaaatcttttgctatgatttctgatcctcctgtgcttgggagatattattcctactgagtcccataagaagagtgaacccttgcattttacctagactcaaataatccacctgtttgcttagtctaatctgttaacacaccctcgctgaagcccataacttctacagagggttaatgacttttatacagtactcaatacagttgatgaatgaatgaatgagtgaatatgaattcagtttcagtgatatgggtcatgtcactgtggagatgatcttttatttcaaatacagtatgagaaccttacaatagtatactttcatttctttccttctggccttttcattattgtcttttaataaattttaaaccctagaatatatttaaaaaaatactttctctttaaatacttttcttttaaataataataaagatctgtttactcagataattaccatttctggtgtatttccatctatcatttttcttttgtctaaaggactttagcatttcttataatgtgagttggctgacaatgacttctttcagctttatttaaaaaatattttttatttgtttcttgtattctgaagttgtgcttgtggatcagtgggtttacaattttcatagaatttggagctttttggctattcttcagatactttttctgtccccccattctttctttggggactccagtatacacattgactggcttaaagttgtccactgctgcacttttaattttttaaggttattttttctttctgcattttattttggatattccaattactttgtttataatttcattaatattttctttttcaatatctaatctgccagtaattccgtctagtgtgtttttcatctcagacatgttttatcactagacatttgttttggatcttttttatatcttccatgtctctatgcaacttttttagtatatgaaataacagctataatgacagttttagtcctcttttctgtcattgttggcatgtgtgactattctgagtttgcttttctccctcacttcggtcagttttattttcatttttgttattattttttacttatttttgagtacagatcttgctctgttgcccaggctagcatacagtggcgtgatcacagcataccgcagccacgaactcctgggctcaaatgatcctcctgcctcaacctcccaagtagctggcactatagaccatgcctggataagtttttctttcattttgtagagtcggggtcttgctattgcccaggctggtctcaaactcctgggcttaagcaatcctcccatcttggcctcccaaattgctgggactgcaagtgtgagccactgcacctggcccagtttcatttttaagtaaaagtttatttcagactagttttagatttacagaaaaattgttaagctaggatggagtattttcatatacctgacacccagtttctcatattgttattatttatagatttagtacaagtgcagtgttgttacaccacctgaatagtgcacataagcacccatgaggtaatttctcatccctcacccactcccatcctcccacctttctgagtctccaatgttattattccactctctatgcccctgtgtacatatttttcagctcccacctgtaagtgagaatatgtgatatttgacttgctctttctgagttatttcacttaagatagttacctccagttctatccatgttgctacaaaaaaacatgaattcattctttttttatagctgagtagtattccatgatgtggattactttatccaatcatccgttgatgggcacttagattgattttatgtctttgctattgtgagtagtcctgcaataaatatttgagtacaggtatctttttgatataatgatttctttccctttgcgtagatccccagtagtgggatcactggatcaaatggtatttctattagttctttgagaagtctccatattgttttccatagcagctgtactagtttacactcccaacaacagtctgtgagcattcccttttatctgcatccttgccaacatctgttattgatttttttgacacctgagtaatagccattctgactggtgtgaaatggtatttcatcgcttttatttgcatttctaactttttaaatgtttcttggccatttgtatgtcatcttttgcaaaatatgtgttcatgccctttgcccattttttaaaaaggttatttttttcttgttgagttctttgtagagtctacaaattagctttttgtaagatgcatagtctgcagatattttctcctgttctgtagattgtctgttttctctgttgattatttatttgctgtgtagaagctttttattttaattaagtcccatttgtctattttcatttttgtagctttccttttgaggtcctaggcatgaattctttgccttaggccaatgtccagaagagtttttcctaggttttcttctagaatctttatagtttcagatctttcaggtctttatactttcaggtctttaatccatcttaagttgatttttgtatatggtgagagatatgggtccagtgtcattctactgtatatggttacccaattctcccaagtatcatgtatagaatagggtgttcttccactagtgtatgtttttgttgactttgaagaagatcatttgcctgtaggcatgtgtctttaatttgggttctgtaagctgtttcattgacctgtgtgtctctttttataatagttttggttgttatagccttatagtacaatttgaagtcaagtaatttgatgcctcaagtattgttctttttgcttaccattgctttggccattcaggctcttttctggttccttgggtattttaggattgttttttctaatattgtgaaaaacaatgttagtatttttataggaattgcatctgcagatttctttgagtagtatggtcattttaatgatactgattcttctaacccatgatcatgtttgtgtcatatgtgatttctttcgtcagcgttttgtagtttttcttgtagagatctttcacatccttggttgagtgtatttctgagtattttattatttttttgtagctattgtaaatgggattgacttcttggtttggttcttgatttggttctcagcttgattatatcattgttgtatagaaatgctactgattcctcctcacaacaaaaaatacaaaaattagctgggtgtggtggcacgtgcctgtaagtcccagcgacttgggatgctgaggtgggaggatcacttgagcccaggaggtcgaggctgcgctaagctatgactgcgccactgtgctccagcctgggtaacagagtgagaccgtttcaaaaacaaacaaagaaacaaaccccaactaaacaaaagaaatactactgattttgtaggtcgattttgtatcctgaaactctactgaattaatttatcaaatttacgagtgttttggaggagtcttagggttttccaggtataaaattatatcagcaaacagagatagtttaacttcctcttttacaatttagatgtcttttctttctttctattgcattactgctctggcccgataggacttttagtactgtgttgagtaggagtggtaagagtggggatccttgtcttcttccatttcttaaggggaatgctttcaacctttccccattcagtatgatgttggctgtgggattcttgtatatgggttttattattttgaggtatgttcctactacaccaagttgttgagtggtttttatcatgaaagaatgctgaattttatcaaatgctttttctgtatctatcgagataatatggtttttgtttttaatcctgtttatgtggcagatcacatttattgatttttgtatgttaaaccctacttgtatccctggaatataacccacttgattgtggtgtaccatgttttttgatgtgctgttggatttggtttgctagtattttcttgagcgtttttgcatctgtgttcattaggggtactgattgattctgtttctgtttttgtgtgtccttgcttggatttggtgttagggtgatactggcttcagttagagaggattttcttcaatttgggggaacagtgttgtcaataggattggtacctattcttctatgtctggtagaatttggctgtgaattcatctgcttctggggttttttgttgttgggagatttttttttatttttattactggttaagtcttactggttattggtctcttcaggctttctctttcttagttcattcttgagaggttgtgtgtctttaggaatttacctgtttcatctaggttttctagttcgttagtgtagagatgttcatggtagactctgatgatcttttgtatttctgtggtatcatttgtagtgtctttttcatttctgattgtgcttatttgaattttctttcttcttggttaatgtagctagtaggctgtcaattttgtttatcttttcagtgaagcaactttttgtttctttatcttttgggtttttatgatctggatttcatttagttctgctcttcatcatttcttttcttctgggtttggtttgttcttgtttttctagttccttgaggtactatgtcaggttaacttgtggtctttctatttttttcgatttaggcatttaacgctataaacttttctttcttgaatccatttacagtcaacactataagcttttgctgtattccagaggttttggtatgttgtgtctctacttttgtttaaaaaatttttaaacttccatcttaatttcatcactgacccaaaaatcattcaagagcaggttaatttccatgtatttgtatagatttgagagtccttcttggaattgactttaggttttttccactgtagtctgagaagacaacttgaaatgatttcagttttttaaaaatttattgagacttgcttcattccttaagataaggtctgtcttggaaaatgttccacatgctaataagaagaatgtatattctgtgattgttgggtagcttgttatataaacatctgttaggtctatttgttctacagtccaatttaaatccagtggggttttttttttctttttttttctgtctcagtggtctgtctagtgctgtcagtggggtgttgaagtcccctcttgtgctataaaggaatgcccaaggctgggtaatttataaataagagattttatttggctcactattctgcagactgtacaagaagcacagtggttgtgtaaaagtgcctggcctcctctcttcagcctggcttgttggctggtagcagcagctgctcagggctcggaagcctgtgtactcccatgtgagtttgagcaatgcctctgtcaatctccaggcaactcactctattaggctggagacctgcgagggtcaagggggtctcccacagctagcgttgcaaaagtccatggtgggaatgtggagccctgggagtctctcatctaccctttcccagcatctagaagcttctttcatctctcagcaatcctggctgagcacgtgccttgcttccttctcctttgtgatcagtgattcctgttgcttttcagttgaattccagtgttctgttttagatgacctatttgaagggtgaatatctactcgccgttttggagctttccatggaagaggcatgtactagctgcatctagttagccatcttgaaccaagcttccagtttctcatattattaacatcttaaaatagtgtgctgcattcatcatagttagtgaactaatatgaatacattatagttttaaagtccatgctttattcagatttccctactttttaactaatgtcctttttgtgttccaggatctcatctctaggatgtagcatattacattttgttgttgtatctccttaggctcctcttggctatgacagtttctcagacttcccttgttttagattaccttgacagttttgaagaatactgatcaggtattttgtggaatgtccttctatgggaattgtctgatatttttctcatgactagactagggttataggttttgggatggaagtccacagatacaatgtaccagttcatcacaacagatcgagtatactatcaacatgatttatgactgattttcttgaccacctggctgatatagtgactatcaggtctctccactataaagttactctttttctccccttttgtacttcattctttggaaggaagtcactaggcatagcccactttaaagaatggggagttgtgctccccctccttgaaggtggagtctttacatgaattatctggaattcttctacatgtctggaacccaaattgcaagattgtccaaaaaatacatttttcaattttctgccctgtcctccttgataaagggatcctgaaagaaatgatctgtatcccaggattcctgaaaggtgataagtaagaaggtaattcaatgatcaacttatatttaaagtaagctacacagaaaataaaagtggtattttatatatttataaacagtcctagttttggccctgttgtcctgctactgaggtcaaaaggaggattttaccatgcagcatcaggatgatggtcagtaaacacaatttcgtatttgctctaaaaacacatgagtattgatagatcatactgtattcatttgtacctaacatcttttgaaaaaatgacctcacaatgttcaagtgataacaatatctttagacagaatcaccacacttttactacttaaaaattattctcttttctctattagataaattcttcccttttaaataataaaaacctaatataaggaacttggagaaaacctcttgaattttaacattgcagtatctccagagccatgtgggcaaactcccagtttaatgcttgaacctactctgtattatcatggccagtttgtttttagggcaccattagggcatcagccctgatgctaacccactacttcgaaaggcggttgttttgtgcttttttttttgggctaccagagatttgagatacagtataagaccaaactgtctgtagctttctcttactgacacttttactttttgcttccaggaactgccagtcttattctgcaggataaaaatcccttataatcacgtattattagttgggtctctcagcattctagttactgtcttttagaccatttctagcttttttatagaagtatgttttcatgaagagatgaatatgcatctttaaaataaacctgttgcagattactgtctggttaggcatcaccatctgtgagatcatttgcgtggcttcttgaatcatccatctaccttacctgcaagggccacaagagattaattttctcatacctggaaaccagaatttctttgtcacctgtttacctgttcttgctccctggagtctttcacttctgcttccaagcgtgtttttcctatttggtaatcacagcgatctctgaaaccccttggaagtatctcctagttggctcaaacatgtatagaaagttgtagcatgcttaacatttaagaaccaaagatgacttctttactaaatggtcattttctgctttgtaggcttgttttctttgagaataaagagaagttttgatgtttttctagagattaaaaaagagtatgctgttataaaacattaaattcaggttgacccatttgaacggctacatctacattttcttttgcatatatagatttttgaagcttaaatgcagataaaattatgtgcaactttgaggtcctgcaattttaaatattcttagtaaaaagccaacaatatcgattccagctattttatatattagcagcttacctatatcagccaattctcacgtaaaacttgagaactggtaatggtttgctgtttatttatttagagtttagagatggaaggaatgcacagaataactgtagctgacctctgtggatgttggtctagtgagagtttgctagttaagagtgtacataatctaggtaaaaccaagagtcttgtctggttgtgcggtaagtgaagcatttgcagttggtttcagtgtgttgcatataagttgagtcaaggtggtgtatgaatacgtttgtctaggtatcactgtaggacttgatgattatgatttcttggttgtcactactctcttatagctgtcctgtgtgaattggacaactaggtggcagataatttttcagattttctgtcagtaacttgaaaataagaaaaccactcaaatatatttatttatttttcactctttgtttttatttatttagtttagagattgggtctcactctcacaggctggagtgcagtggcatgatcatagctcactgcagccttgaactgctgggctcaagtgatcctcccatcccagcctcctgaatagctgggactataggcatacaccatcacatgtggctaaattttttattttgaagagatgagatcttgctatgttgccaaggctggcctcaaactcctggcctcaagccatcctcccaccttggctttccaaagtgttgggattataggtgtgagccaccctattgggcccctaatttattttttaatgcagagattgcagtaaataatactacagtcctagtgtcctgtaatcgttgttaatggcttttgatatgtgatgttattgagatgacttccttattttacacatgaataaaacagcaccaaagataaatgcctgactgtatatttttttccatattgttttgtttcctctaaaaaaatgcttgcacatgaatatagactgcacacacatattttttcattcatttgtgcatcaaatagttttgtgtttttaagagacaggggtctcattctgttgcccacgttgaggtgcaggggtgcaattatagctcacttggggggccacgtgttggtattatagacacgagccatcacacctggcttggaatgttttatatcttccataccacttttgcatagggaatgaactgtcatccctttcatccagtcatcctaatgccgaatttgtgtgtttttcatgtttgtttctgaagaactcaatttaccacatttcagaagcctgttttttaaaaagcagagcagggcactgctgttggattcacactgttcaggtaatacatgaacagtggtagaattacaaggacatcttaatagcatcttttgcctcagggctttggttttgagttaggcttaggatgattaaggtagtgtttatgtattactagctgtgtacgtaattagcacttctaagcagtcatacacccaaattgggaaagatgtgctcaactgatttgtattacaccccaggattgttacccaaggtgtgtagatgtctgttccctgagagcaaaggtcttttcatctaattagcagtgtgaccttgggttcttactgaacttggaggagactgcttattttctggaaagtggtggagatgaaatggttactttgtgggagatagtcactcccacagtgtgtccactcccagatagtgtccttcaggcctcagtggccctcccataccaatccactgagagttgtcaccccaaatctaacagtcacaaggctagcatcttttaccaacaaaactttgataataactgaaaaaattattttattaaattaatatgcagagttttttgggggaaatttgaaccttgaacccctgactttaaaaagttgtttatcattaaaaacagaaaaatgtgggaggactgtcttagattataaaaaactaaaaagacaaccagtgtaatatgtgtaccttggtggaacatgttaaaaacataaatacctgtaaggtgtgttttttggacaactgggaaagctgaatattttctatatattagataataatgatagaattacagttaattttatgcatcagaatatgtatatcagagaaagaaaaagtaaatgggcagattttataacagttgatgcatctaggtgaaggacagacaggtattcattgtactattcttttagcttttctgtagatttaaagtttttcaaatcaaaagttttgggaaataaaagattatgcttgccgaaagtgagctgaagaaagcgtcgcagtagacaataataaatagtaaattatacgaaataatttaaaggccaatgggcaagttatctcacacttcctaggtattcatataattttaaatctaattccaaattttttgttatcttatgtaaacattggtttgcaccatgtctgggaggcacaggcagactttccaaaaggagcagaagcatgggcagttttaacgactccattttcagatctttaccttccacatacacttgagcctaaaactgttcatgcacccacatttctgagcagctagttttcgactctgaagaaggaaaggcccctacattttactatgtctcttaattttgctatgctgcattgttctagggaataaaaatcaggtcatcaaacaaaggaatacttggaattactggttttgggtaatcttttttactgcttaatcaaatcatggtatacctgcctaggcagtttatcttttcctgtcttattcaagaggcttcaaaatgaaggtatttgggcacattctggattcagatatatcataggtagatttataaaagtgacttcattccccatcaattgttcttcaatgaagaacttttggggaaaagacccttaaaagcaaagcagagtgagtttcaagtgatgaaaatagttttctaaaaaatgtaacgtaattaaagataagttgattattttttttagctgttcacaggtttagttgctacgatgggtaattaactagaaagcaatatacctttgaacagcaacttttcaagatattacagataaagaacaaagttaaaagtattttgtgatttctttcagttgaaatgtgtatcattcaacaaagtagttaatgcttctttttatcaaatcatagaaaatattccaattatatttaatcctcataaaatattttgtattttctatctcctaataaaaaatgtaattacattcttgctgtcagactgatttgtttttagaagtacagtaattgcagcaggttttaatctcacattggtatttgcttcacgccccctcgtgtggtagaatggaacttgtagactaggtaaattcttagaacataagaaaagcgcctgatggagtcccccagaaatctggtgactagcccaggccacagttgtacttgtcacctgttttagaccctcgtcccattctaactctcaagactgactttgctttaccctgaaccacacatacctttgtacagtttatcctggccagcactacttcagcattgatttttttccccagtatgaaaggaacttaatttgatattatttagcttaaataatgctgtatactatgtcaagtattcacagatggtttaaatgcttaagaatgtttattactgtgaatactgttttttactgtatttaagtaggccaacatatggtatttataaattgcctctataacatttatggattaaaatttttatatttcgaataatggctaacacttacatatcatttactgtgagccaggcactgtcccaaggactttccatatgttaactcactaaattgaatccttacagcaaccctttgaagtaggcattactgttgtggtcatgatcactttatggattgatttggaagctgagaatcaaaaaggttgggtatgtgataactgatggaggtgggatttgagtcttgggtcactgctgctgagtgcgtagttctcatcacctgggcagtgagtggtgcactccaggtgctgttgtcctcctcaggtgaaggagagctgctgctcttatttgttcatgacattccctctgagtcacctgggctagaaactagggagctccttttgccgactttgctcttaatgcgccactcatcaataagttttactgattccacctctgaaatgttttctttgtccttcctctctgccctggtgctactgctgtatttcaggcagccgtgtaggtcaggggctggcaaatcatagcccatggtccaaatccagccactgctgttttttatgacttgccagctaaaaacggtttttacatttttaaatggttggagaaaagtcaagagattaatattttacgatgcatgaaaatgatatgaaatcaaaatttcagttttcataaatatagttttattggagtagagccatgctcatttccttgtgactacttttgtctgacaatggcagaattgagtaggtgtaatagagaatatgacttgcaaagcataaaatatttcctctctggctctttacagaaaaagtttgctgacccttgatctagattattgcagtagtctacttactgacttcccaaaccttcccttatgtctccttcctttctgttctcattgtggatggatgggtggtagtgggaggatacaagaaactagcatctgtatctctgatatggcgtttatttagttttgccacatagtcatatctgttagttgtttacctgtttatctcatgtaatagagtaggaactccttattgtacagatgataccttactcatgaacaaagggatggtatccacatgatacccatgcttgaatgaagatatattcaatcctttacgaatggcactttaaatttttactcacatattttatattttcattttaagatcaaattgaaaaagacagcagttggtgaaatctgtcagaagtttttttgtgtgtgtagactcccttccagcatatcttttagagcttttacaaggtggtgggatccttgttacttcttttgtaacactgacaaaggaagtgttacgaaggtgttactaggtcctctcacaagtacagtggtttaaaagctaagccattttgattagtgtatgatacatgctttattagagccattctggccaagagcaatgataggatgctggtagctttgggaatgctcttgaaagttacaagagggctctagaaccataccagtgtccaggggttacagtttgctgctgaactgagatcagcaggattggcattacagagataatgtggaaacggatttccattccacaggatgctcccttgggcaatctgttaggagttgaggaagctcctaatattctggaaggaccaaacatgtacagtaaaggtcagagcaaactggatatctcgtctagagtattgggcagtgtttgaggaggcaggttttgaagatcatggaaagcaaaagttcttcagatcagagtctttagagcagtagtctaggcagggaaaatccatgaatgggtgaactgcaggcaggtaggttgttgatactttcctgctgcctcaaggacataccattgctgttgtcttaagagttctgaggtcttggttgtaatgtcagcagtgcgagaatacacatgtcatcaagctgcaaactgcgttctgtgtcatcggagctctcttttctgtactgatgtggcactgtgatggtagaatcacagatactcaggggtcagtccaactttaattcagagttcttctgaaggttggaaggacttgcctgataaccatcaccttgccttcattgataattcttatgaaagcctgcccctccatagtcatcaggccttttatctcagacaaccaagagcaaccagaattctttatgagacacctgagatacgatgtgcactcatcacctcttgtattagctgccaggaagcctagtctctgagagaagtacctgataatgcaaaaaaattaagttttaacttaaaatattcaagaaacatagattgctaagatcacgatcatcttaaaattggagggttagtttatcacttacaattaatagtgcctagcagtctcttatgcttgtttgacatttgtcatgaaaaaacattgcaaatccttgcctgtgttatatatttgttcacccagacatcagtctgctaaggaggacatggagaatatagactttcatgaaggtatacaagaaaatgtgaagggcactgtattccagagtctttttgtgtgaagttttagttatagcagttctaagcccttatgttaggctgtcttgttgctgtaaagaaatacctgagactgagtaattcataaagaggtttaattgcctcgtggttctgtaggctgtacaggaagcctgacaccggcatctgttcagcttctggtgaggccttgggctgcttacagaaggcagagggagagtgttgtctcatatggcgagagcaggagcaagaggtctggggaggtgccacacattcttaaatgaccagatcttctgagaaatcactctatcatgaggacagcaccaaggggatggtggtaaaaaccattcctgagggatcagcccccatgatccagtcgacctcccaccaggtcacacctccaacattggcaattaaatttcaacatgagatttggtggagacaaatatccaaactattttgagcccttcttaagaggttctctttttacattatattcatattactattcttgggatggggaatggaaggaggccctaaaacatcggtagaattgttcacgtgtatagtccataagaaaagtttttaataacttggttaagtgctagtggattcacaactctactgtcaactagctgatactccagggaaatttggtgtccatgttttgacttcttgttgtgctactcaccactgttgccaccattgtgccaaactgtctgtccttttaatttgcttttacaatccagtgttcccatacatactgcaggccaaagggtgagcctggctgttaataaggaggtacatacatatattttagcagagtgaatagatttagctgccttggcaggtgactggagagctgtctgggagtgttgagagaaacagctggggttgccattttataggattgaggctctggattgggttggactaaatgatctttatgtcgctgttaattctgaggatttttttgagcactcttagccacacttgattcttttttttttgagacaaagtcttgttctgttacccaggctggagcacagtggcgcagtctcagctcactgcaacctccgcctcccaggttcaagcgattctcctgcatcaacttcctaagtagctgggattacaggcacgtgccaccacgcccagcttatttttgtatttttagtagaaatagggtttcgctgtattgtccaggctggtctcgaactcctgacctcaggtgatccacccaccttggcctcccaaagtgccgggattaacaggcgtgagccaccgtgcctggcccacacttgattcttaataatcaatcagtttgagccaggcacagtggctcacacctataatcctaccattttgggagccgaggcaggaagatctcttgaggccaggagtttgagaccagcctgggcaatatagtaagaccctgtctctacaaaaaataattagcaaaatgaaacatactggagatcactgttttagtgatctcttgtgtctaggctgggaatgaagtagagaagacaagaagcatagtgatcaaccttagaactgattatcttcatcaggaaactgggagttagcagaacgcagggcaaaagagaacatcaaggaaataagtctctgtagagaacaggaagtggaagaagggacacattgtgagcctcaggtgataggccctcttatcctctcattcatgggatggggtaggggagtgggtggtcaggatttggagaaaaaggaatgtcacttcaaaaggggaagagaacaacttgggctagacactttctggtggacatgaaatctcgtaagacattgaggggattacagaatgttgaggaaaaggatatccctgggagaagagaacagagttagggctttcaatagagactggttcctttgtctctttaccacacaccatgaactgccctctccgcagcatgcctgcagaaagctgcttgaatgcggcatcagctcccaatagctggaagaggaagggttcccctagacaacacggcatcacacacacacaagccagatcgaatgtccttgtgaagtggaaggcaatgaggggacttggtgaggcctctgtacacatgtccggacagtgaaaggctcagtgcttgtggaatgatgcagagtctgtactggaagaaatcattatttccctgcaaaaaaggaagagaattcctatctactgtggaatagtataataggaactagaagtttataaaacataagttcagaagtgataaaataggtgaaaagaagaaggtgaaaagggaaaatacaagggcaagaaacacttggggaacttgtttgttgcagaacaacaaataaattagaagcagcgaggaacagaatactcatggctgaaaaattaccttagtgacagcaaaagcttgagatgtttacagtgagttcagaagagaaaacattgcagcagtgagaaaaaaggacggctatgggaaacaggtggagaacattacaggtgattggactgcctacaggtgcagttgagatgataccattattggccttcccttctctggttcaagtttgtcttggaatgatgattttaagttgcagaaaattgacttctttagatatgactcatttggaaatatgtaagcatggacaaattggtgaaaatgaatattcatgtacttcctagaagaataccaatgagatggacgatttatttatagcctgaaaccaggaaaattcctccttgaagcagtttgtttcctggcattgatacgcagagctcccctcccccaccctgtgatgatggtctgcaggaactgatcttttactaaatgtaaatactgacctgctgatcacagggcaagcattttgctgctttttctgcatccagaactcattatgtagggtgggttttgtggggaaaaaaattttgttttgttctgtcagacatctgtggttaatcatttagcttttctacattaaaaaaaatatttcaagtaagtctgggtgacaggttggcacacaggaagagcaaacagatcctgtaacatttactgtcattgacgggaaactgagctttcattccttgtatggcaccaagtaagtcttagaatcgttacattgcagattgctatggggagactataggcagaggtgaaattggttgctagaatggacttgtcatgaattattcattcactgcctcgttccttgaaaatcagctggaggaagtagtccagtttgatggcaggagtggtatgctgagggcttcagcaagccctcacaagtccagctgcgacagccagccatgtgctgctgctggcagctgtagggtggcagctgctgtgcaggcagcgcctgttccccggcatcaagcacagggaccatgttgcggggaagcgctgcactgagcgcacaccaatgcattcttgttggaaaatgaagcttcaggtaggagacgtgccctgtcagctgtgcctggtttctcactgattcagggatgccattaggctttatggaacagacgtgtagaacccagagttgctcaaggatgcctcactcttgaggttcccagccagaaaaacttagcagtttaattttaatttcattttcaatgatgtactttgtttctaacaaaactgtttcttgaaattgcgaaaagtattcttaagccagtaagcatttaaacatatagattatagcatttttaaatgtatcgtcttattcttgatgtaaaaaaatcttttttattgatataatattgcccacttaaattatggagttatggctttgaaaaaccctgagaaagacaactgagttcataattttaatgaacgcaccttcaggctctattgctattttctagaggaagtgttgttttcagaagccactccaattctttctgctggagcattcattctgggaagatcttttagcttctcatagggtggaaaaatgcatagaagacagaacaaagggtctttgttctgttttgtggtattatttcccacgtgtgtgtgtaagccagacatgtaatttcatttggcagggctgttccagtgttgccatttgctccctctgtctgattttttgtggatgccgtctctgttaactttgctgaggctatgagatgttcttgagctgtggggacatgcaaatagcaaagatgaaaagagccagagtattaaggaatccaggccaaattgaatacactatttcatcagtaaatatatcatttatagttttaaaactctaacaaacatcccctgaacacaagccctgagctctgagacaaccagagaaaatggacaatctctttctacactgttttcataagctctacaacagcagggatctttgttttgttcactcatcattcgcaggggctggacctgtacctggctcatagtaggtggttaataaacgtgtttctgaatgagtacattctgcactaaagaccattaactgtctttctagaaaggttacttgctcatatagcactgtaggaagcagttacagtgttataatttcttttttattttattttatttatttttttttaattgatcattcttgggtgtttctcgcagagggggagttggcagggtcataggacaatagtggagggaaggtcagcagataaacaagtgaacaaaggtctctggttttcctaggcagaggaccctgcagccttccgcagtgtttgtgtccctgggtacttgagattagggagtggtgatgattcttaacgagcatgctgccttcaagcatctgtttaacaaagcacatcttgcaccgcccttaatccatttaaccctgagtggacacagcacatgtttcagagagcacagggttgggggtaaggtcaccgatcaacaggatcccaaggcagaagaatttttcttggtacagaacaaaatgaaaagtctcccatgtctacttctttctacacagacacggcaaccatccgatttcccaatcttttccccacctttcccccctttctattccacaaaaccgccattgtcgtcccggcccgttctcaatgagctgttgggtacacctcccagacggggtggtggccgggcagaggggctcctcacatcccagtagggacggccgggcagaggcgcccctcacctcccggacggggcggctggccgggcggggggctgacccccccacctccctcccggactgggcggctggccgggcagaggggctcctcacttcccagtaggagcggccgggcagaggcgcccctcacctcccggactgggcggctggccgggcagaggggctcctcacttcccagtaggggcggccgggcagaggtgcccctcacctcccggacggggtggctggccgggcggggggctgaccccccgacctccctcctggacggggcggctggcctggcgggggctgacccccacctccctcccggacggggtggctgccgggcggagacgctcctcacttcccagacggggtggctgccgggcgtaggggctcctcacttctcagacggggcggctgccgggcggaggggctcgtcacttctcagacggggcggttgccaggcggagggtctcctcacttctcagatggggcggccaggcagagacgctcctcacctcccagacggggtcgcggctgggcgctctcacatcccagacggggcggcggggcagaggcgctccccacatctcaggcgatgggcggccgggcagagacgctccttacttcctagatgggatgacggccgggaagaggcgctcctcacttcctagatgggatggcggccgggcagagacgctcctcacttcctagacgggatggcggccaggaagaggcgctcctcactttccagactgggcagccaggcagaggggctcctcacgtcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaaccagactccgtctgcaatcccagcacctcgggaggccgaggctggcggatcactcgcggttaggagctggagaccagcccggccaacacagcgaaaccccgtctccaccaaaaaagtaagaaaaccagtcaggtgtggcggcgcgcgcctgtaatcgcaggcactcggcaggctgaggcaggagaatcaggcagggaggttgcagtgagccgagatggcagcagtacagtccagcttcggctcggcatcagagggagaccgtggaaagagagggagagggagaccgtgggccgtggggagagggagagggagagggagagggcacagtgttataatttctataacaacctttacagcaaatgaattctgacttatattgacatagattatttcaaggttttcgtgtatttattggatacattattttaaaatggcagaaatttatctgttcattttactaatgtataattaagatttttaaaaagtcagcaatgaatacaaagacctttgtttttagcaaacccttacttcatattcagaaaatgaaaatgaaaaatacttaatggagaaagcatttggaaaagattgtattcttcagtacattactaaaatattatgattctaatcatatgttatatgtaacttttaaaaagcatttaatttatcagtctatattagaaaggcttggggaactataaatccattttttcataactttaagggtgaattttcagctgcagtgtgtggtgctgagcagcgctaagcagggcaacatattccccatagatatttgactctcagaggaaccaaaggggtcatcttcattaactctactctcctcctccttccacttccacatagtccactttatagaggagaaagctgaaatccagagaccctagatgaatggcttagaacaaatgtgtggctgttatggtcttgtgcttggttgtttcatattttctagttgcttgttaacttcattattgccacaatgaggtttaaaaaagaaagcagtggtggaaacagataatcacattactagaaatttggactatattattatactgaagacaaatattgatgcattttgacgttactttaaataaattaccttagtttgttgaaatatagttttataagaaataaattttcctgtcttgacttctgtgatgtaattgtttttttcctgagttaaaattttagtgactaaaatatgtactaaattttatttcaaaattgaacttcttgtaaaatggtactttatgccatttttgttattccttaagacgacttggcttttccttttatgtttgagatagatgtagattatgtcataattttcccaaatctattttactaactgtattagtctgcttgggctgccataagaaaataccatagactgcatggcttaaataatagaattcattttctcaaagttctggaggtaggaaagtcttaagatcagggtctcgcagtgtgcagtttctggtgtggcctctcttgctggccttctctccatgtcttgacatggccttctctctgtgcacaagctgaaagcatctgtaagctgaataattctagtttccaacctcccgatgttagaatttgtttaaaaatttgagagactgtactactctatcccattctgtcttctccctacgctactcttcaagtcaggcacgtatgagatgtttagtcttctttccccagattacaggcgttgttcagctgggcacagcaagagtgttaaaagttccttaaagttcttaagtttgctctgctgcacgttttctttaggaatctcagattggattttttaaagcctcttgttactagtgatcttaaggctaggaagctatgccaataactctatatcagatttcacctgttttatttataagaattcctcatttcttgaggtccctaaaatatcctaagactcatgggcctcccaggaagtggcttttcttactcacctgcaaggctgggaactctgtaagccagtttttccaaagaaggctttgtaaggatgactctgtaaaggcagtcttagttccttagttccagaacacttaaaagtgtttagtcatatttgattgaatgagcatcattttcaaatgtgagtttagttgcaaaaccaatatttccacttatgtcctagtaaaaaagaggacagattcttatttaatctatgcaaataactttattgccctgaaaatagaatatttattacgtttctgaactttggagggctcaagcagggagaataagatgtttacaagtgtttcatttcagtatacaaaagcagagtctactaagttatgagttatagatagctttaagaagaaagagaaaaggcttccttatatgtctggaaaatacattcaaacagcatcaacaatattccagacaaaaactacagtcatccctcattagctcattcagccatatctagttaatttttgttccactggatgtggggttagtagtattatcaacccatcggcttcctcataagagtcctggaaattctgacttaggccactggtatggtctgaaagttgtttaagcaatgtcatttagaagcctgtgccccaaagtacctggcatagcccttttccatggggttctgattccttctggcctgtagctgattgaaaaggctctgagggaaacatcagaataaaacagcaacaaatagatgtctgcagataaaaacatttaaaatggctgcagttaattttttactgatcattttcaaaaaatgaaggatctgatgagagtttgagaaaaatataactgacaaggaaatctggtttctgtgacatgcaaaacaagataataaagtcaataaaaaaattttaaacaatttaaaatgtaataatgaactctatagttaaaggatgtaatattatatctgatttataaaagcagatgagcataaactttacagagaaatgaatcttgaaatatagcaataatcctagatattatgtaccaataatgtatccagaatatcaagtgaaaagatctagtaagtctggagtgggtcctaagcttctgtatattaatgaaactccatctccatagtaaattatgtgaatccttaattgaaaaccactggcccagaagatgctgcattcacatttgaaaagtgaagttgtaaccaagttaacattttaaaacataagagtgataacagctatacagtgcagagtatcaggactttgataaatagaaactaatcatgacagtgagagcattgacaaatctcttctgatttgctaattcctcccatgcagtttcatcaatagtaacaaacacaattgtttccagtacttttttttttttttttttttactgtgaaagaataaatttttgtcctctttcatgggccctcttataaatctcagagacagttttagtcccaaaagtatctcaaattttttattttattttacatttaggatttgaatttgtaaagacataaatgaaaagttaccaggagatttcaacacttaggaatcagatcataggtgcctgagaaatactttcctactcatttcaaagtgacatccaaacatttgaaaataaagtgaaggttacatgattgtaaagcatttggctctttcataagtgagaaatatttaatcaaggacattgtacaatcaacatgaaaagcacagaaaactattttggtaaaacagaatctttgttatttatacagcagatatcttacaatctcttactaagggcagatcaataatccaagaaaattttctaatttcaacagagaaaaccaaactccagtattgtatcagtgtaatatttgatactacaggaactacaagcacttttataaaatctttttttttttttttcaaaactgagctaactttggccaaggcaagtaaaattatcttttctcaaatcttctacaactttctatatcaatttttgtcctttacagctgatgtagtttggatatttgtcccctccaaatttcatattgaaatgttatccccaatgttggatgtagggtcttctgagaggggtttgggtcatagaggcggatccctcatgaatggcttaatgccctcctctgggtaatgcataaattctcacttagttcctctgagatcatattaagaagagcctgacacctccctccttgctctcttgacctgtcgtccttcctctcaccttgtaatctctgttctccttctccctgtatcatgaatgggaagcttcttgagtgtctctctggaagcagatcctggcaccatgcttcttgtatagtctgcagaaccatgagccaaataatcctcttttctttataaattacccagcctcaggtattcctttatagtaatgcgaacagactgagacaaccctctttctcgttctggaacaaccagcccttttattttaggacaaaactatttttttttccttaataaacaaaacccatcctactacctcacacgtagtgttgtacctgcctgccaccattgttctagtagtctcattcacatgttattgataacttttagccaaagtaacttttattacacagagaaaactagggagtggataattgtgagctgttgcatgccactgttttagcaaactagcagagctaacatccagagctaacacaactttaactgtgtgtacactttcattgtgtacaagtctcaagagtggcaaaaatgaacacatttaactgattaaaagagccaaagacatagcctctttgtagcatataaaaataagaaacaagtatatttgtcaggcctctgagcccaagcctgcatgtatacatccagatcgcctgaagcaactgaagaatcacaaaagaagtgaaaattttccactacctacccaaatcctataaaactgccccaccccaactccccttgctgactctattttcagactcagcccatctgcacccaggtgattaaaaagctttcttgctcacacaaagcctgtttggtggtctcttcacatggacgtgcgtgacaatattaaatttatgcttagttataaatgtctcaatattcagtcttacttagaaatgagatcagtattgagtgcatattcattagttaattcaaattgataccagttcgagtttttaagtttcctaaagatcttggaaatttgtcttcaagctgatatattgcaagacataattactgttgaaatacaaggtcatcagaataatgattttgtttggttgaacacaaatttaccttttccataatcttagacattaagtagaagtaacgctagtttattcaatcagtaaacctgtataggtttatgaatgacgtacccaaatagaataaaagtctatgcttatacttaatattgataaatcagtaaagatacaactgtttcttttaaaccataaatattaaactggtcccatttccaaagatttgctttttttatgtgaacttgatttcttaatacagctcaataattggtttcttgaaagtgttagatcttcaacctccttattttctgggaaatttaggaatattctgtttatatatgtacttatttacctctatgagtaaatcagaatatattactttaagagatttcataatgtagtagattttataatctaatttgttaatcccattctgaggtagaaaattattgcaccttcacacattgaaagacaacagcctttctgaattacacatagacacgcagatgcggaaagagtttatgacttcaattctgaaatttcaactatggggccatggcaaatacagaattataaaactcatcagtccgtgtcaaagagttgctctcttcccagtgagcatgaattcttaattgattcgtggtgagaacagacaaatagacaaacagaaaaaaactaacaaaccagactatttatagttgctcacccattaaaccattcacaaagattagagatttttataaaatggccagaccataaaaccgaatccccattgggaaataatttgttggaggtcccaaatttcacagccatgtggtttgaataggatagaatcacctgtagctccagatggctctaattggcctaaagcaattaatgttatcttgttcttcaaccagtcactgtgggaaaaagtaggggtagaatgttgctgggaaacagaagttttctggcttaaacagtaactagatcacatctggcattaattacaagcctgtggtattgattaaaaacaaataaatggatagcaacttaactgtaacagaatttggcgatagcaactgggtagttgcaagtaacagaccctaatatgtgaaattggcttaatagatacaagtgaagtcaggcagtctcttgccacagggattgttttaggatagtgtctacccctaggactgggagtggggacccaatcctactgaaagtcaatgctgagaagtttagggctcttcaggggaaggtaaaggagagaatagtgttggaaactctgatttgtgatagggacaaactgagccatggagggagccatcaaggcgggtcttgatcctgtgctgtgaagtaggcaatccttctttcttattcaggagtagctggattaataatatgtcttgttttttgaacagtgagatcttgattaaaggcaagaaggcataagtgcttaattgtatatataattaacagctcgaaatgagcaataaaatgaaatttatgtctcttataaaagtagaaatgcagaatgtagggccacctttgtagaatgtcggaattgttaatgatctctggccactcagtataagcccctactcaggaggaagagggacgcagtaagggaaatactagtgctaaaagtgacagtattttcagcaaattggcatatttttcttttaaacatgccagatacgcgaacatgaatcttgacatccttagctctgattatagtcattagtatcctctttaaatttaggaaacaccatctagaaagaaaattggctatatttattcaccatgtttacagtataagaatgaaattcatactgtatggtgttttgttgttagattctgagtgagtgtccattcacttaaatttccaatatccagtgctagctttgtgctaatggcttgtaattagatagctggtgtcctgtattgattagcttatacagaaaaaacactggagaaaaaacaaggtgtatagcacagtgttttatacatcataggttattttttggatcttagtttttttcgagacggagtttcgctcttgtttcccacgctggagtgcaatggcgcgatctcggctcaccgcaacctccgcctcccaggttcaagcgattctcctgtctcagcctcccaagtagcttggattacaggcatgtgccaccttgcccactaattttgtatttttagtagagacggggtttctacatgttggtcaggctggtcttgaactcccagcctcaggtgatctgcccgtctcggcctcccaaagtgctggcattataggcgtgagccactgtgccaggccagaccttagtatattttaaaagttgagatacagctttcataccattaaatcacccttttaaagtgcccaattagtagatttttagtgtattcataaggttgtacagctgccaccactgtgccagtccagaacattttcatcacccgaaaatgaaaccctctacccattagcagtcactccccattctcccatccccacaatccttggtaactgcgaatttactttttgtctttgtggatttgcctatttttgacattttatatagatggaatcatataatatatgatcttttgctactggcttcttttacatacatagcataatgttttcagggttcatattgtagtatgtgtcagtatttatatccttttaatgactgaataatattccattgtatggataataccacattttgtctctccatttatgtgttgatggacatttgagttgtttctaccttttggaaatttttatttgtgtttgcttggtatatattttcccattcctttattttacactacctgtatcaatgaaacgagtttcctatagatagcatataattggttgttttttatttatttttagtttttattttatttatttatttatttatttatttatttatttgagacggagtctcgttctgtcgccaggctggaatgcagtggcacgatatctcggctcactgcaacctctgcctcccgggctcaagcaattctcctgcctcagcatcctgagtagctgggattacaggcatacgtcaccatgcctagctaatttttgtatttttagtagagacggggttttaccgtgttggccaggatggtcttgatcccttgacctcgtgatctgcccgcctcagcctcctgaagtgctgggattacaggtgtgagccaccgtgcccggccataattggttgtttttttaaaaagtcagttctccacatttgtgtcctgtaattgcagtgtttatgtacacttaattgttgctatatttatctatttggagtttgactatctctttgctttttaaaaaatgagttacaaaatacatacttctcagagtctatttagaatcagtattttgctacttcaattgtagtgtagaaacttcgctaaaatatagaaaatatatcacaactttcactttccccctttctgttacagttatcttacattctacattgcataccttcagagcccctcatagaatgtattattattattattatttgctttcagccgtcaaatgtaaagaatcaagagaaaaagaatagtcaattgtttttgtctgaatgcttagcctttctgttgctctttctttattgctgatatacacattgttttctggtatcattttccttccatgtgatgaatttcttttaagcagttctgttggttgctaatcttgttgttactctttgtctgtgactgtttttatttcccttcattcctgaaatatattttcaccacatacttagttttaggtaaacaggtctcttttgtcaatatttgaaaaatgatgttacttctgactactggccttgagggtttcctgatgagcaagacacagtcatttgaatcattgttcctctataagtaatgcatcctttttttctctctgctttccagatttcttcttgtcttcattaatttgactatggtatgcctgggcataggtttcttgtagttcattcagttttttgaatgcataggtttatgtccttctccaaacttgggaaaattttaacaaatttcttcaaatatttgccagcaccgtactttctcgtttactgtttggaataatttgtagccatttgggattggctttttaaattaagtgtaattctctggagatttcttccaggtttgtgtttatcaatagtttgttcctttttactagtggagtagttttccatgttatgcacggaccacagttttctaaccgtttacctgttgaaggacatttgtttgaacaaagctgctatagacacctataggtttttatgtgaacatgtgttttcatttctccaaggtaaatcttcaggagagcaatagctatttcatgtttaatttttaaagaaacttccaaagttttttccaggataactgtcattttattttcctgcaagcaatatataagtgatctagtttctttatatcctcaacatttggtgatgtcattatttaaaaaaaaatttttagccattctgataggtgtgtagtaatatctcattgtgattttactttcatttatctaatggccagtgatgttgaacatcttctcatgtgcttatttgccatctgagtatcctattcattaagatgtcccttcacatgttttgcctattttctaattggatttttaaaaatgttcaggtctaagaattctttctgtattctaaatactagtccttaattggatattcatttgcaaatattttcccccaggctatagcttttatcttcagccttttagcggggtctttcatggagcaaacgtttctgattttgatgaagtttaattgatcagtttcttaaatggatcctgctttgggtgtgtagtataggaactctttgcccaaccttaaatcctgaagattttctcctattttttaaaatgttttatggttttagattatacatgaagtccatgaactattttgagttaatttttgtataagtttgagactcaagtcaaagttcattgctttgttccagcatcatttgttgaaaattctctttcctctattgaattgctttcttaaaaatcagttgggcatattgtatgggttgatttctggattctctgtcttgttccattgatggttatgtctggttcttcactagtaccacacagtagtgattactctggctgtatattagttcttgaaattggatggatggatttctcccagtttttttattcttttaggattctttaggattgttttaagtattctagttcctttgcctatccatataaatcttagaataacctgtctatatctaaaaaaaaaacttgctagaattttgataggaattatgtttaagctgtttatcaatttggggaagagttgtcagcttacattatattgaatttttcattccaggaacagtatgtatttttatatgttgagatcatttttgatcaattttttttgcagcatcagcaatcagattcatgttttacttgatgtgcacctaaatacttcagtttttttagagtggctctataatagtaattgtgagttcttttgttcattgctatatgtgtgttatatatatgtatatatatatatagcaatgcagttaatttttgtatgtctattttgtatcctctgactttgctggactccttcgaggactttgttgttgctattgttaataccttaggattttctacataagcattcatgtcatgtgcagatagagatttttatgtctttcattctgatatatatgccttttattttgtttattttcctaattgtggtggctagaacttttggcactatgatgcatcagaatagtagaaaacattcaagaaactgggaatagagggaaactacctcaacataataaaggccatatatgaaaagtctgcagctgacattatagtcattggcgaaagtctgaaaatttttcctctaagatcaggagcaagataaggttgcctggttttgccactgctgtacaacacattactggaaatcctagctgagcaattaggcaagaaaaagaggtaaaaagcatcaaaattggaaaggagtaaaattatctctttacatatgacaaaattttttatatagaaaaccctaaagtttccatgcaaaacaaacaaaaaatcagactaaatgaattcagcaaagtttcaagttataaaatcaacacacacacacaaatcagctgtgtttctatatactaataatgaacaatctaaaaaggatattgagaaaacagtcctatttacaatggcatcaaaaatgcataaaataggaataaacttaaccaaagtggtaaagacttatacacagaaaactactatatattgatgaaagaaattaaagaagacataaaataaatgggaagacatcctgtgtttattggaaaacttaatattgttaagatgacagtactgcccaaatcaatctgtatattcggtataatccttctcaaaatctcagtgacttttgttttacagaaatagataaatctgtcctgtaatttatatggaatcacaagggatcctgaatagccagaacaatttgaacaaaaagaacaaagtgatggtgtgatgctccctgacttcaaaacttattacaaagctacagtaaacaagttagtgtggtactggcataagatagacatagaaaccaatggaatagaatagagagtcccagaaataaagcctcacatatttggccaaatgatttcccacaatggcgccgagactagtcagtgaggaaaggacagtcttttcaacaaatgatattggtgggggtggcaggggtctggatattaagaggcaaaagaatacaattggacccttactttacaccatgtagaaagattagctcaaaatggatctaagacttaaaactataaaattcttaaaagaaaacctagggaaagaagcttcttgactttggatttggcaaaaattttttggatatgacaccaaaagcaaaggcaacagaagtaaaaatacagaaattagattacatcaaaatttaaaacttctgggcatcaaaggaaacagtggacagggtggaaaggccacttagggaatgggagatatttacaaatcatatatctgataaagggataatatctagaatatataaagaactcctacatctcaacagcaacaaataatctgattctaaaatgcttgaatagacacttttccaaagaggatatacaaatggctagtaggcatatgaaaagatggtcaacatcattgataattagggaaacgcaaatcaaaaccacagtgagataccactttacaaccatcaaggatggctgttatatatattttaaaaatgtgttgatgaggatccgaacaaagtggaacgctgattgtgcactgctaataggaatgtaaaatagtgcaaccacaatggaaaacagtataggagttccttaaaaagtaaaagataattattactgtatgacccaggaaatccacttctgggtatataccccaaagaattaaaagccaggtctcaaagagatatttgtatacctgtgttcatagcaacattatttacagtgccaaagggtggaagcaatacaagtgtccatcaaagggtgaatgaataaataaaatatggtacatttattgcatatagtttcacatttgttttaaaaagaaaaggattctggctgggcacagcggctcacgcctgttattctagcactttgggaggccgaggagggaggatcacctgaggtcaggagtttgagaccagcctggccaacatggtgaaatgccatctctactaaaaatacaaaaattagctggatgtagtggtgtatacctgtaatcccagctacttgggaggctgagtcaggagaattgcttgaacccaggaggtagaggttgcagtgagccgagatcatgccactgcactccagcctgggtgacagagcgagacttctcaaaaaaaaaaaggcttctgacacatgctacaacacggaggaatcttgaggacattatgccaagtgaagtgagctaatcgcaaaaagaaaaatactgttatgattccacttgtataaagtatctagagtagtcagaatcatagaaacagaaagtaaaaatttttaaaaatatttcgggggtaggaagatatagggaattgtttaatgagtatagagtttcagtttttgcaagatgaaaaagttctgtagattgtgcaacaatgtgaatatacttaatactgaactgtacacttaaaatggttaagatggtgaattttatattatgcatactttatatgatggtgtgtttacattgtgtgtattttgccacaattaaaatgttaaaaagaaatggtgaaagcagatagaattgctgttaaaatttagggagtaagcattcaatctttcaccattaagtataatgttacctgtagttttttagtagatgtttgtattagtctgttcaggctgccataacaaaataccacagactgggtggcttaagtaacagaaatttaatttctcacatttttggagacaagaagtccaaaatcacgttgccagaaaatttggtttctggtaggcctttctttctgacttacatatgactgcgttttctctgtacctttctttaatcttgtcatttacagctataaatatccccctaagcactattttagttgcattgtgtaagtgtggtattttgtgacttcatttttatgaatctcaaataaattttctagtttttttttggtgagttcttttttgatttactggttatttcagattttgttgtttaatttccgcatttgtgaatttggtagtttctctctgctgttgataaacaataacatttaactctaaagtttaactctgttgtagccagaatcatactgtatatgatttgagtccttttacatttactgatgtttgttttgtggactactctatagtctgttgttgtgcacttgagaagaatgtatattctgttgttgttgttgggttttgtattctgtggatgtctgttaggtcaagttggtttagtgctgttcaagtcttttacatagctcggctgttcattgttgaaagcaggattttgaagtctgcaagtattatctgtttttcagtcagctctgtcagttcttgctttatgtattttgtggttttcatattaggtgcttatatatttataattattataccttcatgatggttgaccttatcatagtaaaagtccctctttagctctagtaaaattttcctaagtcttttttatctgatattaatataatgactacccctttttatggtggttgtttttgtgctatgtatctttttgcttcttttactgtaatcctgtttataattttgagtctaattgtatctcctgaacttagaatacaactggattttgtgttattgtacatcctgacaacccttcctgttgatttgttaatccatttgcagttcatgctattaatgatatggtttgcttgtttgccattttactttttgttttctatgtgtcttgccatttttgttcctgtgttcttcctttattgctttcttttgcattattttgtattgtaatattttaattccttaaatgatttttaaaaaagatttctaatgctatttaaaaaattattttcttaatggttgagggtttactatatatatatatatttttctaacagaatcttcttcagattcatattgatttaattcctgtaagacatagaatgattcctcctatgtacctctatttctttactaattattgtttatacatatctatttatgttacaaacccaacaatacattgtagcagttattagtttatttaactgtcttttaaagacataaaggaaaggagagcattatatgtttatacagtttgttattttaaagttagcactccttattatcttcatttgtttcagtgtagagtttccatgtgatatcatttccttatgccaacctttcatagtagaagtccctctttatctctggtaaaattttctgaattctgtttcgtctgatattagtataatgatgacaactttgtacccacttatcttgtattactattaaatacattacatttctttatgttataggtttaacaatacaattataaacatagtttttatataattcctttttaaattatttaagaaaggaaaatatatatgcaaaatatatatgcatttatattgtcttatagttacacagttacttttgactactgtttggcagtacatgctttcaactcaaagaacttcctttagtatttcttttcaggtgcatccacttgcaatgaattctctgagtttctgtttatctatgaatgtatttttcatcttcatttttgaagatagttttgctgaatataattatcttggttcacattttttttctttgagttctttatgtccttccactgtctctggcctccctggtttctgaggataagtcagctgttaatctttttgtggttcccatgtaccatggagaatatgatgagtcatttatttcctgctgcttttagtttttcttttcctttctcctttcttttcttttcttttctctcttctcttcttctcttttcttttttctcttttctcttttcttcctttcctttctcccctccccaccttcctgcctgtctccctcccctcccctagcatcccctcccctcccctcccctcccctcctaacaaattaagagataagaaagcttgtgataatgtttgtgtagatgggagtgtcttttcctcttcttcatggccataaaactcctcctagacaggggaattatggtacgtttactcttgatctccttcctgggagtaaaccgttgaagagggaatttatggcagcctcatttgtcacagtttctgcttttaatcatataagggaagtatggagagggcttcttcctgcattcattgaatatcagatgtcttcagcttaaaatcatgattatgtcaactctgagttttgaatgggtcctcacaaaagcatcagatcagaagagatttaatacataaacagatgcaggaatctagctgtcttctattaaacaatgagatttataaaaatgtacaggagtgccactctgctcactaatttttttttttttgagaaaatagttaaacttcattgaaatgttatttatgttaactgggtttattactaatgctaaatgaattaagagatatagtttttacgctgtcagttttaatgtctaatattgcaaatacccatagataaaaccctacataatccaaaggttttgggagtccttaatctttttcttttctttttttttttttgagatggagttttgcttttgttgcccaggctggagttcagtcgcgcgatctcggctcactgcaacctctgcctttcaggttcaagcagttctcctgcctcagcctcccaagtagctggcattacaggcatgtgccaccacgcccagctaatttttgtatttctagtagagatggggtttcaccatgttggccaggctggtctcgaactcctgacctcaggtgatcctcccacctcggcctcccaagtgctgggattacaggtgtgagtcaccacgcttggcccttaatcattttttacaggataaaggggtcctgagaccaaaaagtttcagacttctagtaactatcttcttcatagtcccaaagtgaactgctttacttcgtggtattacgtctatattccaggctggatgagggaggaggaattccagagaaatgggcaatggcaatatcaggaaagcaaaatgttttcccaggaaatctttagttaatttctttcaaaagaactttttatatatttaatagttttccttaactgcaaagtagtgtggaaaagtgagaacttttagctgggtttgttgctgctcaggacaaagtcagggttcttttggtggggacaaagggagataggtattgagtatgtagttagcggtgttcattgcccacatattttgtctttttttttaaggaccagtcctggtcagagtttcaggaaaaccccacatgatgaagtcctattgtttgactctttcatacagaatcccaaaaactcgcttaggcatctcacctcgttgtcttcttgataattattggtttctactttccagggtgtatttggtctatgtgagttttatgccttggctctacccacaagtacattctgttgggagccacatgtggacttgtgaaaaacatcattgacagcactgattaaattgtaaaatgtgccttattcttcagcagagcttctctttatctttgtgatctggtagcttctcacattaagaaaactttgttttctcacaccctcagactcagtctttcccaatctgtaccattgtgtttcctgattgattgatttgtattaactcaattgtgggctcacagccatcttttacataggaatttacttttaaaatggtcatgatttgctttttaaaacatgagtcataaattgggtgcagtagtatgcctgtaatctcagctacttgggaggttgaggtgggaggatcacttgagcccaggaattagagactgtagtatgacatgatggtactcgtgaatagctactgtcctccagcctggacaacatggcaaaaccctgtcttaaaaacaaacaaacaaaactcatagactttattgatttttctggttcaagatttggaatgaaaacttgcacctcaaactgtggtctggggacagcagcatgggagtcacctgggagctttttggaaatgcagaaatctgagtcccccctagacctaacaaaccacaatctacattttagcaagatccctaaatgattaggtgtccagagttggaaaagcactggctaaaggagaaaacaaatgaaatctagagggcatgaggctgtgttctgaggagctctcatgttgaatgtagatgaaaagagcccaccagagagatgtggagatgaaagccagggtagtgtgtggcatctcttagtaccttctctgaggaaggaaggaagatgcagcgaggcttccatctctcctggggtcacaaggtggtggtatccagtaagcagtgactgaatgtgttaaagagctgtaaataatttgccagggtttttattacttgggcattgaagcttagtttgggcttgaactggaacttttttctccttggtatgtctaattccacttctttacattgatgcttggcaaactttacttctcattcagaaccaagatgccattctgactacagggcagagtggtgtcacacttccaccttgatatactttatgtatgtgcttcttttatgtcattcttaagctcttccctagtttggacatttctcaccaaaacactttttcagaggagttcagtggtaatacacgttgagcgtccctaatccacaaactcgaaatccagcatgcttcaaaatctgaaactttggaatgtcagcatgacactcaaagtaagtgctcattgtcacctttcagattttgaattctcagatttgggatgctccacctgtaagtataatgcaaatattccaaagtccaaaaaactcagaaatatgaaacagttctggtcccaagcatttcaaataagggattctcaatattatcattggcatatggttaggagtgagattttggtccatattctatgcctgacacagttgttcacacatagtagttgcatagtaaataagtgtggaaagaatgactgatttgaatgagttttgggacttgctttctggaaaatatctctgatgttgtcctgcactatatattttaagtccaaataaatggacatctaaagagcagtgtttaggctgggcgcagtggctcacgcctgtaatcccagcactttgggaggccgaggcgggcagatcacgaggtcaggagatcgagaccatcctggctaacacagtgaaaccccgtctctactaaaaatacaaaaactgagccggacatggtggtgggcgcctgtagtcccagctacttgggaggctgaggcaggagagtggcatgaacctgggaggcggagcgtgcagtgagccgagattgcaccagtgcactccagcctgggcgacagagcgagactacgtatcaaaaaagaaaaaaaaaaagaagaagaagaagaagaagaaaaagagcagtgtttattgggggaaaataaaagatgatctggtctgctggaactgaactgttaagatcctaccaagtagtggagaagcaaccctaaatattgacaggtttcaggctttaaaacccctgtgttttctagggcttgttatttgtttggttttaccaatgtaaaatatgaattgttctaacaagaaaacaaaataaaagcttgcattatcaaatttatttcttaaagggtaaggaacagctttagctctcaatctgggtttataatgttaagttagcaggtagttctccctcaccccaatatccattctctgttgaataattaatgtcaaaaaggtctgaggatatgatttattggcttctcttagtacttgtgaacttctctgtagatttccagatggtgtcaaaccagccattccttgtgaggtagtaagtaatgtagcagtggttataattggctttctgtacagataatccaaggcctatggtgtctttgtttgaacttagtagactacactaaaatttaatagtaagtcaccagtagcttggccttaaaattgggactcacagcagtgccctgtgtttacctataagtacattcttgactaatgaatgaaactcagattacttgttctctggacagagggctttcattcccagtgaatgaatgtgtgaataatatgattgaattaaattgctagttaaacttggtctttttttgttgttgttgatacggagtcttgctctgttgcccaggctggaatgcagtgcagtggtgtgatctcagctcactgcaacctctgcctcccagtttcaagcgattctccttccctcagcctccggagtagttgggattataggcacgtgccaccatgcccggctaatttttgtatttttagtagagacggtgtttcaccatgttggtcaggcgggtctcaaactactgacctcaggcaatctgcccgcctcagcctcccaaagtgaaacttgatcttttagaaacattctttggtaacattctcccaacactttgagcatactttataatttactaattgactgccttaagatgaagaaacaggtcaggtatggtgactcatgcctgtaattccagtcctttgagaagctcagatgggagaattacttgaggccaggagttgagcctgggcagcatagcaagaccctgtctctataaaaaatacttagtcagacatggtggcacatgtctgtagtcctagctgctcgggaggctgaggcgggaggatcacttgaacccaggaggttgaggcttcagtgaagcatgattgtgattgtgccactgcactctagcctgggtgacagagtgatccctgtctccacaaaaagtatttagtcagacatgttggcacatccctgtagtcccaattcctcagaaggctgaggcaggaggatcacttgagcccaagaggtcaaggctgccatgaaccatgatcatgccactgcactcccagcctaggtgacagagcaaggaaatacaactaagatcttctcttccttaggcaatagtttttgttactcatttgggtttagagcaagaatgagtagattcaggaaaatgactttatttttaaaaatcagatttatgtttagagtgttcactttttttttttaaagaaagtcataggatggaagatgatcgtagttgtttgagggttgccataacaaattgccatacggaaggtggcttaaacaacagaaatttattttctcatagtctggaggctggaagtccaagatgaaggtggcagcagggctggtttctccttggcttgtagatggccatcttctccctctgtgttcacattgtcttttatctgtgtgtgtctgtgtcacaaactcctcttattacaaggacaccaatcctattggattagagtccactaggattagagtcacctcctgagtagccgggactactattgacctcatgtaaacttaattacatctttaaagtccctattccaaatagttatattctgaggaagaaggagtttaggacatcaacatctaaattttcacagaagggaggggaatacacagtttagcccatgatagttgtgtatcagggaggtcaacctaaaggcaaaaaggccaggtgggatgttattcttcaagaattctagctgagaaatgaagagaatctaaactaaagcattgtcaataaaaatgaaaatgagttgtgattgagaggaggaagaatttgatacaagactatgtgactgaatgtggaggggcatgagaggaaggaggctggcatggctcccagatttccctgctccaggaggagaaactgagttgaaggagatgtgagctgtgtgatatcccgattgagtattcagcactttgttagccagacaccccaggactggtcagctgtcctactttcttcactctttcgccgtgactcctcataatgtggactgtgtcacatacaactgagcatgcagcctctccacttgaaatgtgtcttaagacacttatcaccatctgaactttcacgtgaaatgtgacttaagacacttattaccatcttattttgacagtgaattctaaactcttattttttcctgataataaaaaattaaatctcttaaataaaatgttaaatcctttaggacagggactattgtgtattcattttgcccaaatgtgcaatatttactgcctggctacatacatctagtatatagtaggttgtgctttgcaaattctagttcagggaatgatttgtcagtagggttgttgtgatcaattacttgttctttgcatattttaatcaaagattgataattaaaacctgtttgattttcttgcagaatgagaagactttgggacatttcatgagtcattcaagcaacatttctaaggtagagtgccactgaaaaatgttatttattaccttgagtcttttctgttcttatgccttacatgtgtttatactcttttttttttttttgaaaagacgttagagttcttgatacatttctgtaatctgttctgggaccataagaggtatgtggcagttacatttttctggtaaggcaattttgagtgtgtgttgggggaagtgacttctgggagaaaattccattttttccagaaaaccatatactttaaggcagaagaaatctcaggcacaggagagtctgttgccacaattaggaatatatttgactgaaagtaacagaaagctaactatgatgacttacataattatggatttatatggttcatttgacaaggtgtctggaagcaggtgatccagggcagagttgatcacagattgtagtgcacccgattctgtggctgttcggggtgccactgtgtaacccgcatggacctaggggaactgaacaaggggtgaaggcgggaataaaagacaagagacaaaagagtatatttggaagaaggaggcatcttggctctagtggacaagggccctgagctttacacagccctccatatttattaggcaaaagagatagtgagaaggcgggtggaagaaggggtcagctgctcagtctagagtaggcttgcaagactgcattccttgaacaaaaggttctagatgttgcagtagagaaccttggcgccagggagtgattgcctccagcaaaccttctgttggcaggagcagtcggccggagcagtcgtgagtttgctcatatcctgcattcatgatgaacggtttgctgtttgatcatatagtctccaggggaatgctgagttggtcacgtcccatgggtcttcggctccctgtaacagatgttgccagggacccaggctctttcctctctgtgctatctcctacttgacacatggtctcacgatgagagctggaccttcaggcattgcggttgtggccttggcaggaattagaggactgatcaaggattaacaggtctgttagctgagagtcaccattttcagcaggaaggcaaaagttgtcccacaagtcccacctggccgcctgaaatctgcttacatctccctggccagaactggatcacaggccacctctagctggaaggcagctagggaaaggagggcttgggaagtgaatcagccatccaacagcatctcctcacctgtggtgtggtctttttagcgcaccaggagcacactggctgctagggtatggcctgggaaccagcagagtgtatctgatgcagtgagcttgcttccaggcagtgctcctctctcagcccacacattgactctggccaaccccttcgccatacagttaaggccatgaaagttctttgtaagggtggaccttttccccatgtttttggcatatggccaaacacaccacagattcagctgggaggatttgaacaagtgacaaagtctatctgctgtctcaggcctcctagatactctgaaatgaacagttacattatatgccattttaatgtgctgactacatatatgttttcattcaggtcaccttatttttttaagactaaaagtaaactctggcaaaccttcttaagacatttgtctgttcttaggcatatttgtaatctaattatattattcttccgcttaattttgcgttaaaaataggaatgcctttcacaaaatattttttcccatccaacctccatttcttttcttttgctgtccctttggccaggaatgctgcagtgctagaactatgcagtggtaaaccattgctgcccatttttgcaccttttaaaggagctaatcagtgtctaagcacggagaaaagtgagaaggtgcagctgcagatggcctgtttgcttaagttgaattaaatgtgttaaaaaacgctcagtaacacatgtatgtcgccttgccctagtagccaagggcagttctgaaggaggacatcctatgctttaaatatgtacctgttcattcatggatttcagtcacattttatttaaaggaaacttcttcctatagttaaaaaaaactgtttgcaaaccaccatcttaaaaagtctagaggaaaggctattgtcctggcttgggttgtgggtattttgagctttgtaagggttttggaattaacatggatgatggtttactagccatgtgattttgaaaaaggacatctctctgagctttaatttagttatcagtaaaagtagggtaagccaggcgtggtggctcacacctgtaatcgcagcaatttgggaggctgaagcgggcggatcacctgaggtcaggagtttgagaccagcctggccaacatgatgaaaccccatctttactaaaattccaaaaaaatagccaggcgtggtggtgcacacctgcagtcccagctgcttgggaggctgaggcaggagaatcgcttgaacctgggaggcggaggttgcagtgagctaagatcacaccattgcactccagcttaggcaacaagagcaaaactccgtctcaaaaaaaaaaaaaaaaaaaaaagtagggtaataatacaaccttcagggttgttccgagtcttgggattaacatttgcatggaaccatggggcagctcacccattacactgagccaacaaacctgactcttgtcaaagttcgttgaatcctggtgaccttaggttgattgggccaggacagttcatttaatggtagctttattatttattgctgaacaatggagaaccatacattattttttccttcttgcatacatttttttttagacagagtctcgctccgtagcccaggctggagtgccgtggtgcaatcttggctcactgcaacctccgcctcctggatttaagcaattctcctgcctcagcctcctgagtagctgggattacaggtgcgtgccaccacgcccagctaatttttgtatttttagtagagacagggtttcactatgttgatcaggctggcctcaaactcctgacctcctgatccacccgccttggcctcccaaagtgctaggattacaggcgtgagccaccgtgcccggccccttcttgaatacatttttactgtgtgctgtttgcgactggacacttagtgtgtccagtgagttccgggatgcttactatggtcattggagagtatctgagtggagtgagcctttagaacatttgattactcacagaacttcctggttaacctgtcaacgtgaaattctgttgcaaagtgtacccttttgtaacgaagatagttagcatgctgtataaggtggttagacatgaaccagttcagtgggaccaaggaagggagggcaggccccctgtggaagataactgtttttgagaagacagtttttttattggagtatttattaaatgaacctgctgtttgaagccagttttaggccgtgacatgtaaaatcgtatcttcagtatagcagacatactcttgagattaaaggaggccacaatgtggacatactgtatgctacctgaaatccccgttgtctctgtcaggagactttctgctgacttttagaccccagctggggtcagcacatgagccagtcactgcagtctgctttatgcttctgcagttcacctcttgctggcgtaaatttagaggttgaaaagaggtaaaaaataaacctttaatcatgcctcctagtattccatctagattttattacaaagtgtctcagtgtgtattggaagcatattgactttaaaaaccaggctccattttcaaagaaggaagcaggtaggttggatgagatgtttatgaggctgctaggtctgtggtggcttgcctctcttcaaagtgggcagctggatttgatccccttaaggagttaatagaagaagcatattgggatatttaagcaattacaatggcaaagtcttcacccaatacttattttgtattgatagtacaatgttaatggatatcatttgttgagcctctgttaccaagggatttcatgaaatttgtcacctccaattaacatcctaaggggtccaaagtcaccttttccttttatttttcaggatcgcacttatcactgcctgggttttcatgaatttttttccattgcaccttcaccccacatgtaaccttcatgagtgtagagccatgctttgtttacccctaaatctgcagaaccagtgatgggatggagccctggaggttgtcagtacatgctgagtcaatgtttgcatgctgttctgctagacacttgatacccagcccattggttcatccctcttcatcatcccagccacttcccaggcccaggcctcctaaactcctgcagtagcttctcaagaatctatcccaaaccatctagcacccagtagccagtaagtagaattcctaatgcttctcttttcaattcttcagtgtttctgattacactaccttgagctgtcacatctaaggtgacctgggcctggccacttggaacctgatcctgtgcaatatccccttggtcatgatgatctaggtatggtgtctaccttgatgattttcaaacaagccaaattcctatttgcgcaccttttgttctgtccgagaggcctctcccaatcttaccccttttttgcatgaatggctaaaattcctaactcatttctctttcagttcttagcttctttagaggcacttacccttgacaccctccccttagtctaaattttatcacccatttgggttttgttactctttcttcatagcacctatcacagtttgtaatgatagcagtgtgtagaaaatcttatatttttagaagcagcagaatgtccccccttggaaaaaaatctgtttaattgactgggtgcttggagaagtttgaggcagtttgagtcccacaggtgacatgctttatacaaagacgggcactggaatgcagcccccatgaaatcgccatgcatcttgcccagaccttcacctcaccgcagggtccttgaccatgtgggcccacgagccatcctggaggatgttccccagatgccccatccacactcagtcctcaccctatgtacttcccttgctgctgtttgcttaatcattttctaaagaacaaactcaaagttttatatcattgtgtagtatctgaaatcacatttgattggttttctttttttagtttatttgtacatatttatggggtacctctgatattttgttacatgcatagactatgtaatgatcaagtcagggtatttggggtgtccctcactgtgaatatttatcatgtctatgtgtcagaaacaatttaaacctctcttctagttattttgaagtatataatatattgttaactgtagtcaccctactctgttgttattgaacattagaacttattgtgactatctaactgtatttttgtacccattaaccaatctctctttatcccccactcctgcctccatgcacacccttcccagcctctagtacctataattctactttctacctccatgagatcaaatttttatagctcccacatgtgagtgagaacatgtaatatttgtctttctgtgtctggctaatgacctccatccatgttgctgcagatgacatgatttcattctttttgtatggctgaatagtatttcattgtgtatatgtgtcacgaattctttacctgtttgtccattgatgtggacacttaggctgattccatatcttttgcgaacagtgctacaataaacatgggagtacagatatctctttgataatactaatttgttttcctctggggaaatactctgtagtgagattgctggattatatagtagttctatttttagttttttgaggaattcccatactatttttcatactggttgtactaatttgcattcccaccaacaatacataagagttcccttttctctgcatcctcaccaacatctgttattccctgatgattagggatgctgagcagtttttcatgcagctgtcggtcatttacatgtctttttttgagaaatgtctagtcatgtcctttgcccactttttaatgggattgtttgtgtttttaatgttgtttgagtttcttacatattctgtatgttagttccttgttcgatgggtagttttcacatgttttctgtcattcaacaggttgtgtcttcactctgttgattgtttcctatgctgtgcagaagcttttcagtttaatatagtcccttttgtcggtttttggttttgttgcctatgctttggggtcttagccataaaatcattgcctagatcaatgtcttgaagtgtaatccctgtgttttcttctaatagttatatagtttcaggtcttatgtttgagtgtttagtccatcttgagttgatttttgtatgcgatgagagagagggcttcagtttcattcatctgcgtatggatctctcattttcccagcaccatttattgagagggtatcctttccctaacgcatgtttttggtacctttgttgaaaatcagttcgcagtaagtacgtggatttatttctgtgttgttgattttgttctattgttctgtgtatctgggtttgttttgttgttgttgtttgtttgttttttgagatagagtcttgctctgtcgcccaggctggagtgcagtggcactatctaggctcactgcaacctctgcctcctgggttcaagcaattctccctgcctcagccccctgattagctgagattacaggtgcataccaccaaacctggctaatttttgtatttttagtagtgatggggtttcaccaagttggccaggctggtcttgaactcctgatgtcagatgatccacctgccttggcctcccaaagtgctgggattacaggtgtgagccaccactcctggcctgtatctgtttttataacaacaccatgcttattttggtttctgtagccttgtgtaatatcctttgaagtcaggcagtgtgatccctgcagctttgtttgtttttcttaggattgttttggctatttgtgctcttttttggttccatatggttttaggattgttttttctgtttctgtgtaaaatgacattgacattttgatagcaattgcattgaatctgtagattgctttgggtagtatggtcattttaatgacactaattcttttgatccgtggacgtgggatatctttcaatttgttcgtgtcctcttcagcttcttttatcagtgttttgtagttttccttgcaacgcctttcacctctttgattaaatttatttctaggtattttattttgtatagctattgtaaatgggattgcctttttgatttctttctccgctagttcattattggtgtatagaaacactatcaacttttgtatgtttatttttgtatcctataacttttccaaatttatcagatctaagttttctaatggagcctttaggtttttctaggtataaaatcatatcatctgcaaaaagggacaaattaacttactttttccaatttgaatgccttttatttctttctcttgcctgattgctctaactaggacttccagtactgtgttgaacaggagtggtgaaagtgggtgtattagtctgttttcatgctgctgataaacacatacctgagactgggtaatttttaaagaaaaagaggtttaatgaactcacagttccatgtggctggggaggcctcacaatgatggcagaaggcgaaaggcatgtcttacatggcagcagacaagggagaaatgagaaccaagcgaaagaggtttccccttataaaaccatcagatctcatgagacttattcactaccacaagaacagtatgggggaaaccacccctatgattcagttatcccccactgggtccctcccacgacacatgggaattatgggagctacaattcaaaatgagatttggtggggacacagccaaaccatatcattccgccctcggcccctcccaaatctcatgtcctcacatttcaaaaccacccatgccttcccaacagtcccccaaagtcttaacgcatttcagcattaactcaaaagtccacagtccaaagtctcatctcagacaaggcaactcccttccacctgtgagcctgtaaaatcaaaatcaagttagttagtttctagatacaatgggggcacaggcactggataaatacactcattccaaatgggagaaactggccaaaatgaaggggctaaaggccccatgtaagtccacaatccaatgggtcagtccattcttaaagctccaaagtgatctcctttgactccatgtctcacatccaggtcatgctaatgcaagaggtgggctcccacggcctttggcagctctgcccctgtagctttgcagggtatagcccacctcctggctgctttcacgagctgtcattgagtgtctgtagcttttccaggtgcatggtgcaagctgttagtagatacaccattctggagttgggaggatggtggccctcttctcacagctccactaggcagtgccccagtggggactctgtgtgggggcttgcaacccacatttccctttcacactgccctagcagaggttctccatgagggctccatccttgcagcataccagtgcctgaacatccaggcatttctatacattctctgaaatctaggcagaggttcccaaatctcaattcttgacatttgtgtacccgcaggctcaacaccacatggaagctgccaaggcttggggcttgcaccctctgaagccatgacctgaactataccctggctgcttgtatcctttggttagagtggctgggatgcagggcatggagtctctaggctgcacacagcaagggggccctgggcaccagcccttgaaaccatttttttttcctcctagtcctctgggcctgtgatgggaggggctgccagcaaagatctctgacatgcccttgagacattttcccccattgagttggtgattaacatttggctcttcgttacttaggcaaatttccacacccagcttgaatttctcctcagaaaatgggtttttcttttcaatggcatcaggaggccacaaattttctgcttttattttctgtttctctgagaatgcttttaaaactttttaaaactgaatgtttttaacagcatccaagtcacttcctgaatgctttggtgcttagaaattttttcctccagataccataaatcatctccctcaagttcaaagttccacacatcaggggcaaaatgctgccagtctctttgctaaaacatagcaagagtcacctttactccagtttgcaacaagtttctcatctccatctgagaccacctcagcctggatttcattgtccatatcatgatcagtattttggtcaaagccattcaacaaatgtctaggaagttccaaacttgcccacattttcctgtcttcttctgagccctccagaccattccagcctctgcctgttacccagatccaaagtcacttccacattttcaggtatctttatagcagcaccccacttactggtaccaatttactgtattggtctgttttcacactgctgataaagacatacccaagactggataatttttaaagtaaaagaggtttaatggactcacagttccacatggctggggaggcctcacaatcatgggggaagatgaaaggcatatcttacttacatggcggcagacaagggagaaatgagaaccaagtgaaaggggcttcccttacaaaatgagatttcatgagacttattcactaccacaagaacagtatgggggaaactgcacctatgattcagttatctcccactgagtccctcccacaacctgtgggaattatgggagccacaattgaagatgagatttgggtggggacacagccaaatcatatcagcgggcattcttatcttgttccagttcttagagggaaggctttctttcacttttcccccattcagatttatgttagctgtgggtttgtcatatatagcctttattaatattgcagtatttctttctttgcctagtttgttgagaatttttatcatgaaggaatgttgaattttaccaaatgccttttctgcttctattgagatgatcatatggttttatccttcattctgtttacatgatgtgtcacatttattgatttgcatgtgatgaaagacccttgcatcctagggataaattcccttaatcgtgtactgtctttttgatgtgcaattggatttgctttattcgtattttgttaaggattttttgcatctatgcctatcagggatattggcctgtagttttattttttgttgtgtccttgtctggttttggtgtcagcataatgctggtctagtagaatgagttaaggagaattctctcttcttcagttttttggaatagagaagaattgttcttctttgaaagtttggtagaatttggcagtgaagtcatccaatcctggacctttcgttgttaggagactttttattactctttaaatctcattacttcttattgatctgtccaagttttctgtctctttctgatcaatcatggtaggttatgtgtctatccatttcctctaggttttccagtttgatagcatgtagttcgtaatagtctctgatgatcttttgtatttctgtgttatttgtaatgtctcctttttcatttcagattttatttaggtcttctatctttttttcttggttagtctagctagtctatcaattttagtttttcaaaaaattaattttttgtttcattgatcttttttttttttagctcctatttagtttagttctcctctaatgtttattatttcttttcttttactaattttggatttggtttttacttggatttctagatccttgaggtgcatccttcgattgtttgtttgaaatctttctactcttttgatgtaggtgtttattgctctggacttccctgttagcactacttttgctctatcccacaggttttggtatgttgtatttcgatttttatttaaggcatttttatgttttctccttaatttcttccttcacccagtggtcattgaggagcatgttgtttaatttccatgtaattgtacagtttctagttgatttctagttttaaacattgtggtctgagaaagatacttgacatgatttcaatttttaaaaactttgttgagacttgttttgtgtcctaacctgtggcctatcctgaagaatggtctgtgtgctgagaaatgtgtattctgtagttgttggatgaaacgttctgtaactgtctgtttagtccattgtcctaacgtgcagtttaaatgtaatgtttgttcattttctgcctagatgatctgtctaacgatgggagtggggtgttgaagtcctcagctattattatactgaagtctgtctctccctttagatttaataatatttgctttatacatctgagtgctctggtgtagggtgcagatgtatgtagaagtgttatagcctcttgatgaattaatccctttgttattatataatgactctctttgtcttttactgtttttgacttaaagtctgttttatctgatataggtatagctagtcctgcttgcttttggtttttatttgcatggaatatcttttttcatccctgtactttaagtctatatgtgtctgtacaggtgcgatgagcttcttgtacacagcatatagttgagtaatgtttttttaaatccattcagccagtctctgtctttccagtggaaagtttaattcatttacattcagggttgctattgatatgtgagggcttattcctgtcactttattaaataatttctggttttgtatatcctttgtttccttctttcttattgtttataattgtggtttggtgggtttctgtagtggtaacgtttgagtccttttttttgcttatttgtgtgcttgctctaccagtaggttttatactttggtatgttttcatgatggcaaatactgtccttgtgcttccatgtgtaggattcccttaagcatttcttataggaccaatctggtggtgaattccctcagcttttgcttgtctgggaaggactttatttcttctcatttatgagtgataacttggatggatatagtatctttggctggccttttttttttcttttagcactttgaatatatcatcccattctctcctggtctataaggcttctgctgacaagtctgctgttggttcgatgggggtccacttataaatgactagatgcttttttcttgctatttttaggcttcaacttttgactgtttgactatataatgtgctgtggaggagaccttgaattatatttggatatctctgagcttcttatatctagatgtctaaatcttttgcaagacttgggaagtttgcagctattattttgttagatattccatcttttttgttttctgtttgtcttctgagacactgaaaatttgaatatttggtcatttcatggtgtcccatatgtcatgtatgctttgttctttcttttctattccttttttaaatttttttgtcttactggattatttcaaaagacctgtcttcaagttctgaaattatttcttctacttgatctatttgttgaatatttcaagtgtattttgtatttcatgtaatgaatttttcagttccagaatttctgtttgtttttttttttataatgtatttttggaaaatgtttcattcatatcctgaattgcatttctcatttctttgtattgtttgtctgtattcctgtgtatctcactgagcttccggatcttggtctgttgcccaggcaggagtacagtggtgcgatcatagctaactgcagcttccaactcctgtgctcaagcaattctcccacctcagcctcctgagtagctgggcctacaggcacacatcaccatgcccagctaatttttatttgtattttttatagagacgaggtctcactatgttgctcagactggtctcgaactcctagcctcaagcaatcctcatgcctggggctcccaaagtactgggattacaggtgagagtcaccatgcccagtgttcactgagttttaatatcattattttgaattctttttttgggatttcataaatttctttttgattggaatttattgctggagaattattgggttcctttgtgggtgtcatatttccttgatttttcatttcttgtgtccttatgttaatctctgcacgtctggtgtaacagtctcttctagttttcttaatttgctgttgtaggagaggagtttttcctgagggtgtgtctatggtgttggttgtgcagggcactttagctttgattctcattgtgtgcagtagtatagtctctgtatgatttctttggctataagtcatgtttgtggtgtctgtgatttcctcagtatcttagggtatggtggaggctgtagtgaggttttgctggggacagggataccaggttggcctgtccttggtcccagtggtggcagtagtggggtgagtatgcctgcccttgggcctcagtgcagtatatgctggcaccagtgttagcaggtcaggtgggttatttttgggggacctccttgtagcttgctcaaacgctggtagtggcagtggcgaactgggtgggtgggtgaattcttgggctcctgggcagcaggcatgatatgggtgatggcagcagcagtggcaggacaaccctctggctcccaagcagtttgcggctgtgatgggctggttgaaccagtcttcaggcccaaatgtgtacgcaattgagtgctagatgtggcggtaatggcaggttgggtgggcctgacctcagatgcccaggcagtatgctcaggttccaatagtggtggaatgggctgcgcagtccccaggcctcaggatggtttactcaggaactgggtaggacatacttcagccccccccggggatgcattcaggctctaacagtcttaggtaggggctgggtgattccaaggccctggcagaatgctctggtggaggcagcagtggctatactgcagccctactactggggagagtggggttgctttcagtggcaataggtatgccagcggctagggagtgcacactttgctcactttgtccttggcgcttgtgaaaacgtgcagtggcttcactgctggaagcagcagggtctttgccaaatggtttgcacttcatccctggcagcagcagctagctgctgcaatggctgtggtgaggaatatcagtggggttccagggatgtgaagaagcagggactgttgggcccccagcaggatgcagtctcctgaggactgggctctcagtatggtgtcttcttgtagctgccttggactccaggggtgtgtgggacccatcacgagctccctccctggagcaatgccttctcgccatctccaggcagctccctctgttagcctcaaggcctgtgagggtctagggctctgtcatggctggaattgcagaagtgcatggtaggaatgtggaccgctggggatcgctcgcttcccctttccccacactggggaacctcttggctgccttgcctgactgccctctccttgcctgctctaggtgttttctgtcacttctctgttgaattcgtgttctctgttagatgatctattcaaagtctgattcttcctcgctattttggttcttctttgtagaggaggtaagtaccagatgcctctagtcagccatcttgaagcccctcctctagattttgattggttaactttttaatgtgaaaatataactattaaaaagcatgttcttcattatatcacctaaactcattgtgatggccctttgtgagatagagctctgacagatgggtattcaggaggctgtgtggtagagagaagggaggggtggggatggggcaagccaactttccatctctgctgtgagcctctgcctgtcaaggggccattgtctcggggtaccaggaagccatagagtatggctggcaggggcgatgcacagtgtactgggcatggcctcagggtggactcaggtgacgtgaggtgactgcctgttcaggacgttgtgtcctgtgccaccactgcccccacctgcaggctgtcttaccatttgacaatatgtctcatctctaacatggagacaaggaggccatgcagagtttacgaggattgcacacattgagattttgtccagcacctaactgtgtgccagaaattgtgctttgaatgctgaaccaaacagcagagggaagtacgcagacctctatacgataccacggatggagagaattcctacaaagggaacagtaaggagcttaggtagagaattacagggaacccaagttgaaggactgctcagagaagatgtggctcaggagagacatgtaaagcagatgtgagaggtggaaaggagccaaccaggatgaggttaaactgtagtagaaagatcatttgtcacctgcttggaaagtccagtactttagatggacaatgaaaggcatcttcagtggctgggggtgatggctctcatggcaccctattgcaggtggctgtaaccacaagattgtgttgactgtggctgttcatgtgagtactttggcctaaaatcctatagaggctgattgaaattcgcagaggaggcttaaacccactctattcagctggaatttctttaataccaggaattggcctaggctaggctaatcataggggctggactttttggagcctctcttgatgcctctcagaggaagattgtggtgcaaaaagggcagtacatagacacaatgttattttatccccagggaagccttctcattcaaccctgggaatcaaacttggtccaggtgacacaatttcttgagcaagttcatgattggcagcacttaccccagggagaaggcagtggaagcccgtagcacgagtatctctctgccagccccctagccagcctggctctgtaggctctggcagttgcccaaggctggggccttgcagactgtgatatgtacctcttgttaatcaaatattcctgggtagaatcagactggacatgtttaatgagcaattacaatgattgctctattgcttggcaagcacatctcaatgaatttgagcactaaccctcctaggcctcctgaatattttccggttattgttgccattagacagggatgagatacagcagaatgtcacgtatcagagggacattccttacaaggaattcttgctgacccacttttattacgcgagggcagacctggatgtgattgtcaagaccagggtttgcttctttctgtttctgaatgcagagttgaccagtgacacgctcaggttactcaaaacttatgggttacaaataaggcaaaatgtgctttcttaatttattctgaagaaaacagctgtcccaaaacaggatatttattcctaagtgacaaaaacaaaggatgaattggaggagtttcatggcatcaggtggcctcagcaccactgagcctcactcgaatcctgacagcactgaggcagtgtttccgttcagctccccttttgcaaagtttaaccgactgtctttgcagtattttttcatctgactgttacagtttagtttttggctgaagtttggttcagtctcctgaaggtggaaggggggcaggtttaaaacaatttcccaataataccaagattatttccatttttcactctcattcttccacaagtatacagcggagttccagaagctaagcaacatgcaggatagcatcttccttagctggtggaatatgttcctgtgttttaagatgttctaatatagcaaagatggagagatggaacccgtgtaaacaaaagctttttgtgagggcctcagtaatttttaagagtttaaggaggtcctgtggccaacaagtttgagaatctctgttgtagaggcacagtctccccagagggtagctgtttagttcattgagcaaatgttccctaaacacctagtgtgtaccagaccaatcagcaacagcttctaagttaacatatcccagtaacatcttcttataaaccttgataggtgcagtgaaagaaatgaatagggtacaaggatatgataacagggatgaaaagccctttctcctcagaaaggaggaggggccatcatgctgggttggaatgtgggagtgttcctgggaggaggaggaggggtgggaaaggccaccagttgccgggaaaggagggcctaggcctagaggaagtgagggtcatttttcctgcctgccatgtttctgtcagtagtatactccgcggctcagggttcgctcttagagttctgtgcatcttgggccagggctggccagatgagtagcctgagcagaagctgttttcttcccaggtgggtggacggtggttaccttggttggaatgaggcattttgtagcagatatgagacctgcaggtttactctctaggtcatcaagaatcaagagtggtagtcacacggaagtcttgttccacactggaggtgtgcctggagtggtgtgtgctgcatttctgcatctcccttgactttatttgatcctagtagcagccctgtagattgttgacctcattttttaaatgattaaactcctgctcggtagtgtgctcagtggactggccccagaacacagagggaagactttggggtcaaaagccagtgctttggccactgccccagaattctctcagaggaaatattttattgcctcttggcaatgaaaatgtatttcgactatatttgaaaagttcaatatttaaaggaaatcaacagtattaaagggtccttgtgagtgataagtaactcacaaacacagcccctttcaccgtgttatttctggtgattttggatttttatatggttacatctttagtttctgggactgtgaagccacctttgctcagaaatcattgtcttcaatgtaatttattgaaaacaaattatatttgcaagatcctcagctgcagcatggaggaagacagtcctgaaaaagtcccttcagctgtggccttctgtcccctccaccagtgctgtaatatattcccctcattgttctggggatttattgctactcaagtaattccgactccctttaaaaggccactgtagaaaagaattccatgttagtgctacttggcgtaagcaatgctaatgagagtcatttataatggatatcattttagcattcagtagtttttaattgtacatgcttctctgtaagtatattgtatatacttacttttttaatggtcagttttaattaattgcctttgtgaaagcttgttcttggcacagcccttcataagagtcaacatgtatttatcagagcaagccacagaaaagccacagaatggcctcttttcttttaattgtggctcatttttgaagttgaatacaactgggtatttatcgaaagcagagttactcataatgaagcattggtttgacagagtaacttctgtgctaagcagaaagtttgtcaagatgtaatctcagtctgcacattgcaatatgtaaacaccaagtgagtttatctggctctgtggtatgaagtcaggcctgccgagttgaccgttaggagcagatccctatctcttagtttggaagtgggagggcagtaaccgctagcaatctcatgagcaggaagcacaaataaaaaagtgatctggtgagcaagatttctaaaacggcccccaaaaatgtccccacaattgcctggaacctgggaatgcattgctattattactcctatgatcatgttgtgttgtgtggcacagttgaccttaaaataagggagattatttggggttataaatacaggcccaatggaatcccacaagtgcttaaaaagcagagaacgttctctgactggtggcagaaagggaagtcagagagattgataccgcaagtgggctttgaagatgggaaggggtcatgtgactgcagatgcatgtggcctgccccaggtggagtcagccagcagacgggccctcagtcctcaagctttagggagctgtgttctgccaacaacctgagagaatgtgtaaacgcagtcctccccaggcctccaggaaggagggagactgaccagagcagagagtctcagcatgcgcatgtagactcctagtctgtgggaactgtgaagtgatacatttgtgtagttttaagccactaagttttgtttacatagcaacacacctcttatatgggtggcaaatgctttccatgtagaggaaaaccttctttctagagatctgtaagagccatttgcttctagagcctctgggccaacagccaacatgaactcttgatttagccatcttcttcttttatttttttttgataatttttattttctttgtagaaatacagtcaggcagtgactttcaagtgactttgaccatgatccaaagtaagaagtagctttttttttttttttttttttttttttttgagacggagtctcactctgtcgcccaggctggagtgcagtggcgcgatctcggctcactgcaagctccgcctcccgggttcacgccattcacctgcctcagcctcccgagtagctgggactacaggcgcccgccaccacgcctggctaattttttgtatttttagtagagacggggtttcaccgtgttagccaggatggtctcgatctcctgacctcgtgatccgcccgcctcggccccccaaagtgctgggattacaggcgtgagccaccgcgcctggccagaagtagcttttatattgaaacccagttcacttttgcatacacatctgagagacaaaattacctcaaaagactttatcctttttatgtcagatacattctgacatattctattttattgtacttttaaaaacataggtcatcacccactacattgatttctttacctgtcatcccaaagtcggaaagttgttgcagttggttgtgcttctgcagttttgttttactttttaaaatcatcaatcacctgttattttaagaatgaatttctgtttgggaaatgttgctcagtgtaaagtggcattatggttttgtgggtctctgtgacaagtccatgtccctccatccaggttccctggtctccctcctgagtagtctgtgcagcaccagcacagatggcagtggtgcctctctctgcttgtttcactttgtgtgttcattactggacataatgagaacttttcccatttttttaatgattgctgatatttctttctgtagatggaacagtgttgcctcagctccaaggtgatgggcatttagggtgattccagccgtttgctgtcacaaactagtgcagtgtacaaacctcttcccgcaggtgtgtgaggatgaattcctaaaagaattgctgagacaaagtatatgtgcctttgtcatcctgagggcagttgtcatcctgtggaggtttaccatttgctctcccaccagcaatgtataagcatacctgcttcccaacacttccgccaacacatattatttgattaattttcttggctgataatggtatctcattgtagttttaatttgtatttctcattgtgagagaaatgaagcatcttttcatgttttgagagccatctgtgcatcttttcccattgtttctgttaagtcattgatttgcagtactgtaatttgtgatgagttgtaaacatgagctcttctggcctcttaaccatccttatccagcctgtcttcacgttcctccttgcctaaaaacaagctcactcaaacagatcattcctgtggccctctcccttttgaaataaatcagatgggcaaatttgcttttgttaggggcctgagacccaaatgtttaaaagtagcttagctgatgagtgaaaaggaggcccagttgggggttgcacagaaaatgaggggcgtgggtaatagaggaggctgggcagtaacctggcagaaggcgccagaggccaaggaaggtgcgctggtgtcctgcagtgagaaggatgtgtgcactatcaactgggtaaacacactgctatagctgctccagcgacagcaggcactctcagaagggaactgagaaaaggggaatgccagtttctgccaaggatatatggaaaagttttttttccccgtatgttctttggcaaccttgttaaaatcatttaaaatggtgaatttgataacaaagccagccactaaaagacttggatgtagcaaaacaaattgtcaaaaagtatttatcatttctaagaaataaaataaactgggatttaggcttggatagaaatccagaggtttgttttggcataattaattacaacatctgaagaagggaggatttttacaagaatttttttttttgtagtgagattgctttatattccttttcatgactggagagtctgtcatttggcaacccgcaaagaacttcaggaacagagggcctaagttttcttgacacatttggatttttgcatgatgaacatttgcacttttattagtaattgtcgagtcgtgtgtggtctgatcctatggagaggagagtgtaggtgttctctggagctagtactgcccccggctcacacgtgccacactgcctgctgctttcagaaagagcaggacggctggtcctgtcccatctagtgaggtcctgtcccatctagtaaggttctgtcctgcagagctcctaagaggggattgctggcctttgattacactggcttccagaatctgaccatggaaccattatttgaagctgtcagcttcattttgttgttgatcaggccagtcttttaggtctttgttggttgatagatttctctcaggtctatagcagcaacaaataaagctctttaaaattattttcttgaccattctgcctatggattggttctgacctttgaaatgtttgctgtcctttagatcgtgacagaaggagcctcttctgggagctgtgaagaccccacagatctcactggttttcttgcttttattggaagagttagcatttgttgaagtttatatttatgtaaaataacaataagtagattttaaaatttttctttaaattctgtgatctaataagaagagagactctttctctgtcattgggaggcttgatgaggatcggacatacctgctgagagtatcctgtaatgttttcataagattggaaatggtgaaatgagagcagaaatgtaggcagaggatgccaacgctgtttcctatttcctaagtaaaactgagcagggcagaatctccccagccctgccagaactcccttcctccttgggtccgctgtcactgtcatgctggccttgacatctgctacaagtgcacacacatggggaaccacacagggaagtgaacacatgtcctgacgtgtgtgtgtgcctggtgtggctgcttccttgatccaggctttgttttgttacgaggctctgccctcctaccttcaggccttgctcctcatcatgggcatgcaaggatggaatcgttaccccagagtacactttttgacttggattacttgtagtttagtactggagttcagaactttaatttcccatcagaaacctgcctcccggacccaggacactgaccttgattgggcacgattttccagataagaccttacctcctcccaacagggtttgccttcccttcagaatacaggaaagtacacgtggttccaagaggaccatgctcttactaagataaaagggaggagggtgactaggtactttcctctgctgccatcccttgaaggaagggggcttccttcaatgcctcatcagttccagggagtatgcttgacccagcaacacagaggaagaagtgacctcatagcaatgaggggcaagcatgtggatattgctgggtatttcttcctcaaagtctacctggggacaggtgatgaagacgcttacttctctgcaatacaccgtgatcaggctttggtcttcatgacacattttagccttgcctatgtgtgttgaacagagctggtcatcctcagaaataaaagaagagagcaataagtacaggaaggctttcagtcccagaatagtgttaggactaaatgtcagagaacagggggactgtaggagtttggggaccttagcatggataccctctcaatctgctcccctgtggtataaacagtaaagcccattgtactaaaaggccttgagtgcttgtctctggggcaggtggagccagtgatgggtgccccgagaggaggatgctggagaggggacagtgtctaaggcagttggagaaaaaggacaatggcttatgcagtcaggcctagaagatgcaagggatgtcacagcatagtgtccacaggcatccctagatgtctttcattttgtttcaggaagaatattgacaaaggtagtgatgggagggttatttcaaggatgctattttcatgtgtccaagtaaacttaagattcctaagaactttgacctctaatgcttttaaagaccgtgtacctcatgcccatatgcacattcagttagaaaataaatgtagattctttggtgaattcgaagatgtgctcatggagtggcacagcgtgatctcagtgtacacatgaagcatgctgatgagagcttcttggatcttgtttcttcaggtggacttgcattaaagtgctgttgaatctctgcactgggagtgggagcagccatgcgatgggtgccttaatccgagtgccatcctggctctctccaggctgcttcatttgctgtgaggggtagggggaggaggagtttccaggcaatggccttatctgttctggtggttgaccaagggtcgggggtcccaaaggtggagttccaggatgagagtgcacccttggggatggtacttagaaagagtggggactaggcctcagccagggaatggtgggccagggtggagctcctttgtatcaaggagttagggccaagggccatgcaggtgggcctgcagaaggtgggtggtgatatggcctttctggtgataacagactcgtggcactgttttcctggggctgttggggttgcatggagcagattcttactcaggcttactgtcttaaggagggaagaatgcttttttatgaatacgcataggtctgtggggctgtggagcctggggaatccgaggctggcgtgggagtctggggccctctagcggtggtggtgcatcctcagctcagtgccactcactgtccctatttctctctgtccatttctctcctcactgcagtgcttcctctccttcctagatttttttctctaagtttgactattcaccaccccagagactctgttctatcccatgacctcttgctgtactttctttcaaatctaaattttcttgattatttttcttaatttacagtttcaagattagatctgttgggagcattctgtgctctacctcagcccctggttgagctatggattggtgtcccccatggtgacgtggtctggactcccttttgtgtgaagagctgtggcagggcagtgaggttttgtggaactcagggagcatctggcactatgtatgaggttgtgaggtgggagagagctcttaaatctaccagccttgttgatcttgggaactaggagagagtgctagggaagccagtgccagcaggcctggagcctcatatttctttggcatttgtatgataccttctagtacttcgttttttgacttatatatgaactaactcaatttagatgcttagaaaataaacggccactggacctgcaagagattagtagtggtgttccatagccttagacatttcttacacttttatccacagataagaaaaaaatagtgatatttgatttgttttgccaaggcttagaaggatctaatatgtgttactcgttgagcagcgggaagcagcagacatttctagggtttctccctgtcaccattcaggagacagtgcacacaatccccttggctcttacctgaacactgaccacaggtctgtcattgcaggctgggagtcctccgtcagcatcagctccggctccggtgtcctccttctctcgcacttctatcacgccatccagccaggacatctgcaggtaacactctgcttcagatgctgccatgatcagtgtgcagccagaaataagcattagtgtctgtaggttcttgaatttccatttgcttaatcaatctgcctttggtctaaacagttggcgagttttatgtgtggtttgctcaccaagttacccatgctagtctcatttcttcactatgatgtctattctcttttaaaattgtttttactttctgtgcttttatcccactgttctgcatgcagttccagtgcagtgttttctgagtgttgtcaccacagttccgtgcagtctgctgttgtctcgaaagctcctcactgccagagttctctgacacaagggctcactgtgacagttatctgtaaggacacattacaggcgtcaaagagaaattcctttggttcagaatgggcccaggccttgaagcctgctaagaataccaaagccagaagaacactaaagttctcaaggtccctcaatgatgtgggtgagaaggcgcaggatacttcagaaagttttgcctatgtggaaagaacttgttctgaagggaaattaatactccctcaagatacgtgtctcagaactaacaggtttcatcataaagaaaaaagaaccctgaaccacaaacctcttggcaattccaaacattcttgtgtttcatgcctttctgccggtcgctcaactgcctcagaggtggaagctggcaaggggggcaggcccggcctgctgctggaagagaaggcggatggtgaggccacgtcccgaagccggcaactgctccagtacctgttctcactctcgcacggcttgagcgccagcagcctgcacaggttccatgagctggagagctgcgctgctcgcctgcacactgccaagtcctccagcgggctggcagggagtatgggcttctgctctgacgagatgggagacgacgatgtctttgaggacagcacatctgcaaaactgaagagtagggttctgcgggcgcccctctgctccacggaaaaggacagcgacctggattgtccttctcccttctctgaaaaattaccccccatatctcccgtgtccacgtcaggggatgtctgcaggttggtttgccaggaagtgccattctagccatctctgctcgcatcaggaacctcctcttgctttagtatgtgaagtttcaggaaaatgaagtaataggaagttgtaaccagttgtgggttgatggttttctccagaagaatggagtatcaatatcgtttgaaaaacttaatttttatgatgtgagtcccaagatagttttacaaatgataaaagaggaagaagctggctgggcgcagtggctcacgcctgtaatcccagcactttgggaggctgaggcgggtggatcacctgaggtcaggagtttgagaccagcttggccaacgtggcgaaaccccgtctctactaaaaatacaaaaattagccgggcgtggtggcgggcgcctgtaatcccagctactcaggaggctgaggcaggagaattgcttgaacccgggaggcggaggttgcagtgagccaagattgcgccattgcactccagcctgggcaacaagagtgaaactctgtctaaaaaaaaacaaaacaaaacaaaaaaaaaaagaggaagaagctacacatattaaaggccaagctgactcttctaaactaaaaataagtagactttgcataaagaaactggaagaaagaaactagtatcttcagttttccagcctgatggtccagattttaagcattgttgcatctcccagcctcttttttaacccttgctccctacctacccccaaaaggtgtgtggggactggctgttctccagtagctccttccttccttctttttaactgaggtgtagccacctatgtcccatcctaactctgtttcccccctttatcttcccttgtgcagcatccttgtctggcctccataattcactttttgtcatgactcttgtgccctcctcattctgacctttctccagtctccgctccttagtgccagctgtcatcatttctaacatttggatcagagatcccctcactaaaacagcctgagagcctggctccttccaggacgagtgccccaacctgttctctagctgctggaaaagacccctctgtttcttaaaagcctgttaagttccttcaggctagtagctacaccttgttgcatacttccttggaaatagagagtgctttcaaattaatttctcacttattgctattagtggtcccaagaaaaagagatgaaattgcagcatcttgtaatggtgagttttttaggtctaggagagaggtactgtcatctttgtttacttgctgagagacgacagaaatgtgtagttgtggggtatgaaggtaaagtcagtgattatagctaaaaagcaaacgtcatttaaggtcactggtatttttggatgttggaatgcaggttttgttttacatagaaattttccctctaattattttaccatcttatgttctggaaaatgattccatgttgctttaaattcatctttcagtgaagttcttatttcttaccaaaaaatgacagctttgtcatttcttacatcgttttttcctttctgttgccaaatgccctccagactttccatgttggtgcggtaagctagacatttttagtttgtagtgattgttttcgtttgtgtttgtatgtttttgtgcccatagtcacttctgtaatgttcgtttctgagtttcctttggggggattaacctgccactgaagtgtcagcttccctgtcatgggactgtccttggaatgacaggttttccttccaccataggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaagtacgtgggaggaagggatgcttcacccttcctgaaaccagtgacccccagaaagctggtgtctcagatcatgaggtcatggcttgcctgcgttcatttccttaaaaagctggggctggtgcttacatttgcattgtagagattgttgtttctggtgctgattttcaagtccctcttctcaggaagaagctctttctgaccattcataatccttcttttcccttcaaagtaagactgcttgcttgtcggtgtcagtcctctggcctttgactacagactgtttgtgacatatcttagcacctaattttatacatattaactgttgacgtcctgcttctctgattaggactgtctgttggagattagtatctccccagcacccagcacagtgtagcatacagtaaatttatttgtatacacccatgataactatttgctggatgggagtgtgagtaggtggatagggaaaagaaaggaagcacaaacgttgcgtgatgtgcaactgtcttcagaaaggacccacaggcattgcatgacacgcagctgtctggaggcccatgtcactgctccctctgagaggagctttgtccgccacactggcttcctgtttaaattttgactgtttcatatatctctctagatgcccagcacaaaaggttttgtctggaagaataaaaaactgttcctatctcagaacattaatatataaattgcaagataagtcacataatcaaatactagccaattaaatgctaaatggtgtgctggtagagcataacagtcattcagaaaaggaaatgctcattatgagctagagtgctggggaagtggagcgatggtagcctcatagggtgtttgggttttagagcagttcttgaaggatcactaggatttggaggcagagtgcaaggagtttagagaggtcaggctgtctgtggagtaaagcataccctagaaaggtgaaggtgaacattgacagggtgtcaagctacgtgcgttgtaggaagtagcagggagcatggggcactgaggcactgactctgtattataggtaggaagaccagggaacttgctagtgtataaaatcccagcagaaaacaaccagatttagagaaggcttgtgcaaactgcttaaaaaaatgttttgcccagtagaaaccttgtaatttattgggtgcctactctatgctaatctctcaacatgggaagtccttgaggctctattttcaactaccctgcatagactcatctggaaagaggctgtgactagggttggcaaaggatatgtgcagagtgtttacacattgttctttctctctacctttatgtgttttctcctgattcggaaaccagtaaatgaaaaagaaagtctggctatttggagtaaattaatgagctcctagaggagatgggactagcagagtctgcttgtaccaggaactcttagcgtcgatttcgagctgttgctgccaaagtagcaaggaccaaagagtgagcgtcttctgccattcaccttcacaatgtagtgtgacccatctgctagtgtgttgtggcatcatcaaccctcttcttccgctcgtccatgccagtcagcacatcagggagacttaaaacgtagtacctgggtcctgggccaacatactgttttcattaggactgaaatcatagaattctttatcaggccatcttatgtctgcttgcaagaataagcagacaaggggatttttgatggtagttctgcattcatcttgatcctggcttcttttcattgcatagaaagttggctgcacctggtacctggttgaagccaagtggttttaggagaacaatacttgggggaatgcatctagtttgggaagggagaagtggggtggaaagccaatcttacctacctacaatgctctcaccccaccggagcccttccccagaagcctgagcctcacactctgtgttgtctttctagtgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggtgagttctcaggctggagcaagctcagcatgggggccgggatagctcacaggagtcctggggtcagaggattttccagttagccaaaaacgtctgggtttccggaggagggacatcagttaggaggcactagcctcctttttggcatttcttttgctgtggtggtagtttttgaaacccagtcaggagagttcatattctggagcatgagaatctccgcaaactacatcctataaaagcaggaagtagctggacactgtcttccactcttctttgactgagcaacattggatgagttgtgaatccattggtcagtggtgcaggcttgtggtccccagatacttgaggctgagggatggaggattgctgaggctcaggagttcaaggctgtagtgtgccatgatcacacctgtgaatagccactgcactccagcctgggcaacatagcaagactccatctcttaaaaaacaacaacaacaacaaagaatcagttgattatgggaagttcagaagttgtgtttttctttacttcatatcttaaataaaatctaataggctgagtttttcccttccaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgcttttgagcctgttttatgacaaggtgttactttgtagacctggcccatacatttcttttttgtcaacactgaaaaagaacagtttctgagatcgaaatggaaggaaaggaagtgagtaatgacaacaaaactgaatatttaaaaaatattcctttatagttaaatctctccagttggtgttggcttcacattgaaagagcagccatgtgccaccctggccggggtgtgtgcactgcatgcaggttctcccttgcatgcaagatgggtgctggcccactgtgaggcttctgctcggggaagttctgtggagtcactaccagggccaagaggcaggtgggctggctctgggacgagggccaggtgtgagcaaactgccagggtccgctgtgccactgctccccggccacatgcccgcccagctgtcgccttaaccagactgaacagacaggatccttcagggcccttggccccactctcagtgcattctgtcatcagggattaccacctgtaccattttcataaaacaaaaccaaaatcactaccatcaaatggccttgtccctctaaaaagtctgcttaaaattctgtttttaaaacccagtttcctagttttccaggcaaatagttacctccgggaaagttgctgggggggcctgaagcacaatgtagcgcagatgcttcctttccaggccattctctcacccagcctgcacggaggagatgggagatgctgggggtcctgccctcagtctttttgggccttaggcgtttcgttcatcctgctaaggggatgaagcaaacacgaggtgattcctttgcctttcagagtggaagccctggagtttgttttgaaggccaggaggctgaaggatctctaagctacggtgtgggcttaatagcagcaggctttgtcctcctgtctcctccaagccagtgtctgattccttggcaacacaggtcttagtctgtggagtggctctgctgtggccttcctctggccgggcaggcactgtccagccatagccagctcctgagaataggtcagcctctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagatgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctttaaaaag

SEQ ID NO: 649 - DNA, 23008 bp, Homo sapiens
gagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcggtgcgtgaggcgggcggccagggcacggtgcgtggggtgcgccgcgggcggaggggcgtggcgagtggacggtatgtcccacgggaaccgccaggcactgacggcgtggacggctgccaccgaggcgcagggcgggtgctgcgcgtctcactgctcggcgtttggcgttagcgtagctcccgggcctgtttatggtttattcctaggaacccttgtcgcgtgtccgttttagacccatgtacaaccccacggctctcttgagataatgaaagtagcactattacgttataaacagagacagcagcacttaagaataagaacctaaattaacagattgagctcataatacatatactaatttatacgtgatatgctttcgtcacatacaatatgtgtgcttgtcagtaaaataccatgtaaacctaaacagtttctcttagaatcaagctatttaacgttctttacacaatactttacacatatagtgacttttttctcactcacgtggtccacagttgcagtaaacctctgtgtttttcccgctaaaccatgttgccaacacaaacactagtactcaacagtgctggggtttaaaaaaatatgtgtatataaataaagcaaaattcaccattcccctttttattagagattttttaaattgttgaaaaagtagttcagattttggaattatttcataaatgtcataattgtaatgtgctttaaaatattacaccctgcagactacttttactttaattatataatgaatgatctccagtcacttgaaaatgtctatttctgcccggcgcggtggctcacgcctgtaatcctagcactttgggaggctgaggcgggcggatcacaaggtcaggagatcgagaccattctggctaacacggtgaaaccccgtctctactaaaaatacaaaaaattagccgggcgtggtggcgggcgccggtagtcccagctactcgggaggctgaggtaggagaatggcgtgaacccgggaggcggaacttgcagtgagccgagatccgccactgcactccagcctcggcgacagagcaagagtccgtctcaaaaagaaaaaaagatttggccgtgcacggtggcacacgcctgtaatcccagcattttgggaggccgaggtgggtggatcgcccgaggtcaggagttcaagaccagcctggccaacgtggtgaaacctcgtctctactaaaaatacaaaacaattagctgggcatagtagtgggcgcctgtaatcccagctactcggaggctgaggtgggagaatcgcttgaaccctggaagcggaggttgcagtgacccgagatcgcgccactgcactccagcctgagcgatcttagactccatctaagaaagaaaaaactatcttcagatggtcatcaggaatgtgaaaagacatcaatttcattagtcatcaaggaaatgcaaatttcattagtcatcaaggaaatgcaaattaaatctcaatgtagtacagttgcatacccagcaggatagctaaaacgaaaaagagaaaattaccaagtgtttggaaagatgtggaacaaatgcgctttttgttgttgttgttgttgttgttggagcagtacgcactttttttttctttttttaaaattattatacttttaagttctagggtacatgtgcacaacgtgcaggtttcttacatatgtatacatgcaccatgttggtgtgctgtacccattatctcgtcatttacattaggtatatctcctaatgctatccctccccccttccctcaccccatgacaggcccaagtgtgtgatgttccccttcctgtgtccaagtgttctcattgttcaattcccacctatgagtgagaacatgcggtgtttggttttttgtccttgcaatagtttgctgagaatgatggtttccagattcatccatgtccctacataggacatgaacttatccttttttatggctgcacatggtgtatatgtgtcacattttcttaatccagtctatcattgatggacatttgggttggttccaagtctttgctattgtgaatagtgcggcaataaacataagtgtgcatgtgtctttatagcagcatgatttataatcctttgggtatatacccagtgatgggatggctgggtcaaatggtatttttagttctagatccttgaggaattgccacactgtcttccacaatggttgaactagtttacagtcctaccaacagtgtaaaagtgttcctatttctccacatcctctccagcacctgttttttcctgactttttaatgattgccattctaactggtgtgagatggtatctcattgtggttttgatttgcatttctctgatggccagtgatgatgagcaggaacaaatgcacttcttatgcactgctggtgggagtgtgaactgtaaaaatcatgttggaaaactagcagtatttactgaagttgagcatatgcataacatataatccagcactttttctgagtctcttaacatacagaaatatgaatacgttggtaccaaagacatgttctaggaagttcaaagcaagagtattcataataattccaaactaggcacaatccaaagtgtttcaacaatagaataaataaatatggtatcacgcagtggaaatgctacacaataatgaacatggattagattacgaacgtggaagaatgtaacagttgagtgaaagaagccagtcgcaaaagagtacatattgtttgagtccattaaatcaagttcataagtgacaaaactacttcatggcgttagaaatcagggtaaggtggctgggtgcagtggctcacgcctataatcccaacactttgagaggccgaggcgggtggatcacttgaggtcaggagttcaagaccagcctcaccaacatggtgaaacccccatctctattaaaaatataaaactagccagatgtagtggcgcacacctgtagtcccagctacttgggagactgagacaggagaatcgcttgaatccgggaggtgaaggttgcagtgagccaagatcgcaccattgcactccagcctgggcaacaagagcgaaactccatctcaaaaaaagaaaaagaaatcaggctaaagtttacccttgtggggaagggagagactataagagggcttctagagttctactaaggctctgtttctcctttttcttgagctgagggccagttgtgcaggtatgctcattttataaagttcattaaactatatacttaggatttgtatgcttttcagtatgtatgttatacagtcatgttacttaatggggatacattctgagcaacgttaggcaattttgttattgtgcgaacatcatagagcatatgtaacacaaacgtagatgatatgacctactgcatacctaggctgtatggtgtagcctgtcgctcctaggccacaaacctgtatagcatgcgactgcattgaatactgtaagcaactgtaacattatggtaagtatttgtgtatctaaacataaaaaaggtacggtaaaaaatatggtattatcttatggtaccactgtcatatgtgatctgtgattgaccaatgtcattataaggtatatgattgtatactattctttttcttcctccttttccttacatttattggacttcttttctttcaatattcatattgaagactttgaagattatccaatgagaattttatatgaccttcattcagaagttcagactctaaaggtatcactcctacaatattgatttattatttttctgtggcgagtaatttttttatcctaaatagatttagtcagaagttagagaaattaaaatgtactttctttattcataaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcaggtttgaataacttcattttatagcatttgttttagtattgaagaaacaaggcagcatgattaagacaactgtagccttggctatggtttttagttctagctctgttgttatctgacgcttatttgataaatatttagtcaactctcactgtgtggtgtgcttttggagtgctaatcaggggtgtaatataaaaacagtccttgttctcctttccaaaatgccaaatgaaagctagcacaatgctagatttagcacatttaggctagatggcctatttaaatgaaaaactacaagataaatcttcaaaacttgggataggtggtttctagttagccctgccaataaaagctgagagacctcgaggcatgttatttcatttttcttgttcacagtgttctcttctatagaaagagatattggctataaaatttgacgaagtccttttttgattctaaaattttaatgaagggcattctatcatagtggtttagaatttggagtcaaaatgcctgagttcaaatccgtattccaccacttaatagctgtattattatctttgtcaagttacttaaccttgtgcctcagtttctcatttgtaaagtgggaatgtttagtatatctatctcatgagattgtataaggattaaataagataaagttgcttacagcagttcctagcatgtcagtcacccaagattaattattaactgttactgttatgcccatacctctgaatgactaacttcagtgtcttcatttcttttttttttttttgagatggagtctcgctcagtcgtgcagtggcgcgatctcggctcactgcaagctctacctcccgggttcaagccattctcctgcctcagcctcctgagtagttgggactacaggggcccgccaccacgcccagctaatttttttgtatttttattagagacggggtttcactgtgttacccagaatggtctcgatctcctgacctcgtgatccgcctgtctcggcctcccaaagtgctgggactacaggcgtgagccacagcgcctggcccagtgtcttcatttctgttattaaattgaacaagtatgtattgaggatgtgtgtggcaggtaagttaaacagtccatgtgagacgggcacagtggctcatgcctgttaccccagcagtgtgggagattgaggcaggaggatcacttgaggccagggctacataatgagactctgtctctacaaaaaattcttttacaaaattagctgggcatggtggtgcacacttggagtcacagctattcaggaggctgaggcagaagggatcccttaagcccacgagttcaaggccacagtgagctactatcacgccactgcactccaacctgcatgacatagcaagaccctgtctcaataaataaaatacatacatacatacatacatacaaacaacccataccaccaccaccaccccccacgtggaatcatagaattcagttgactttggtgtgaaagagccacagattcaaatacgggctccaccagttattacatgcgtgaccttgggtaatttctctaagttgctttttcctcacttataagatggggataataatatctccctatggagtagtgataatgatgatttattaatctctgaaatgacagcactgtgataaatacatcagtaggtttttggaactcttgtagcaagaactttctgttctcaaaagtaacagaaagcataatgccaaaaacaactcagtgactcagaagctcttcaaaggaacaaaaactatgaaatcaaaatataaaactttagagatttaaactcaagacttttaaaacaaaacaaacaaacaagaaagtatataaccggccaggcacggtggctcatgcctgtaatcccagcactttgggaggccaaggcgggcagatcacctgaggtcaggagttcgagaccagcctagccaacatggtgagaccctgtctctactaaaaatacgaaaattagctgggtgtggtggcgtgtgcctgtaatcccagctactcattaggctcatacaagagaattgtttgaacccaggagacggaggttgccgtgagctgagattgcaccaccacactctagcctgggtgacagagcaagactccatctcaaaaaaaaaaaaaaaaaagtatataacctattaatggttgagaaactgtatatctttgaagtgctctcctattatttttctcaactaggtgttttatataggtgttccagactaaggatacaaacttatctttatatagcagtctttgctatttagctgaggcatctggaagttacgaatctaaaataatatcatactctgtgttaaatctggaacacagttgattccatactgtcatgaaattttaaaatacagtttcaggccaggtgcagtggctcacgcctgtaatcccaacactttgggaggctgaggcaggtggatcacttgagcccaggagttcaagaccagcctgggcaacatggcgaaaccctatctctacaaaaagtacaaaaaattatctgggcatggtggcacatgtctgtagtaccagctgcctgggaggctgaggtaggagaatcacctgagcccagtgttgtgggtgtgactagctggggctagtgtctcaggtggtaaaggaatttaccaagacagttgtaggtagagaaaggcagatttattagcgaaagtatgaaaatacattgcaaggttgcaatgggcagtacagcagagaaggggctgtctgcaaagaggcagaggctgaagggaagttttatagggtcatgctggaggcgggctaggtacagaacaaggttgttgtgaccaggcatggtggctcacatgggtaatcccagcacgctgggaggccgaggtgggcagatcacttgagctcaggagttctagacctgtctaggcaacatggtgaaaccctgtctctaccaaaaatacaaaaaattagctgggcatggtggtgcgtgcctatagtcccagctttggaggttgaggctgcagtgagccgagattgccactgcactccagcctgggggacaaagtgagaccctgactcaaaaaataaaaataaaaaaaaaaaggaacaaagttgttgtgcctgcaggttgtttgtgattagccttttctcagaacagttgttcattgttcgccccaacctggggccttcccccattgttgcctacttatctgtgattgtgccactgcactccagcctgggcaacagtcaaagctacagaaaatatattctgatgctcactgaagtctgagaaagaaaaaaaaaaaagaaagaaaaaatattatgaaaaactagtaaatcacattaaggatgtaagaaaattggacttttatttgtgaatattaatttttcatcttataacacttttaacttgctttccttctctaatgtataatcacaatgagatatgggtgcacaagagatacatgtcagaactttattaaagggacaattgaaataacatttcagctgagtgtggtggctcatgcctgaaatcccatcactttggggggccaaggcaggaggatcatttgagcccaggagtttgacaccagcctgggcaacatgatgagaccccactctacaaaaaaaaatttttaaaattagctgagcatggtggcacacctgtagtcccagctaccccaggggctgagatgggacgatcacttgagcccaggaggtcgaggctgcagtgagctgtgatcacacctctgtactccagcctgggtggcagagcgagaccctgtctcaataaatactaaataaataaaatgtttagacaattggaacttttgctgatttgggaaatttcagataagctgttttctgttgtttttgtaaacgtgaaattttccattttgagtttgaccagaatattctgatttttcctcctagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaaggtaagcagctctgttaaaaggcatattttatctagctttctaaaccttttgtatttattgattttttttccagaagaaataaaatgtttcagacatttttgctttaaaaagttttcagatatttatttatttattttatttcaataggttttaggggaacagatggtgtttggttacatcaataagtttttttttggtttttttttttgtttttttttttcgagacggaggcttgctctgtcacccaggctggagtgcagtggtgcgatctcagctcactgcaaactccgcctcctgggttcacgccattctcctgcctcaccctcccgagtagctgggaatacaggcgccagccaccacgcctggctaatttttttgtatttttagtacagacggggtttcaccatgttagccaggatggtcctgatctcctgacctcatgatccgcccgcctgggcctcccaaagtgctgggattacaggcgtgagccaccgcgcccggccaataagttctttagtggtaaggttttcagatactttatattagagatcttctcaaatcaccaatactatcaataaagtgtgagctgtcagtttcttcaggtgagagactatagaagtgataagggcctgaaaaaaagatatttgtagggatagaagaggaaataagattaaaggggtaaaattagtaagaacttgtgattgatttgctatggagacatgggaaaaggggatgatctaggataaaccccaagtttctgttttgttgcttgggatgatgttagaacaagaaaagaatacctggagtatggggggataggtgatgtgtttacatgttggttttgacattgttagtgcctcttcatgcttaggcattctaatatcagtttaaagctcagtgaagaattcagtgctaaactagatttgggagtcattagcatggaaatggtgattaaaaccgtaagagttacaatgaaaataccacttatcaaagtagccaagcaatgtctatagataaatacttatcattaaaaactgttactattaaagaaggataacaaacattcctgtcaaagaaaaaaaccccacaactctggggaaaaaaacactaaagataaaattttaatccaaaagatttttaaaagagtagaattgataaacctaagaactggtccttatctaaacataaatacaaataagagcattaagaactaaggactatattgtgtgttttgtttgtttgttttgttttgtttttcagatggtcttgttctatcccccaggctggagtgcaatggctcgatctcagctcactgcaacctccaccactgggttcaagtgattctcgtgcctcagccacctaagtagctggaattgcaggcacacaccactacatttggctaatttttgtatttttagtagagacagggtttcaccatggtggccaggctggtcttgaactcctggcctcaagtgatccacctgcctcggcctcccaaagtgctgggtttacaggcgtgagccactgtgcctggcctatgtttttatttttctaagctatcagaaaatatcgtaggttatagtattgggaaatttgaaaatttcagatatattaaagttttagaaaataatacaaaatgataaaaattgacttgaagtagaaaacctgggtagaccagtaatcagagaagaaaactgaaaagttatcagataacaggccaggcacagtggatcgcttgacattaggagttcaagaccagcctggccaacaggatgaaaccctctctactaaaaatatgaaaaactagctgggtttggtggagggcgcctataatcccagctacttggaaggctgaagcaggagaattgcttgaacccaggaggcagaggttgcagtaagctgagatcacgccactgcactccagcctagataacaagagcaaaactctccaaaaaaaaaaaagttatcagataacaagctccaaaaagctctgagcatagatggtgttctggaggaatcctttctaatgttatgtcatgtcatgttattgttttgagacaaggtcttgctctgttcccaggctggagtgcactggggcaatctcagctcactgcaacctctgcctcctgagtttaagtgattctcgagcctcagccacctgagtagctgggactgcaggcatgagccaccacgcctggctaatttttctatttttagtagagatggggttttgccacgttgcccagactgctcttgaactcctgggctcaagtaatccacctgtctcagcctcccagagtgctgggattacaggtgtgagctaccacgcccagcctaacatcattcttgatgttctggccagtgtaatgagataggaaataagaaatatttctgtgttgcacttctaggccattttgtacctaggcaactcaagaaaatcacatgaaaaacgtatagaaataataaaattcaagtaagaggctgaaagaagatatatattttatatagttacacagggcaactatttctttctttatgtatttatttatttatttatttatttttagagacaggttcttagtctgtcacccaggttggagtgcagaggcatcatcatagctcactgcagcttcgacttcctagactcaagcagtcctcctgcctcagcttcccaaggagtaggtgggactacaggtgtggaccaccatgcctgcctaatttttttttttttttaactttctgtaaagacagggtctcactgtgttacccaggctagtctctaagtcctggcctcaagtgatcctgaaggtatttttgaagtaaagatgattcagtaagttatactggaacaattagttaactggaaaaaaaatcaagtcatctctgcctcaagtcaacataaaatatagatagatcaaaaagataaatatttagataaattatttaaaaaataaaagaaaatatagataagttatctgtttaaacagtgaaagcgtatactgcaattaccattatgtttgtaattgcaagaaacttgtaaattaattgacatgattagacatcttaacgatatttgtttattctattcagaaatatggaagggaacatgagtcaggcatggtgattcatgccttagttccacctgcttgggaggctgagctgggagaatcacatgaacccaggagtttgaaaccagcctgcgcaacatagctagatcccgcctctaaaaaaataaaaataaaataaatagactggaacatgaagcatataaagggcaaaaaataaaccaagaaaataattgcactgagggctgttacacacatactaataagaaaccactaacaccaaaagcagcctaggcaatggacaggaatagatacgactaataaatattttaaaaacagttttgtctatcaaaatagtacaaagcatatttgttttaactgttagaagagtacaatgaaacgtgtgttcatatatcattgtcaggaatgtatcatggaaagagttgattcttaactgtttaaaaccttttacctaggtaaatgactattttacctctacgaaaacttaacaaacattttggcacagtggtgtttattacagccttattttaaatggggagaattggaaagaaccaaaataactaacaggagaaagtagataaattatggcatgacatcaaagctagaaatcatactaaagaatatggatagatttaatcacatacaaactttaaaccactgtatcataaaatatttgaccaatgacgaagcaggaaaagtgttataacatgataaatatatgtgcatatatatgttatatagatacataacaggttttaaaaacccatatgcagtaattagtgaaagacagacatcccaatttttaaaacaagcaaagacatgaattaacaaaagaagaggccgggcgtggtggctcatgcctgtaatccaaacactttgggaggccaaggtgggtggatcacttgaggtcaggagttcgagaccagcctagccaacatggtgaaaccctggctctactaaaaatacacaaattagccgggcgtggtgacgggcgcctgtagtcccagctactcgttaggctcatagagaagaattgtttgaacccaggagatggaggttgcagtgagctgagatcgtgccactgcactccagcttaggtgacacaatgagactccatctcaaaacaaaaaaaccccagaagaaatacaattgaccaataagcatatgaacacttttagccttgcaggtaatgaaggaaattcaaataaaaaaatgagatgtcatttttcaactatccagatgcatatttggctaaaacatatccagatgtttttatttccaagttttaactaggcttattaatgttaagagagagaataccaaaaaagacaggttatattcagtgttgataagacataagaaaatgcttttataatgctggtggccactggtgaatctttcttagggaaaattgtcagtgtatataaaagcctttatgaaattttacttaaatgaacaaattcaaggaaaacaaagtgtgcatatagtgttatatatataacactattatttcatttatagttcaaaagttcaaaagcacaaaaattatattaagagtacacaagtagttaaagtaccaagcaaatctagacagaaatttccctctgtagggcagagatgggtaccaagttgggaagcttccatagaggactacacaggtactagtagtattctttctttctttctttctttctttttatttttagagacagggtctcactgtcatattttggttctttccaattttcccctattataaataagctgtgataaatactactgtgccaaaatgtttgttgagttttcttagaggtaaaatgactgggtaaaaggttttagacatttacaaatcaactctttccatgaaacattcccaccacccaggctagagtgcagtggcaggatgatagctcactgcagctatgaactgggttcgagtggttcttccacctcagcctgctgcgtagctgaggctacaggtatgtgccgcaactcccagctaattttatttttttttattttttgtagagatggggtcttgctatgttgcgcagcctgatctccaactcatagcctgaagagatcctcccactttggccctgcaacaggcataagccactatgcccagcccttttatttttagaacttttgtacaacatatatattcttttgtatatgtgccatactgtatacacacttttaaaaaaatgttttacacaatgaccaggtgtagtggctcacacctgtaatccacacctgtaatcccagcactttgggaggtcaaggtgggtggatcacctgaggtcaggagttcgagaccagcctggccaacatggtgaaaccctgtctctaccaaaaaaatacaaacattagccaggcgcagtggtgtatgcctgtagtcccagctactcgggaggcttaggtgggagaatcacttgaacctgggaggtggaggttgcaatgagccgagatagcaccactgcacttcagcctggtggcagagcaagaccatgtctcagaaaaaaaaaaaaaatgtttacacaagatgttaaagacagcatgggtcattatgtttaaattcaaaactggaaacttgtaagtgaaaatcaatcctgaactatcttgtattcagtgatattctctttataactattttacagacatctgtgtaactggctaggacaatgataatcatatgacaggatcagtcattttagtcttaaaaaaatggcaagtttttaatctatatgtgtacactggttataaaattccactttaggattttgaagtcccaggagttacatagttccctttttgaactaataagttgaacttagtggtccttaacctttttgtaccatggatatatattagaaaaaagaaaagaatttgtttcatgggacttctgtaccataaagcataactgaatgtttgtccaaacttgatatttagtaaggttaaatttttttcccagagattgaatgttaacttttttaaccttgtaatttccctatgaatcacaccagtgaggaggccatagatacagaatccaggctcaatgataatgtttttgccactcccagccccatcatccagcagttggaaaaaagtggtaagtataagaatcaagttacttctcaggaacatttttcccaaactatctttgaacaaaattgatttcatcatcttagacattctaatagttttcttcatctgtttaattcctaacattggattacattaagtaccatttcattcagcatgattttgtccaagagaaagaaaattttctggtatgtttttaatactcttgattatgttcaatatctgtcagcttgttattaacattttaatttgaaacttacatattcaccaatattttgatgtagagccttagtactttttcttttaacctattgattagagttgtacattatcttatataaaccacgcacggaatacatcagctgccaatttaaattttggtttcttttaaatagctcagtaacttaaagaaaattttcatacagtgttttcatatttgtcccagcaaacatgaaaacattggtgttcatgaaaaagcaagataaaaaaatcctagagttttatgatttttttgttttgttttctttgagacagggtctcactctgttgcccagactggagtgtagtggcacgatcttggctcactgcagcctcaacttcccaggctcaagcaatcctctcaagtatccgagactataggcacacaccacgacgtccagctaatttttgtattttttgtatagatggggtttcgccatgttgcccaggctggtcacaactgtagacaactcattgcaacctccgcctcttgggctcaaccagtcctcccacctcagcccccacgtagcagggactacaggcttacaccaccatgcccagctaatgtttgtatttttttggtagaggggtttcaccatgttgccaatgctggcctcaaactcctggactcaagcgatctgcccaccttggcctcccaaagcacttcatcctttttaattgataaatagtattctactgtatatatgagccatattcatttgctgattaggaggtagtgttttcattttttattattataggcagtgccttaaggaaattttcccttgtgcatatgcgtgtttctcatatctaggagtagaattgccaggtcaaagggcatgcacatttttacttattctagaaaatgctgaatagtcagctaagagtagctgttaagatttatcttctcactagtggtattgagttcctgtttctccgtcttttccagtacttgatgatttttagacttcagatattttgccagtcagattgtttttctaacatatttaccttttctctttgttgttttttaaggttgcctcgatgatactatgtgttctagatagcaattgtctatatatgcatgggtctctcttgtctatatatgcatgggtctctcttgttcttatctttaatttttccatccctggttaatgttacactgtttttaactactgtacctttggagtaagtcctgccatcttggaagacaagtgacctgttctccgtcttcctcctcctttgtcagaagtttgataattttcttcataaaggttttacaccatttttaatagatatatttgtaggtatcttgtctttcttgctactgtgaaaagtatcttttttcaaattatatgtgtaatagtttgttgcttttatgtttaatatatattacaacacaactatttgttattgtgtattactcttgcatccttgctgaattttagtagtgctaatgataattacatatgtaaatatgagattttcttcctgtccagttaagcatactatagttatagttttttaatgaccattttatgtgtcttttagatgccgaatataccaactctcctttggtacctacattctgtactcctggtttgaaaattccatctacaaagaacagcatagctttggtaactttccataaaattgaaagccacagtctttctcctaaagactcaaatacactactgcttgcaggctcaaagagtctgtttagaagacatggatgaatccagcttttagggatgtatttacagtgcatttctggagggtagcttggcagcataaatcaattgctctaaaaaatatttttcatacctttaaaccatatctctgaattttttctaaggcaaattgggacaaagatttaaacaagttatagagtaaggaacagcattatttataagcacaaaacatgggaaacagtataaatatcgaatgatatcaaagaactaaaacacagcaaggcatatccataagatcaggtgttacatatactatcatgttttgaaaaacagatgagagcatataaaaagaatgttttcaagaaatattaatcatatggaaaatgatgtgtgtgtatgtacacacacacatatatatacacatattttaaggaaaaagtggatagaaacagcagtgtagttatctctgggtgataaattatgggtgattttgtgcttttttcccctaaattttaccaacaaataaatttaatcagatttcatcaaatcaaaaccttatccctctttagtcagtatggtcacttaaccaatgctatagaaaaccaatactgtattagggtatccaatagaattttctataatgatggaaatgttttatagtctgcactgtccaatatggtagcctctaatcacgttattgagcactgaaaatgtggctagtatatctgaagaactaatatttacttctttaaattttatttaattttaattagcttaaaatttaaagagccccatgtggctgtggctactatattggacagtgcagctatggatgaacacagggctgtgttatcagttgaagtatcaggttatctgcctgttagtacctgccatttacaattcatctactccttatgttcacgtggaaggtaccctactgaggtgacactctatcgtctctctctcttaactctgacctgagagagatgaagcgacttacccaattggctgatttagcatgaataatctgcatactaaacttacctctgatctgctttcttccttttgggagtgcatgtggtaacatttgttcatgctgtgattttcgtctgactacactcactgttgcctgagatggggtgggagtatccatctaaatctttggttcattctatatagttatgacattaagcgtttttttggtttttgttttgttttgttttgtttgtgacggagtctcactctgtcacccaggctggagtgcagtggcgcgatcttggctcactgcaacctccgcctctgggttcaagcaattctcctgcctcagtctcctgagtagctgggattacaggcaggcgccaccacacctggctaattttttgtatttttagtagagatggggtttcaccatgttggcgaagctggtctcaaactcctgacctcatgatcggcccacctcggcctcccaaagtgctgggattacaggcatgagccaccacaccttgctgacattaagctttaactcagcctttattagtaatgagatgatattttgtcctctgtatgccatttgttcttgattttgtttagaacttggtcagagaagatggggcatatgggagcctattagagaccccaatagaagtaacaaatgattaactatttttatttactacattatgttatattaccataatttaatggtctatttttattcaataggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccggaagtaactaaaattccagaagatattctccaggttatttttccaggctatttttttttttttttgctgatattcttttcaatatgaaatatttaaagacctgaaactgcatataaactgtcttatttatcattgggctagtgtgctaattttggtgatgagagaatctaaattctgagctgtcaggaccttattttctaattcttgttcaactgtggtttccatgtcgatcatggttccattagaagtgttgctggcaaagtcagaaaagtcatttaccctacaatttcccagagccagggtatcatgaataacataccagtgtttcttgaacttgaaacttcttggacctcagtttaagaaacactgattgatgtatgttagaatatagtcatgtgctgcataacattttggtcaatgatggactgcatatgccacagcagtcataagattatgatactgtatttttactgtacattttctgtgtttagatacacaagtgcttatcactgtgtagcaagtgcctgcactattcaggacagttacatgctgtacaggtttgtagcctaggagcaatagtctataccatatagcctaggtgtgtggtagggtataccatctaggtttgtgtaagtactgtgatgttcacacatgatgaaatcacctaatgcatttctcagaatgtatccctattgttaagtgatgcctgactgtatctgattctttagtatttaacagcagttaccattggcctactaatgacttataacaactgccaattctaaataaccagtctgattctttgacagtccccctccttaataggagttacagtgtttggcaattattacttacacgtgtggaattctttttttttgttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacagggtttcaccttgttagccaggatggtctcgatctcctgacctcatgatccacccgcctcggcctcccaaagtgctgggattacaggcgtgagccaccgcgcccggcccacgtgtggaattcttaatagccattctagaagtcttcctgacttatggagacccatgagaaggataaatcacttcggaaaatactcagatgccattagaactgactcatgctaggatatcaataaagtacttgttatccttttttctctgtcttttctgcttttctggaagatataataaattgcatgaagaaggagcatcttctgtctttatgaaaattatatagtttccacttccctatggttgcttcatctctccttatttctttgtaaaaggaaggaagccttatatttactatatcacccctttatgcatgaaaaaattatagctgatacttcatgttctcctttcataatttttataattgatgaccttccttttgagcattcgttttacatctttcctttgtgtattttccctaacatctttgttaaggcttaatttcctctcagggatatattgctacttgttttcactaacctcagtcagaatacattttaagctttaaaaatcagtccttcacatccaagttaaatttctaatatctccatcttttcattgcagttagcatgtcttttttttttttttttttagaccaagtctcgctctgtctcctaggctggagtgcagtgacatgatctcagctcactgcaacctccgcctctggggttcaagtaattcttgggcctcagcctcctgagtagctgggattacaggtgtgtgccaccactcctagctagtttttgtatgtttagtagagacgaggttttacctgttgtccagcctggtctcaaactcctgacctcaagtgatccacctgccttggcctcccaaagtgctggaactgcaggcgtgagccaccatgcccgccccatagcttttattgaacattttgtaacttcttccaaatttaggttatattattcatatggctcgataaaaaggaatttccttttttttttttagcttttatcaaaatacaactcaaacctagctactccaatagcaattaaagcagtgccacccagtaaaaggttccttaaacatggacagaacatccgagatgtcagcaacaaagaaaactggtgagtatgttacctttgtaaagaaagttcatgtgttatttgaggaggacatttaaaaattaacatttgaccatcctgaccaacatggtgaaacctcgtctctactaaaaatacaaaaattagccaggtgtggtggtgcacacctgtagtcccagctactcaggaggctgaggcaggagaatcgcttgaatctgggaggcggaggttgcagtgagccaagatcatgccactgcactccagcctggcaacagagcgagactccatctaaaaaaaaaaaaaaaaaattaacatttgaatattggtaaaaattttgtttttaattgacatttgccagcttaagttaatagcctgtctctatcttttgatatagaacttgtgatccctgaatctcagattcccgaattatccagtttaatgatatcagtgggaatctatcctcaattattttataagtgtaaaatatatagccacagtattgtgtcatttgtcttaatggcttttaattttattaaattgatatttgttatttgtatctgttgcagaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggattattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaaagagggagatttccaggcctgggtaactatatactgtgaccattggaggtagagacaggtctcaacagttggaaccaggaactctgctgtcaggttgagagttttgtttctcttccagcttttcactgtgtgggggtcttttctcttatgtcagctctttctatcacatggcagctgacctctcacgctccactctgcagcttggacacccagtagaccctgaatttcactctctctaaaaggttctgagggctcatcctgggccaggggccctcctgtgcactgttagctatggccacgggagcctccagagctgcctggtagcttcaggttgacctgcttatcaggcctacgatccttctgatttaagtacagctggaaagtattatctaattaagttcatgatagtgcttttggagaacttgtcaaattacagccaatgagaaaataaggacctagcatactgtggagaaccattaaaaatttgagaagaaacaacaagtattatgtcaacttacttcaaaggcgtagttttgggaatttgatgcagtaaagattaccctgttttatgattgttccttgaaagtcaaatgggggacctgtccattgtgctctattaatcttgtcagaaaactgtcaccaaaacaaaacttgagtttgtccttgttctaggagttactgggtagttgtaagtattatttttattaaatataatgtaaaataaaatgttaagatacttagttttgtttttcaaagtaaagctgtagtcagccttatgtatgccattgactctgaaatgtataccagcctttcactgtgtaccgtgtgtatataaatccacagaaccggatgagctgcttagggagggaatatattcaaagtgtaccaaggaccaaatcctggagttctcccaactttagaggatggaaaggggcagagtaatctagcaaaggagactgaggccagtgaagtaggaagaaagtatttcaaggagagtgatgattctgtgaatattgctgagaattcaaataaaaagaggactgagaactga

SEQ ID NO: 650 - DNA, 142928 bp, Homo sapiens
agtaaaagatgatgaaagccactatcaatcctcactgctgagtggcagggagaagcagcaccactctcagctcttttctaatcttgtaacttagtgctagaagtctctccaggctattaccatgggcatttgttctctgttggagctgtaagcagatgaacccaagtagagaagatagatcttggaaggagagatccattgagtccagaagccagatcagcaaatggaggaacctcggaggtgaccagaaagatctccatcggttgcccaaggctgtaagtagtgatggttttagcgatgaataacgtaattggctatgaagtactgtggcagagctgctgttttctgaaggtgagaagccatttttagctcagagcaacccttaagagaacttttggcagattttgttggcattattgaaatatatatagaaaagttgctgattgcaatggttatgggaatggaatttaatgacatttgtaatttattacactcattggtttttattgattatagtattgtctgactttttattttctactatggttcctttagcagaaaagtaacttttgtgcatatattgaagtggtttttcagctatgaattctttagggtagaaatttatttagcaaatgtgaattcttttgagaaagtatgaagttttgcagaaattgactgtgaaatgtcagagaaaaataaaagtcacttacttgaaacctatttggcctttttgctttataactgcttaaaaatactgagtgaacctggagtaaatatttgaactgatttaaatgttaaacataggtactcatgttatttgggaatattgggattagacactgaacatgtggaaattcattgctcagattttcactggtgtgaacttgaaatatgagtagccttatggcaaatgagtagtcccctgttttctggagccttggaggcttatactgggcaggttgggaggagtgagaggtgaagatagtccagtgatttcttccatctgattgacactttcacaaatagaacttttaagtgacaaagctactataattgtataccgggataaactaaagccacagtaagcgaagttttttctacagcacagtggtccttagcaagcacacctccatgccttcccctttgcctcctcaagccttgctccttgtcagggttcacctagaagatctcaacagggagacatgtggagtcctccctgtttcccaggccagtcaggagcccctttctgggatctttaagacactggggaaatgaaaagctgacctcactaaaagcctggagggttgtcatagtcgaattcttctagtattatttctgtcctatacaattgtctaagtggctttttaaaatgtagctgtaaggccactagtaagaaacaaaaaataggtaaatatggctagagaaggtcccttctgaaataaagagaaccatccttccttaagaagtggaatccagagaagggagggagcacaaaaatttgagcctcagaggctcaagagaacccagttatttgcgtttgcagctcctcacccctgggcgtgattcctgtatgtggaaacgcttgccccttaggacggcctgtttgcaaacatgtttcatccacatttttttatggcatccctgcagattgtagcctggtgtgatggggtctaaagacctacattcacatgtcatatctactactcattgactcagtgactttggataagtcacttaacctctctctagatgtcactcttctcagctgaatgatgaagaatttgaattagttaccttgaagtttaatcgcagtgctaacctttgtaagatctatagttgtgttacaggtgagccatagaattaatagattaatttttttttttaacggagtcttgctcttgtcgtccaggctggagtgcaatggcatgatttcggctcactgcaacctctgcctcctgggttcaagcgattctcttgcatcagcctcccaagtagctgggattataggcgtgtgccaccacgcccagctagtttttgtatttttagtagagatggggtttcaccatgttggccaggctggtctcgaattcctgagaattttggcagggtgatccacccgcctcggcctcccaaagtgctgggattacaggcgtgagccaccgcacccaggtgcttaaattttttaaaacatggggtgcttagaaaagaggttctgagggcctccagtaagatggttttatagtacggtgttctgtcagatttttaacttctttgtatggaactctgggagaagctctttgccagtctgcattggtgttgcctttcatatgattatcttgttgcagctaatgtggatttactacctcccatgtaaaaacctggtctcaaagaattcttactggcccaaaaggagaatgatttggggttaaatcagatcatctccttttctggtcagccatctgcaaacagccctttcatttcatttgagatgaagaaggtaacttttgtatttgggagagtgttagttagcttatttcctttcagacttctctctgcacaaccagggatgatgtttcttcgttttttttttttttttttttttgaatcggagtctcgctctgttgcccaggctgaagtgcagtggcgctgtctcggctcactgcaagctctacctcccgggttcacaccattctcctgcctcagcctcctcagccaggattacaggtgcccaccaccatgcccgctaattttttttttttttgtatttttagtagagacggggtttcaccgtgttaaccaggatggtcttgatctcctgaccccgtgatccgcccacctcagcctcccaaagtgttgggattacaggcatgagccaccgtgcctggcctcttcatgtgttttaaggaacaatttggggctgcgtgcagtggctcatgcctgtaatcccagcacttcaggaggccgaggtggatggattgcttgagcctaggactttgagatcagcctgggcaacatggcgaaaccctgtctctctaaaaaatacaaaaattagctgggtgtggtggcacacacctgtagtcccagctactctggaggctgaggtgggaggatcacttgagcccaggaggcggaggttgcagtgaatcaaaatcatgccactgcattccagtctgggtgacaaaaaccctgtctcacaaaaaagccaaacgaaaaacagaaccacttgggttgatttaacattattttcactgtcactagtcagagatgacatagatgcagtgatactttgtgaggtctttattctggtccaagccttttgggtcaacctttcatctacaccagaagagagattagagatgagaagtctgcctgggtgacacagcacaatcagaatccctgagagaaagaggcagaagaaaacaacgactgtgccctagctcctgcagcctttacctctgctacgtcagtttcctttatcaaaagaggaggggcataatcctcgctatgcacttgacatcctgagatgaaggtgcaacgcaaaaaagtgatgtctcaaaagtgttttaaaactgctctacggagcaaggcagcctcgccgctcacagacccagtgatggaattcaagtgatggcattcagccccttcagggttgtgactgcttgggataattaagactgtcttctaccaaaatctcatttacagtgaatgagaggagagaaaatatcaacccaggatggttactctttgactggcttcctggaaggagctgttctgtgggtccatgtgtgaccattttggttttttcctctcagaatccttcctttattttctttctttttacttttttttttttttttttttgagacggagtttcactcatgttgcccaggctggagtgcaatggtgcaatctcggctcatggcaacctccacctcccgggttcaagcgattctcctgcctcagcctcctgggtagctgtgattacaggcatgtgccaccacgcccggctaattttgtatttttagtagagatggggtttctccatgttggtcaggctggtctcgaactcccaacctcaggtgatccgcccacctcagcctcccaaagtgctgggattacagacatgagccaccgtgcctggcccccctttattcttaaaacacatggctttcctatctctttctaaaggatggttatgcaagacagaattgcttgaaagaacagtctgtatggttcctgccttaaattacagcagctggaggagatgagttgagcaaaaaagcaagaagggcccatagaatatgaagataacccagggagtgggaggaagctgttagaatatgaaggagaatgaaaaccgaaagtgggatcctgcggccagcccttgtgagggccctggcaggtggagtgattattatccttccagcaaggcagtcagagtggctggagagcatgagagtaaaaatagctgccgttacatttcctacagactcactagatcccaaaaattgcagtggccttggaagcatgtttgttcatcctggtgtctttataacagaagagagcaaaggcctccattctctggggacagcccacaaagcccctgcctgctgggtggacagatgggagcgcttggcatggggcctgcccttcatttgagggtgagagtgaaaaaccagaagccctgaaaaatcaagacctgccaccacttgtagatggtaaaccacaataatcatgtctctacagagagctgggttgaaattatcatctccactcaacccttgcacaagtgagtacattgcccagtcaggggaagagaagaagcctaaagaagttacacacaaatggagcaccacaacctcaacgagtcctgcattgtcttcaaaaatggcaggaaaacttggccccagaagcctggtggtcctgctggttaacatttcattctgcttcccctctgagctccagcaaggtttctgggcctctcctctcatcactgggctgctcaggaaatgcaaatgagtttcacttcagcaaaacacagagaaagggcagtgaaccgtcacaacaaacagccccggatacccacagcccgacaaaacagtgacaggcatggtttagactgtgtgttttcaataatggtcccctgggctctcacaggccgagagagtgaacttcaaggtgaaagccttttatttttttgaaaggatatccaagttgatgcttgtcttggcaaggtgtatttagaagtatcatgctttccagcctgtgctgattttattcttgaagcattttataaacatcaattgtgccgtgaagctcctagctagtaaattactaacattgctgattgtactagtcaggttgggctgcagtgacaatgtcacttctgctcagcccgtggccaagactggctcctggccccaccagttgcatggggatcaggacatgtgggacagtatgcactgaatgatttaaaaaaaaaaaagtcaacatggcagaaatatttaattcaagggaaaaaaaggttcttggacccacaggatcagaggtgagcaggcaccagtcaacacaaggccacaggtcagccctggggtaggtcccactttggggacctttaaaaatcctcaaaaacatggtccttgtcactcagattttcacacctttcctcccaaaattgtattccaaaacccgaacatttctccttcttctgaaagtattaatgattcctgcagcttacctgaccaaagcattgtcattattatttcaaggaaacacattttcaacacgtttatgtcccagctgctgactgagctgtggatataaaatggtggctaaaacagacctggtccctccttctagtcttgtgggaggtagcaatgacaatcagttagtcaattgcccctttgacagttttggtctctgtaggtcttaaacatccaaagctgggtgcgtaagcctagacaaggtgatatgtcctactcatttcaaagataatgctttaataacctttggggttagcaccctttgattagggcaagagtccttaatatgaaactataagtccaccccaacacacccaagcacactaggagggagttagcagcagcagattatcccgttgagcgacccaccttcagacttctgagctcacccacaacaacagcacctgcatctgctttccccagctgccgccagcataagcatacacatgaccccttgcttgacttaccctagtcctggctctggctgcaacaaacagttgttgaggcccaggtctatagaaagatacatgtggtccctggccttggagcctaggcatctgagccaggagtcatgacccacaggaaaagtagtgacgcaaggttgtgcctggtgcccaaggaaaatcacagaccagagctgcaggagctccctgagaccttgagaggaactcacgatgattgagatctaagtagtgattgagatctcagccttggcatagggtagagcttccataagctgtccgtgcctggtcagccatttgcaaacagccctttcatttgagatgaagaacacaacttttagggattatttcagttacatagagacaacataggagagcagtaatgtgagcagaggggttttaagggagttcacctgatacaggtatagagaggaaggggaatagcgttttagccaaaggaaagagcaggagtacagacatcttggtgagatggaaatatcatggctttagatcttgatctggtctctgtgtgatcctagcaagttatataacctctctgcaccttgtttcctcatttgttaagttaccgtcaactctgaaatattgttgtgccttaatgtacagtatatagtacagtggcctcacatggtgggtgctcagtaaacaataataagattgctactgcaagtgaattgtgccattccaagaacaaggactgggctctctgagctggcttcagtccaaggccagccttccactttgtacatacaggcagtggccagcaaaacaacccagctccctgcctacctctggcaccctgctgcacccagaacagagcccctcctttgcacacaccctgcagaatacctgccaagcatgcgctccagctctccccagcctgtcccagtcctcaccctcctttagagttatacagctggtgggtggggagctatggaggaatcagccctaccctagccagatccagcctcctagctggcccagcctcctagctggtgactcagcctccaggctcctgcacaatctgtcctccacacctgcatcaggtgaacttcctcaaacctctgctcacttactgccttcctcggacacctcccctatagcggttctagccttgactgtgtagcagaaacctctagggagctttgaacatgcacaggtcacatcccagacctgtcagactctggggaaaagacctgccttcccccacccccatggatattctctaaagctcctcaggggattgcagataggcagacaaagctgggaataattgcagtgggtcccttgtgggggattggacttggggctggggtgaggaggcgtggggaccagttccacacagcgaagtaactgtcatctgcagtatcgccaacacctgggagcctatgagaaatgcagagtcacaggccctgctgattcagaatctacattttaccaaagtccccagtgtttccccgcactgtcgagtttcattaacactggcaccagcttttactaattgctcacggtgctccaagtgcacagccaggtgttttacacacaccatctcatttaatcctcacacccctcagctatgagcaccccctttgacaaacaaggaaaaatctgccgttccttcaacaaatccttcctgagcacccacgtgcgaggctctgtgctagagactgagaatgaaaaacgggcgctcccctgctggggaagagctcagaagccaatgggatgtggatttcaatgtcttcccagctgtgtgttcctgggcgactttctcagcctctctgagctcgtttccttttcctcttccgccgaacagggctaaaaatcacaccgcacagggcttggtgccttccctaagctaagtactcactcaccaggcctggttctagcgggagctcaggaatggtcgctattgtgacaaatagaaaacccgccaggagacagagaggaggtgggtccctggaccgcggtggcacatgagggctaagaacctcccaggaggggctgggctcggagcgcgctctcggagacgcggtgatgcgcggggcccgggccgtggacaagactgcagtgtcctgcactacctgccgcccactcatcaggccgattctcctcaccttacgcttagatgagtttcgagtaagaccactgctggcatcaagagtctgggcccatgatctcgccctttcgggctaggcgaggcagacccaggttggctgcggcccgcggtccccgcgcagccaacactggcagccaagcgcggggcgcgcgcgccgggagagtggagcgcggaggcccgacggcgccccctcccggcgggcccgagccacggccgcgggctctggcgggtgccggggaggccacgcgcgacggcgtcgcagccggagcccagacagacgccccacgctgcgcggccttcatcccacggctggggcgatggaaaggtggtcccgacacgcgcaggggtctgaggaatcggcttcgggattctgtggtctttgtggtccgcagccggcaccactgcttcctgtaatttaattttctctcccgaaagcgttgctaattaaatcctttctccggcgagccgtcgccccccgcccctgctagtctgtttattaagtacccggcacctgcgagggaatttttgccctcggcggccggcgggtcaggtggaggggccgcgctgccccttagctgcgcctcctggcttccttccccaggtctcctccctctctttccacctggaacaagacagcaatccttgaggtctttgagcaaacgcaagaaccgtccttctcctgctgctggtgacctctgctgcttggggcatccaattcatgtcagttcccctcccctgtctttccagctgttcagtcgtattcccacttcccaccaccatctccccgcaccgcacgctggccacgtggaaggtttgcggaatggggcccaggggcttgtggaaggtcacgcagcccatccagggcacagtcggaactaaaactgagccctcttgaagcttggctttcaggggtcacaaactcaaagccttcaggggccagatagccaagggtagagtgtggggtggctctgggttgggcaatggttgggggagtctgtggcaaagtaaaaggtatgtgccccattgagggccaggtgtgtgcaatcctcgccaagtctaagagcgagtccagtgttcacggagggcagtgacccgcccagggtcacgcagggattcagaaccactgggtactccgggttcacagtgtgatctttccaggatgccacttactgactgaggacttgggagcagtcctgctcagtcctgcaccccagccacctcagtccttgcccctctggcctgccctgcccagggtcaccacatcccgcagggcctccttccccacagagtacctcacaccttgggcaccactctcccctcccctctacctaaaatcaccccttcagacagcttctggccacatcgcagctgtcaatcagaaaaagaaggcagcctcatttcaaggtatttggtggcaaatacctcccagaatttgaaacaaagggcctggggagccaaaatactattttgaaggacacattcatggtaggggaatttcaggcatcacaagccagccagaaaggggtatttggggacaggaaggctggggagaagcccacacagaggactgcctctttggaaggcctcagcgccagctctgctcctctctgagttccaggtcagccccctggtcccctcctacacagctttttggccttccatgggggtaccctcacatacaaccccacttcagtagctgtctgttgccctctctggagagtttttcctctgtcatagacaggctctgcaggtgttttcctcctcacaccctactttcattttagagtctttggtggctccgtgtcctggtctgcaaggatgggggtagaagtgtgctgggctgtgcttggccctctgccagggtctggttccctcctgcaggtaccccaacaccgcctgggaggactgccatctagaaagagcttgggcgttttccctgactaggtatcatccttgagcctcagccctgactgtccttagacagtaacctccactgatgctctgccctggaagaagtattttcatccagggcaatctgcccataatccttagctgggaaagatctagggacccccattttcccggcaaagtcaccataagcagttgactgttagctctgcaaggcacaagctgagcctacttcctttctctgtatccacccgtgcctgttacatagtaggtgctcaataaacatgttgaatgaacagatcaatgaatgaatgagtagaaacttggctccttgttaattttcagcagggaatgtattgtgtgtctgtaatattccacaatggaaagacagtctagtgctgtgttaaatagaccttggagcaggcagcctgggtttgaatcctggctctgccacatactagcttcaggctttgggcaaattacacaacctctctgtgcctttatttatttatttttttacctggaacgtcagggttataataaaacataccttgtaggattgctatgaggaatacatgagttaatacagataaagtgtgtacaggacaagcacctggcatgtagggaaggctcagcaaatcttggtcattgttaccagcagtagaatgactgtatcaacaatgttagtgtcctacaccatgctagggacagggggaaactaaaggattccaccatctccatttctgctttccaagggcatgcagtagttaggagacaaaacctacaggagagagtaagagtgacagagagctgccaacagtagtgggagtttgaaatagaaggtttccagggggctggaccaattgaagaaaggtcctatggagaagtgcgatgtggaggaggggctgggaggggcctaggctaaaggaggaggcatgctggggccaccaggttacaggatgtggggaggtgcccaccagggtgcagaggtccacgcagagagctgccttgccagtccagatggggcactgtacataacaaaaggtcactgcttacatctcagggttccagcctttccagttctattgtaagtcctggaagccatcttgctaggaatggtgtccttccaatgccatttgctgaggctgtgcaggaaggcaagagtgatggggagctcccagagacccctctttgggcccagagaagactaggaatctctgatgttcccaggtgagctctagcatctttgggctgattctctggaaaatgaacttaaccttctacctttgatcgccaacctggagacttgcggatcctttagaaaaactagacatcagttcatgcttgactcatccaaacggacaccatgagctggtgtgagttagggttttctaagaagtgatcagaggaaggaggcagggtccatggggagcgtggcctgaggacaaacctgcagttgtggctgcaggtatgtgctcacatcccaccattcctaaatgcagacttgcaattcccagaaaccacctggtatctctgcctctgtatagtccctcctacctccactcccacccacagccctgcttttctgcctggccccctcctattcatcctgcatgacccagatgttgccttttctgggaagccttcaggtccgccctggtaaagtaagtgctctccgccaggcttctgtagcaccctgtcctcccatcggcactttcatgccactgaatcacaaccatctgcaatttgttctcttcctagtgagctccctgagatcaggtactgggtctctttcatctttgcattcctggttcttggcatcatgcctggcatagagtcagcatcgatgaatgtttttgaagaatgagtggaggagctgggccagtaccatgaatagagaggggaatgagagcagaagcagaggccaacaccaggagcaactgagctactcccagacacctcccgcccccaccagcaggctcactgtggctggtgagcaggcccaaggttctgcctcatctttaacgtgtctcagataagttaggagaaatgcctcctctctccctgcccatccttccttttcttcctggcaggaggggctgcttcccaagcatccccgagggcatgctgagaggcagggcaggagggagatgagggggaatctcatgagcaatgaggccagttggaggacactgggtacagacaaaagccacagtatttggaggaccaaatgcatggacagtaacaaggacagtcatcttcctaaggagaaagactggctaacagatggtccctgggacctaaggactgacttgttacagtggagggggacctgggttgaagtctcctcaagtttgttgtctttccaaaactccttgggttcctggagcttagagtgaggcagttcctgccttgcctaatctgacactagggcatgggtcaaagcagagtgtacccactttctggatggaaagcatctcactccagcacatgggcctgaggacccatgatctctattggcactgacagatgattctacccctgctgtgggagtcagagagctgtgctgtaaagaatgactggcagatgtccctgaaccccttcctccatggacgcagagtggttagttaagaatgacaccatcaactgccatctgacgggccaacgacagaggctagtgcatgagatggccctgaaccctagtgtcacaatcttttccaccccaatcctcctaacaatcaccccgttttcaccttcagggccatcttgggccccctccctagcattcctctactcatgctccatgtctgtgaagtgcctctgatatctttcccctctttaccatcccacaaccactatccccacccggatcccggttacatctcactgagatatagtacatgcctcttaccaggtccctcaacctccagtttctcccacttccagtctatcctccaaggctgcgctttctgaaatctacctctgatcatgctgctctcttgctcagaactttcagtggttccctattgcctgtcaaatgccctccaggtcccttagcttggcattcagagccctctctgcttgggtccctactctcagccttaacctcctctgcctctttgtgatatcccttataccccaaggcccaggcctgttctctgtccctggaaagccctccctgtccctctttgcctgctgaaatctcatccatctttccaggccccgtatcatggaaaggccccagacctagcagcagaatgtgctctctccctcctctgagcactcccagaaacctctgccagaatgggaactcctcgaagagagagtggtctcatctgttttctagccccacgatgtgcaaagtgcagtcctgggtccagcatgggaataagagatgtggagtaagcatgtgagcgctaaatctgcatcattcaggcaatattcattgagcacctactgtgtgcctagcccctgctacgcatcaaggatatgacagtgaccaaggcaagtgtggtgcctgccccatggagtgtaggcagcccatgttctagaatgtgctgaggattcaccacagctccattcacccagcacctgcagcaaagctgttcgcctgttggtgtgtgttcagggaacatacaccaccatgacactcggctaggctgagggttctgcaacagctctttgcagttgtatccttcctcagtccaggccttgtgtctttaggatgaatcagaggccttgctcattcgtctgctcagggcccactgcctgaaaggctcaacaccctcccaactgtccccagggctgggaagcctgagacctccagatgttgcagggcctgagagggcagggggcctgactgatccctaggagaagctggctctgtctgtggaggagcagcagagggactctcttcactcttttcctcacctgtcttctgatatggggaggagagggagaggaggagaaagaatggaaggagaaggaggaaaagggaagttcctaggtaagatattccatctctggtccctgtgggtccatggaccccagcactgaagcctctggttaccaacccagcactgaagcctctggttaccaaccagaggtgacacctatttagcaccacacagcccagccctgacaaatcacaatggactctgactgagggctgcagcagggctggggggccccatgcatgtgccaggaatgatcactttagttgctggattgtggagtgaatccagggtccccagggaggagcaggggcagaaggggtaggatactcagagaatctgagccatggttgtttaccaactttcttagttgtaagaatttcttagtattttcaatacttattttaaatatttgaatagctagtatggctgcatcagtacagtccagccctgctaccaacagtgcccatacaatcatatcaaatccaatttaaaaccatatattttattgatgttcttcaaggacaatacagggccatgtgtacaaatgctactcaagtctcacatctggcaacctccccaccgtcatcccccattgaccagtctgcaagcagccaacatcctgtaggtctccctgttgcccttccccaggatgtcaggcctcaccgtgctgagccttcaggaggctggaaatagcagggctggcttctaagcttgagctctggagccaggaaagagtcaaggccaaaattgcccagatcttcccctcctccctctccctcccattgcttaagtatggccagaattgtgggtgaaaatgcccccagcgactcctccattgaggcagcctaggcttcccctcttcagccatctctatcacattctttatttccaaatgacctgccccaccaaccaccaagatggcagagtgaccattttgcagggagtgtgaatcagtgcacagacggcagtgacaaggtgcccctgatggcatgaatcttgtcatcctgttcatcactgcattgccagtgcctggaagaggctgggaacgtagttggcactcaataaatatacgtaggatggatgagtgaaggaatgagtatgggagggagaaatgtgagcaggtggagccaatactacattagctctctagggggtgtgaaggcagaaccacagtaaagtcctcccaatctctgctcaagaacccaggctgttgcgcagctatcagcgggtcactgcagttggcggttggacattgcagggcatggattcagcactgctgcctgcatggatgtcatattggctttgggacccagtcaggagggggcacttgtgttgtccctactcccttatatgccccagaggtctggtcctctaggtttcagaaaacacacagcagtgcctccaccggagtcagtcagatgcgcagggatggtctgggaattgcacccttatattctggtcatctccactcctcagccttagctcaccactgccccccatgccctgccactgacaatgacactgctccatctccctgtcctcaaatgtcagtcccctcaaccacccaggtagccctgtctctgcagagactctctcttcagtggctgggttgggtcctgattttcagacccctcccatgcccacactcccctctaggaaagcaaatatctcacaggcatctctgcagatcttgcctctgggtccagcaatcacaaccaggacatcagaaccttggggttggaaggaatgtgtaagctcacctagaatgaccctgtacagaaatcccttccacagcatgcctggcagacgactgcctagactctgctggaatacctccagtgatggggcactcactaccttcacaggcagccattcaaacattgaagagtttcagctgctggaatgccctttgtatagggcataaatgaacccaattgtccctctcacttctccctttcccctaggcattattcctatatgtttctaacaacacttctcaccaccacccatctctctctctctctctctcacacacacacacacacacacacacacacttccatatggttatacagtcgaatatccccttcatttatcagtaattatctttccctgtcccttcttccttgccttcccatcatctggcaaagacctgggggctggagatcaagtagaaaggctggaagagttccagggacaggaagcatccagccaggtcctggactgggctgggccggccagatggggcagggtggacagggaataacatttggaaaaagcaggccattgattgctgtctcccagaaaaagggtcttgaacctggtggggggtggtgagggagcagcaagctactaagttctttttcctacagaggggatgcggacacacacccactctttcccaactcccctagcagttggcagagctgacttggctgcctcttacacgtggtgattttaaacatttgccagcctctaggtcccagggagtctcataccagcagcaagaatccactcccctctcccaacatgggggctgagaggaagggctctagcagacagcagtgatgaatgagacacggtggagaatggatgagccaggaagagggggaaagcagggatcccaaggggacggaaagaaagcagaggcagcctaacagctagcagccacctggctggctcgtgaggagcctagaaatgcctggggggacatttttcctccttgtcatgatccaccagctcacgctgttctcatgggtggaaggtgaggggaagatgctaggaccttaccagcacaaggttgtagtgagtcatgggtggagacaaggctgccatggttttatgctcaggaggagtcaagacagagacagagagataaatgacgggagtgtctactacttatcctgctgcttggagctctcacttccgacattgaacatggggaccagcaggcccagcagccacctctttccgaagacctcttgtaagttcttgcgccagggccgggccctcactgccacccccttccgcacctggtggcgggtctgcccgcggaggatcaacagcagctggtggcagcagaagccggcgcaggccaggccgatggcgaaccagaggtagagcatgaggatgacgaacatttcagaacccaggacagctcctgcagggcacggggaggggaaacaccagagccgctttacacccaggccaccggcataactgcgatctaggcaggctttccaccgggagggagggagattaatgagattgacgctacattttgtagcaacctcagcgctgcagctgcagtgagggagaggaaggaagaaccagctgccctaactttttcttggcgcggatggcacctgaggcaagaggggaagactggagacatggcagagaagagagctaagtttgatgagcttagcaaggacagccctcagctcctggggcagcacctggccgctgataacatttctgtagagtaggagatgcctgtctctctctgctttctccttttgggctagaagcagggtgaaggggttttgctcaggaggagagaggggtgagctggggaccctaaagagggagcaggtgcctgggcagctgtctagtccacagcaccttctccctactgttctgggaacgctggttgagaggactcaggaaaatgacagcatgatggagatctgggaagaataagtcacgagcttagtctgaagagcagcccagaacaccaacgtagagaataattcagtcattaatgttaacaagaggacagtgtggccaccaccgcattccaccagagctggttctgtcaatcaaagcttgctagaagaggcccccaaggtcatcagccctgtgtcgtggggcaggatctccccagaatccctctaaaccaagcacttcctattactggtttgaaataaccactgagtaagagctcccacactcttcctcagagtttgggtggctggtccatgctaggtttgaatctcccagctgtgtggactggcacaagtgtcccaacctctcagttgcagctcgttcatctgtacaatgggtataataacactaacgatttcatacagctgcatgtttcaagaaaatgatgtacagagtggtcagcattccggttcacactcagagcggtgctcccagcagagggtcattttacagagcaggagactacatccaaaatgagttcaactcctgaaactatcaagctttttccttctccttttcagggcttagagtcctggctgggctgcaactttggcagctgtggcaaagacacttaccttgacctacccagcagccagggcactggaccctggagttaattcgaaagtattccttagcctttggttccctgtagggcaaccctatcacctcctctggtggggggggggcacctcctctaaggactccaccttacaacctattctgcccttgaaaatctcaaccatattttgccctttccctagccttctcttgccccagcccacctcttcccaagtctctccaacctccaatttccaaagccctgtcaactgggctttcaacacttgtccagtatgagcagtggtggactcagcagccatggaggatgtggatctgatttagattctctcattagcagcctcctcttgtcctcatccctaggagcttggatagctgtattatttttttttttttttacaaagctggggacagataggcccagctgccatttacagcagcccctccactggcacaggggcagcagtgggacagggctcacattgggctgtgccatcccctgacccacttcttccatgtcggcacagattagcttgggcagccatgtgggggatggaggatcccaggtccatggtgctctttggcgtgaggaatgctgacaggcaaaggtggccctcaagctgggatgtgagaacatcagagctgtcaagcttgggcctgccttgcaacactgccccaggaacaagcctgggtggatggaagccatttcccacagggttttttcctggcactaaatcaaggcatgagaaaaagaacttgcggccttttcttggccccatgcagcagctacaaaaggctattctggggacctgctttctctaaaagtgtttgaagttacctagcctggctgcttcagctcctcttaactatttaataatagttctgcctctttttaaaaatcacagaattttcctaatgagcctaaaaggacacatcagtcaatctcccctgccccttcctcccaacaggcatctataacacctttgacaaataatcacccagcatactttttaatacatccaaggacaagtagctgcctcccttccaaagtggctcattcgagaagcagcttcagagaggcagcccccaagaggcagtatggtgggtggaaagagtatgagctttggaggctagaagccccaactccaaatcttggtttggaatcgtaccagctgtgtggtgttggtgcaacttaaccttgctgagtctttggtttctgagccttaaaaatggacatgataatatggacttgtcaagaggaatgggtgaaatgtgacatgcatagtgggtggtacataataggtgctcaatgaacattagtcccctttccctcttactggactttctggtagcacccatcatgctggtgtacttacccaaatgccaagatacaggtcagatggtggcatctccatttcccagataagaataaggttcagagaggtgacacagcaacctgtactggtcccacaaagccaaaagaaagggtaacttctgaaacctaactagctagccgcctccctctctggatcagctgagggcctgtggttggccgccaccttcacactagaagacccctcccacttttagctctcaaggcccaaactcacagccatccatgctctggtgacagatctgactcagatctgtaccacagttggggacagctcaatttctttctttctttttttcttgagacagggtcttgctctgtagcccaggctggatagagtgcagtggcatgatcatagctcactgcagcctcaaactcttgggctcaagcaattctctcacctcagcctcctgagtagctgggaaaacaggcacatgccactatgcctggctagtgtatttatttattttttatttttgtagcaacggagtctcaccatcttgcccaggctgatcttgaactcaatttctattaaacaacccatgcttcttactcttttctgtccacctgtcctcctgtgcagatgagagagggtgctaccaactgttcggattgagggttggggaacaagaggaatgggaaagggaaagccaaacaggtggggtgtatgtcatgggagggaaagaaaggaaggtcctcaagaggaaagatgaaaggtcacaaaagatgagataggagagttggaggtaagaagtcttgctcgcctgtttccagtggatatggtgaggaagtgaaagacactggaactcatgctggcacaggagtctgggccccaaggtgggcactcactggctctgttctcccatcagatcaaacctagcacatatggacaggcctcaagcccagatttatctcaaatcaaaccatttcaaggtcttccttctggaaccatccatttttacggttggcgaaactacttggaaaagaaagtataagcaggcttgttggctctcttcatccctccacctgcctgtgctcacactccacccactagcccacccacccaccctcccccgtcctggttattttggtcccggcagcctcctgtgccagtgctgggatccagaaggcctgaaagctgtgagttctggacccagctcagccaccagccctgaaggcagcccccgtagctgggtcccccctgtatctctgtgttcccactgccaaatggcatgatagttctatgcctgggaagaactgggctgtagccaccacaaagactgaaatgatggcttcccccagagtagagcagaatttttatgaatgttcagcccaggcacctcaaaacaatcttgggctttcagaggaagtagctgccctctgcctttctttgctcctagaaggccaacaggtgaggaagcatgttctattccctgagccactgcagaagagctgtggattaaggacctgagaggcagaccagagactgccactcagtagcaggaagacactgggcaagccacttagtcccgtctgagtctcggtttcatcatctgagaaatggagatagcaatgctatacatgcacactcaagcacgtagacactactgattgtggaagctaagccattcagagtcaaaggccagggtagggaggaagtggaaggaaacgcagtaggagccagtctcaaggccaaataaagtggtaagaactgccaccaggagctgagtccttctagggccaggtatcaggtagtggtccttggtgcatactagttaaagtgcagtcctcagccaggcgcagtggctcacatctgtaaatcccagcactttgggaggccaaggtgggcggatcactttaggtcaagagttcaaggcccgcctggccaacacagtaaaacaccatctctactaaaaatacaaaaattagtgtggcgtggtggcacgcacctgtaatcccagctactcgggaggttgaggcaagagaatcacttgaacctgggaggtagaggttacagtaagcagagattgctttcaccactgcgcttcagcctgtgtgatggagtgagactctgtcttaaaaaaaaaaaacaaaaaacctgcctctcccacccacgttccctctgctctgagccatcagcaggctggagaacaggctggtgaggtcaaacataataggcaggaggacagagcttagcctcctgctgggctgggctggcaacaagttcaatattactgcaattggttggtgagacctctggagagcagagtccttgggtgacatgtaagcagaactggggaccaggcagaggaatgtcatagcatggttgtacctcatggggctacatggaggaatggccagcacctagtcctgcctggcacagagcaggtgtattacctggatgccacaactctgtgagcatatggacagcatgatggatgagaatgatgggggcaaggggggatgttaccaataaaatacagcatgtccgcttaatttgcatttcagatagccaatagcaaattttctcagtgtatctcatacaatatctgggacataattatactaaaaaattatgagttgtttatctgaaattttaatttagcgggacggtctgtatttttatttgctaaatctggcaacttttggggttggggtttggggcccggcaacctttggggtgggaggtctttgtgtagagcccaacctgcccgccaaggcccactcaccggagaagaactggctgatggaggtgggcaggagcgtgaggaaggccaaggggtgggcgaaggagatggaaaggacagcggagatgtaggccacgccggccaccatggagtagaggcaggccagggaggtgtagaggcagaacaggacgaagttgcgcatgttcctgctgccgatgcagttgccggtgaagaaacagtgatggtcgtgcctcagggtgactctggcgcacactcggcagaagtgggtgctaggtgaggggcatggagtcttcctggccgaggccccctggcaggcccccaggtcgtctggggagttctggatgacaaggacgtaattgcccagggcgttggccgagaggaataggaagagcgccccgtggagcagggcgggcgagaagagccgggcggccgcggggtcctcgcgcatgctgggcaggaagaggaagagctgcagcacgaaggtcaccagggagatgcacaagaagtaggcgggggccaccacgttgagcagccgcagggccagcatcctcgattacattcctgcggggcccggggtgagaagaggactgactgactacggcgtccagggggcgccctcgcccgctcctccgtgccgcgcgtctggggcactgcacgcgactccacgcccccaaccccctgtcccgcggatttcccctccccagttccctaaccccggatcaggcaggccagagacccgagcccgcagcggcctcgggtctaggccccacctgggggtgagtgttgcctggggttttgagcgagctcggcgccttggcgcggcagagtctggcacaggagggagggactcgtttgcagtctttaggagttgtgagggtggggggcaccgggggataggactcctcccctctgtggatgtggaaacaagcccaggtttgggatttctggttcagacctccctaggaggagaaagggaaggatttggggtcgggggcaggagaatcagcggcacttgacctgctggaaatcctgcttcacactcccctttctccgtccctgcgtccccacccacacacacatcttgggcagcactcagggacctcaccaggttacccaaggctctttggaggtatgtgtgcgtgagggaccacgatgtgtgtgtgtgtgtccttgtctgtgactctgtacgtgtaatctgtgtgcgcttgagtatctgtatttgtgtatgtatatatctgcgtgtacagacacgcagcctctgctatctagctttaaaaaaatcaattgaaacaatcgatacactcacactcgctctcgggcaccgggtgaggtgggggcgcaaccagaatacctgtgtcagcgggtcctggccagcacatctctccaacgctggctgcccgggctatttctttgcgaagagcgttttcatttgaggcgaaattaaaatccccccttcgcgcccgcctcccgccctcctgctgagagaaacccaaacaaccctcatggcgccgaaatcctttccatgccgacaagcccgccctgggcgcacgagtggatgcttggccagcctttcctgggatcgaccccgccgccgtgctcagccctcaccacgtccccatcccaccccacgcctcacagccggggttcctggccagcttcggaagccaccgagaaataggattccgtgcgcccgagagaacttttccaggggctaaggaatcggccagccggaggcgcgagaaaagttctgggaaggcggttgcacctaggatgggtggatgccacggggcctccgtccaggctgtcccgtccgcacgggtcgactggtcaccttggaatcccctttgcaggtcccagcgccccccgggaacccgcagcctccgcggagagcgtgggcctctccctaccgctggggcgcagcgcagtgcacgcctgagggtggtcgccgggggctgggcacgcccccagtcctgcgccgccgggggctgcggcggtgctgcccaccccagagagccctcggcctggggctccggcgaagcaagtgccttcccggcgccggtcgccaggggggcgcgggagcagccagatgcgccgcagcgctgggaaggcggcgaaggacaggggctaggggagtgaggggcgctcggcaggcagcctcagccctggccctgcgcgggagaagggacagcagagaccgcccgtggggccccggggtgtagggagctgtccgttcagccctggcgcccgcctcgcccgcggcagagggcggcacagccggagccttggaaagaccggcagcgccggcagccgcgggcttctcggccactgcctcccggacgcacgggaagccgccccccgcgccgccgccgccgcactgccgccgtcgcagaggggtgaggaaatcaactcaccgagctctggtcgccgacaagaggagccccggacgccggctctcgccctgcccgaggctgcaaagttgtggactcggcccggctggctcgcagcctgcgcttcgcttcgggaactgggcaagtagcggggatgtggggaggagggagcgggcagctgctggcttcccacttgggcgccagcgagtaagggccaggaagcggcggggatggcagctgggcaccccccagccccgccacccctccctccgctcctgggggcggtgctctggccgccagtctcagcatcgtggacttgccccctcctcccctctcgattccccttgagcgggctggggcgccctgcctggtttcagcgcccgttccagctgggagattgggattcagccctgatgtggattctccagccatcatcctgcccttccctctcggctaggtcccacgaccttccctgctctccactcggactgaaggaaccctgggggcttgagaggtcagcttgccagggcaacacccatgaagatcagcgtcatctcctcggaagggctgtgtacagagggttgggagttgggactctggagcctgtctacctgggtttgaatattcaccattcactactgtgagatctcagattccagtttcttcgtctgtaaattccagtgtgatcttagattccagtttcctcatctgtgaaatagagatatgagggttaaatgacaatctatgtaaaacccttaaacagggcctgcccagggcaagcactgcttgattagatcataattagacactacttatcgggcccctactaggtagcaggcattgtgctaagcctttagcataagatgcttccttaatcctctcagcctgatctgtgaagctggctgagccccattctggagatgaggaggttgaagctcagagaagctaagtctcatgtctaaggtcatacagccattaagtgacagagcctggacttgaacctggttctagcattaatgctcctgcactcagcctctacacagcccagcatcaccctgggacccacgggcagctctgatttgagagaaggaaagacaatgggagtttatccagacacagagcttgaacttggagcttcttctttgagcctcacccccaccttcttatttctatttccttccccttccagggctccgctattctaaggtgggtactgtgatgcgccaagagggtagtgacaccaatgtgtatcaaacagtggggggtggggggagcagagccttaaaaacatcaaacactgcaggaatattggtgccatcaccatcctcaatttcctgggtgtcgcagctcacctacctgccctgttcctctcctctcggtgatggcatacttaataaataaacatttattgctttctcaactggctgattaaaacaagagcaatcccttgaaatgagggccatatgctgatcagctcagcctctattcttgaataaccacacactgtttcctctgtaatttatcagcatacatcaaaataaaaaagaggccaggaaaccttttcacattctaaaaggatctgacatgtaagtgaaagaacagtatatgccacatggtggccgtgagcagctggtagccttgtgagttccagtggccacaggacagacatggggaggcacacatggcccttttcccttcagagcagctttgtctcataatcgtggccgtctgggccccttttcacaagctctgtctgcctctcacatgggcttggcagggagggaggctggctggggtgcttgggtttgggtatactgactgaagatctccattccccaaataccttgtgagtcgggtggtatttctaattttattttgcatatgggtgtgaggtgggaaggtgtgtgtctgaatctgtgtgtatgaggaaagggaaagagagaaagaagctaagcgaacgtgggaagatgttagtgggggaagggagtattcagtcaggaaaaggagatctggtcgtggaaacacaaatggacaaggacgattatttatttagaaatatcgtttatcaacagaaaaggacattacagcttcagatctaaagctagtggttcctcagctccccttaaggaatggagtgaagggaagcacggcaaatgtcattttgtttttctaaaacttatgcttatccctgacaaaatcaatagggaggcaaaatcaatatgaaaacttcacttggattctggccctatgagagtcaagcagactaagaatgagcattttattgccatttaccagctgtgtgaccatgagctgctagtcatttaacctctctgctctcagtattctcatcggtaaaatgggaataagaatgctgctgttatttgtggtgatgatgatcaaatgggatcatgtaatttaagcaccttagcgtctcccacatctttagggctcctcttttcaaccacaggactctcttcactttccaactaaaatgagagctccttgcctatgttggaaatgttttggggtttcttccatatttcctaataggatgatttgcccagagttgacactgagtaaaagtctcttgatcgatgaattgctactggtctgtctgtgaaaggaagagctatattctgaggtctttgaaatgtctggtgagggccagatgcattggctcacacctgtaatcccagcactttgggaggctgaggcaggcagatcacctgaggtcaggagtccgaaaccatcctggccaacatggggaaaccccgtccctactaaaaatataaaaattagccaggcgtggtggccagtgcctgtaatcccagctactcaagaggctgagacaggagaatcgcttgaacccaggaggcagaggttgctgtgacccaagaccatgccattgcactccagcctgggtgacagatcaagactctgtctcaaagagaaatatctgctgaggacacatttgccattgatcttgcaacctgccaccacccaccctgactctaatctcatcctccataaacagtgacagaaatgatttataaaccacactctccattgctcttgctgtagattcctatagttaagccataactgtacctgcaggcagtcccatggggacaggggcacagataagcatctcattgctgtccagccctttcctggagatatgcgccctcaatcttgctatttggtggtgttatttgaataaaatgaattccctttcaagtggaaattattccactttgcttcagagtgttgtattacaaggagagaaatccatgtagcaagcagcttctgccttgagtgagtaaccccgcctccatgtctgtcaggcctataatgccccaaatgttttggatggagactattccaagatgcaaggagctgcacctaagaaggctggtggtggttttctttcattcttatgctcttatttcagatagatcaaggtgaagataggcttgggtcaggatgctctttagcgctgacagcagatcatagccagggataaccacagagtgtttcccaagcctgggaaggcttacaaagatgccatccctgcctgcccagatttggaaaacatgcaagtgtaatcttcattttagccaactaaatacatgaaaattggattatcacagagtttctatttggaggtggtaatttactttgctaactatgtcttcattttaacaacgataacattactttgatgtaataaagtgctttgcaggctacaaagtcatccacaaaattaaaatttcatcccatgaatctctctcaacagcacaaactagctggggtgagaattatcaaacccattttccttatggggaaactgaggttcagagatttgctgcatgttaatttgcaaggcttgactatgtttgatttgaaatatgatttaatatgcaaaacatatctcatcgatatttaacttttctggaacatgtcagttgcataaaggaagcaggtatgtaacatactcccccagagtaacagacctgaaggatctccctttacctaaaactgctgtgctctgcactctgcatcctgtctactctgctttgtcttcaacaacttttatcaccacttgacaggtatatatttgtctgtttactgtctgtctctccccactgaattctcaactccgtgagagtaggatttgaactgctttattcactgctatatcccaagtgcctataacagtgtctggcacatagtagtaggtgctcagtaaacattggttgaatgaataaatataatatgcataaacttgtaagcctgcagcacattaatcaaatgccctcaggcactctgctgtttgtcgtgctggagggggtgtgtgtgattaggggcaggtatgctcagcctccaagctcacatgtcaaggtagaaactacaggtctgggtgacaagtaaacccagtggtctcccaggtgattggtgcatcagggtggaaatcttgggttagcttgggagagcctcttttgcagtatccaggctgtggaagaatgaaccaatgggctctttcaccaattagccatggtttccagggaccgtttaggcagtcctggtagggacgcctgtgcctgtggacaagcgagtacccagccctgtggaagcggtggcagcaagattaactggccctttcatctcagagcacgcaggaggcagagggaggagaaagagggggtatagggaggaagaagaggagggagggagagggcagagaggagaagagagaaaaggagacaggaaggagaagaaaggggggtagtgagagagtgctcatttatctgtctgacacaccaagtttatgtcttcatgatggaggaggctcgggaggagcagggcaaaatcagctgtctccatcgagagccctgcaatgccaggtgtccaggttgggagggaatgaggcagaaggtggacatctcaattacaggaggaggggagtgagaccaagggagtgaggtccctgcagtgcccttggctgtttggagacctcttagatatgtcgttaccgtcacagagcagcaggcagcacaaacctcacactcctgaccccctctttctccctccccctaccccagcagagatggcccaggctgcagaagagaggcagtgtggtgcgaccaaaaaaatcacaagtttttggtgtctgttgacctgagcttgtctcccagctttgccattcaccagctatgtgaacttgagcaagttccttaacttctctgagtctcagatttgctctcctttaaatgaggactttaactaacctgcagtttgtcatgagcttttgttttggggggtttgtcattttgttttcttttgagatagagtttcactcagtcgcccaggctggagtgcaatggtgcagtcttggctcactgcaacctccccctcccgggttcaagcgattctcctgcctcagcctcccgggtagctgggattacaggtgcagaatcagcaaaaacaggtctgcagtatgggatagaaatttcagatgggaccagaggaggaaaaaggactccaagaagaaggtccagagaacattcagggcacaggttctggggtcaaaggaccctggttcaggtttcagctccaacactcactggtgcagccttgagcaagccagctaacttctctgtgtctcagtgtcctatttataaaagagtgttaagtacagctctcgcctgatagggttgttacataggttaaacaagataacatctgtagagcacttagaatagtggctggcatagtaaacactaaagaagtgagaagttatgtaacgaactgtgattcggttccatagcatgtgatagaagccccaagacaaaactggtttaaactaagatgaaagtctatttcactgccacgtaaacgaagtttaagggagcccctccagggttgatgcagaggctccaaggttatgtgagacctagactctatctagttccatcatcctgagcatgctgcctcatggtccagaacagctgcttctatcccagccatcatgcccatattccagccagcaaaaaggagaaaaggagaaagaatagctcccctctctttttttttttttcctgagacagagtcttgctgtgtcacccaggctggagtgcagtggcatgatctcggctcactgcaatgctcactgcaatctctgcctcccaagttcaagtgattttcctgcctcagcctcccaagtatctgggaatacaggcatgcgccaccatgcctggctgatttttgtatttttagtagagacggggtttcaccatgttggccaggctggtctcgaactcctggcctcaagtgatccaactgccttggcctcccaaagcgccgggattacaggcgtaagccaccacgcccagcattttttttttttttttttttttttgagacaggatctcactctgtcacccaggctggagtacaatggtgtgatcatagctcactgcagcctcaacctcctgggctcaagcagtcctccagcctcagcctccagagtagctggactacagatgtgcactaccacacccagctgatttttttttcaatttcttctagagacggggtggggcagatgcggggggaggggggtctcactatgttgcccaggctggtctcaaactcctggcctcaagcaatactcctgcctcagcctcccaaaatgcttgtatcacagatactgcatccaaccacatccccgccaccaccccccccccttttttttttttttttgagacagagtctcattctgttacccaggctggagtgcagtcatgcaatctgggctcactgcaacctccacttcccaggtttaagcgattctcctgcctcagcctcctgagtagcagggattacaggcacacgccactatgcctggctaatttttgtatttttaatagagatggcgtttcaccatgttggtcaggctggttttgaacacctgaccttgtgatccgcctgccttggcctcccaaagtgctgggattacaggcgcgagccactgcacccggcctacacagaccctactttttaaggacatttcctggaagtcgcacacattacatgcacttacctctctcattggccagaacttggtcacatggccacacctagtactggtcagtatgtaaccagctaagatttgtgagttgtattgagaaagaagaggagggaaatggatttgggggatgacttgcagctttttcttctactgtgaaaaagtttagacatgcaatttatccattccctgggcctcaagactgaagatggatttttctgggacttctagcctctgagattccagtttgtcattggtcaaatggggctattgctcgctgcccttttctgccctccacctgatctttgccttcctcttggcacgtttccttctcctcacagaacaggtgcaggaaaggcagctgcagcctgccaaagccttggccctcagatgaacatggatggtgagggctggaggtggctatgatcagtgtcccaggccatctggctgcttcaataagctcaaaatctggcccaagatgaaagagaaggggagacagaaaagatgcactttaaatattttttactcttaaaaaccatatgagtaatatgttttgtaagaaaatacaaaattttttaaaattaaaagcaaaacaaaatcttttcatcttaagccctgagctaattatcatgaacatcttgtacgtgtctcacaatctttcatctactcaaatttttttccccttaattacaaatttgagctcacatcttcattatcttttataatcagcttttaaaattcagcattaacaagacaatccttccatgttgataaatacatttccccggcgtaatttttaatggacagcgagtatgtccctcttacagaagtgacacaatttaataggggtgcaccaaaatttggctttgatcttagtatcaaattttgctctagagcttcatcttcaactttggcccctgaaaggctgaattgccaagttcagacttaagcatcatttctgggtttcctagactggggcatgatccatgatcctgtggctgtgttacatggactttgcatgcaataagcgtaacaacctgttatacaggcatatcatttggatgtactgtgataaacacttttaaatatggatgaccttctatgtgtaaattgtaatgaatatattctttcgtgctctatgtgttgaaattctatcaatgtataaatgtacgtttattattgcaagagtaaaatgctgtaatcatttatgattgtaaacattgtcccttttatgtacggaaataattattgagagcttttaagtattcagatttagaaggaaacacatagctaatacaaattttgaaaaatatgtcagctagatacttttaaaagatactttttaaagacttgaaaacatttttaaatttttttagagacagggtctcactctgtcacccctaggctaaagtacagtggcactatcatagctcactgaagcctagaactcctgggttcaaggaatcctcctgcctcagcctcccaagtagctggtattacagtcttcagtcactacatctggcttaaagatacattttgaggcaacaacaacaaaaaaattaaaataataatatgaaggagaataatatggattagattatatcagagttctaatctgtgtagaattgtttgggatactaatattcatggcactaaacaaaataaccttttaaaactgtattccatttttagttactttattctatgtaagccatgaatctttttttaagccctatttgtaactctttatatcttataaagataaaataaaaacagaatctcagcttaaccaacctcataatttcataaatagggaaacctccaaaatcacatatattaataacaatatctatggtaaattatatttaactcagtatggaatataaagaatatgaaaaaaagaaaaactattatcgttattattatttgagacggagtctctctctgctggagggcagtggcatgatctcggctcactgcaacctttgcctcccgggttcaagcgattttcttgccccagcctcccaagtagctgggactataggtgcccaccaccacgcccagctaattttttgtatttttagtagagatggggtttcgccatgttgcccaggctggtcttgaactcctgccttcaggtgatccacccacctcggcctcccagagtgccggaattacaggcgtgagccaccgcgcctggccaagaaaaaattattagaacaagtgaggcatcacactcctctgccattcagtcaaaagtaagcaccaatttattaacacaaacattacataatacatgatacaggagcaatctcgctactgctagcactaagaaaatgttgttcttgcactataacattaaactgttaaatactgacagtgaaatgcaccaataaggaaactgtcatcacagagaatctctgataaaattttagatgtactcctttatcaaaggcattggcttgggcttcggctgaatacggattgtaacaattgaccatctggtgttcagccaaaatgtgtgttgagtgcatctctaactttagattatttccaatttctcactattattagcaacattgcaatgaacgtcctaacacaaacaactctatgggaccctgtgattatttccttggctgaattccaagaagtggaatggctgggtcaaaaggatccctattgccaaaccatcctccagaaagtttgtgccagcttccttcccacttaaggagtgaggggcttgtaacctgccttctcaccagctccgggacctgcttttccaatcccccacagaggctgggagttggatggtagagaatggcatccttcagccagccccagacgccccctggagcccacgattgcaattgtagctataatttattttgtgtttacctcgtttctggcattgtggtagaccttttcttcctgcatttcaatcccctcaattatggttcaaagtaaatatggctggcttcatcttatagatgagaaaactgaaactcaaagggttggacggccctgcttttagccctaatggaaatctccaggggcctgttcaagcaacagtctgcaaccctattcctgcaggtaaatgaaacctgcaaggtccaatccccacgaccccaactgttcagcccctcttgggatcagggatccctgcgccctcccagccagcacagtttctagccagggcctaaaggtggaaaagaaggtgaccacccggtgggctcagctctgtgctgtacattgtctcatgtaggtctcaaatggccaggagagatacctttatcttatatgaaaggagacagtggctcaggaaaatatccaagagctcgcagctaggaaatggcaggaatgcagataaggacctgaaccagaggacacactcagggcatgttcatagagtggatggaaggatgaatagattctacagggccctagatggtgaaactacaggagctagactaccacagaccctctgtgtaaaccaggtactcccaggtgggaaagaagagggcaggatttgagccaccctggtggcaagggtcctctcttttttcattctttcaggcaagagaagttgcatctagggctgccttgtacagttgttcaggttctacactttacaattccagggacctcattttcacacatgtatatttggataattattataataattttccagtagatggcagtaaagtatcttgagttaaggacaccccttttctgtacaaatatactgtttgggctatttgcagtgctgggtgcatctctctaccagccctccaaactgctgagaggttgcctgacaccctttccctcccttgtctcaccccttcatcgattgcctcagagtctcagagttgggctggggagttcagaggagagtggcattagcaccagaaagccccagctgcatcctttattccaacaaaggtgatgtttgtaatgggaaatcctgggttcaagacccagctcctgcatttttttttttttgagacagtttcactcttgttgcccaagctggagtgcaatggtgcaatctcggcattgcaaccttcatctcctgagttcaagtgattctcctgcctcagccgagtagctgggattacaggcacatgccaccacgcccaactaatttttttgtatttttagtagaaatggggtttcaccatattagccagactggtcttgaattcctgacctcaggtgatccgcccgcctcggcctcccaaagtgctgggattacaggtgtgagccaccacgcccagccgctcctgcatttctttcgaatggtcttatgcaagtgacctcaaagttctgggccctacttttcctttctgaaaagagtgcagtaataatccctgcccttggggttgcaaggaacaaatgctattctgaacatgaccaagaatggctagctataaagcactgcatccatgagtgtcctccttacccagagaggatatgctgcattattgtgggaagggtgtgccacagaccacgtggtgctgccttgtcacaacactcccccgagtcaccttcccataagggatctctctcctggctctccgctgctactctatcccaaggggttactttgacctcttcagcctctgatccaagctccttagtatagttcatccattagccagtcaatacatactagtaagcatttactatgtgctggggtctatactaatctctagcctcaagttgcttacagtcccatgggggcaaaaagttagtgtagttgccatcttgtttcttgtttcttgataaagctaggctttatcccattcctctgggaccccgggggagaaagagaccttacccagttcctgccttcctagttcctaggacatttaatgactggacactatccttggcccccaccattgcagctcactccaagttgtagaagagaagctcagctgggctcttttctgcctgtctcatatgggtcagggaagcctagaacaaacttgctatggatttcacttacaatttgacacagctgtgaagaaacaagaaatccaaagtagcagtggcttaaatgagctagacctgcagttccttctaatgtaaatgaagttcagaggcaggcattccagagctaatgtggccactctacagtgccaggagggacccaggctctttccagttccctgttcggtcatccctcagatgtggtcttcatcttcacgatggaggtgttagcccagggctggcaaagtccttcatcacatcagggcccaggctccttttctatcatttcctcctcaattcttagtacgcagcctctacctcatggcccaaaatagcttctcatgctccagccattgattcaacatccatcagcaggaagtaggaaaaaaagtatgagcaagggcataccttctttctcttaggataccccctggaaattacttgtggtacttctctttgtctcccattggttagaatttagccacatgaccatatctagatgcaaagaaggtcagcagatgagtctttattccaggtggccctgtgcttagctaaaaattgtaggtccaattcctagagaagaagaggagaatgggaattgaggaaccatgagaattctctactacatcttgcctatgaggggacatctccttcctacagggaacatctctacctagcagtctccccagcataaattaagcaggaaaataaaataacctaataaccataacaccacagaacaaggattacacaaatactgtaatggggtaatttcctctctgcatataaatgacatttgtgttctattgtacttatcatcattgccaacccttatcctataatccctgatgtgctcagctgcctccagtcctattcctcccggtccatgtatagcatctcctcccacagcactgagacaaagccctctgtgcacccatctctgcctcctccctttctagggtggaatctggctaaagttaaagctaggggagaaatgagggggaggccccgcgacagcggcagctgcacagcagggacaggcggcggttgccttggtgagctgggcagagatttctatgatgctgctaaatgtattttcctgacctgccaccgccttctctttcctgcttaggagacacctttcaggagctgaggcccctcatctcaacttcttctctgctcccaccctttaaaatactcatttccctgctcattacctcttcctgtaagattgggtctggagccctcagacaccctaggtgtggagggggaatggggcattaacactgattgagtcttgcaggtatttttccacggaccttcacagcagccctgcaccctcatccgcatttgacagatcaagccctgagcctgagagccgctaggtagttggtagttggtagttggtccaggtcacccagcttgtaggtggcagacctgggactggaaccccatgtgggattctgagggtggaatttcaagcaagctaccagatgtgggaggagacatttgggggcaagagaatgtgcacagcattggctgtccctgccagcttttcagggataattttggagcagggacggaaaatctgaccctgctggtaaaattagcagcaaaccatgtaccctggcctgtggtttaagggggtcacgtgagaccaagagctataggcaccactgcctgctccacttgccctctctgtccccatactccccaggcagtttcaccatcacccccaaacttgatctccaggcaccctggctctgccctctctccaacctctccaagccccaaaaaatcatccctctactcagcaaaggcaaccttcagttccccacctcctccccttggtgccctgcctgctcagctccagtcctgtcttcccccctccccaccccacagtcccaagctgctagatcagggtagtgctgagaacttttggggcctggggtgggagtggcgcggaggggagagaaagggaaaggggaagggcatcttctcccctagcagagctggctccacggagtggagtcctgtgctaggaggcctgtctgggtagcccactcacacttcccatgcttccctcccctgtggttccattcagccatctatctgagacagagagaagggcagagcgtgggaggatagtttggggttaaggttatcatggctcacctcctggaaataggacttggggaccagaagctggatttctgaaagtttatatgcatacacttgcttctacatgcccactcatacacacaagcacacctgtactgacacatacatgcacagatgcacactcacacagacacatgcatgcacacgcacacaagcactcacctgcacaccttagtccaaattcctctggcagtcctctcttaaggttaagggtttgaactttgaagtcaggcaaacgtggagttttcttttacatattgcattataggttgttttttgttttttttttttaagacagagtttcgctcttgttgcccaggctggagtacaatggcacaatctcagctcactgcaacctctgcctcccaggttcaagtgattctcatgcctcagcctcccatgtagctgggattacaggcgcacaccacgaagccatgctaagttttgtattttgatagagacagggtttcaccatcctgaccaggctggtctcgaactcctgacctcaagtgattcacctgccttggcctcccaaaatgctgggatgacaggcatgagccactgcgcctggctgcattacagtttttaaacaatggtttctcattttcagaaggcactgtctgatattagaaccatataaaggtgtcataagtgcaggtcccccccgcccaccaccccagcccccagtctcttgttccccttcccagagacaaccattgccaccgattacttgtatcctcctccagagttggtctgcagataagagcctctatagggacataagcatgcgtgcgtgtgctcatgggtgcacacacacacacacacagttgccccctagatacactagcatactgctttgcactctgctttctttttatttttctgagacagtgtctcactctgtcaccaaggctggagtgcagtggcgcaatcttgactccctgcaacctctgccccctgagctgaagcaattctcccacctcggcctcgtgagtagctgggactaccgacgcacacaaccacacctggctaatttttttgtatttttaatagagacagaatttcgccatgttgccaggctggtcttgaactcctgggctcaagtgatccacccgcctcggcctcccaaagtgctgggattacaagcgtggacattcttctttctttgttgattgatgtaccttggcaattgctcaatattcatgcacacatggatctcctcctttttatttatttattaattattattttgtagagacaggctctcactatgttgcccaggctggagtacagtggctatcaacaggcacaatcctcaagccctgcagtctccagctctcaggctccagccatcctcccacctcagcctcctgtgtagctgggactacaggtgtgtgccacctgcccagcttccaggtcctttttaatgagtgcatggtcctccatcatgcagatgcgccataactcctgtgatgtgtcctactgactgaccagattgtttccagctgttcactttgttgctgctacctggcgtcttttttttttttttggagtctcattctgtcacccaggctggaatgcagcagcacagtcttgacccactacaacctccatctcctgggttcaagagattctcctgccacagcttcccaagtagctgggattataggcacccaccaccacgccctggatattttttttttttttttttttagatggagtcttgctctgtcgcccaggctggagtgcagtggtgcaatctcagcgcgctgcaacctccacctcccggattcgagcaattctcctgcctcagcctcctgagtagctgggattacagcatgcaccaccacgcccagctaacttttgtatttttagtagagacagggtttcaccatgttggtcaggctggtctcgaactcctgacctcaagcaatccagctgcctcagcctcccagagtgctgggatgacagacgtgagcccccacgcccagcctgctacctggggttctttcatgagtgtccctgcccgtaccctttagcccacgtgggtgtgcgtatctgtcagaactgcatgtgaatgaatggctggcccaatgacttggcctctcatccctcacgttctcagtttgtggatgacaacagtcagagcgctggcttcacggggtgaggatgaatgaagtcctaccgtagtgcctggtacacgggaacccccatcagtgttagctggggaggggaaaagcagctggaatggggagggggagaataaggggcctgtgcagccaggggaggctggtcagccccctcctcaaggccaccaaggagagatcacaggggcctcagcccaagaagtccccggctcttgcagttgggaccagccagtgtggctgccaccaggaggggaagcaggggacagggagcgggcggcagctgcatcacagccagagtgaggagcaggccaagcaggggacagggagcgggcggcagctgcatcacagccagagtgaggagcaggcccggcttccctgctgagtcatccccgctggagtgagaaagggagggagtgaaggagtgagagagggagggagggtgtgcgccagcaccgcacatcacacacacgcacacatgcgtgcacacatcacacacacacatcacatatcacacacacatcacacatcacacacacatcacacacacatgcacacacacatcacatacatcacatatatcacacacgcacacttacaccacacatacacactcacacatgctcacatgctcacacacctcctgatttagggaaaaggagcccctcccagcagaaagaggctttgttccccacaagatgtgaaagccgtggagacaaaggagaggcggcactctctcctttgaggctgttcccagctgcggtctctccagccttgctctgtcctcaccccatgccgaccaatcttctcctctgtcagcccgaatcctgctgccagggtgaccaaccctcctggatggcccaggactgagggctttccccaaatgacacgaggacgagttgggcaccctgtctgcccctctccaactccaccctcaccttcaccaccctgctggcaccagatccctgcaaatcacccccacctggcttctccagggaggcacaaaagctttcctggctctgcagtgatgttttgatgcaacagacatttatgagactggttcctgagctgcacagaacaggcatgagtgaggctgcgtgccactggataggggctgcccatcactggcaggggtccagaggagatggagactcagggggcaggctggagggagggtagcacatctcccttcattaaaagccactttttgtcttagtacaaaatcccaacacccaattggtgcctaacgccctgctctaattccttctgaatgtatttctattcacatggaactggctttggaaaagtctgaatttaacaggattcaaacaggaaatatttttgctctgtctctaatcacagccttcgaccatgctttgccaaatctccttttctgaccctgaacaatattcctggcagattcctagctttctggtcacctccagttattaaaaatccaggttagtctagttcaatttaaaagttcaggccagaggcgcggtggttcatgtctttaatcccaccactttgggagaccaaggcgggcggatcacctgagatcaggagttcaagaccagcctagccaacatggtgaaacccccatgtctactaaaaataaaaatattggccaggcgcggtggctcatgtctgtaatcccagcactttgggaggctgaggcgggcaaataacaaggtcaggagtttgagaccagcctaaccaatatggtgaaacctcgtctctactaaaaatacaaaaaaaatttagccgggcacggtggcatgggcctgtagtcccaactactcgggaggctgaggcagaagactcgcttgaacccggaagacagaggttgcagtgagccgagattgcgccattgcactccagcctgggtgacagagtgagactccatctcaaaaatagataattgaaaataaataaataaataaataaataaataaataaataaataaataaaaatattagctgagcgtagtggcgcgcacctgtaatcccagctactcagggggctgaggcaaaagaaatgcttgaacccgggaggcgggggttgcggtgagctgagattgcaccactgcactccaacctgggtgacagtgggagactctgtctcaaaaaaaaaaaaaaagttaaggccaggcgcggtggctcacgcctgtaattccagcactttgggaggccgaggccggtggatcacttgagctcaagagtttgagaccagcctgggcaacatggtgaaaccccatctctacaaaaaatacaaaaatttaccaggagtagtcgcatgcacctgtagtcccagctactggctgaggtgggaagactgcttgagcccaggaggtcaaggctgcagtgagccatgattgtgccactatactccagcctaggcaacagagtgagaccctgtctcaaaaaaaataaaataaaataaaagttaaataccatgttcagctaggcacggtggctcacacctgtaaacccagcactttgggagcccaaagcagaggattgcttaaggccaagagtttgagaccagcctagacaacatagcgagactctgtctctacaaaaaaaatcaaaataaaacattagccaggtgtagtggtgtgtagcctgtagtcccaactacttggtaggctgaagcaggaggattgcttgagcccaggagttccaggctgcagtgagttatgattgcaccactgcactccaggctgagtgacagggcaagaccctatctctaaaaataatttttaaaaatcatgtgcaattataggacgactgccgccgccccatgtccatcagcatcaagcaaggctaggaatggggggcagaggtttctcttcctcccctcccgcatggagtcctttcatttccaggatttgaggttggtgtgtgatgggttgggggatgagagctggagaggagcagccacagatcttgttctcttggccaccactgcctgataatcaatgccttctgccgcaggcttccaagtggggtatgtggttgagttgtctagggagagggttactctggctagatatcttccctctcagctcaacctcccagaggcccaccagtgaaattcctccccagccacctccccagtgtttatggggcccccaggaaactgatgcacccttacctggccgaacagggcatgcgggcccctccattgctgctggctctgtgtggctgcctctgtccactctccttcccattcctgccccccttgggccatgggatgccagcctcttcctttacaggcaccccagtttctgtgagcaagtctccaggagttcacccctacttccagaaagcggagggggaagcagagcccctaccctcggttaggaacaagggcagtttcaggggtgtgtggtctgtgcacttccatgaggcctcaggtcagaagtgctggcggttggtccaatgctcttctgtcttgaagtctcttaatttttaaattaggggcaacttgttttcattttacactgggctccaaaaattatttaggcggtcttgactgttctcatccgcttatagaaaggaggagggtttctggcaatggtgggagtggagagctggttctggaggctgttgaagccccaggaggtacacagtggttttcacctctctttagagtggaagatgctccacacacattatcccgctttgggttccagtcatcagcttccaggcaataggatcgaaatgcatcagcatcctcctgcaaatacaaacatccctcaacatctaaacactcactacccccaaatgggaatcgaatagattcagatcatctgcttttgttttttgcaacaatgaactcgtgttgcattcattgttttataacttcttttttttcacttaacaatatgttgtaaacatatcttcatgctgaaaatattaatctacaatctaatattcagcatctgtttcagggatatactgccttgtaacaaaccacccaagaaaccaatggcttaaatcaatgatgatttattgtttctcactcttctatgggttggccaggcagttctgaccatccacaagaaatacagcatcttgagagagaaagactgggttccggtctttgccaagcctcttcctgctcatgtggtcttggccaagttattgaacctcagtttcctcatctataaagcattacaaattataataatgatgtctcccttacctgtgatattttgaagattaattgagaactataataatagtatatacctgtatctatctatccatgtagatagatacacgtgttaatgtgtgtgaggtataacaaatattagagattgctgttactgttgttgttgtttggaatgccttggcaagggctaggctagtaaggaagttgctggggcaaggggatagctggctttccagctcatcacaatgtgaggcatcagagagagggaggatccctgctcaggatagaaagatctgaaaggaaacaatggacagagctgagaatattaagcattgctcagccaaaagggtactgaaggcgaggaaaaatcatctcactgtagcctaaaggcacttagtagttagctatattttcctacaactaataatatgctggcaataaagtcaggataatatatgctcaaaagcgggtagtgccagcttagaggcatcagacttaacaaatgaccatgggcgtccacagcctctgttcctgcccactccaccaagagccccttaggctgttccaggatacagaggagcatgcaaggaccaagggagcatcttggaaggacaggagaagcggtatcaaggagcccaagtctagaccctgatgatttcctgatatcttgtttcaattcccaaacatcctatatttcagttctttcattttcactttcagagattccaacatgtagagattcatgtctttgtgtcttttgaaaaatgaaatatttaaaacaaacaaaaaaatataaaaaataacccatcaaaaatccatgctcctatggctcaaggttgtaaaaataaaaataaaaataaaatccatgctcttgccaccagcataagaaagaaaacagtaaattatctttgatgtacttcctaatcccctcctcctaccttccctcaagaggcaaccactctcctgaaccctggcattgactatgcatgggcactctttttaattttttaaatatataaataaatctgataggaaaattgaattgctttacagcgatttgagtccctgtgaagggcttttgggtactctgccagggtgtagatgacgtctgaagaggctacaagggaaccagagagaaaaaagcctgatgaaaggaacagagcctacatgatcggtgacaatatcaactggaataacatacatgtaattagacttggggggcatgaacttttttttttaataatggctaaattgttttaatccaaaataatctaggaattattagaattactaagaattaataagagagtttagcaaagttgctgaattaaacaatcaatatataaaaatcaaccagcctgggcaacatagcaagacccagtctctacaaaaaaatacaaaaaaattagctggacaaggtggtatgcacccgttgtcccagctgcttgggaggctgaggtgggaggatctcttgagcctgggaagttgaggctacagtgagccaagatcacaccactgtactccagactgggcgatgggagtgagaccctgtctcaaataaataaataaaataaattaataaaaataaaaatcaattacaccctatatagcagcaacaaataatttgaaaatgaaaaaaattcaatgtataatttatataatataaacgtattagaatttggaaatatattttttaagggctatgcgagaccttcatagaaaaaattataaaactttaccatattcttggtatgccaatacaccatattcttggacctgaagatttaataatttaaggatatcaattcaccccaaattatttatagatttaatccaatctgagccaagatatcatcaggtttgtttttagaactgggcaagctgattctaaatgcaaagagctaaaaaaggacaagatattctagaagttgaacaaggtaggagaacttgctctctcagattttaagtttacagtaaacttacagtaatggtggtttcaggcatagacaaataggccggaagatcggagagcccagaaacagaccccacttattcagacagttgacttataacagaggtggcgctgcagagaggtcaggaaagatagtattttcaataaatgatgatgaaggtccacaggtaaaaattgaaattgattccctatcgcccatatacacagaaatccactccagttgtacttttttgttgttgttgtttgttaagacagaattaacataaaattcaccatttaagccacttttttttttttttttttttgagacggcgtcttgctcttgtcacccaggctgaagtgcaatggcacgatctcggctcactgcaacctttgtctcccggattcaagcgattctcctgcctcagcctcccgagtagctggcattacaggtgtgtgccaccacacccggctaatttttttgcattttagtagagacggggtttcgccatattgaccaggctggtctcaaactcctggcctcaggaggtctgcccgcctcggcctcccaaagtgctgggattacaggcgtgagccactgcgcctggccttaaaccacttaaagagtcttttgaagcataaaaaaaaaaaaagaagaagaaatgtcattcccacttcccacttccaacctattactcctgaatccccagaaacagcttctttaagtgctcagttgttttatctggtacttatctgcatatttctagagacaataccatatttatgctgctatttctctatatatccatttctagatattacttttctataccctattataatcaattatgatttagctctcttataccaccagtagtaatacatcacaacttctgttccatatttccaaaaaaaaaaatgcaattcagtgttttttgtgtgtgtactcacagagttgtgcaaccatcaccagtaattacggaaagctttcatcaccccaaaaagaaaaccctacagccatgaagcagtcagttcagtgcccccttcactatcaccaccaccatgaccaccacccaacacttcagctcctgccagtgaacaacctactttctatctctgtggatttacctattctggacatttgtatagacagaatcatacaatatggggcctgttgtatctggcctctttcactcagaataatattttcaagattcatccatgttgtagaacatatcagtacttcgttcctttttatggctgaataatagttcattgtatatcacattttatttattcatttgttgatagacatttgggttgtttccacttttcggctgttatgaataacgttgctgtgaacattcatgtacacattttgtttgaacatgttttcaattttcttgcatatatatctaggagtgaaattgctgggacatatgtatttccatatttaactctttggagaaccacgaaactattttctacagtggctgcaccattttacattcctatcagcaatgtatgaaggtttcaatttctttacatcctcaccaacgcctgttattttccattttgtgtccatcctagagggtgtgaagtggcatctcattgtggttttgatttctgtttccctaataactaatgatgttgagcatctcttcatgtgcttattagccacttatatatcttctttgggaaaacgtctattcaagtcctttgcttgttgttaaaaattaggttgtctttttattgctgaattgtaagagtttaaaaacaatatattctggatacggccgggcacagtggcttatgcctgtaatcccagcactttgagaggctgaggcgggtggatcacgaggtcaggagatcaagaccatcctggctaacacggtgaaaccccgtctctactaaaaatacaaaaaattagccgggcgtggtggtgggcgcctgtagtcccagctacttgggaggctgaggcaggagaatggcatgacctcgggaggtggagcttgcagtgagccaagatggtgccactgcactccagcctgggcgacagagcaagactctatctcaaaaaagaaaagaaaaaaagaaaaaagaaaaaaaatatatatatatatattttttttttctggatactagtcccatatctaatatgtgttttgcaaatattttattccattctgtgggttgtctctcctgagagtgtcctttgatacaaaaaagttttaaattttgatgaaattcaatttttctttcatttcctgtacttctggtgtcatatttaagaaaacgtctaattcaaagtcacaaagatttacacctatgtttccgtctaaaagtctcagggttttaggtctcttatatttaggactctgatatgccctgagttaattttttgatatggtaaaaagtagggtatccaaattaattcttttgcatataaatattgaattatttcaggactgtttgttgagaagaccattctttccaccatcaagtggtcttgtcacctttgttgaaaactaactgaccatagatgtatgggtttatttctgggttctcaattctatttcatatagaaatggaattgagattataccagtaccacattgtttcaattactgaagctttgtggtaaattttgaaattgagaaatgtcagtccttcaacgctggttttttttttttcaagactgtgatcggcattcaggtgtcttgtaattccataaaattttagaattagcttgtctatatctacaaacaagtcagctgtaattctgatagagattgcactgaatctgtagatcattttgaggagtattgttatcttaaaaatattaagattcagcctgggaaacatggtgaaaccccatctctacaaaaaatacaaaaattagccaggtgtggtggtcccagctacttgggaggctgaggtaggaagatcacttgcactcaggaggttgaggctgaagtgagacatgaccaagccattgcacgccaacttaggcaatagagagagaccttgtctcaaaaaaaaaaaaaaaaagtcttccagttcatgaatgtgggatgtcttttatttattttggttaaaaatttttttttaacagtagttttcagtgtacaaatcttttttttttttttttgagacagagtctcgctcttgttgcccaggctggagtgcagtggcgcaatcttggctcactgcaacctctgtctcctgggttcaagcaattctcttgcctcagcctcctgagtagctgacctcaggtgatcctccctccttggcctcccaaagtgccaggattacaggcgtgagccaccacgcctggcctcagtgtacaaatcttatacttacttggtaaaatttattcccaattattttatgtttttcagtgctactattaatgaaattcttaattttatttttagatttttcattgctagtgtatggaattacaactgattcttgtacactaaaacttcactaaacttgtttattagctctaatagtcttttcttgtagattctttaagggtttctatataaacgagtatgtgatctgcaaatagagatagttttactttttcctttccaatctgattatcttttatttatttattgactaattgccctagatagaattgccaatgcgttgttgaacagaagtggcaagagctgacatgcttatcctgttcctgattgtagggggaaggctttcaatcttttattattaagtatgatgtgagctgtgggtttttcatagatgcctgttttcgactgaactgtatccctcccaaattcatgtattgaggctctaacccacaatgtgattatatttggagacaggacctaaaggttaaatgagatcataaagagagggccttggtctggctcagcagctcactcccacaatcccagcactttgggatgccaaggtgggcagatcacctgaggtcaggagttcaagaccagcctggccaacatgtgaaaccccgtctctattaaaaatacaaaaaattagctgggcatggtggtatgcgcctgtagttccagctacttaggaggctgaggcatgagaatcccttgaacccacaaggcagaggttgcagtgagccaaggccacactactgcacgctagcctgggtgaccgagtgagactccatctcaaaaaaaaaaaaaaaaaaaaaaacaggatcttaattggatagaactgacatctttataagaagaggaagagaaccacctgtggtggctcgttcttgtaatcccagcactttgagtgtcgttgttgagtggagtgctccataaatatctgctaggtctagtttgtttatagtactcttcaagtcttctatatctttgatgatcttttttattttttctttttctttttgagatggagcttttactcttgttgcccaggctgatgtgcaatggcacaatctcatctcactacaacctccacttcccaggttcaagtgattctcctgcctcagcctcccaagtagctgggattgcaggcacccgccacactcctggctaatttttgtgtttttagtagagacagggtttcaccatgttagctaggctggtcttgaactcctgacctcaggtgatctgcctgcctcggcctcccaaagtgctgagattacaggtgtgagccaccacgccttgcctccttgatgatcttctgtatagttgttctattatttaaagtggaatattaaaatctgcaactgttattgtttgtctatttctgtctttaattatctcaggttttgcttcatgtattttggggttctgttgctgggtgcatatatctttataattgttatgttttcttgatgaaatatccctgttatcattatataatgtcattcattgtctcttgtaacaatttttgtcttaaagtctattgcttccaatattagtatagccacccccactgcctttggttactgttttcatggtatacttttttccaccctgtcattttcagcctatttgtatctttgaatgtaaagtgagtcacctgtagatagcacatagttacatcatttttaaacactcatctgctattatctgccttttgattggaaagtttaattcatttacatttaaagtaattgaggaaggacttacttctgctgttttgctatttgttttcagtgtttcataccatttttgttccttatttccttcattactgccttcttctgtgttaaagatatttttttttattttatttcagtttatttgagacaaggtctttctctgtcacccaggctagagtgcagtggcacaatcttggctcactgacacctccacctcccaggctcaagtgatcctcctgcttcaacctcccaagtagttgagactacaggcgcacaccactgtgccagcttaatttttgtatttttgtagagatgggattttgccatattgcctatgcaggtcttgaattcctgggctcaaatgattcacccacctcagcctcccaaagtattgggattacaggcgcgagccaccatgactggctgatattttttaatatactatttaatttcctcatcttttcttttactatatatttttagttattttcatagtggttgccctgaggattaaaattaatgtttaatttataacaatctagtttagattaatactgtttcagtataagaactttgctactatatagttctacccccatctttatgttgcttttgtcacaaattccatctttacacatttgtgtctatcatagatatatatcagtaatttttatttatatagttgccttttaaataatatgggaaaaaagaacagatacagactaaaaatacattaatattgacttttatatttacctttaccagtgttctctatttcttcatgtgaaatcaaattgctgcctactgtcctttcatttcagcatgagagactccctttagcatttctcgtagggcattagtgacaaactctttttttatttggaaatttcttaatttctatttcattccagagggatagttttgcttgatatagcattcttggctgacagctgtttttctttcagtccttttaatgttctatcccattgcttccttacctccatggtttctaatgataaataagctgttaatcttattaagcattacttctacgtgataagctgcttctcttttgctgctttcaagattctatctttgtctttatctttgaacagtttaattataacgtgtctcagtgtggacctctttgagtttatcctacttggagtttcttagatgtatagactaatgttttccatcaaatttggaaagtttttgcccattatttctctcaagtattcttcctattagaccccactacctcctctggcactcccattatgcatatgttgtggtatacttggtgatgtcttttaaagtctgctcattattctatgtctttcttttttatgctcctctgactgagtaatctcaatgacttatcttcaagttcactgattcttctgcctgctcaaatctgctgttgagtctctctaataaatttttcctttcagttattcttttaagcactagaatttatatttggctcttttttataagtttggtctttttattgatattctctatatgtgagacatcattctcatggttttctttagttctttgtacatggtttcctttagttttttgagcatattttaaatggttgaattaaagtctcttaaaagtaagcccaatgtctgggcttcttcaggaataatttctatcaattgtcatttttcttgtgtaggggccatacttccttgtgttttttccatgccttgtaattttttgtagaaaaccggacatttcaaatattataatttggcaactctggaaatcagatttccctagggtttgttgttcctgcctgttgtagttgttgctgtttgtttgtttagtgccttttctgaactaattttgagaactctttgtgtgtgtgtgtgtgtgtgtgtgtgtgtgtgtgtgtgtgtatggccacagaagtctcttccattagcttcacaatcagctagtgattggacagagatttccttaaacacctgggacaaaaaacagtaaaattgccctgtctttatagataagcctgtgtatgtgtattgggacatgccttcagagttcagttaggcagtttataactctgccttagtcttcaatttcttcttgcttagagactgaaggtcatgcagaggtgagagcttagggctttctcaggtttttcttgagcatgtgcttatcctctagattcccaggaatatgtcagggcttttcaaaatccttattttgaatagaatctcacaaagtgcgagaggagacatcttcctggaaagggattctggatgaacaaataacatttagaggcttttaatagattacctggctcataatctgtgagtgaactgaaggagaatgactgacccctcagaagcagctgccacattacagtgatactgaccaaagtagtaaagaagtaaggaagcaagtctgaagaagggaagagggagttttcctagtactacttccataccatgtgttttttatggggctggagtatgaaaaggaaggttgcagaatgaggtgtatcaaaaccatctggaaccaacttgtccccattccagggaaccctcacccacagctccaacctgctcaggcagtaaccaagatggaaaaaaattttttttaacattcggcccctttctttattgtaatagtttatctggaagtacacaaaaattaataaattgcttttactatgcaattctgaaatatcaggtctactgccgtcaataaaaaaaattagtaactacttttatgacattaaggtcaagtcatcatttgtagacagaatcaattgagactctttggcacttacgactaatccattgtaaacaattatcaatcttaaaaacacagctccagtaaacgtgtaattatactgggtacagataaggaagtacaaggccggtatgatcgcttatgcctgtaatcatagcactttgggaggccgaggcaggtggatcatatgaggccaggagttcaagaccagcctaacccacatggcaaaaccctgtctctactaaaaatacaaaaagaaattagccagccatggtggtgcttgcctgtaatcccagcttctcaggaggctgaggcatgagaatcagagaatcacctgaacccaggagacagtggttgcagtgagccaagaccatgctactgcactctagcctaggtgacacagtgagtgagaatctgtctcaaaaagaaaggaagtacaagaagctcactggctatgctaaaccaaataaatgaaaagcagcaaaactgattttttttttttttttttttgagacagagtctttgtcacccaggctggagtgcaatggtgcgatctcagcttattgcaacctccacctcccgggttcaagccattctcctgcctcagcttccctggtagctgagactacaggcatgcgccaccatgcccagctgctggggtttcaccatgccagccacgctggtctcgaactcctgagatcaagtgatccacccaccttggcttcccaaagtgctgggattacagacatgagccaccgcgactggctgcaaaactgattttatactgtgggtttatacaaataaataaacaaaatcctttcctttttttctatattttttcttacatttcttataaaaataacagaatgcttcattttattcacttcaatgggacaaagtccttagagaaagattgaaaagagctgataatcaaactcccaaattttatgcttatttcttttctagtgctctcaattttctgacatttaacacaggcaggaaaacgttctcggtaaattgagcatttgagtctataaatgtcttcaagcactctggcaagttacatatatcccattgcttttggttgcccatctcttctttgcttcaaacccccatgcgagtttcttcttttttcaggcagccctgtgaatttttagtctccatttttggcttttacaaacttgtggcagacaactgctttggcaatttttacaccaagctctcgagtagctagctagttgctgagttcttcagccctctcaatattccactcctccacagcctgctctatcctcttttcgaggccttctcagtggttttccttttaacaggggggtcaaacctatcattgactccaacatactgagtaagctccttccactgggctgcatttgaggactgttcaattccacatatctaagggaattccagaaggactctcttcttaggcatttacatttgactctgcttcactttttgcttcatcttttgagaaatctatgatttctgcttttctgttgctcccatcctctttatcttcctgtaagttaagcccagagctctccaatgtagcttcatcttcagagtttgactcaacatcactttcatttaggccaggaggtactagcccactcaacatcttttcttctgtcaggatgcagccgcccggcagccatcttaagaccctgtcaaccaaaaaattttttaagaaataatttttgtgtgaaatcattgttgtgtattatttcagtgtattatttcagggctttgtataaaataatgtggacattttacttctatttctatgctctggaacagtttaaaatgattgagttcttgcttgaccatctttttctttttcctttctttcttttcttttcttttttttttttttttttttttttttttttttttttttttgagacagggtctcagtcgcccaggctggagtgcagaggtgtgattttggctcactgcaacctctgcctcccaggctcaagcaatcctctcatctcagcttccagagtagctagggctgcaggtgcatgccaccatgcccagctaattttcgtattttctaacagatggaatcgcactatgttgcccaggctgatctcaaactcctagattcaaacaatctgctggcctcagcctctcaaagtgctgggattataggagtgagccaccgcacctggcctatatttttcaattaattaattttggaggagacaaaaaacattcaaatcatagcactcactattaaaaaactggaaataaaaacaaatgccaaacaaaccaggaaggattaatttatggcacagtcaaacaatagagtaatgaaaatgaataaactccaactgcataccacagtgtggatgaatcttaaaaacacaatgttgaggccaggcatggtgactcatgcctgtaatcccagcattgtgggaggtgaggcaggcagatcacctaaggtcaggagtttgagaccagcctggccaacatggtgaagccccatctctgctaaaaatacaaaaattaactgggcgtggtggcgcacgcctgtaatcccagctacccggcaggctgaggcaggagaatcgcttgaacctgggaggcagaggttgcagtgagcctagattgtgccattgcattccagcctgggcgacaagagtgaaactccatctcaaaaaaacaaaacaaaaaaccaatgttgagttttaacagcccaacatgaaagtatatttatactccaattctcttaatgtacactcaaaatacagaccaaaccaaaccatattgattaggaatgaataatcaggtggtaaaagtacaaagcaatgcaaggaaagactgaagtcaggatagggctatctctgtgcagggaagggactgaaagagaaaggggtggattgggaaacgatacagggaaacttctggtgataatgttctatttatcgacttaaacagtgtcgctacacaagactttgctttatgattattcattatcgtgctcacttgcgtatggtatatgcttctctgtatatgtattatatttcacaaagttaataaagcttatacaacaaagaaaaggttcattactgaaaacagacaccaactcccaggggaaggagtacaacggagctgatttcaagagcctggacatgaggccctgaagaggagatcttcactttctggcccagaagaaacccatatttctgcctcatgagtatcatctcggggaagcaggggagttctatagcctcaataaaatatcaatgcaaggacccgtgcgtgtgtgtgtgtgttttttttttttttttttttttggaacagagtcttgctttgtcgcccaggctggagtgcagtagtacggtcttggctcactgcaacctccgccttccgggttcaagcaattctcctgcctcagcctcccgagtagctgggattacaggtgcctgccactgtgcccagccaatttttgtatttttagtagagacggggttttgccatcttggccaggctggcctcgaactcctgacctcgtgattcacctgcctcggcttcccaaagtgctgggattacaggcgtgagccaccacacctggccaacccatttattctttaaggatctaattctgcagggcatcagccaggctcaagatagaactgaggtgaggctctgcaggcttcaatccccagatctgtctgaaaatgctcagttgcgctcaatcctaggtgaagaaatggtaccagaatcccagagttccagcacaacacagtggtgtttcttttgtgatgtcatcaacacctgcttctgacctcacccgcccagaagtttccaatatcattcagtgatagtggcggtggataacaatgacctcctaccagctgtgaatttctcgtcttccactagtactagtaaaagagattgctgctggctaagaatacccaccggtggggtcttggtgagtggggcccagtctgaggccaggggtaagagagggcagaggggccagggttgccccagaagaagggaagcctggattctcttctgtggcagggctgagtgatcatagggcctgactcctccactggggaatgccagcttccaagtagagacagtgctgtgtgtctagacctaagcctgaagtcttcctctctctagaaatccacaaccctgtgtctggtcaggcagaagacactggaaaaatggttttccattccaatacatttccccactactttctgcacaggaaaacaaattcacttctgtctggaaaggcagattagagcatgtgataggagctgagctcccaaaatgtatccactttcttagagagtttttatttggctcttgggatcagggataccctagagtatgtggcttgccacttaaagtataaatagtgtcttggctttgccttgaaaatactgtccctgtcagtggcatatgtttatattctgggtcttgtagtaaaatctgtggtctgactcccatcatctccaaccccatggccccctgcttaccctctgcctagcagcctcacccagcaccaggccttggggtcatagggacactggtgtgtggctttcacttcctgccttttctctctcattttgatttttcctgaacatctcacctgggtaccacagaaaacccatgtacatttgcgtaggctgtgcacagttgtgaggtttttttaattgttactgttgtttttgcaattgcaaacaattctgcaatgagcattcttgtgtgtgtaggtctttgtgagcttgagtgtttatgatggaaattatttctaaatagcagagacaagttcccagggccaccataggctcaacaaaactatgagggttgggtccctgcagttgttcactgggctggtttaagatctcagacaatttcactgatcaatcaatacaggcagtccaacttacaacgactctacttacaattttttgactttaaaatggtgcaaaagccatatgtattcagcagaaatcatacttcaagtatccatacaaccactctttttcattttcagtattcaataaataaaatcctctaacacaaagcccattttataataaagtgttgaaatatgcaacattttattatacaataggctttgtgttaggtgattttgcccaactataggctaatgtcagtattctgagcacatttaaggtaggttaagctatgatgtttggtagattaggtggtgtgttagtccgtcctcatgctgctgataaagacatacctgagactcgataatttataaagaaaagaggtttaattgactcagttccacatggctggggaggcttcaggaaacttacaatcacgatggaaggggaagcaaacccatctttcttcacatgacagcaggaagagaagtgctgagcaaaaggggaaaagcccctcctgagtagttgggattacaggcgcccgccaccacacctgggtaattttttgtatttttagcagagacagggtttcaccatgttagccaggagggtctcgatctcctgacctcgtgatccacccgccccggtctcccaaaatgctgggattataggcgtgagtcactgcgcccggcctttttttttttttttttttttttaatcgttgttctctcttctcttgctcttgacttttgcccttttcactgtgcttgctttcttattagtcctttccccttctaacatgctcctgctcatctgctgtggttttgaaaatcaggaaagtggcttctcctttaggctattggttcagctgctgcaacagagaccagacaatagtgactttacaaggttattgctctcccgtgagaaaaatgcaaggtggtcaacattgtagggcacttctccaggtcatcttgtgactcaagttcttcctgccttgatgcttgactgtctctagggagttgtcctggtcagcatcatcaaagctgccctcccctccaccccatgtccacatcccagtcttcacaaagaggaaagaggaagtagagaacagccagcttccttttaagtatgtggcccagaaattaaacctattacttccactcatatctcactggctaggacttagttcatacttccacctggcttcgaggggttctgggatatgtggtctatagtaggagagccataaatccaggttttaatcttgggagctctactgcaaaaaggaagagggaaagaaaaggggctcttagcagtctctgccacactggatctattgaaattttgtgtggagtaaataaaggtgggcaccaattgaagacacaaggtgatctgcagaaaaagcccctcccctcccctcctcttccctcacctcccctcccctcctcttccctcccctcctcttccctcccctcctcttccctcccctcctcttccttcccctcccctcctcttccctcccctgccctcccctcccctcctctcctctcctttctgatgtagatctctctatattgcccaggctggtctcaacctcctggcctcgagaaatcctcctgcctcagcctcccaagtagctgggattacaggtgtgagccaccacacttggcttccatcccccttttctgtacctctctctctgtctattttttttttcttttgagacggagtctcgctctgtcgcccaggctggagtgcagtggtgccatctcagctcactgtaagggttactcagagtccttttgtttcttttatattgttctggattatgttcccagaccagacattggaggttaacaacgcggtcatgaagacaataacaggcataatctttcagatttgacaactcaggccaaaggcactcccaccccaatccacaagtgagagcatgataagtgttttcagtgtcacagaccagaagggcctttcttttgaaagcctcagttattcatacccatacacctttactgagaaccttctacaagctgacactcatctaggtggttggttgggacattggggtcatctctttccccaccacacagcccacctggcatctccatgggttctcctccttccatgggttctcctcccttccttcccttccctccctccctccctcccttccttcccttccccttccttccttctttccttccttccttccttcctttctttctttttctttctttctttctttctttctttctttctttctttctttctttctttctttctttctttctttttctttctttctcctctcctctcttcccctcccctcccctccccttccctctcctgccctcccctcccctcctctcctctccgatgtaggtctctctatattgcccaggcttgtctcaacctcctggcctcaagaagtcctcctgcctcagcctcccaggtagctgggattacaggtgtgagctaccacacctggcttccgtccccctttactgtatctttctttttttttcaagacggagtctcactctgtcgcccagctggagtgcagtggtatgatctcagctcactgcaacctccgtctcctgggttcaagtgattctcctgcctcagcctcccaagtagctgggattgcaggtgcccgccaccacccccgactaatttttgtatttttggttgagactgggtttcatcacattggccaggctggtctcgaactcccaacctcaagtcatctgcccgcctcagcctcccaaactgttaggattataggcgtgagccaccacacctggcctctctttacggcatgaccttgatgcttatcaggtttctcctctaggaggtggagtgggttggatatgggcttacaacagcttctgtgatgatgaagcagagaaggaaaagacgaactgcttttgttgagaatttatgctgtcccaccagactgtgaatagcataactacagcaacaacaatgaatatttgcagagcatttattttgtacatggtatttcatttaatcctcacaatcaccctttaagcttatgattattgttttcccccattttccatatgccaaaaaaaaaaaaaagcacagagaggttaagtcccacatttaggtggcccagctgggactgaaatgcaggcagctagcgttcccagcactattcttgtattgatctgatttgtctttgtacccgccagcctttatcctagaagagaataaaggtgtcagagcagaggggtgtgagacctcaactagcccagccctctcagaattacagatgagagggaaaaacaaagagagatcaagtgagctacccaaggttgcacagcatgatagccgctaagcaagggctggaacctagaccctgatgccctgttgccactgcagaatacgtgttcaaaagtcttcccgtcccgtgaatgaaaaagataatgagtgggccggcgcggtggctcacgcctgtaatcccagcactttgggaggctgaggcgggcgaatcacgaggtcaggagatcgagacaattctggctaacgcggtgaaaccccgtctctactaaaaaatacaaaaaaaaaaaattatccgggcgtggtggcgggagcttgtagtcccagctactcgggaggctgaggcaggagaatggcgtgaacctgggaggcggagcttgcagtgagccgagatcacaccactgcactccagcctgggcgagtgagtggataatggatagacttcgacagagtctgtctatgtggctcacccttgggtcttcgtggggtggttgggtcatgagaaccagggggtcaggggaagagggagatgactagagtgcgccagcctgatacggttgtgtggaagggggtgctgtgctgctggttatggggaaatcaacccatgaaagcataaccagcctttgaccccctcctctggcacctcatgaccttgtgttcacagggcttcctctatggcattcttatcatattgttaacagccctaactggtgaaagggagtcactttcagagagcattgggcagtggcttctttcccatcagctattgtactgcaagtgccagataatgtcgatgacataaatgtgcctaggcccctgcctgggagggagaggctgtttactactgccccttgttttgcacactggtctttgggggttgcaaacactggcacctgtcctcggggtcaaaaccagtgtctatagcagagtgggcaggactttgatgaaactctgatacctgcaggattgtggcccaccgcaaaccggaaatgacccagctcactcccttggccctccctggtggggctgtggccaattgtagatcactcctttgctgtagaaggagtctgggtagcagctgggtaccagccactaggctggtgccaggacctggtccttgggcggggcagagggctatctttgtgggagtggagtggcttttcttgcttctggctgatgggactaaggagactgggaaaggcgacatgcctcagggagggcgaggggaggtggcaaaggagctgccaaggcccaatgcatcagggcagctggagcaagctggaaccagggaccggcagccttgtgtgtttgagatagtaatttgcagatggttcctggtagcgacagggtctctgaggcggagcctgggtcttcgcgtaggatctgccagcctgggttccccggcaggtcagagaagctttggggcggggccaaggttggcccctgcttgggaggagccgggatgcctctctcacagtgatgcagagaggaatttgctgacagtcccttgccaggtggggctggcttcgcccagccggcgaggaggaggacccgctggcagtctcctcccaggtggggagcgtggagcctgtcactgcagcctggcggcctgagcgccgagcctggggctggggccgcggtgctgaggacgcaaatgtggtgagcacgcgatgcgggtgcggtgaccggggctggtcgggccgggaagaaggggcgccggatccaggtcccgcacggggagggggcggggaaggattgcttgtttctgtgctttctgagaccttgcattgggagggatgggggtaggggagactgcgccacagtcccttgccacgctggctgtctctagcttgtacccaggaaagggtggcctgagccgcccacccgggagggcgtggctttagtagaccggtcttcactgggttgggggaacggaggtgggtaggaggtttgcttggggggtccccggcctcctgcctgacagccaggtgggagttaccgctcggggctaccctctcccccacccagggattccccggggctctgccgcccactctctgggctgggacgggagggggcagtctgctccgccgttatgggttatgacaacgtcactgctgcgctgctgcctggcgggctgggctcctgggcccccaggggaacaatgccaccctttccccatgtgcttccaaagaaaggctcttgcctccctactcgccctggccttgagagaggaacgttgtgtttggatgaaggccctggggaaactgaggcccaggggtgctgtggcttgaccaaggtcactgagcaggccctacagagctggcctcccaggcactgccttcaccgaatgccctctggaggggcaggggcccttcttcctctctagaccccaggacctccccccaccccagcaccccatttcctcatccctgagaatgcagggagttgcaacttccgcatggggctccagggtatcatgggtgtaagcagcaattagattgtctggggacaggagaaaattgctcatgaaaaacacctaagtgagcagagggggtgtgagcgtgtgctgttcttgtgggttcaaggaaagaatgagagttggctttgaggagaggaaggcccgtgctgatgggaatgaggagatgaactttctccttcaacagcctgcagcgctccaggaagatgtgttttccctcaagaaagggtccatctcttagcaccaccctctgttatcaccttatccttgttctctctccggcccctgtccctgggagaaatgggctacattccgtctattgcccttagaagtgaactttccccttagaagtgaattcaccttgttcttctccctgggacagatgaccttccctggagggaaactgaggcaaggagagagcgacattttagagccagagccagatgaggaaactgaggcacagagggtggagtgagttctccaggtatcttacctacatgcaggtcttctgactccccagccaccaaagggcagactggaggggcctcttcctgtcttctcttcgcaccccacagtcccagcgctgagaagctgaggctgcaagggcctcctgatgggtgtggaggaggtcggtgacagggaacagcaccagcattttctcctcctttaagatatgttttctagtttcttgggaaggaagcagcttgaagacgggaagtgaagtctcttggttaccttcccatcatgcccccacagggatacacaatttctgtgggcctatcggagccaaaaacaggcatccctcctgcccgagtgccagcagctgtgagcatagccagggagtggggatccacaggtagagggacttcatttatctccctgacagcatctccggatcgggggtttgggccagcaccggtttactccaagtgaaaggagttgccatgtgcctggctcatgaattgctccttttcagacaccctctgagcacagaacccctgacgctggcccctgctggcttcacaggagccttgggttgcatgatgaccaccaggagctgctggggtgacctgtgggaagggatggggttcccagtaaaccagatgagaactagctgcttgtggggtgacaatatagcaccagagaggagagggcccaccatactggagggaaaccacatggtatgtgtccctcccagctagcagagaaagggtcaggcctcagagaggccccgtggtgagaaccagacttaaagagcagagagctggaccgagtgcctctatcggcaggcactctgccctcagcatctctacctgatagctaggcatgaaaacaccttctccagatgggtgggagggctttggaaacttgtcaagtgtttattacaaatgggaagtattattcctggagtctctggtctaggtggaagccatctgtttcctgccttgatgggggaaacatggtcatttcttcttcagaggatgctctctccctctgcggccagcctagggcatccttctaggctgggaaggcaggtcagccctccccagcccgcttcaagttgtgcttgggcccttgaggagtttcatcccctccatccccagctgcccattatagttaacatatttaacaggatgttcacccccgaaaatgcaggtgtctagtggcaccgtggagcttcctacaggcctgtaccctccccactgcctcaactctcgaattccacgacctctgctctgattcttcctgggaagaggcgggtggaagaaccataaagataatgggtgtaaagtgctgggagctgtttgcacagagcgtccagtttgcaggaacccacgtggtgctcaggccatgggcaggctcacactgggaaaggctgtaatgaaagtgctcagaggaagtgctcagcttccagtgagatcagcagcttttagtgccctgttttgcctgaggtggggccccaatgctcactcttctttcctctcgtgggagagcagtggttttcacagcttacacatcagcatgggtggtgtaaatggaactccacattcttgcccatgagttggctggtgcaactcctgcaaggtagggttacaggaggagctgagatgagaacgtgggcagctcacgaagtatggtgtgtccttgctctagatctgtctgcattgcttaggcccaactgagggtggctcttaagaagaacaacgtgtggccaggactccatgttctgtgtttctagggcaggatatgtactcaagctgccacattccttgccaacacccctggggctggtgctgagacatgcagaggcagagtgggcggggaaggggcgcctcattgtcacctcctgcctccttgtagtcattagtaatgctccccaaagggaaaccgaagcatagacctgcttagaaagctaggactaggacccaagtgtcctgggctcccaccttctgcttttcccagcctttcactctgccatttgacacgagcaccctcaagatgagatgggaagagctgggctggaggtgagtgagtcatgcccagccctgtgcctgtagaccttcattcctgccaagccagggcctctggtgtccttagaggatcagaggcagaaagatcagcttccaacaggaaaccaaactgtcccctccccattactgagtggcctggccaaggaaggtcctggaggcagaagccttctcctcactctggctgagtcttctcagagttgtgcccagcaaggtgcatgctggcctcaggccatcgagtcccagcagaagagcaagtgaccctaaggtctttggagagataggtgggcaagatggagctgtggccagtccgctgggatacagctgtccattgggttttgggtgttgaggactcattgccttagggtgtctgagtggcagtgatttggccatagggtagaaacactacagagggcaatggaacatgcacccagggccctgtggggaaatcaatcctgctttgatgggggacatggaagcacagaggacctgtcatacatggacacgctgcctgggggagtacttgggagctgcgttcccacctatttcattacctgctcacttcacttccgtgagtcttccatttgcaacatggtgaagcaatcccctccacacagagccactggaaggatgaatgggaggaagcggaaaggtgcccagcttggggcctggtgaccaggagtccccttctttccatttgctcgtccctctgcttgctgagtggccagctgtccagggacccctgggatggcgaccatgttttgttgttgttgtttttttttttgaaacagagtctcgttctgttgcccactctggagtgcagtggcactatctcggctcactgcaacctctgcctcccaggttcaagcgattctcctgcctcagcctcccgagtagctgggattacaggcgtgcgccaacacgtcggctaatttctttgtgtttttggtagagacagggtttcgccatgttggccaggctagtctcaaactcctgacctcaggtgatccactcatctcagcctcccaaagtgctgggattacaggagtgagccaacgtgcccagccagaccatgcttttttgatgacaccaaacaatgttcaagaatggctgaccaacaatgtcgactgctccaggcactgttagaactgaactgtcaccttcaaaaatgcttcaggccatgcatggtggctcatgcctataatcccagcactttggggggcctaggagggaggattgcttgagcccaggagttcaagaccagcctgggcaacatagaaagaccttgtctctacaaaaaagtgaaaaaattagccaggcctgtagtcccagctactcaggaggctgaggtgggaggatcacttgaggccagaaggtttagtctgcagtgagctgtgattgcaccactgcactccagcccagacgacagagcaagaccttgtctcaaaaaacaaaacaaaataaaaaatcaaaaaggcttctcacatccctgaggacctggcagagggggaatcttctcagaaccaaaggggtgtgtgtgtgtgtgtgtgtgtgtctgtgtgtgtgtgtgtgtgtctgtgtgtgtctgtgtggtgtgggcagggagtgtcctttcatacaatgagcaagctgttgctggaccagggatccttccttggctggcgcctcatgtgcccaggcgtgtcaactaggcctggcttggggagaccttctcaggcagcagaagaacaacagcctgaacaataagcctggcttgaggccctggagccactcagcagcctcacattctctgtcattactctttaatcctctccacgccttgggagagaaagcaagtctgagtcacccgctcaataggtaagaaagctgtggcttgagaggttgtgacagctgcaaccacactcacacaccaaagcagcagaacccaaactggggccatggccagtctgtgtccaggggagccatctgtgtgccgtcctcccaagcacagctgacacatcctgagctcacctcttactgctggggctggtggttttgctgaagttgcttgagacgaaaagacttggaagagaaggtcgtgcgtttctccccttcccctccactctgggcagggcgcccagaaccagattctgctgaaggacatctcgagtcacgggagcagggaaggtagaaggctaggattcccaccccgcccccaccaggttccgaggggctgagccgaggcaaaggaaggggactcggcaaggccaggcccaggctccacactccatggaggggcttcttggggccctggcccaggcacatacatgcagcttgtgctgcacggagcagccagggaggaagggacaggaagcccctggcctgggtcacagagctgccaagtggaggagcagaaggagccccagtcccagcaccctcctgtgtggctggggagagaacccagaccatcgcagccctgatctgttcccagagacagaggaagggaagtgagtgggaagagcaggctttctgacccagccctatcccagggcctggtgtccccgtgactctgcctgcttcccctgggagttacctttgaacccagctctgacccagagcctgccattgaaggctcatcttggagtaagcccaacccatcttctccagtgaggctcccttcccacatgctctgttcccactcaggggttatttgtgtgtggggcggggggatgtgtcagatgcccttgaagtttttgcaaaatacacatgcctggcttttctgccccatctcaccccagctcggctaagaaccattgctctggcaaatcaaacgtgccctggactgtctgagccactgcctctccccatcccagtcctggtccttatccctatcctcatctgttcatcttcctgtccgtcaaagcccaattcaaatgctacctccttgatgaagccctccctggatctcagccagatgagatcttaacagccttgaatgcccttaacactttgagtctatctcttctgctagaaaggacttcatcctttcacttttcaagtgttctttgagtgccagtcacacacaggtcctccagtagttcatggggaatggtgtgggtaaacaaggaaatggcttaatgacaatagcttgagaaaaataataacattctgtgaaaatagcaatacaaagctccatgagacattctggcaagaatgctagtaaagccaaatgtgtatatgctttatgaccaacgatttcacatctaggtatacattacctagagaaactcacacatgtgcataaggaaacagctccaagggtatctagggcagcaatgcttgaaatgcaaaaaagaggtcttggctggactctgtggctcacgcctgtaatcccagcactttggaggcccaggtgggaggattgcttgagcccaggagtttaagaccagcctgggcaacatagcaagaccctgtatctactaagaaaaaaaaatagccaagtggggtggtgtgtacctgtagacccagctacttgggaggctgaggtgggagaattgcttgagcccaggagtttgaggtttcagtgagctatgattgtgccactgcactatagcctgggcaaccaaacagaaaaaaaaagacagacctcaacctcaatatctgcaagaatagaataatgaataaaactatgatactgtgcagcagttaaactatgtgtaactggggagttttattttttataaattataccttagcaaagttgatatatgtgtacatacacatatggatacatcctgtattaacatgaataaatttcaaaaacaatgttgcaaaaaaaggaaattgcaaaataataccattaagtgaaactttaattttctttttctttttctttttttttttgagacagggtcttgctttgttgcccaggctagagtggagtggtgcgatcttgactcattgctgccttcacttttcaggctcaagcgatcattccacctcagcctcctgagtagctgggactacagatgcacaccaccacacccagctaatttttttttttttgcattttttgtagagatggggttttgctatgtttcccaacctggtcacaaattcctgggctcaagtgatccacccatgtgggcctccaaacgtgctgggattacaggtgtgagctactgtgcctggctgaaaatttaattttcgcaaaaaacacaaaactgtactagctatgatttatggatttactaatttctgttgcaatgcctaccaagatcatgtgtgtagtgccttggagagagtaagagctgagactgaaaggggaaaaggaaggacttctaacttgtcagtaacacttcatttaacaaagaacagctgaagcaaaaatgacggaatgtttacatttgttaattcagttggtttaaatgaattgttcaaagttgaagaaaagtaatctgagatgtctatggaaaggtgctgacatctccctggggagtcaggaaagggtccaagaggaggtgacagctgggtgtgaaggactcagggaactggcaggtttcactggggtgggggagttgggaaaagcagccgtgggtgcttaaagccagggaatacctgtgccggctctttgcacgtctgaaatgtttgttgactgactttgtatcaagctgtccctctgctgccctctcatccccttctctgatttcagctgttctatttctgagttgtgtacatagtaaatagggtcctggggggaaaatcatgtgtcattttatgattttttagagatgagataatctaataggggttaggagaggattagaggcaaatatacaaaattgaacattaaaatggggaaatagtcactgatacagagaaaatagaattatgattattattattattattattggtactgtgtttggccatatgtaaatccagttgaaaactagctgaaactgatgattttttgggaaaatgtaaatcatcagtttgacatcaggagaggtagaaagtcccaacagaccaataatcactgaagaaactgagttttcataaaattctcctccaaaaaaactaaggttcagatcacttctagtttctatcaaacctccaaggcacagataatgccaatgttatttaaactgcaccaactacaccaaatcacagagaaagagagattctaaattattctatgaagcacgaacaacatggataccaaaccttgacaaagatagcacaaaaagagaaaaataactaaaaaatcttatgaatagtggtgcaaaattcataaatagcaataaatggactcacagcattatgttacaaaaatgaacataccacaagcaagtggggctgtattccagaaatataaattccatagtagaaaaactattaatgtaattgaacaaactaatagctcaaaagaaataaaaaatcatacaaggaacttcataagtgctaaaaatgtctaaaatgcatttgataaaattcaacatgtctctgattttaactcttacttcataggaatagatggatattgcttaacatgattttgtgtatgcctatgtgtgcttgtgtgtgtattcagacataaacacacacaaggaaagaataatcatgactgtaattctttaataccactctagaggtacaagccaacacaaattttggaaatgtaagttataaaagtgctaaatttatcaaaattgtagacggtaagattgccaacctggagaaaaaagaacaagattgtcaactgaaaaaaaattagaaataataaaagaatataccaacatgattggtaataactattagaagcaaaaatatatagcttgtttgtatataaacagactttaaccttttaaatataatggaagaaattgaaaatatcagtaaaagggctaaaataaccagtactaagtctaaccagaggtggcaggagcagctcttaagactacttcattcttgattccctggcacttggaatagggcctgacacatagtagtagatatttgtcaaatgatggaacggcttcacagactgataaacaaagcacacctaatatgcaataataatagtagtaaacaccaccatatagtagttcctctgtgtggccactgtcctattctttacctgtagcctaaggtgtgagctatcctggagaatgttccgtatgtgcttgagataatgtatattctgctgctgtttggaggagtttttgcatatgtctattaggtacaattggtctatagtgttgctcaagttctccattttttttttcttttctttcttttcttttttctttttctttttttttttttttttttttttgagacagagtttcgctcttattgcccaggctggagtgcaatggtgcaatctcggctcaccacaacctccacctcctagattcaagcatttctcctgcctcagcctcccaagtagctgggatcacaggcatgcgccaccaagcctggctaattttgcatttttagtagagatgggatttctccatgttggtcaggctggtctcgaactcccgacctcaggtgatccgcctgcctcggcctcccaaagtgccgggattacaggcatgagccaccaagcctggcctagttctccattttcttagtgatattctgtctggttgttctatccattattgaaaggagtactgaaatctccaattattattgtggtgtggtctatttctcccttcagttttgtcaatatttcttcatatatttgggtgctctgctgttaggtgcatatgtatttatagttgttatatcttcctggtgaattaactctttatcattatgtaatagcctcctttgtcttttgtggcagcttttgactgatataaatacggccatccttgctctcttttggttaccatttgcatggaatgactttttccatcctttcactttccacctatgtgagcctttacatctaaggttcagcctcttgtgggtagcatagattagttgcatctttctacaccctttacctgtaataactcatttaatcctcacaataactccatgcagatggcgttactgttacctccatttttagatgaggaacctgaggcacagaaagggtaggcaacttatcctaggtccagtagagtggaaatttgaaccaagcacttcactctgagtttatgctctttgtatccatcctcctacatagtcaaatcggaattttgaatttagagggaggattgttgggtaggggagcaggaaatggattattcaaacatgactttaggacaactgtgtagccctttgaaaaaaataataaagttgggccctaccacaatccctacatcaaaataaattctagagggggcaaagatattttaaaaagaaagaagaaagccaggggtggtggtgcgtgcctgtagttgcagctactcgggaggctgaggcaggagagtcacttgagcccaggagttcaaggctgcagtgagctatgattgtgtcacataagtactccagcctgggcaacagagtgagaccctgcttcaagaaagaataagacaaagacgaaggaggaggaggaggaagaggaagaagaaaaagaagaagaggaagaagaagaagaggaggaggaggaaggagaagaagaacaacaacaacaggaggaaggagaagaagaaaaggaggaagaaacctttaagaatacaagttgaaaatatgggcaaatactttcatgattctcaaatgggaaaggctttttaagcaagtccaaaggatgccataaataaactcaaaaagagatgaatgacaatttgcaatacacatgacaagaagtaagttgccttaatttagaaaaacttctttaaaaatcaataagaaattagaaaggatggacacagacaagtcacagaaaaataagtgcaaaggccattcagtcaataaacatgaaaatacgtctgtcttttttgacaaccgaattacaaattgaaacaagataccatttttaaactcactgtaaaaatccaacaatctgataatgcacacttgtgagggtatgagttgctggggcagagcaaactggttcaccctcattggaggacaatttggcaaaatgttaggttcacataagttttgacccagggatatcctctagctggcctcatatatgtgcacaaagatataaagtcaaagatgtaggctgggcacggtggctcatggttgtaatcccagcactttgggaggctaaggcaggcgcatcacctgagcccaggagtttgagaccagcctaggcaacaaagtgagacttcatctctacaaaaattaaaaaaaaatttaggcctggtgaggtggctcacgcctgtaatcccagcactttgggaggtcgaggcgggcggatcacctgaggttgggagtttgagagcagcctgaccaacatggagaaaccccgtctctgttaaaaatacaaaattagccgggtgtggtgacgcatgcctgtaatcccagctactcgggaggctgaggcaggagaatggcttgaacccgggaggcagaagttgcagtaagcagagattgcgccactgcactccagcctgagcaacaagagcgaaactccgtctcaaaaaaaaaaaaaaaattagccgggcatggtagtgggcacccgtggttccagctacttgagagatggaggtggaaagatcacttgagcccaggaagttgaggctactgtgagctgggatcgtaccactgcactccagcctgggcaacagagtatgacgctgtctcaaaacaaataaacaagaaaaaacaaagatattcattacagagtatgatgctgtctcaaaacaaacaaacaagaaaaaacaaagatgttgattacagctttgcttgtgcagcaaaaaatgtagaaataacctaaatatcaatcaacaaggacagattcacagaaagtgtagtgcatcggttcagtggaacactatgagctatgaaaagaatggagggatctgtctgtgctggtatgcagagatgtgtgatgtatgttaattagcaaagcaaatataagtactgggaatatgttcctggttgggtttaaaataaagatgcaggcatagatatatatatatgtgtgtgtgtgtgtgtgtgtgtgtgtgtgtgtgtgtgtgtgtgtgtatgttcatatttctgaaaaaaattctcgaggaaaatttaggaaatgatacttatgttggagagtggggcatagatctgagatggcagggacatccatgccatatttcttttttctttctttctttctttctttctttctttctttctttctttctttctttctttctttctctttctttctttctgtctttctttcttcctttttttggagacagggtcttgctctgtcacacacgctggagcgcagtggcactatcatgactcactgaagcctcaacctgctgggtttaagtaattctcccacctcagcttcccgagtagctgggactacaggcggacaccaccacatccagctaatttttttttttttgtactttttgtggaaccgggtttttgccatgttgccgaagctggtctctaacttgtgggctcaagtgaacctcccacctcggcctcccaaagtgctaggattacaggtgtgagccaccatgcctagcgtggatttcgttttcattgtgtattattttgaatggtttgatttttttccccctaagcatgttattttcagaatttaaagagcatatttaaagctgggcatggttgcatgtgcctgtaatcttaactatctaggaggcggaggcgagaggatcaattgagcccaggcattggagaccagtcttggcaacatagtgagaccccatctcaaaaaaacaaaacaaacaagaatatttaagaagaaacaaattataaaggggagaataccagttaaaatgcctcaccctgaactttgtttttaaattcgtttctcagtgggttcacctctccttgcattcacaatttcagatgtgggcgggcccaagagttcaccgccaatctttattttatccatgaggaaaatgagagctagagaggattgagcaagctgccggggctccctggctagctggctgcagagactgggctcctgtgatgctgctttcaggaaagggaccgatgatccctttatgtggattataaaatcatccttggacttttctgccctttcccagtgtgtcatctactgagtcttacttcatgggcacccatgtggggaacttgttaaaatgcaggttcccaaacaccctcctggagattcaagttcagtgggtcaaggtagcgcccttccacctgcattttagcaaaccctcccctcctcctgcagatgattctgaagtgggtgatgtgtatgacccctttgacctcccccagctcaaccctgctggcattgtctgtgcatctaggctgaacacccccacagcagcaagggaaggtggggtgctccagctcagcaggggaagtgacagagctggtgcctggactcccagtgccgtgctgtctccatggcccgctccccacagctgctgctcagctgggttgaatggtagctcccagctcacctacctcaggggtgggcactggctggcctggatttggagctggggcaggctgggggtcatggatgcttccggagtacccctcaccccatcacagctccccaaggcaggccttgtggtagatactgacaagcacgttggagttgggaggggcttggccagcctgggcttgggaaggagctgcaaggaggccagggaggactgggatgcatgcccgcctgcactgagagggttctgttgtccctgtgctatagagccttggaggagcctccctcggggtcaggaatcgagcggggacaccgctgggccactcagaaggaccgtttcctggggactgatcaagaggagggaaggtcctattacagcccagaggccacgtggggcctgagccccaaacctcagctgctgttccaggtaggtgccccggcatcatcccatcacccatcagggctaagccctagtgccagctccccactttgagcctgggaaatgtggccatcctggccgcccatggcctgcagctctctagccagcacttgggcaaagaccctccctaagccctcccaaacccacaacctgccaggaaaggggcagaacggcctaaccccattctgaagggcgctgtcccaggtgaccctgcccatgaggcctgggaaggggcagaagatgctctggttttggttaggatgtcctctgtcccctggaaattcccccggggctgagctgctagctgggcctcctggtggttctttgcccagctgactctggtttggggcaagcctagaatccggccagatgtggctcttccaagagttccctaactcttgacactttatcctctaggaaaggattaagacagatggtatcttcatagactgctagagctagggatcttagaggcagaatccaaccgcaatctctttttacttctcaagtattacttgtatcaatagtgtagtttccaatgttgtggttgaacatctcagaggaatcaggtgtaatcttgtcaaaacagcgcgggaagccctttggcttcagacagcccttcctgggctcagtggcctccccttgcccctcagcccagcctgtgccccacgctcctcttcctctccttccaccttcccagttacctccagcaactcctccccactttgcaaaaggaacattgacagtgactggacatcccaagctagaaggtattgaagctaggttagcatctaagtgaggctttcttccctatttaagtaagtaaatacattaataaataaatctttgaggaaggattagagagtccaggaagctttccagaggaagctctaactgtgttaagatttctctatttgagagtgtctcaaatctctcttacatgaaagaagatactatcctgcatggggtgttggccaagagcatcgtgattgttgctgttactgataaaaataatcttagatatggttctttatgtcccctttataatttcctggtcctttcttgggagagccctccagggcagggagccttagccacaggcagtgtttcacttctgttcctctggccattcccagggccccagccctacgccagactcttgttcaagattattagaagaggcagcagtggagccagatgggttcacaacccagctcaaccacctactggccttgttatctctatgaacttctgtctcttcatctgtaaaatggggttaacaatagtaccctagggtgaagattaactacggtaatatctgtaaagtacttgaaacaacatctagcacccagtaagtgcttaacacattagatccgatcactgcaaaagtctgttctctcccagccatagtctgctgcctgatcaacctccctaagacacagtgcagtcatccaattccctggctctacaaccaaccatgactccccattgtctagttaatgactgtgccctaacttcactttaagggcttgaaggcagagaagaatatcatttgccttgcatgtagtaaggaatcagtaatgtttgttgggagagggtttccgctctcagagtgggtgaactgagtccctaaggaatggaagtgcagtcacctacagcccacatctgggggtttgatccaagctcttctgcctccccagccatagcctggccaggagcggacctggatctggggccctgcatccgcacacaaggctagggttggtttcccttggatccactgggcctgcaaatgcagtgagccctattttgagctccagccttggtccacatcagagtcaagagaggacacttggccattgcccagacaggcagtgaccgcagttataatgtgtactctgatgagttcaggccaggcagcagacgtgacgtcatggtcctcattcatcatggggctgtggccaaaaccttggctcccatggctcaggtgggaagcctgaggccagcagagactacccatgatctggcatcttgggacagagaactcagctagctccatcctgcatctcagcccctctggcggaagagaggccacacactgtggaggaacaagccctgggctggggcaggacagaacagcatttgagaccagcctccttatctggtggagagaccttggccacatcaatgaacttctgtattttcccgtctgtgaaatgcggaggataacacctgcttcgtagagtcagggtgagggcaaaatggagcaaaatgcccagagccactgcacgcatggagagggcacttgggaatttgccgcgattctgatcagaccatcaaagttgttctccaggctgccaagtggagctgtttcagtcctgcaaacttctagctttccttaggtggggaaattgtcctcgcctggcctccgctctgagatacaggaaaatagtggtggtttttggcaggagcaggaaacagttcaaatgtttcctggcaaggatgggaagtgcaggagggaagcagcgcagctctgcttggttttctcagagatttttccacttggaggctcggtgctgccaagcccaggaagccagcagtaaagggacagggagggggcaaaccagagcatgctggttcccgcaaggtggtatttttctctttatccacttgaagaatgaatgaatctgttgagattccagacactggactaggcagcagcaagtaaaacaaacatgaccctgctctcagggggctttcattcaaatggggcagataatgaacagcatattatggatgatgtatgttagaaggagataaatgcaatgggggaaataaaaaacacagagaaagaaagggagggcaatcaggggtgccggaggagctgcgttattaagaagaatggtcaggacagacctcactggaaaggcaacatttgagacacacagattgtttgctccccttggggattcctgagaggcccgggggctcagaatcaaggccaaatgcctttcatgagattctaggataggagcaaaatctagaagctcttctagtcccagcccagataatgccatgcccttcctccaagaccttcaatagctccgcactgcctacacagtcaagtgcaaatcattcagccgagattcagggcctcatgatctggtcccaacttgcctgttatctcaccagacccttctcatcccacctcttcagccaagctagtctgcctgccatttccagaacagtccactctctgtttccctcttcctctcatttgtccctctgcctggactatccttgttcccactggtttctgtcagtatggaaatctcgcccagtctccaaatgccacctctccgaggccttccttgaccccccgggctgtggtctctgagccccacagcttggcttgttcccttctcagtgtgcggctcttactctgccttgggtgtaggcaccggttttcctgtcttgtgtctccacctggctggaagtgctccgggcagggcctggactccttcacctccagcaggtgtgggactcatcgaacactggctgaattgtgtccctgctcaaaggctcccagcgacactgtgatgagccgggcccactcagacaacgaaggcagaagtggaggcgggcaagaaaggaggggaaactaaaatgtaggtgagagatgagagaggagccggtgaaggacgaggagagagaaatccccaccatcctttttccagagaagcagattgtcgcagacagaaggagggatccctctcttcccccagaaatagctagtactcccttcagtctcccaggccagtgcctccttgtgtctaactgaaatacctcttgctgcagctgtagttcactttctctttttccatcatctggcttcaggtctccattcaagtcctcattcagcctggatcagtgtggctttcctgatcccctacccaaggggcaggagcaagttcagaggaggctggctcctgccctggagtttgtgctctagttgaggaggctctgatgatccccagagccacatggagactgccagggagctaagatgtggatccaccacgagtcatggaggttgtgccagccaccacccctcagcccctcggcacagcctccctgcagggctaaccttcatcacaagcaaacctgtgaatagagagctcccactatggtagcagggattctcaggtccctcatgccccccaggccctgtgaggccctgtgagccagacccacagcctctgccatctgcctcccacccatcactggaccagctgtgctcagagagcacacgaggcagccaacgtggctctggccctatttagacagatggcgccagagcccagaaataggcttcaacctggcccccatcctggctctgctgcccctgaggggtggtgcatttccatccaggggacctgaactaggctcacatcttgtcctgcccccgctccccatctgcctctcggcttttatgcatgcccaggtctcctcccggaatgttctgccctgtcctccacatggtaggaggcccatgtgtcctcaggctagaaatgtgatgccttgaggccaactggctaggctcaaatctcactcaaggacaatagttcccctcttggtggtgatgtgaggacacaggtgctctcgtgcttccagagtcttagcacagcagctggcaggtaataagtgctcagttaaagtgatctagtgctgtttgtcttttttttttttttttttttggtaacagtttaataaagtgttcataaaatgttcccaataggctggctaagagcaaggtagcagatagaaaaccaagtgggaaacgttttgtggccacacccacagcaaaagagaagctatccatcttctaagagttgccttggctggcacctcctccaggcagcctttgtggattctccaggactgaggcaggagctcctcctctgtgctcccagtactccttgaacagagctccagagtgcagctatgcggtcttgttatggtcttcttaggggtctgtgtacccactagagccttgtgtcttgcctgtaggcaccttgagttcagggaacagagtctggactgtaatttgctgaataaattattttgtgaatgacaggtgggagagacagtgagacggaaagaatcagcttgaggctgccttttccagggcctatcctgaaaacacgaggctgcccacaccaaagtctgggggtcagatgagggagctgaaagaggagcctccctctcctgttctatggtctaggatagtgattctcagtgtgaggtccctggcccagcggcatcagcatccttcagggacttgttggagacagagattctcaggcgctacccaagacctgttgtggcagaaaccctggggcagggcccagcgatctgtgatgtaacaagccctgctgctgattgtgacccaccaaagtgtgagacccattgctgtaatgtttcaagggtgtgcgttcactttcccataaactaacaccaaagaggagaggaagtagagtgtctctgggagtagcgggggcggtttcttctctgctgaaggcttccaagaaggccctggggctgggcccccaggacatggctcctactggacccccactcctgaggctgagatcattgcactgacagggcaggtgtgatggggacacttgagatgcccctgccctctcccaggtggccctagaccagacaggacgctgctcccacctgctcttgagtccattccatccccactgccattgcccagcatcccttctaggtgctccctgcagcaggggccccagggcagacttctggaatgacacaactaagggagaccctggagatcattggctaaaaacacataaattcacacaagcgccaaaacacacaagtgtatacaactcaacatgcacacatatgaacacataaatatgcatgcaacccaaaacacaagcatctaaaacccaaactataatcacaaacacattcctaagcacaaccaaatacccctcaaaacatactcagatacacacacacacacacacacacaaacacattgacagacacacctcaaaacacacaagcaccaatgcatagacccactgtattggcttcccagggccctgcaacaaattaccacaaactgtgtggttctgaacaacagaaagttattctcttccagtcctggaggccagaagtctgaaatcaaggtgtcagcagggccgtgctccctctgcaggacctaggggagcatccttacttgcctcttcctagttcctgggggttgtcagcagttcttggcattccttgacttgcagctgtctcattccagtctctccctttgtcttctcatggccttcatctaaggacaccagtcgttggattcaggggccaccctcatcatgtatgacctcattttaacaaattacatctgcaaagactctatttccaaacaaggtcacattccatgcttccacgtggacatgcattttgggaggatactgttcaacccagtagcgctgcacatcccaaacacatagctacagaggcagacaggcaggcgcacacacacacacacacacacacacacacacacacacacacgcacacacacccctctacctggcacatggaactgagctcctgagaggagagagagtccctaagtgtcagagctatccactcctcctctctgggtgtccagcactgagaagcccacatccttattacaacacttacccagtgatgctgcttttcagtttggttttgttgttttgttttgttcaaaacggttaggtatgcatatagtacaaaattcaaaaagcaataaagacgctgggcgtggtggcttatccctgtaatcccagcactttgggaggccgaggtgggtgaatcacctgaggtcaggagttagagaccagcccggccaacatagtgaaaccctgtctctactaaaaatacaaaaattagccggccgggcatggtggtgggcgcctgtagtcccagctaatcaggaggctgaggcaggagaatcacttgaacccggggggtggagattgcagtgagccaagatcctgccacttcactccagcctgggcaaaagagcgaaactccatcttgaaaaaaaaaaaaaaaaaaacaataaagagaacagagtgaaaggtaagtcttcctcgccacctagttccctacccagaagacaagcactggcaacagtttcttgtgcatccttctagaggaaatggagacacacaggaggcagcattctccatgtgccgtctgcatcttgcttttcctgcctggccatgcacccattgttctttattctggctactttcacaccacttggatctcctccacctgactgtgtgcttgctgaggacaggccatatgtaatggatccctgcctcttcagcacctagctcggggctggcccagagcaggtgttcagtgcagggtggctctatctagacagtaataaattgtcaacagctggttggatctgagtgtgactggctgcagagctttggttgatcagagcccaccctggcagcagcaggaggtggggtgtgatggccccagtaggctgctcctgctggtaggcacctccccattggcagcctccaacccggctctagctggagctgactctggggtcagagcctctgctgctatatccctatggctgcttcacctccttctcctccttcctgccccctccagactcctgcagaggaagcagtcaggggagaggctggagggagaaccatgctggctgcctgccggcatcttagcccaggggccctgcaaaacaggagctgagctgagccattgcccagccttgctggctgaagacttagtggggacttgttaccacggagacaagaattgcagcaataactcagggtcaaactggatccctcagcttcacccagttgtggtgaatgtatttgctccacaacactcaaatatgagatgcgccacattttttttttaaatcaaaacagaaacagatgcctcagtctgagattttgccatgataggctttgagcaaagccctagggggagacagaggtgggcaagggctgctcagccccctgagactggaaacccagggaaatgctcaccagcagctccctttgtccctctgtggaaggagggcttaagttagatgatttgtaagatctcctccagccaaaacactctcatcacgggggccaaatgagtcctaccccaacccactgccaatctttcctttcttctgcaaatatttgtaaagcactcaaccctatccagcacagcagaggaaataatcagcaaacacagccaagggctctgttgtcaaggagcttccctttgcggggaggtgtggggagtcagccgtctgctacgtcatcccgtaaacaacatcgaatgtactaggtacaacaaggaaaattatacttaactttattgagccattgcaatgtgctaggcactgctctaatgtttcatgtgagttggctctattaaacctcacatctacccaataagtaggtgctattaacatctccattttacagacaaggaaactgaggcatagggaggttaagaagcttgcccaaagacatggggctagtaagtagcagaggcagaacttgggcccagagagtctagtactagaaatccacatttgctgcatacatgatgcctgcctcccaagatgctcagaggcacaggacttggggagctgggcctggcctgagctcttccctaaggaagcaaaaatggagctgagattaaccagggggagaatgaatcaagtaatgggagagagaaccttccaggtggtgggactggcatatgcaaaggccctgtggcaggagggaaggtggcatgctccaggaactgagggaacaacctaggaggctggagatggaagtgagggggaagtttgacatgatgaagccagaacactaggcagggccccacacccaggccttgctggccaagttaaggagagcgaagaaagcccttctagctgattccatcacagcctggtccaggaggcctccccaggcactgcagattgggttcggttcatctgtgagcccttctcacactgcgttatcactgcctttcagccaaggcctttctcattcacctagaatgagcttgaggaggggaggaacacatctcatcctctttagcaacccctatccagtagagaactcaggaaagaataagtgagaacagtaggatggaagggagggtgagatcagcaagaccagggggtgtacccagaaggctccctgaagaaagcagagttgaactgggccttgccaatggagcattcccgttgggggaggatcaaggtcctccacagaggggaggaatggagggggcagagacaaccaaggcctttgatgggcaaggggccttccatcggctggagctgagattcctcgtggggagctgggggaggtgagactggaggggctcctggggccaagagggcctcccctggtcccagcctctgcccaggagcaggccaggagcagagagctcagatgtcaaaaggagcagggagctgtgcagaagctcgggccttggctttagatctccacccctgctgttcagctgctagctgtatgaccctgggcaggctacacacccactctgggcctcagcatcctcatttgtaaatggggacagttgccacctcttctctggcaggactgttgggggccaggtgagatgactttgtaaacatactttgtcacctggaggagagtgcacataggccctccgtcaggctcagaggtaatccagaggccaggcccattcaggaccccgccccctacctcctggaggctaccatttctcttttgttctcttccctataggagtctaggtttagaccaccccaaaaaatgactagaggggcctcagtagctaccatcttccactgatccattgagggggtggggaggtgggaggggcagggcagggggctggggaggctgcccctgcctgccctagtgagagctgtgccagggaggcctccaagtcctcttcctgatctctgcccctgggacttgatgctgtagtcagcacagtaccactgctgtcaggaggagccactgacctggggtggagcagggagggaggcttgcctctggctttcaggcagacgcccagggacctggtggccactttggcttcgatgatgcaccaccttggcttcttgatctgcctgcccatggcccagccaggccctgacaggggagagagaggagatggcattggattcaggctttgattcttctttctgagtaggcagcctgcacaggaaccactgggctgcatgtcactgtgagagctcagtccctccaccctctcctccccatcaacaagtctgagtgggagctgatcagaatgagggcatttgaggaagggaagagggatttgatgcaggaggaaagcttgattacatggatatctgtcaatctcaagccttccttttaatatatgatctttttctaattagaagcaacaatacatgttcatattaaatagtttttcaaactcagaaaaaaatgttaaggactgttaaaagaatgtgatataattttagtttttttcttttatttttttttagaatccagatcatttcatttaacagcattgtatcctgctgtttttatttcctattttacctttttaacacaggcatgaagtcacctgtcctcctccccgtgtctccctgagtcactgcccagctcccaggggcctgggtgactgtgacagccccacagctgcctctgccttctgtctccagcaccccctgggcaccatcatggctgctcacttactcaggggcataggcagaaagccatgggttggggtccagggtctggaggacaaggaaaagaaacttcctggcaaggagaggcatctctgtgggggtcccagaggtgagatggatggggtggggaagccaacacactcagcttccagcctgagtccaagtggccaccttctcccctgatggcgtcccaactccatctgccacccacagaggtgttaagaggataagtttcttaacctctctgggcctgaaattcctcattcataagatgggataaaaatagaagctgcctggtccttctctttagctgagagtcccttagatgtagtacagatgtgggaggccatcctcctgtaccccagaaatacagtcctcctggaattgggcaaagctgctctgttccttcaaaggcttgtgccttcggaggctgcgtgatgtagtggaggcagacacttagattctaatcctgcctttgtctctctccagctgtgtaactttaggccagttacttaacctctctgagcctcagtttctgtacgtgtaagatggggatactgactcttacttcttaggctgctacctctcatgttgcttgtgaggaataaacgatgttcagtgggatagccataagaaggcctggcccatcacaaatgcccatgtcctttcctgcccctttcttctcctgaggccccctcaggggctacacccataggagcctggagtgtggttccagtattctctatcagcctttccttttttcagtgtacttctgtcttgagcctagcagcttcattcctgcttgttggaatcagcgttctctgcctcgagggtggcacatagcaaagtgatcaggagggggctgtggaaccagccccccagctcaggccctaacttcacggtactaactccctgatctgggcaagtcttttaacctctctgggcctgaaattcctcattcataagatgggataataatagaacctgcctggtctttgtacaggaaacaaaaaacactctaggaatcttaagcaaaaccaggactgggacatgatgctgtagtcagcttgattcatacagggaatcgcagggtctcgaaatcactggaagaattagaagctgggtcttcagaacagagcagaactgtccctccagacaaattactcctcacccagtcaggagggccattactggagccacagagttcacgtcctttcacctgctatctagggatgagaaaactgctgcagcttttgccacaattgcctctcacaccaccccctccctgggagccagagactgggcattgaacttcctgcagagaatcccttcctgtcctcggcatggcttgtcagcagaacacggcctgagcaccagggagatcgcctcctcctccctctcctcccttcagccttgtaaatctatctccagcatgtctaattgaagagctctaatctgtatccagaaccccagctgcaagggagtgttggaaatgtaccttttaactttccagcttctgcaatataggaaggcacagaggtgggaatggatgctgagggtatcaaccgtgtcccatatgcaacctgataggtttaacccagtcgacacctgaagagacttggcacagggcctggcatatagaactcactcaataagtgttagctgttattcttattcttgggctggggcagcagcgagaattgcctggccctgcccacgagccctggcagagagcagcagaagcagaaatgcctttgcccagcatggtgctgtccatggtgctgagagcccagctggacccagccaggggcagcgggatcattgctctgcttgcatcgtgggcccaatggaaggtggaactgcaatcctctcaccccatgctgaggcttcaggagtgactgcagcggagggacgtttggggacctctcggggaaggctggcttcgatcctatgaagaggacagcaaaagcaacaacttagtttgtggcacagtttacagaaagagtctccatgcactatgccctttaactaacactcataatcaccctggtataggcaggacagatatgatctttaagaaaaaactgaatagcaagaggttaactagcagctgataaacaatagagccagattcacacccagtctccttacctgcagctgtatgctccctccactccctgcagcgactgctggagggaaacttggtagccaatgtgcgctatgtgggggcaaaaatttgggattcatgtactctgtgcactgtgcaaatgtgtacaaaccacctacattttattctttcctacccttgagtgtgtctctgggtaaagggccttctgtctctcattgaggcctactacgtgatggtctttgggagaaccatgaaaagtataagagaaagatatggtccctactatcaaagagcccatggatttgttggtaagctggctgctcacgtgcatgggaaaatgagaggatggtcccaggcagtggttgcaaggccagctgtgtaaagagggtgggaacaaggttcagacagggctggtaatctgaaagagggttcagaggagtacaatataagctggactcaggggctttaaatgctgatgagaccaaggctcacccaagtccaggaggaagtggctcaagctgtgtaggggtggggcaagcaactctgaataagggggctagtggggcagaacagagggtaccatgaggaagtagccaggccagtggcctctagggtaatgggaggaataccagagcctggaacttccagtgaagaggtggtgtgggcctctgtagatcttcagccaactctccacagattcgggaccagctgggggtgggggcagagattgcatgggaggagaatataaggaccagcctcacgaactgccacactgtgacatggtttaagaggcactgaggtatcatcctttatccccaaatctctccaccctctctccttatttaggaggagtgacaaaactttttggatcatcaagaactccttctctaggtgcaaataaccctggaaatctcagtctggtgcttttatgtcttggctgcacacaataattggagattctcatgcttaatgtctggggtggaacatgagtatctagatgtactaaacactgtctaggtgattccagtgaccccctcccaggctaaggagtcactgaaagcactgagtggggagccaaaaacccccagttctatccccaatccaccactttccccagccttaagcaaatctccatgtctgctggagactcagtttctccatatgtaaagctgagcaaaccactctttgttgtgaagagttgaggagtttgaggatggtatggggcagggaagggcttactgatatttagggaaagatttatggccagcagacatgtcagtggtgaaggacgtgaaccagagcccttcattccagtgacacacccttcctctccccacacttcctccaatagtaaccagccccctagccatgagagtaaacctcactgagagggggtccctccgtgagaaggggcaaggggtggtgggggcagggcaggagacctggagaagaaggaagaaggggaggtgggagtggatgcccatgaccaggaatcccagcttgtttgtttaagtccagaaccatgggagataatcttacctgttgttaacaaaaagatgattaattattgaagctactgagaaggctaaatggcaagggggcagggtgggagctgtggctttgtgcactctgggggtcatggggttggagagaaggtgggggtggctccccagccatagcaccttttcctagggcatggcttgtggctatagtgattctctaatccaaaccaaaacacatgtcctatggaccagttcctgagaactcatggggatggtggagcagactgggccctgggctgtgctgggaaatgcaggcgtagtggctgcagatccagcctgggttcctggctcagcccactctgctctccgctgcatcaccctaaaggctagggaagctgctgtccctggactaaagtttgagcaaggtcatccccttcctctgccccctgctcagcatgtccagagcagcagaggctcaggggccagcaaagcagagggttacaaatggtctggcttcagggccagctctgccattcactagcaccgtgacctcgggccagttaacttctctgggccatgaccttgagccagttgtttaacctctctaggccttaattttctcttgcatttagggatggttctcataccctagggtacttatgagaattaaatgagctagtacttaaatagaaaatatttagctcatattacttgctctgtaaacgttagctattaataaaatttgtccctccctgggccctcctggaccatcctaactctggggtcatccctgagatttggctttggccttgagatgtctaactcatctggaaggggaagtgggaagcaaagtgctggccttgttagttagggcagcagtggataaaaccaggctaggtctggaggcctgggagtgagcagtaggatggggcagacagaaaggcaaagctagccctttttgaagcctttgcccagttgccaaagacaactttgcccaagcctagaacagctgagctgccagcttttggcataggaacccaggatggaggagaaatgggacaggaagagggccacacactctcccatcagataagatatgcagctaggaggggccctgaaaccctgactcaccaaccagaattcacatcatctcccactgcccctccttggcccacaaagcaaggctgacatttattttttatgcacaggaaggacagaaacaaccaccacctaccagctgcagtctgtgggatagtggatggacctttccatcctcacatctctcctcttgcctgccccagaacagagaggctggaaggaggagtgtagggactgtgcagtctgggcccctcaccacagccttacaaataagctgaggaggaggaggatggcagcgctggcgaattaagcagtcatatttctcaagcactgtgcaaatggatttatgtgaattatcttacttcccctttgcaataaccctgtgaggcaatactgttattatacccattttccagatatgggaactgaggctgagacagatgaagtcactgcccctggtcacacagctagcaaaggtgggtctgggattaagtccagtcagtggcttcagagagcctgatccttcccattgccccagacagcctttgtcctatactgtgaaagtgatgtctaaacagatgagttctttgatgcccccgctacgccctgctgggctggtggccctgctgtgttttctgttgacatcctagagtttctagcttcattctttccagtgctggtgctttagtctccagtaagccaaaatctggattttctgcctgtcttcttcacacccaagagctagctctccctccagaaagaagtatggtccagggagggtgaagggatgcagagaaaaggcttggtgctgctttaggtttccatggcaacagcctccctcattactgcctctgcttgctgcctgggaaagctgaggagggtggtgaggtgggagagggtgaggatcttgtctcctttcttttcctccctcactgccctgcaggttgagcagccaggttgagctgaaagcctgcacctgaccaacctgctggatggaattccccacctcctgcccaactccaagcttagtggctggggccttgtaactaggggtcctcccaggcagaagggccacctggtccaagccgcccaacagcagtcctctccctaaccccaaaggctgggatgtgaactccctagagaggacctcatgtttgtacttccaggggaaatagatactcaatgaattcttgttgaatgaatgaatgaatgaaccaatagtggtctattctacactgtagccactgccattcattttcatttcctcaaaacgttatattcagccttccctctaggtctttgccaacacgggtgcctctgcccacgcttgcccattgcacaggactaactcctacacccctttcacatctcagcttggaggtcactttgtcaaaattcaaaacttttacacttcaaaagacaccatcaagacaattaaaagaaaagcaataggccagggggaaactatttgcaaagcagagctctgataaaggacgtgcatttgagcataaagatgaccaaaggggccctgaaggagggtgctgccagcaagggagttcctgggtctgtaagtcttgtggtctctccaccgcgtgtgttcttttgcagcagccccgtagctgggtggagcctccgggcctgacgtggaccttcactggagaagtgactcaggtgggaaaagtctccccgggcctctccacctgcaggatcgccttcctacaccttcccccgcccgcttccttcgcgcgggctcctcccaatgaccaccagcagaactgcagcctcctgccttagctgacctggagcccgaggtagctcagatgccagctccttcctccaagagaccctagaaatgccattggctgctactctgatgctctggcagaaggcatgccgttgaagtgtactgtgttcgatgtaaactattatgagtttgcatctggctaaacgtgctagtgagttaattagccacctggggtagaaacaagaaaactatgggtggcctaggcagagctcgatggagcaggaattaggggaactgagaaagacaggcaagagactcccggatcctgctagatgctaatctagagggtgggagtgggaggagttttgtgcaccccttctgtttccaggactactctcaggccctccatcgcaggttctgggagtgagcacaagcagcccagactcccaggccacctcctgtcccctgcttcaatccctttaccttcattccttctccatccccatctctcagccctccccaactcctgaaacctttccatggtgccccctggatctccattcttcattttgcaaatatttatgtgatgctccttgtgttccaggcattgttctacaagatgaacacatcctaacactcctcttaagagccctgtgaagtgggtactaatggctgttgccatttccactttacagaggagtaaagtgaggcatggggactgtaagtgccttgctcaaggtcacccgatgagcgatgagtgagcgttggagctgagattcagtggcacggaacctgtaatccccagaagcatccccagctcctcggtctcctcaccctccgactgggagactccccagtccagcttccctttccaccctctcagagggtggttcctgcttcccctccaacaccactggcctggggatggagacgtgtctttcttgttccccttggcaacattgagactcttcctccctgctttctagagccccctgtcttggacccacaggtgtcaacctagacatcttgctgcccatcgttgttagtcatcaaggagtcccccaggccactctccccttcccccctcactgtctccccagtttttttcctgtcttcattcttgctgatgtcaatgtccacatctccacaaagatgatccttctgatactcagccgctcgctcccacggtcatgtcctagacccgatcaccaccgatagccggaatctctttcatttcagcaccaaacatcccactttcagcatgccactccctctgctctacacttactagccgtccacaattcttctacctccccttggaactccagtagctttccctggtcctcacccatcttgcatcttatttctctcctggctcaaattccacagcaaatcattacaattattcacctgctacaccctcaaccctcttgtgttatgctcatacttgctggggggaagcctctacccctactaagtcttccacacctgcaaccatacaggtgaatccagcacagcaagtctggctgctctcgtcaattcaagatcatgagcctccacaggccccattgttgcctggcaatcctgctccatttccgtaatccatcctctcttattcccctagacttctatttctacctttttttcctgtcaccaaacatccaacatccgcccaccaccaccacctcacactgggctgagacctcattccttcttttactgagaaacctgaagcaaggctgggcatgggggctcgcacctgtaatcccagcactttgggaggccgaggtgggtgggtcacctgaggtcaggagtttgagaccagcctggccaacatggtgaaaccccatttctactaaaaatacaaaatttagccaagtgtagtggtgggcacctgtagtccgagctactcaggaggctgaggtagcagaattgcttgaaccctggaggcagaggttgcagttagccaagatggtgccactgcactccagcctaagcgacagagtgagactctgtctcaaaaaaaaaaaaaaaaaagaaaagaaaagaaaaagaaactagaagcagtaaggacagaacactcactggctgccgccgccactcctgggaccagccagcacctgagcatgtgtgctgccttccctcccactcacccagccaacagcctgactctcagtaaacatctccactgtgcactagttcccaagcctcccgcagtctcactttgctccagcagttcccccctcctcctacttcttctactgaatcattcccaccactatacaatgtgttatttttcccgtcttaaccactttcacctccaattactcttccagagagctgtttttgcccactggctccaattcctctcctgtcattctctctggagcctattccagtctggccacctgcacatggcttaaaccatggctaatttggctgggcgcagtggctcgtgcctcaagtgaaagagagatagagagggagatagagagagaggaaggaaggtagaaaagagagaggaaggaaggaaggaaggagggagggagagagagagagagagagcaaccatggctcattcacagttgtcatctttcttgaccacatcaacactggttcctccctcctcctggaaacattgtcttcattcaacccaggacaccaccctctcctgcttttcctccttcctcactggctgctacttctcagtctccttctctgtttcctcctcccctgccctgtagatattggcgcaccccgaggctcccaccttggatctctcctctcactacattctcttctgtaattcagggctttgcctcgaagagttgtcgctatgccagtggcttttgtctcacatttatgtctccagtctcttttctgaactgcagactaacctatccaaatccctgctccccgtccccacttagcatgttccaaactcaactcttggtttcacccttgcacgcactccccctccacctctactgtccatttccatcctgcactttctgcctctcccattccataacagcaactctatcttccagtggctcaggccaaaaacctgagagtcatcctcgactcctctcactctttcacatcccctatctaatctgccggcaaatcttgttggctccacattcagaatatttccaaaatctgagcacgtctctcacctccactgcgcccatcccagtccaggctaccattgtctcctgcccggaccctggccgagctctccgcatctacttctccacttgttcacccctcctgctcccccacctagtctccatatgaggatcaaagagatctcattaaagcctgtaatcccagcactttgggagtccgaggcaggagaatcacttgaattcaggagtttgagactagcctgggcaacatagtgagacccttgtttctatcaaaaaattttaagaattagcctggtgtggtggcatgcacctgtagtcccagctactcttgaatattgcttgagcccaggaattggaggctacagtgagctatgattgtgccaccgtgacagagtgaggctctatctctctcttaaaaaaaaaaagtcattttaattcactccatggctcactccccatgccctttgccctgccctgtgcagcccactggtctgcttgcttccccaactctccgggcaagctcgaagcccagggcctctcctccacttaaagtgctctttccccaacagctgcatggttcactccctcaagtccttgctcagatgtcattctctcagtgaggaattccctaatcacccctttacaattctaacctcaccctcatccctccactttgtctccccagtagaatcccacaagggagggatttttatttatcttgttcactggtgcatttgtctagcataaagcagttgcccaccaaatattcaaatgcatcaatgaatggatgaatgagtctacttttctcgaatggaagtgaagggtttccaggtagaggtgaggtctgaaggcaaaatgaatgatcttttgagagaacaaccaccttgcagataagttcaagtagctaccggacacctcccattttcacctgcccttcccactgttatccatgcctgaggaatgtgatgccagggacggcaggctctgcattggtgtctcaccaaaatgttcaggctcacggagttggctcaggtccctgggcaggtcctggtctccctagttcaaatgcctggaagacagagacctttctaagccaggcatagaaataacaaactccacatatttccagctatttgtgggggcaaaaaaattaaaacaattgaactcatggagatagagagtagaaggatggttaccagaggcttagaaggatatgagggtggtggggagtggggatgcttaatatgtacaaaaaacagaatgaataagatctagtatttactagcacaacagggtgactatagtcaaaaataatttaattgtacaccttaaaacaactgaaagagtataattggattgtttgtaacccaaaggataaatgctcgaaaggatggatacctcatttatcctgatgtgcttatatctcattgcatgcctgtatcaaaacatctcaggtactccataaatatatacacctactatgtacccacagaagttaaaaaaaaaagaggggggtgtttcttgagtcactgcacatgccaggcactgcattccctaggagctatggcccttaccatggctggatggtgactgcatcagagattgctgaatgcagagatgattgtcattgagccccgtctgcatgggcgttccgtgaacacagcggttttgacttccaacctgaacatttccacactggggtctgacccacatttgtgaaatttgttcatttatatacaacaaaaacttcccaaggtagaactggaaaaatgcacatttggatgtgcattttacaactcttgtttcagggatccagtggtacaaaataagaactctcccaggaaacgagaaccagtctgtcatcccggccttgggtttgaggcagctgttctcttgcaggacagggctgtgtgccgtctcgtgggctggccctcctgtcttgggtctgaagtggcctagcctggccgaggcactcggtgcccatcccacaactccccatcgggcttctgtgttttgcaaaatgcaagggagtctttgcatctgacctggatgccctctgtttcccagggatcctcccaggatgtctgcctcaccagacgacctgagtacagggggaaggttacagaacatgacagtggatgaatgcttccagtctcggaacaccgtcctccaggggcagccctttgggggtgtccccaccgtgctgtgcctcaacatcgccctgtgggtggtgagtcctgggcactgcaggaggcagacagtaaagcctcagacagggtcgaactttcacaggtgatgcagtgggggacccagttgtccaaatggacaacaacaacattgatacaaactgcctgaatgtcagtcctgcctagggtggccccggtaggtgggcctcaaagaggctggaggaacaggcagaattcctgggattcttttctgtgcatcattgtccagaggttcacctggcctccttcctctttctcattgctgaggtcttcaaggcacattctggtcccatagatctgaacatgcctccagctccattcaatgaactctgagcatccactctgtgcccagaagctgctgggcgctggcaacctacagttgaaaggaatggcccctactccaacagagctcaccttctagtggaggagctccctggggacctcagggacagggtctcccccaagggaatgcagggggccagccaaggggaagggatccatgaagtctcccaccccacattgcttttcctggcctgtagctcgtccttgtggtttactccttcctccggaaagctgcgtgggactatgggcgcctggctctgctgatacacaatgacaggtgaggaggggtcgagatgggtgagccgttgcccccttggggaaaacctgttgccatggccaggacgcagctctgcccagcgcccgagctgcagcaggtgtctcgccagcaagtggcctctgcccctgctctgccctccctgcaggaaggggacttggagggcagccatccctgggcacaaggccgtgtttttctctggtcttagactttctggatcacgtggctgaactcccagatgcctggtgtacctggcacaggggcgattgctgtctgtgcccagagctgtgtgctcagcaaaggagctgaggagcgcctgcccgtggcagagcagagggcagccctcagccagggagtggggagggagcagggcaggcagctgagaacttttctctcctttcttacctccctgccccttccctggctggcagcctgacctcgctgatctatggggagcagagcgagaagacatctccctcggagacttccttggagatggaacgcagagacaaggtgagtgctgggagcggtctgggcggtgggagtcccagcactgggcaggcaggcgtggtgtgcacaggaagaaacacggcttagaccttggggctttgtaatcagccagcctcaaccactctggcagtgtgaccttgagcaaattcctcagcctcccccagactcagtttccccacctgaaagatggagttattgaccatacctactactagggtgccaagtaagtgttaacgaattaagatatcttagagagatttttaacattaatttgtcttctctgctcaaatctccaacccttctcacagtcccgtcctgcccacgtccctacctctgactctgaatcaaggcctcacctcccatttcacatagaagattctagtcatgtggtagggattccctcagcctcaggcttcccagccctgtttagtggagcgcagtctgctgtttcctcctcttccctggtgaaggccagccctccacccgactcatgcattccttcagccacttgctgtgtgccagccactggtctgggagctggggaccaagtcctgcctcatggcgctgtcttccccaggcaggggagacgaccagacagaggcatggtggagaacgccacaggaggaggtcagagatggtctcgggtagtggtgacatttcggcggggccctgaatactctgagagggagccctgagaacgtcctccctccccacccccacacacagctgaactgacagtggcccatgctgctgtcaccacttcctcacctctcactcacgccccgcctcccactcacgccccgcctcccactcacgccccgcctcccactcacgcctcctctcccacccacgcctcccctcccactctcgcctcccctcccactctcgcctcccctcccacccacgccccctcccactctcgcctcccctcccactctcgcctcccctcccacccacgccccctcacactcacgcctcccctcccactctcgcctcccctcccactcatgccctgcctcccactcacgcctcctctctcacttacaccccacctcccactcacgcctcccctcccactcatgccccacctcccactcacacctcctctctcattcacaccccgcctcccactcacgcctcccctcccactcacgccccacctcccactcacgccccgcctcccactcacgcccccctcccactcacgccttccctccccctctcgcctcccaatcacgcttcacctcccactcacgccccctcccactcacgcctcccctcccactcatgcctcacctcccactcacgcctcccattcatgcctcctctcccactcacgcctcccctccccactcacctcccactcacacctcccctcccactcacgcctcccattcacgcctcccctcctactctcgcctcccctccttctagcgcctcccctccccctctcgcctctcactcatgcctcccctcccactcatgcccccctcccaccaagcctgccccccactcactcgttgcctcccactcctcccactctcacctcccctccctctcacacctcccctcccacccacgcctcctctcccactcatgcctcctctcccactcacgcctcaacctcctcaaatgtgagctcccgtccctcactccacccagacaaccctgaaggtcagcagtggttccccccaccgctaaatccaatggacttttctcagttcacatcttgcctgcgttctctgaaacgtctgaccctgtagaccgtctttctctcttgcacaggtgctctccgttgcataggtgatgtcacattctttgggttttccttctgcctctctgtctgctcctcctgtgtctccttagcagacttctcctccacaccgggagtccccccaaccagctgatcccatatccttcccctcaccctgactcctgggcaatgacacccacactgacaacttcctttgccatctctacacataaacttttaaattcctgtctccagctaatcctctcccactgggccccagcctgattattcaatgcctttcaaaatacctccatatggatattgtagtcatttggggttccatttgtccaaaacatttcatgatatcccaccacacacccacctgttcctctgaccttggtctcagacctcccaccattctccccagggtctcctctccctcttacccaggtccccaagcatagccaatgtgtctccacgttgtgttgctttgaccttcccagctttctttctctccatcactcctaccatcccctggtccaggcctccatcagcctcttgcctggacaactgcagtagctctaactgatccctttaggtccacgctctagggcccttatccattttccacctgcatccagagagattcccctgcctggggacatatattctgctgcagagaccttcactgtcttcctagggcctgtggaatcaattgcagatgctgtgccgtggcctggtagtttggtccatcctcccttactcctcccaactcccctatccctgccacatgagtccaccgtttagcttctcaacagggccacctgcttccctccaccagccctttcccaggctcttccctctcccccttccgcagtggcccttctctgagtcactcaccttttgttgagatttcagcttaagcacacttccccagggagccctgaccacccctcctgggtccagatctcttgttatatagccacagaaaatgcattccttttcttcaacatttttaaccctgtctgtaacgatccctcatctgcaagatcagtctagtgtgtctgctttccgcaggccctgaacttggatttgctcaccactgcaccccacatccaatccagcctgccatgtacttagcatctgatgcatatttgtcagttgcgctaagtaagcggagccaaattccttccattgtcatccctcgagaggcggggtccttcacttgctagaatctgccctctccaaagtgcagagcctcagacaagtgacttcatctcttgaaggcttcctggatagaaaaaaggcagcaacatctaccttgcaaggtggctcgcaggtttattcttggaaatatcactttgattttttttttcttgttacaatgacaaaaaaagttttatttttaaaaatctaagaagataaatccttatggcagcagtgagggggacaaactgaagagggcgtaaattaaattaaatggagaacagagagttcagtgaggtggcccccacagtgtccagccaggatggggagccttcagccagagccaggtggtgtgggtgaagaaaatgggtctcaccatggttccctgagcaagttgggtcaggtactgttacccccaggtggcgggggctcagataggtgaagtgaactgacagctgtcactctgtcacgtcagctgagctggctcctgggaactgcagccctgtatctgcctctcatgtggctgttcagctgctgagctttctgaatggtttatgccttcagagcgataatgtgtactcaggggagggagtgtgtgtgtgtgtatgtgtgtgcacacacacatgagagagacagagagagagagagagatccacacaggatattcatggccacgcttctactcatgacctctgccctttcctggatgacccatcctctgtctattccagtatacacctgtgcacctgtagtggaaggggcagaaacacattcccaggaagatgtgtccccagtggtacctaatcatgagggaccatcaagaaagctacttgttcccttagtcagttgcaccctgtttgcccagctgagccatggagacagactcttcatgcaggaggggtggctggacctctctcggcccagctctgctttgctagttacccctccctggggatgctccccactgctgctgccaccaccatgctatttcccttccttgctctgactcacacctgaacatttatccttaatttagctccccagggcatagctggaggaatgtcctgctgtgaacaccctcgagtggccattgtcaccatcagccaacccaacacagggaaggggacttagaaggtgggacttatgccgaggggagcaagggacttctatttcttttgtgccttctcaaaaggaagcaacgaggacaggcaaaaaagaaacagatgtcctttgctcccctcggcataaggcccgccttctaagtttccttccctgtgtcaggttggctgatagttgcttccttttgggaagtacctcttccccagtccatgtggttccagaggactatcaatcaagaggtctgcctggttcacagaagtgcacatgacccaaatggggccaatctagagctgtaaccttgtgcaaggttttgctaagtcctctgggatcccagaaggaagcaggcaccagagtaacttcaccagctaccagagctggcagcttttagagctgcaggccccagccccctctcttacacaccgttccaaagatgactctctctctagtcccccaccaatctccccatggctaaggccacctttccccaccacccagaaactccagacagcaagaccccaagagaaaggcctcaaccggacaggaccctcagcacatggcatcaaagatgccaccaaaccacgccaggtttcatgatgtttactgaggtgcaggaattcagagggaaagagaccttcctccttgcaacacccatatcaatccccttaagggatttttttttttaattttaataagtggggtcttgctgtgttgcccaggctggactcaaactcctgggctcaagtgatccatctgcctcagcctcttgagctgctgagatgacaagtgtgagccaccatgcctggcttccttaaggaaattttaattggccccacttgggtaaagttcccattggccagtcaatcactggaggcaaactcccactcggacagagtaagagtaggagcccactggaccacacgcatccagtgaaggacatttccagaaggaagcatgaaggacagacagagagcaacagacgttcaccccagaagcagtcacttctccccctccagttcaagggtcaccttctaaaccccatttcctataacaggagggcagagatgtccactcatttccagggaagcatctccctccacagtcaccactggttcccagctgagccttcagactctttttcccaggaaggaggccccggacgctgccgcggctgcctcagatgacctggccgcctgggttcccagagctgggcagggcaggccaggacctgggttttctcacagtttctctcctttccccgcagggattctgttcctggttcttcaacagcataacaatgaagtaagtgcccgggctctgtgagcttgtgaccgtgttgccttgggggtggggggtggaggctcctggaaaagttagcagcccccagcctgggaagacagggcctgagctccgtatcctccccgccacctcggcccattaccagtgaaggatgctttcctggggtacagttggtgacgtgagaactgggcacagcccactgcccctgttatctctgcctcagtccttagggaaggaccacttttaatagctgaatcattactcgcgtgcttatagaaatgcttctgtgaactccacaccaggaaaaagaaacccttcctttgtgctatctgcttgatttctgtgaacatcattcaacatatcatgtgttcgcccttctgcccaagcaaacatcgggcagaagggcaggcctcgctcggcctcagtgcctggagagcagaggggcagcccttgcccacctcaccttgtgggtttcttgaatgccagaccccactttgcaagcaagcagcccccaagtcacctgttttctcctgcaagctgacctcaagttacgtgttttctcctgattccccaacaccagccagacgcttcagcagagcagacacttaccggaactctatgttcccactgcgtaggcatacacacatgcacactcatacatacacgcacacacacgtacacgtgtgcacacagctctgcctccacctcagaccccacacactcatgggctctccctcagtgtgctccacctgtcctgtcctgcccatcctttaaacccctccaccccacccctacccaaagactcctatcacagaggcccctctgtcagggacccagcatctgggaaagcaggaaggcagggcattgcaccgtgcatccagcagctcttgagagcagtgtcatagaagacagcttaatgcgtttactgagcagcaataagtcaagtagcgtccccgtgcacaaacccatgcggtctggttggagaaacaaaggtgaacaagactcccttcgtagcattcagaatgggagggttataattgctgtgcagacggcatgtggggaagagagaaattaattccaactggaaaagtatagttttgagctgggcattggaggacaggaagagtttcgacaggcgcgatgtgggatgtggagggcacatcagaagtaaaggaccgtgtgagccagtttgttgcagagatgagtagggtgtgcacagacatggtaaatctggtgtgactagaagcaaggtttcatggtaagtgtggcgggggagggtaaaagattgggctggaaggatcagttgggatttttttttttttttttttgagacagaatatctctctgtcaccagggtgatgtgcagtggcacaatctcagctcactgcaacctccgcctcctgggttcaagcaattctcctgcctcagcctcccgagtagctgggattagaggcacgtgccaccatgtccagctaatttttgtatttttagtagagacggggtttcaccatgttggccaggctggcctcaaactcctgacctgaggtgatccacctgcctcagtctcttaaagtgctgggattacaggcatgagccaccgcactgggcctcagctgggaccttggctggcatactgagaatcttgggctttcatctagagacagtagagagccaattagtatttttaagctggaaactcagaacaatatatgtgtgtaggcagaagtatggagagtgaatggcattagagaaagtccaaagtcaaggtgagcagttaaggaggctattccaatggtcgaggtgggaggtgctagtgacctgaaccggggcagtgactagagaaacaatgggaggggaagatgggagggagatcataaggctacagtcagtaggttgtggcctagttaagaaagagggagaaattgaggtctggtttctggggagggtagtaatgccattaggtgggagaggaaacacaaaatgatgagatgtagtcagggcaagtatgcaagctgacaaaggagctgttgaaaaaacaagattgaagcctaggagaaaggtcagagttagagatttcaacttgggagatggtgcatggaggctgtagttgaagtcatgggagcagatgggtcatccaaggatgtaagaccagaagcggcccaagggagtgcctcatcgaggcgggaggaagaggcatcctctgggctggactcagtgaagccaggccaggacaaggctcccctctagggtggggcgacccagaaacctctagtgctacagaggtggagtagaatgggggttgaggaaaggacattgactttggtgagttgggtctctgttgggagggcaggccgaggataggatgtccaagacacagaggcagagaaggaaggtcacctttttccagaggtgcatggaaggagggaagtgaagctactggaaggaggagggaaaacaggtcagggaacagatcagagagtggatccttgaggagctgttttattacagaggaaccaacaagcacttgagcctggttgtagtttacagggaagaggtgtgggtggacgcaggtgcatgcagagagaggaggatgccgaagatgagagagcagaacaatggatccagcacgtcttcagaaagaggtggaaggaagggaagcaatgagagcagagacagagaattaattgtgagtaggaagaagggcgattggctggaaggtcagggtggggcacttacaagaaagatggagaaaggaaacaggcctagtggtggaggcaggaattcctggcccaggaagagaattctagtgctctcagtgccatccagtcctgtccagccctctgctctctccacctgattggaggctcctggacctcaccccgcctcaggcagtgcaagaggaccttcccccgctctccagaagttctcatccattccacttctggcatttcattctcaagtccagggagggaaacgtttagccgctcaaagttaaaaaatcaagagctctaaataattcctcaaatgagaacattgaaaaccttgaaggtgtgccttttgtagtattgtttaaaaataaatcttttttttttttttaagacggagtctcactctgtcgcccaggctggagggcagtggtacgatctcagctcactgcaacctccgcctcccacgttcaaacaattttcctgcctcagcctcccaagtagctgggattacaggcacgtgccaccatgcctggctaatttttatatttttagtagagacagggcttcaccacgttggccaggctggtcttgaactcctgatctcaagtgatctgcccatcttggccccccaaagtgctgggattacaggcataagccactgcacccggccttaaaaataaatctgaatcccagactggatgctagttttgcatacaacctacaatcctgacaagggggcaggggtgggtaaaccatggtgtgtccaccagtggagtggggaggcctgcatggtgctgagcatgaaccagtgctccatcaacagaggccactgtcaccattacgtaaaaccatcggaaaatgcttgagattaaatgccaagcaaaagagcagtgcatcaaatgctttttataactataatcaccaagtaaaatgaacacaacaagaaaataaaggaggttgggcatggtggctcacacctgtaatcccagcactttgggaggccaaagcgggcagatcatttgagatcaggagtttgagaccaacctggccaacatggtgaaactccgtctctactaaaaatacaaaaatttggctgagtacacacctgtaatcccagctatttgggaggctgaggcaggagaatcacttgaatctgggagacagaggttgcagtgagccaagatcatgtcacgcactccagccggagctatagagtgagactctgtctcaaaacaaacaaacaaacaaaaattaagtccaaatgcttattattatcattattattattttgagacagggtcttgctctgttccccaggtcacccaggctggagtgcagtggcatgatattggctcactgtagcctcaacctcccaggctcaagcgatcctcctacctcagcctccagagtagctgggactacaggcacatgctaccacacccagctaatatatatatatatatatagtagagatggggtttcaccatgttgcccaggctggtctcgaactgctgggctcaagcaatccacctgtctctgcctcccaaagtaccgggattacaggcgcaatccaccatgcccagccacaaatgctttttaatcattgtcttaggttcaatgagattgtagatgaattatttacttctttttcatattttccaaagtttctatgagcacttgttgcttttaaattgtttaaattgaagtatagcatgcacatggaaaagtgcacaccaaaaaatgtacagctcggcccggcatggtggctcacgcctgtaatccaagcactttgggaggccgaggcaggcggatcccctgagctcaagagatcaagatcatcctggtcaacatggtgaaaccccgtctctactaaaaaatacaaaaaattagctgggcgtggtggcgcacacctatagtcccagctgctcgggaggctgaggcaggagaatcacttgaacccgggaggaggaggttgcagtgagccaagatcgtgccactgccctccagcctgggcaacagagcaagactctgtctcaaaaaaaaaaaaaatgtacagctcagtcatcacaaagctaaggctgtgccaccatcatcctgatccacaactagaacatcgccaatacccagcagctctcttcctgtcccccaaccttcatccccatcccattctaactctatagctcagtattgcctatagctgaactttatgtttgaaaccacacagtatgtgttgtttgtgcctggtaacttttactcagcattgtgtttgtgaggttcagctatgggtcattcatttttattgctgtgtaacaggggtccccaacctccaggccacagatcgatacctgttaggaacctggccccgcagcaggaggtgagcgagcattacacctgagctctgcctcctgtcagatcagcggcggcatgagcttctcataggagcacaaatcctattgtgaactgcacatatgagggatctaggctgcctgctccttatgagactctaactaatgcctgatgatctgaggtagaacagtttcatcccaaaattatctgcccccccaccaccccacacccaggtccatggaaaaaattgtcttccacaaaactggtccctggtgccaaaaaggttagggaccactgctgtctagtatttcatgatttatatatcacagttcttgtgtccatttcaccttgatagacatgtaagttgtttccagtttgaggacgttacaagtaatgcatctgtgaaatttttatacatgtctctaggtacacatgtcatgcatttctgttgggtataaacctaggagtgaattgctgggtcatagaatgtgcatgtattccatttcagtagataataccaactgttctccagtgtaactgggccagcatatacacccatgagagcaggagaactcccagcgccccacactctcaccagcacttagtgttgtccaactttccaactttggcaaatctggcagtgtggagtgatagctcattatctcgtcatgggtttcaggtgttccttttttcctaagagtgcctctcagtaccacaagtgctttatctggtgcctgcaccatagcaaccactcaaaatgtttgaagaagtaataaaaggatgaatgcatgctctatttcaagagtgtttctggattcctgagtgtgtatctgtaacagagcccctatctttgatatgtctgtgaaattcagttaaagtatacttcaaggataaccgaggctttgagatatagggcaatttcgaagttgccttatatatgagatatagagatagtaaaaaaaaaaaaaaacttggggagggggtgatcattttctgcccttccctctacctccccgcaacaagtggtggccacgctggctcctgaggcacgtccttgtctgtgtgtctcttccagggacgaggatctgattaacaagtgtggggacgacgcacgcatctacatcgtgttccagtaccacctcatcatctttgtgctcatcatctgtatcccctccctgggcatcattttgcccatcaactatactggatctgttctgggtaggcaaagctcagctggccctggggcagcagctggacctgagaggcagccaggcaagccagtcagggctggggttgagggtctagacatctattttaatcctgcctctgggagtttgttgttgtgtgaacttgaacaaaccatgcttcgcttctctcatgtggagactggagacgattcctcctttgtcacaggtttggcccagagcctgacacacagcaggcacatagtattaattcagtttggaactgagtgttcattcatggccccactctggctgggcgttcctggagacccttttgtgacatgtgacccactgcaaagatccctgaacccactctgttggacataacaccataggtgcagaatttgtcttgtaggacctctactcccactcattggaacagggtgagccctttggagggaacagcattgtggatgagaccttggcttctaaaacagaaaaatcatggctccacaatgtttacccacacctgctccccagaaaatacctttgcctagctaatatgttattttattttatattttatttatttatttatttaatttattgagacagagttttgctattgttgcccaggctggagtgcaatggcgcgatctcagctcactgcaacctctgcctcctgggttcaagtgattctcctgcctcagcctcctgagtagctgggattacaggcacccgcctccacacccggctaatttttgtatttttagtagagacgggttttcaccatgttggccaggctggtctcaaactccttacctccagtgatccgcccgccttggcctcctaaaatgctgagattacaggcatgagccaccgcacctggccactaacatgtgatttaaccttgtatatggcaaatcagtctcccgagctttactttcctcaactgtcttagggattgggagatcacatgccacatacctatacagtgtttgatatacatagtaggtgctcaatgaatagcagctagtatttcatttagaatcatgaagctgaatggagctgtatgaagactgtacaactgggtggtgcagaatagcaccgtaaatgccccaggggcaaccagctttcccctgattcctcaggtttctacctgttcatccttggccagaggtagaccttaattaattcagtttagcacactgagtgtccatgccaccaaatgccactactagagtaatatctgagtcttgtctcatcccaagagctggtatgttggcagtgataatatcatgcaggatttttagacacattttataagggggtgtctgaaccgtcaaactaatgcacatagccagaaggatttcctctgaatgaggcagtgttgccttttctggacgttgccagtggtaatagtgttgctaatttcatcattctgctcgtggctggatggctggtgcctccaacaagcattcactgggtgtccattatgtgccaattatgccctggagataccacacaaagaagtgttctcgctttcctcccgagagccccagtcagcagtgccagggaaaagaggcctctgatgtctttgttaaaagttggggagaagctctggggaaccagaaggaagaggaggtcaaaggcaagcatctccagaccccacgcatttgtccaggaaccttgaattctggcgcccccagcaactgaggagccaggctcgaggtcagcaacttctttctctttcagactggagcagtcactttgctcggaccaccattgtcaatgtctccacagagtaggtacctgatcttaacctcccattccattggctgggggtgttggtgtggagaggaggtctaacatgtcagtttgcaacatgggcagcgttttgctgataagaaaggcctggtttccctgggaatcgggtcctgagtgagatgccagaagctgcatcctcttggtggggcaggactcttggtgtgagatgaggccctgtgtcctcatctgtcatgagtggagctgcccaaactggccactcatgaagacgtggagaaatggtcctatttgcttagtgtacccagatcccaagaggcagagaccatgtgctgaaagagattgaagattgttttcctgccaccaataggttccagtcagccgtcatatacccgagtgaatcatgtgcctgacagtccccctcagagtcccacagcagactcgtgccccacctctgccattaactggccctaggtctgaagcagtgcacccccaacactgagcttcagtccttattcatgtccatcattggggaagagctggtggacatgctctctaagctccttcccctcacaggccaagaacctgtgggtttcaacttcagccaacctgactggaggccatatcaatttgccccgagccaaatgtggccccgttggtccatgccatggcccaggtgtctaggccagcttggctgattcctgacaaagctgcagaagcagctccagcaagtgtgagtggggttcacacacccctgccccacctcgcctcccccaacccctatccctctgcccctgctctcctgcaatacaccttggagcagactggcttaacccaaattctgaaatgagcggaaaggggctatggcatcctctcacctctgctttgaccatatcctcccctgaggatgccaaccagagcagggatatcggctccttcccgaggcccattgctggcccgaggtacctacatcttcccaacaaaaagtgaattctagtagaacagcaaaaagccatcaatctccatgaatctatcctggcagagagctggaacattctgtagagaccatgtagccttgcccttctgtggaaactgagggtggagcagcatggtggatccaccatcatagcagatggcaatggcgtgtgaggtgccaggcaccaggggtattttgaaacaaggtgacctttctcccctctaaccatgtagaataaagtgggccctatttctgagtagcaatcctagccaggtgctttgggatggcatcatgtgggttgaaagcagggatggcaaacatggtccaagtgccacgactctcctaccccaggggcggtgctgcaaaccgtctggtcctcctcccccgaggcctgcaggtaacacaggttcttcctcacttggtctgctgtgcaaccatgggggcctgagccacagcagttggcaggatggcgtagcagtgatgaatctaagtacttcagcagctctgggctcacctcccagcgcaccattgctacagtgaccttgagaggggcaccgaccctctctcaccctcctttccctatgagtgaagtgaagataaccacatgcatggctatgtgtgtggttgagtctagtgagaaaatgcacaccatgcactaagtcccacttggatctggctcagagtaaacactcaataaacgttccccccatgagctggagcaagaccctttctcaccactgatgccccttccaaggcacctgagtgtctggactccaagaaggtgttcctggaaagactgcatgtgggctgggagagaggggtccagggagattgtgatcggtgggaggggagggtctgagaagactgcaatggatggggagatatttggggagactgtgataggtgagaggggaggatccagggatactgtgatgggtgggagggagacctgggagactgtgatgggtggggaaggtgtccagggggactgcagtgggtgggggtctggggagactgtggtgggtggggggtctggggagactgtgatgggtggcggttatggggagactgcaatgggtgggaggatctggggagactgtgatgggtgggagggagcagggagccctaggagactgtgatgggtggggaaggtgtccagggggactgcagtgggtgggggtctggggagactgtggtgggtggggggtctggggagactgtggtgggtggcgggtatggggagactgtgatgggtgggggtatggggagactgtgatggctgggggtatggggagactgtgatgggtgggggtatggggagactgtgatgggtgggcggtatgggaagactggtgggtggggggtatgaggagactgtggtgggtggggggtatggggagactgtggtgggtgggggggtatggggagactgtgatgggtgggagggagcagggagccctaggagactgtgatgggtgggggaggtgtccagggggactgcggtgggtggtggcctggggagatggtgatgggtgggggggtctggggagactgtgatgggtggggagtctagggagactgtgatgggtgggggtctggggagactgtggtgggtggggggtatggggagactgcgatgggtgggggcatggggagactgtgatggtagggggagtctagggagactgtgatgggtgggggtctggggagactgtggtgggtggggggtatggggagtctgtaatggatgggggtatggggagactgtgatgggtgggggtatggggagactgtggtgggtggggggtatggggagactggtgggtggggggtatagggagactgtgatgggtgggggtatggggagactgtgatgggtgggggtatgggcagactgtggtgggtggggggtatgggcagactggtgggggggtatggggagactgtgatggtagggggagtctagggagactgtgatgggtgggggtgggggatactgtaatgggttggggtctggggagacttggatggttgtgggggtctgaggagactgtgatgggctggggggccccaggagactgagggtaggaggaggcccaggggtctctgtgcagtgggctctggggagctcacaggctgacctcactgctgctgcctccctccctgcaggagcaagctcctgtggctgcatagcctgctgtccttcttctacttcatcaccaacttcatgttcatggctcatcactgcctggggtttgcacccaggaatagccaaaaggtaagtagcctacaaagctgcttcccactgtgggaagctggggtccctccccactgggctgaccacttccaaccctcagagaagccctcagagggtccagggagactgtgatagatgggagggggcggtttcacctgagcaggggccaagcttcctcccttcagtcctagtaacaatcacctggcccccacctctcacccttctccaccctctcaccctcctccacgctgctccaccctctcacgctcctccaccctctcaccctcctccacgctgctccaccctctcacgctcctccaccctctcaccctctcaccctccatcctctcacccctaatgaaactttcagactggttggtaaatagctgctgcccaggtacctcctatccctgcccctctgctgccccgcccctccccagggactcttggacttcccaccatctgaaaactaaaggattaacaaggcccagtggaccagcgggggcctccatgctaagtggtctgggccctgctgagctgctgctacttagtgtacctggccctgcccacccctgctaggcccgtgcctcgcccttctgcagtctctcggagatcagagacccccgtgtatccccaccgtctcagtttgggtgaccccatccaagcagaccctgagacttggaatgagtagcgcttgtttatgggaggtgatcccaggaaaggccagtaagggagtgaggatgcaaaggcaaccaaaaaaagggagcatggaggggcaacttacccctgtgggcaagtggagcttcatgaccagggaactctgggagctggtgtagagcacatgccccagaattttcctggaggtgagcaatcgtgggtattttccaccagctccctgtccaccgttcattgagggttgcgcttgggggctttaactcctcccctacttggccctgcacaaaagctgaacatgccccaaggccgggaaagagcagtcgcagtatttgaagcatgctgcaggtgttggtgtgcagagatgactgacggggggccacgggcaggcaccagcagtgccacccatctggaccagcacccatgctctgctggggatgggcaagagtgaggagcatccttagttcccgtcctcagcctttcaaaggttcagtggtgtggaatcagctccttccaggccgtccattcaaaaggactgattcacttgaacccaccccagagtgcaaatccacattccctgaaaagtgaacccaaatgcttcagcctgccaggcatggaggcttggtcacccttgaccagtctggtgtctgctacttcagctttccttcttgtcaccagaagcctctttcaagacccctgattcttgcagcacaattaccagactgtcatcttaaaggtgacgacccaggaagatatttcccattcacagaataaagtgtgaagtttagggaagcttccctaccctctccccagagtcttgtttacttcccaactccccggcccagtctcacgtgagggatttccctagagatgtgaggctttacgctggaacagtggaagctacagggagagcagaaatcactgtggggtcgctctggcagctctttccaatcatggagctctgatcctccaccccagcctgatggcagctttccagtccttcctcccttcaccacagcagtccggagcagggcacccacagctgggcacagaggagaacggaagcacagttgaccaacctcagagctgcctggctcagctgggacgctgtgggctaaggcagctggcacttccttggcccacagtgtcccagcttggctctggctttcttggctctctcagcaaggaggcactggcatcagcagcctgctgtgagcagaaggcctgctctgagccaccaaaagactgaggtgtctggaattcctatgcaagcacagtcttctttctccatttttatttttcccacccaggtcacaaggacactaatgatcacctatgtgcccaaggacattgaagacccagaactcatcattaagcattttcagtaagtgggttggggtaggccaaggcgtggattgcttcctccccataaccccgcctgggtcctcaagtgggtagtgagttggtgcaggatggtgggactgggacaccccggggtggctctccctggactcagctcaggatcagctttttagaatggggagggccgctggagctggagcagggtgtctgaagtcagggacttcctgcatggcatggctgtgatatgggtgatgggaatttttctttctcctgttgcttcaactactgagcacagggaaccttggatcacagctatttagagaagatcatctggagacatcctttgtgaccccaagttcccagccccaaggacactgttcactgagctaattatctcttcgtgaacagctgtctcctgggttccccagtgggtggagctccgcccttttgccctgttctgagttgtgtaggaaggatttggcagctctcagattgccaaggttcaaaccctgaggttcagctttaggagcagagatggagtatcccatccaggaacaccaggcagctgagccacccagccctcagggccgacatgctgggcagggggtaggggcagcacatccccaaccccacaggccgactcagcacccatgtttgtggctgcagcgaggcctatccaggcagtgtcgtgacaagagtccacttctgctacgacgtcaggaacctgatcgacttggacgatcagaggtgaggctgcagcggggccttttggggcccggggtgggggtaaaaggggaggatggggctctgctggcccctgacctgcaggtccttctcctgttgcccaccgctggcaggcgccatgccatgcggggccggcttttctatacagccaaggccaagaagactgggaaggtgatgatcaggatccacccctgtgcccgcctgtgcttctgcaagtgctggacctgcttcaaggaggtaactggcttgagcgttgggagcacagcaagggagcggtggggtcctggggctctaggctctgtgcctttgcccgcactgttgggccccaggcctcactcaggtctgctctagtgctccccacccagctccttcctccccatccaccatgtcctgcctccctgttgagatgggagcctttctggaggccaccttcagaacaatccagggaagcttgctgctgtctcctttctggtcttggatgggagaatgagagagaaggaccagagaaaacacagcaggctacacgaggctgccaggcctcaggctcccaaagagataggacagaaacatttgaaggcaacagcttgtcttatcacctgaccactgtggctcaaagagggcgtcgagactcagacacctgcttcaggaccatgccgaacttctgccagcccagagattcaccctctctcgtggaaatgcggcaaacacattctctcacctctctggggtccaccccaagcctgaaagcccccgggtacccctagctatgcctcactttccccagatctaagggcaggggtgaatggcagtcatcgcctcttcttgttctagaggtgggactttggaggccagccagggtcctgggctccttgaggtgcttcaaggccaccacaatccagggaggcttgagtggggaggaacctcgtgaccagggaggccttcctggggctctggccccagccctgaaggctgcctgccaccccaggtggatgcagagcagtattacagcgagctagaggagcagctaacggacgagttcaacgccgagctcaaccgcgtgccgctcaagcggctggacctgatctttgtcaccttccaggactccaggatggccaagcggtgagcaccaggcaggcgccccacccagccccaagcatactcctgcttctcggcactctcctccctctccacctccagtttccccttctgcctcccctgggccctccatgctcgtcacaggcagctgccatctggctctccagtggatgagatggccatacctgcttcccccagctgctggggcccagctgctctcaaggggtgcccaggccggggctcctcactccctgtccttgctttagcacagaggtggtcagagaagcctttgacctcatggtccctcttctgcccttgacaagaatgacatcccttttccctttttctttttttttttttttctttttttttttttttctttttttgagagagtctcgctctgtcacccaggctggagtgcaatggcacaatctcagctcactacgacctctgcctcccaggttcaagcgattctcctgcctcagcctcccaagtagctgggattacaggtgcctgccaccatgcccggctaatgtttgtatttttagtagagacggggtttcaccatgttggccaggctggtctcgaactcctgacctcaggtgatctgcccacctcagtctcccaaagtgctgggattacaggtgtgagccactgcgcccagctgacacacacatcactccctcctcaccataagagagcgtcaggatagagcagctctgtttgcccttctcctgccgcaggcctcccctaattcatagctctacagtcccctctcttctctgccccagcctctggcagcccatgcgttgacaaggagtgaattcagtccactctggaatgttccagaaggatccttaggactgggccaaagtcctaaaggagctccagaatttatctcttaagaactgtggggggcaggggggctcttctttctgggggaggctgatcctgtacagcacattgttcccacctaccccaaccctacaaaggaagagcagaactacctagattttgctcacaaacaatggtacacaattttgcaagttccttacactctcaactttttatctggcaaatttggttactgatatctgtcctgttcacctcccggagggttgacaagtgatatgccttctattcagtttctgtgttgtttaaagcaatacacctacctaaggttatattgttcattctttgagacattgccatttggtagagaggatccggggcttaattacagcagaatatgagctagcaagccagaggtggggctccagcacctgctcctctttggtcacatctctaggcacctcgatttagtcatctgtgcaatggaaatgatactggtcatcaattagcacagtgtcaagcacacagaaagaactcaataattagtagctattgatattaagatgaggctaaaagtagtacctcccttatcaaatctcaaagaaagagtgtgtttatgtgctgtcactgctgttaaggggaaaggcagaaacagaaccacgtggcacctctgccctgcctgggcagtctaggcaccctcaaatgccctttcctccagatactgggccttaggaactgtccacctctaaggtcctgaagacatatccaaggcttcaagaatccccaggaaggggatgagcccccatctgtaggaccaccatagtggccctgagctcctggcatgagaccctcctaagcccatccccccacccccagacccacatttcttcctcttctcccctctctgcagtgtccgtaaggattacaagtatgtccagtgtggtgtgcaaccccagcagtcctcagtgaccaccatcgtcaaatcatattactggagggtcactatggccccacaccccaaagacattatttggtaagcctcctccatccctcccctctcctctgagctcctctgagactgaagaaggcagcaggacagggccttctctccccatgtcattgcccaacagagactccaaggggactaagttccatgctctcctaagcaccacaacctgtgtgtatgcccagactcattcccacaagtgtgggtggcatccaacccttagcaaaaaggcttttcctgcagagggaactcaggtccatttttttttggctctatgctctggatcctttataaatggtgtgacaggggacggtccagggtcctgttgcatgcaagtctgggcccaggaggctggattagaccagggcaggctgggtccacagctggcctgcagcaaacagcacgtgggctctaagaactgatgtctctaaatgtgcctccttcttccatccttccccaggaaacacctgtctgtccgccgcttcttttggtgggcccgctttatcgcaatcaacaccttcctcttcttcctcttcttctttctcaccacgcctgccatcatcatgaacactatcgacatgtacaacgtcacccgccccatcgagaagctgcaggtgcctcctctgctcaggccaggcctggggaccccagggagatcaaggaataattcaggcgaggatgggatggggggagccccctgggagggggctgtggagcccatacagtgcgaacattgtggaggtggccatggtgcaaatggcggggtagggcttgctttgttctaaagggatgaaggtgggtgactgccagtcttagggaccagggctagagtgggaagggagagtggggagtccacaggcaggtcctggggtgagttggagggggtgtcgtcctgtcaacatgggctcagaggtcttcatgaacggggtcatcccaggccagcttggggtccagagggtgtggcaagtgtgagtggctctgctctctgcaagttgtccgaggcagcaggctcctggtttgtgtagtagggttaaaggtgaggaagagtgaggtaagccccaacgcagccctctcagagaagtgggagctcaagatctgcctccacctccctcatctccagacacctgcactccaggctgggagccctcagccctggaggaaccatctctgaagttaggggatgcctcctgctgatggtgcaggtcagagggatcctagcccatttccaaattctttagcctcaagactgttactaggagcctagaaggtctcttcttccatattctcgccatcctcatttccaacaacacacatgtgcatgcgcacatgcacacactcacacaaagtcaacacacacgcatgcacacacacgcacacatgcacagtcaacagacgtgtgcatgcacgcacacacatacagtcaacatgtgtgcatgcacacacgtacacacacacacaagtcaagccacaccacttctgctgctgatttttgttcccctttgtcaactttgtaataggccccagaccccacgcatcctgggagggccacagctctccctggggactcctccatcctcccctcctcccccgctcacatgtcatcacagcaaaggcaatttgctggggttgcactcctggctagctctggccttaggaggaagtcactcaagaaagctcaggctgccgctccagtgacctcagcatagaaggcctagctgcttggggactccacttgaccttgggtgtcagcctctgcctggccaggaaagccagtgagaagggccaggccccttgcagcctccaggagagcaagccagccctgggagtgagtgggaggagaagaagcaaggggaagaggatgcttgcattgacgtctctcctgccgtcctcccctctccccctgcagaacccaattgtgacccagttcttcccctctgtgatgctctggggcttcacagtgatactgcctctgattgtctacttctccgccttcctcgaggcccactggaccaggtgacctgggggcctcctctcgtagccctgtggtttctccagcctcttcccctgccctggcttccccgccagcctggcacttgggcctcccctctagcctaagaaggagaattgataagggatggttttgatacctgaaaccatccccaaagaccaacaggtgttctgtctttggaaggagggtctgggttgactctgggcccctgggttgctgagatagagccactgtctaagagtgtggggccaaagccaagccctccttgagcttctccctcagcccccagccatatcctgaaggcatggagctgtaggcatgagctaggcagtcccaggcattccatgcagaaggcacaggaggaaagacttgtgtgggaatgtcaatagaatgctttggccacacagaggggcccacaaactcactatgactgtcatcacatatggcccacaccatgccaaccttttacccaatcaggagcgttcccatttgttagccttgatggttctatggtggctgctcactgggtagaaagtatttgccataccctgggcaggtggcagtactttggcttgaaagctgcatgcatctcaaaagttattttccgcaccaaaagttcctactattccaccaggcagcagccaaaaggtttgtcctaacggaaatccttcctggccttttcctctggccaagaacaagacttatattgatgactgaaactgcagggatttttagtattcttggtaatgtctctttaacacagagacatcaactatatggcacatctgtgccttcccatcccttcccatgcccagcacagacatcactagtggatcatgctgttctttcctgatgctcccagatgcagcacagctcacagtggtgtatggagatggcatcggtatgcacaattaaaccaatttcccagcccagacctctactctgcgtatgtctgtattagccagttttcacactgctgataaagacatacccgagactggacaatttataaaagaaagaggtttcattggactcgctattagtccatttgcactctgctgataaagacatactcaagactgggtaattaacataggaaaaagggtttattggacttgcagttccatgtggctggggaagcctcacaatcatggtggcaggcaaggaggagcaagtcacatgttacgtggatggcagcaggcaaagagagcttgtgcagggaaactcccccttgtaataccatcagatctcacgagacttattcgctatcatgagaacggcatgggaaagacccaccccccataattcaatcatctcccactgggtccctcccacaacatgtgggaattatgagagctacaagatgagatttgggtggggacacagagccaaaccatatcagtgtctctcttcctctctattacatagttaggcctttggttcttattaggccacgtccattgatgaatatctctctgtttccttctagatcaagtcagaatctggtcatggtgcacaagtgctacatctttctggtgttcatggtagtcattctgccctctatgggactgaccaggtacctcacttccaattatcccttccttcttagccaggctctcttagagttaagacctcctctttcagatactgtagacctgcctgtgattgctgcaaacccactcctcaaagacagccccatgcctgtcatgggtgtagcatgagccgggcttcctgcagacactaacgtgtcagccgtgagttcagcccacatagagcttatcatctggctggggacacaaggcgtgcttaccagttgcctgacagccccacatgggaacaacacagccaaaaagcagtggaaattcagaagagggagagagtactgtgagagaaatgagtgaatattgtgagagaaatgtctgcttacagttttgcaaactggcccaggtttgctggaggaggtggccttgagctgaaaggccaaagggctcggggccaggacagcccagcactaagaaggaagaggggaagtgtggactggccagctggaataaagcaagggtctttctttggagattgggcaagggaggatggttgaaccctcagccttagctcataggtttgctaactaacagacctgccttgtttttgcttctagtttggatgtctttctccgctggctctttgacatctactatctagagcaagcatccatcaggttccagtgagtactcccatgtgtccaccagggctgctgtgtgtgcacacaggagtggttatatgtgctcttccctgagtccagcacctgaatttgctcacagaagtgtagacaaatgcttgtgaacaccctcactgggcagacttgttacctttcctgtgctgggatccctttggcaatctagttaagcccagggaccccttctcagaatgatatctttgaaataattgtatagtcacaggaagttgcccccaaactgtatgcagggtgggtgttccatgagccctttatccagtttcccccaatggaagcactgtgcataactatagtgtaatatcaaaaccaggaaattgacactggtccatccacagagcttattctgattctgccagttttacgtgtactctgaatgatgtctttatgtgcacaaaatacatggattacaaagaaaaccaattatacaattatactgaattacagttatcaagatattttaaaaatcaaatttttgacatagtctttataaacacaagatattgcttttttttttgagaccaagtctcattctgtcgcccaggctggagtgcagtggcgcaatctcggctcactacaacctctgcctcccaagttcaagcgattctcccacctcagcctgccgagtagctgagattacaagcacatgccaccatgcctggctaatttttgtatttttaatagaggtggggtttcaccatgttggccaggctggtctcgaactcctggcctcaagtgatctgcccacctcagcctcctaaaatgctgggattacaggcttgagccaccacacccaaccaatattgcattttttatataagcaagctaaagttacattttactgtcttaaaaacatcagtataaaaactgatattacttattggaataagaatattaaactaggggggatcattgacaaagcaacatgcagaccacgtgggacattctgccaatttcgatttttttgttttagtgataacaagtgttgagaatcccaattttcaaagatatgttgcaaatgacatgcaaacttccataacttgctctataaggcaaggaccagaatccttcaaggtattttttagtagagatggggtttcaccatgttggctgggctggtctcaaactcctgacctcaggtgatctgctcacctcggcctcccaaagtgctgggactacaggtgtgagccaccatgccctgccgtattgcccacattcttaatgcaagaaaatgctaaatttcagttagagattagtgaaaataaagatgttattttttcccatcctagtttacagaccccccagaaacccactcatggattctcccgagtctttggacctggctcagacacccttgctttggatcaagccaatgcatgtatcccctaacacacccatgctttatgtggtccctgcccctccctgctcaggggactgcttgttaacttcattgggttggggacatatatattataggagagagacagagaaaaagaaagagaggaaatgttattctccttgtctgtatctgtatctccactccgattcccattccctctgctgctctcctctctctcctcccttttaacatctctccctctccctgtggcttctgttgccaccttccctctccctcactgcccaggtgtgtgttcctgccagacaacggcgccttctttgtcaactacgtgatcacggcagctttacttggcacaggcatggagctgctgcgtctggggtcactcttctgctacagcacccgcctcttcttctctagatcagagccagagagagtcaacatcagaaaggtacagactggctctccgctgagcacagccctcagtttcctttgggagggtgtcagggatagagcctgctagaagcaccaagggggttgaggtgggagggacggtgtggatgggtgttggtggggcaccttggtctacagggttggaaaggaggctgcctccaggcctgagctgccaggaggctgatgaggagccacagaagtagtcaagccaaggggactgggccacctcagggtgacacctgccttctgccccagaaccaggccatagacttccagtttgggcgtgagtatgcgtggatgatgaacgtgttcagcgtggtgatggcgtacagcatcacttgccccatcattgtgccttttggtgagtcatctccaaggcatgcccaagggctgcacatccgcagatggggaggaggaattgagcctcacaacatcagtccacctcctggagcatggggagacctgtggtagggaggggtcagggccagggccaagctgggggtacagggcagctgaggttggatggctgccgatgggggatgtttgttgaatgaacgcatgagagaatgactcttcaccaagctgaaacagtcagttctcggggctcaagggaagctgctggctccggaggtcagtaccacggagctcccccaacccatccttggttgttgtgactctgacagccgtggatctggcttctcaggcctgtggagacactggagccacaaaggtccagacttgaaggggccactgagtaagtttccacctttgtcccccagggttgctctacctgtgcatgaagcacttgacggatcgctataacatgtactactcctttgcacccaccaaactgaacgagcagatccacatggctgccgtctcccaggccatctttgcgccactcttgggtctgttctggatgctgttcttctccatcctgcggttgggtaggtaccaagccagcctggagaccccacctccacctgccccactgttctgtgagtcccttaacactgaccctgttagaggagaaaagcccaggcagggcaagacgctgctcaccagacctggccacacccagtgacttctctgggcctaaagggcctacattagagtctcagctgagcttcaaggctaagaggaggccctggaccaacatggtccccaggtgtggatttgggtttccagcgctcagggaaggaaacctcatattccttctttctaagtctagacgggtggaaaatagagtatcagctattgggaggctcagttcccatgacatttcctctgggatcccataagatgcctggttttttgttttgttttttaattttattttttgaatcagaatcttgctctgtcgtctagactgaagtacagtggcgcgatcacggctcactacagctttgacctcctggtctcaagcaattctgccacttccccctccccagtagctgggactacaggcgtgagctgtcatgactggctaattgtttttaattttgtagagatgaggtctcactatgttgcccagtctggtctggaatttctgggctaaagcgatcccctggcctaggcctcccaaagtgctgggattataagcgtaagccgccggtgcctagtggtagatgcctggctttatgggttgccaaaaaacctggaagaggaaacagagcctgcagtaggggccagctttttcctcactctttagctacacacagctactgctcctgcccaggggagctcagagacaccctcccagaagcagtccctgcaggccacagattagaaatctctcagctttctccccgttggaggcaccttaacccccagcaacccccaaccccactgcccttccctcagacacctgaccttaaccttctcagtggtgggagaagggagacgcggtgttttctttctttttttttttttttcttttgtttttagagacggagtctcgctctgtcgcccaggctggagtgcagtggcctgatctcgacccactgcaacctccgcctcccgggttaaagctattctcctgcctcagccccctgagttgctgggactacaggcgggtgccaccacgccccgctaattttttgtattttagtagagacagggtttcaccatgttgcccaggctggtctcgaactcctgagctcaggcaatccgaggcagtgttttcttttctctccctgccatggtggcatccatacggtcgactctcagtcatttatgtggcttacccatttgccatcacccccaattgcttatcccgctagcctttccctgccaccccagagacttcattttttccataatgctttttttctaagaataaaggactgcatgtttatcatcaaaaatagaaaaaatataaagaccaacatgtaaatgacccatcatcttacccagaacctgatgtcttttgttcccagccccctttccaggcatgcgctttggggctttgggcatgggaacattgagagggagcagttggtctattgttactttgcaaaactgcgatagtccatattgtaacattcagtcctgtaccctgaggttttgtactgaacacaatgttctgagcaatttcctaggttgttaaaagactgaacacgtaggtgcctttcagcggttgcatgaaagtctaccagttttagtcagttctccgtgattggatattgaggtttgccactttttgctactataaaaacactgcagtaagcatcattaagcagtgatttttggctgtaaagcataatttaaacaacatttacctagttagaaaactgctgccgtaaaaaagggatcaaatattcccaaatgtaatgtaggtgacttttaccttctagattccctctctgtgccatcggtgcagataactgagcatgctcacttcaaaagggcttgcagggaaaggtgtaggtcagagatggcgttgggggcactggcagaaatagtcactcaaagatacttcccagggacgatggtgttggaggtgaccagcaggtcaggaaggacacatttaatgggcactgcagtgggtactgaagtcaattaaaacattttttcatggactccacagatgccaaattctaacagagcaaagggatgatgttattttgtcagactcctagatgccagttgttatcagaggaggactggcaaggtcaaagcccttgcagtggtgctgtgacggtccctggcatctgccagttggggtggcatctcggctggcagactcctgcccatgactttttctcctcctcggcaggttctctccacgccatcaccatcttttccctgtccaccctcctcattgccatggtgattgcctttgttggcatttttctggggaagcttcggatggttgccgactacgaggtgagttgccagcctgcccctcctcctggttctcttggtccctgggggacacagctgtaggatactctccaggtctgggctcccatagcaccacaggatgaaagggtctcgcctttgtctctgactgtagagcgtggagcccagtgtgcatgcgtgcatgcatgcgtgcatgccttgcgtgcatgcgtgcatgccttgcactagcttaggctctggcccccatccagaagacagctatcctctccttttctgccctctgacacctcctccaaactgcaggctgctgcgatgtgagtccagtgcagccactgaactgtgagcctccaaggactggaggccaagagagaggatggagcaaaggaggttgcggggggagttgctgatgattcaaaaagaggggggattgtcattttctctcctttaagaccccaggctattgaacttgaggtggccatgtttggaggtggcccctgccccacatgactcctttggttgttggcagtgggcccagcctaatcattaggagaggggagccaatccatgcccttttagagccatgccaacaactgtgtgttctagctcagcatttcccagaatggatgtctatcctggggcactggaatgatttccagtggatcacaacataatttttcatttttcatggttacgtatttaacattaactttctgcctatggcaactgaaatacagttttctgtttataatagtgaattgtttcctttttaaatgaatgtatataaagaaaagaaagctgattttaaggactgacacactactgagcctgaggagggactcggaggaggatctctttgcttctggtgtctctgtctgtgtccagggctctgggcacaggtgcccactgccctctccgcccagccttccttctccacgcctggctggaacaccacactagtgaagggtctcgtgaaggaccccgctgactctgtctaatacagcagcattatgtgattgggttggccaggtgtccactctagagaaggagaatggccaggaacctaggctgtgttggtgtaggacactttccaaattagaggggaagccacaggaggaaagacgacagtgctgaagtcaaggcttctcctggagtcaaagcaggctcatctttgaacttcaattccagctctgcttacttcccccagtgatggcccttgggaatagaacattccagaagggactcccttgcatcccagccttctctctgtccccctgggtctcagtcttgccaggctgaaggtctggaaagacagaagatgagttgagttccaaggtggtgagaagcccaggtgtggagttgaggctcctctggatgaatggggaggggcaaagagcaggcctcctgtaacccaccacctctccctgctgcagcccgaggaggaggagatccagacagtgtttgacatggagccaagcagcacctcctccacgcccacctccctcgtgagtcctgagtcccagggacaggttgggagggtggtgcttgcagggatggtctactctagtggcattgtgggggatgccagctttgctgcccactctgggtatggggaaggagatgggggacccctgggctccctcctctaatggagcaggacttggcccaggtccaaatgctgccgtggtcctggatgaagagtgagaaaaagagaagagccaccgtgtactcggcattgtctggaaggcacctagagaggaagtacttggtcagggaggccgagaccacagcgacctcggtcatgtagacgcaggggggcctgctgaggattggcctcgggaccaaaggctgcccctgaggcacaggtgcaggcagagcgacacagacagagcttcagggaactattagaagtctgcactgatggtaaggcagggacgccgaaatgagcgagcctgtctgcgtgcagagaggctggctcagagtgcagagtgcagggcctgcaggctgggtgctgtctctcacacagtggctcggcctgaaggggaatgggcacaagcacccacccgcatccctgccacaaatgcagcttcagagccaccaatgcacacactgaggtgggtactgggtcagcctgtgccccaaggccagggctcctgggaggagctctgaagaagggtgccaggctggcactcggtgaaagcatcccagaggagggagcattgaatctgaccccaggaatgggcatacggggtgccaggtgaagtagggtgtggggcaagagttttcaaggaagaggagcagcctgtgcgaaggcctggagacagaccggagcttgggggactcaagacagttttcggcacggtggaaatgcggagtgggcggcagggccctatgggagacaaggctttctttagttgtgggcagagctgggagtgagtgcacggtgacagaagcacagacaaaacaccagcaagtggacagaagtcaccggagtgccaggtttgcctcactttgaaaaaccctacacacaggcacagattatctctgagaggggacaggagtaggtgcttccataatgaagagaccacaaggatttcaaagcaagaaagtctctcttttcttgggacccttccaaaaggacccctcttggaatattgttagcaataagtttttgaaatcttcttatgagcctggcgctttgctgttttcgctcttaatcttttgataaacccacacagtagggattttcatccccaaatggaggctcagaagttccgtcaatatagagtccagggcaccaagcaagggagtgtcaggacaaaggtcgaaccaggtccatctgactctaaagcctatgcttttaaaaaacacgactaggatttattttttaaatcttgccttattaccacagggctatatgaacatcgcacatcattatagggggaaaggataagcagaaataagaaaataaaaagtccatattcccaccacccagagatgaccactgatagtgtattttcttgcagatatttatatactatgtatctcttccagataattatgtatgatttacatagttttgctaaaatgaaatagtactgcacatactgttttataacctttttttgtggggtggggaaacagaatcttgctctgttgttcaggctggagtgaagtggcaccatcttggctcactgcaacctccatctcctgggttaaagcaattctcctgtctcagcctcccgagtagctgggattacaggcacatgccatcacacctggctaatttttgtatttttagtacagatggggttttaccatgttggccaggctggtctcgaacttctgacctcagctgatccacccgcctcggcctcccaaagtgctgggattacaggcgtgagccaccacgccaggcctataacctgcatttttagttaacaatctttttccatatatataaattttttatctctttgaacacccagccggtattcaaattgccttaattgttccagaagtatcttttagagcttgtccaacccaatatcaaatctagcacatgtgcctcaggttttcatgtcccttttattttagcacagtgccttttaaatgacttggagagaccaagccagcagtcctgcagaatgttccacctggatttttctggctgttcatgatgtcttatgacaggttccatgatctcctgaatgctggaagttagatctgatggcttgatagatgcaagttcaacatggggctagaacacattacaggtagtgctgcaatttacactcagagagatgtaacatcctgttaattcccattcattaatgatgccgtcatgaccttctaattaggggaatgacaggtggatttttccatggttcagttgacatttacccctttatgaccaaaaggtcatctagatggcttactttggcaccacgcaaatgtctagattcttttgtaggaaaaccgttccttcaaccagggctgtttggtttcactgaaataaactcctatgggaaaggtttcattccattccctaataacctattttctaagtaaggagatggtttaagagccacttcagaggatgacaattgctcttcttcctagtacatcctgtgtttttctatctgctgccgtcccaggcatggggaccattcctgggtgtgacaggtcatgtgaccaaagtctccgctagcagttccacatcttgaggacaggccaaaccagtgacagatcccgagggagttctgaatgtgctgctgaagctgtattagaaggtgcactagctcaggaaagagggtctctccagacctcagctgaggggagcctcatgtcacctcccctggatgcagcttgacttggaactgagagtgaatgggacatgttctaaaggagcagtggactaggagtggggagtcctgccactgaaccagccctgggagcacctagatgctcatcaaatgatcaagaacaattaggtgggtgggacagacaggacccaggctgctggggaagaaggcaggctccaaggtctggaggagacagaggcgatgggggtggggcatgaggggagagggtgtgcccagggccttgcccccaacgtgaccttgctcctgtcccctgtctctatcccaagcagctgtatgtggccaccgtgctgcaagaaccggagttgaatctgacccccgcctcctccccagccaggcacacctatggcaccatgaacaaccagccggaagagggagaagaagagagtggtctgaggggctttgcgagggagctagactcggcccagttccaggaagggctggaactggagggccagaaccagtaccactgaccgggacctgaggcctccactggcgacttgttgaggggtcaggggagggcctggcaaggggaggcaggagggtggcctggacctccccactacctcctgcagactttgagaagcccacagtggagacatccaccaccccagccatgggccatacgggggtcctgacctgctgcccggctggaactgggggtgctcggcagtgctgaaggagcctgggaagggatgggaggatacaggcaagcacatgtcttgagagaggtggctggagccccggcacagagactgaacgctggggtcccttcctgggaccaagatggagaaggtgttcctaagggaggagacagaaggaggctgccgaaggctctgtggggtcatcaccactctgcatcagctgcccttccaaggagcttctgctgctgctcctcctcccagccccggcccattcctcccctgcagtctgaggaggcaaaggtatgtgcacggggcacattgacaggacacggaggaccacctcatcacagggttccctgcatggggatctgtaaagagaaagtttctgcacccaccagagcaagagccaactgaaagcgtagacctgagaagaggtaactcagccccttcctgctcctctgccctcatcagatgtccccaggagcagcagggcagaggcccttctttctattcttacaagggtagctagagcgtgatcactcagggctcatcaaatgagactcgtgtgcatttttcagaaggaaaccttggttagtccttgctgggtaacacaaagtggggtgagacgacagaagccgaattcatggaaggggggtcttctccccaaaactctgtgtggtgggaaaccagctatacctccccaagccccagggcctaaagagaagacccccgaagccaaagatgtggccacttaaaagcgtctcctgcctcctacccaactgagtgcctgggcccccagcttggccaagatgggcagtacgttagggtaagaaccccatgcttcaaacttaaggactgaccatcacctgcgtcccaagtaggacccttcctcccttctcggggctgcccctgcaccctgccttgaagaccacccaagcggcctccagtgtgggcctggtccagacattgcagatgcttcaaccgtgatgtcgccccaggcctgccaggggtgtggtggaggggaaggccacgtgctccagggagaagccctttctggagaagcaaggctgtcctcccagggctgccactaccagagacctgggggagctgaattccgaacagtgatggtgacactcagcacctttgccacagccggggggaaccggcttctgcctctgggatgggctctcatcaggaccaccgtgcagcccagccagggaggacatgagaagggccagtgggggcctcaatgaaccagaacaagccaagctgaatggggtctgtgtgctccagggccctcttcagccccctcccccaaaggtctgggtccctgccaccaacctactgaaggccggcccccggctcacctcacctgagcacctgcaccaggccccaggcacatggctgccctgaactcagatcacctagaccttgtccctgccccacctttgccccatcctagccccagaagctccaagcttcaccgcaggtgagaaattgtgctcaatgggcagaaactgctatacccccagggcatggcccacattttggcatgagggtgtctttccagagagcttgggttggctggagagaggctgtctttcccattccttgtccagctaggaataaaggggaaatggtcctagcctggcccctacacacccaggtcccacaggccccctccccactggaatttcaccaaccaacaaggggaaagtacgctgttacagcatagcggtcaggcccagcaggagcttggcacatgatggggaggtggccagctccaggccctgcccgaccccatcatgtgtatttggtgtatggggtgtggggggtcacaccagaagctggcctggggtctcttctttgctggacacagctccctggcccctgcccccagcccctgcagcccctgccggactgtggaagccacatatgggaaaagtcctggcagacaatgtggcgggatgactgggggcttctccctctgaacctgggtccagtgtagcctggctctgagagaaggtggtgagcatgtggagaaggttccatagtccactcttaggggaaccagcaaagcctcatggcagttggctccatctggacctcccatggtcactacaggatggtggagcagggggcatcttttagcctccccccgccaccacatccaggccctctcaggcacctcctgcctcagcccacacctgcctcacccattgcccccctccccccacctactgccatcccactcctctgccagccacttcccagccgccccaccccactccatccaccaaatcacctcctgacttaatcctttctggaaggagctgccgcccaggaaccggtattgcctagagcctccaggaggggccctcctcaggcctccagtggccccatgcccacctgcctgaccctccactgcccctggaagcaaagtgcctatcagcagcgttgcgtcctctggggcccccggtcgggggggagggggtgtgggctaaccttggccaccaccacaaaaggaatgtgccagaatgctgaaccttcttgttaatgctatgaccgtgccttgaataaacaagtcctcccaacctc

SEQ ID NO: 651 - DNA, 68718 bp, Homo sapiens
atgacggaagtgacggcggctcggcgatggctctcccgcaggcgcagaaacggctgctgggcagctgatgggcaggagcttaccaggctggcttgctctgagctgcggttactgtgtccaggccccgggttctcaggtgagtcagggatgcactggcttcccagtcgccccgtaggagcatgactccccgaggcccaagagctgggattgtattccggaggaatgggatcccaggaaggcgccttgttgcgaacgcaggtacggctcgcgtttctcaggctccgcaggccgtgggccctgcccgcggtcgggctggcggctgtaaggagtgtccggaccagacccggtaactcagtgcgagaggctttgcgcgctctcctggggtcgggtcgcgcgagcttcccacgcagcctcccctgtcgcggagcttccgtgtcgggggaggggcgcttcccccagatcacccgcggacatggcctgccacctggtagctgttaaaagagccttgcctggatcgtttcatgcaaagagcacgctctcttttggtgtctgccaccttaatctcacagttattcaatcctgtcacaaactcaacttttaaaacaatggtgaacttttgagtccttaatacttagagtgtatttgaagacttcacgctaagtcacatagacgtcagaacaaaccttttggggtagatattattattccctttatacagtttaagaaaacgaaaccaaagtgacttcagtgacttggccagtatcttcctgctaataagtggcagtgttgggtcttgaacccagatcttccaagtttagtgttaattttgtgattactatgtaccaggagccatttaatcctcaggacgaaatcttgcaagataagtagtataatcttcaatattggatagtaataaaatgtagaatttaaaaatccatattactaagaataaataattaataaacaagtaaatggggcagcagggaaaacttccttacagcaggattccgattgataattgtagaaggaataatggaaatagaaaatactatttggtaaacaccacagtagttgtttcagacaacagtcatcaatggatactaacgtcaatgggcaaaagtatgatgaaaagcatatttctgtagcctctactctgtcttcatgagatatttataaaggaaaagtagtaactacagaggagaaacctggtggacatcatcttaaccaagtgaccaaaattcagcatcatttacctcttgataacaatgcactgaaaaggtgcctaatcaattctgtggtgttcttgccaaaaatacataacctcagtttaatcacataagattagacaaatctaaatggagggacattcaacaaagtacttggccagtattttcaaaaatgacagggtcttgaaaagacagactgagaaactgtcccagattaagggggacatgacaactttgacatgagaatgtaactcacatatcttaatctcctgcattctgaaatctccatttgcactgaggccatgcttcccatgggctgctcctagccactgacagtggcaggcctgttcctgagaatctccccacgggttcttgctgaacatttcttatactgcatggctgtctaagaggggtctacccattgttacttccctccattcagtgttagacttacactgaagtctgaggcgcttgtaacttttatcagctccctcccattttccctcacacacgcatttctcctaataaaatatttgcaggtttactcccatcttagcgtctgctttttagatgacacacagttacacagcaacaaatgcaatgtgttatatccttggattggcttctggtccagaaaatagacattagtgtgataattgacaaaaattgaatactgcctgtagattagtaaaaaatattgtgtcagtgttaatattcagattttgatcattgtaccatggttatgtacaagacgttgacatttggagaagctggggaaagggcaaatgggaattctaagcctgaaatttccaaataaaaagtttaaaaaatttaaaaattatacacaagaagaaacagttattctatcgcattttaggagcttaaaaataataaatgtttatatgtttttcaataatcctctgagatgaagtaatggatacctaaaatttgaaatattaggatttttttcctcttaaagtataagaataaaacacaaatctaggtataccatttgaggaatttttacatatgtatacacttgtctaaaccatcatacagatcaaaatatataaattttcagtaccccagcaagcttctttgtgccatctccgagtcagtaacttccagtaaggtaactttatttttacctctcatggattagttctgcttgttcttgaactttatataaatcaattttgttgtacttttttgtgtctggctttttaaaaattcagcaatattatgtctatgagattcatcaggaattagtcttaattatttaaatatgagggaatttcttagaccttcagacaaaataataaagatacattgtgaagattaatcttgttcttttttcttctttgttaaattttctgttttttaaattctcactctcaaaaaacaacagcttaaataaaattttcgccactccacatatttttgtgtgttggaaagttaggagccatttggaataaggaaaccagattcttcccttggctccgccactagatgttgtcactcagggaaagtcctttaacccaagaggccttgtttcttcatgtatagcatgaaaaatataatcagtactttagttaccattaccaaagccgtgtgaatattagatgagtaggatgcattaaaagatttttttaatgccagcagttagtcctttttggtgttagagtcttattgaaggttgtgatgattgtgtatagctctgtagcacttcacataaattaactcattgagtcattcattcagtcaacacacttactgaagtaactacctatgggcgagacactgttttcaggctatggacataaaatggtgaataagtccattctgccctgatgagcttacattctgatggagaagtcactggaaaggtattagtccctgttaggtaatcccacagtctcctagcccctattctgtttacacctggttgaaaacattgtgcatccatagtatgtgaaatattacctggtagttatttattaaatttaattgaatattaaaatttttattaaaaaacccatagccattgtccttcaattgttaggaatctaactagaaagagcaaactgtaattgatgaaaaactacaggaggtaataccaagacaacataaaattagtccccatctgaatgtataggtaataatgtattagagttgggcaaatcaggagtgggaaattgcaacaggaattatcagaggacagcttcgtagaggaaggagggcttaagccagctttagaaagatgtaaatattcagtaactgagattgtctgcctggtcattgtgagggagacctgagaaatgttgattgtctcagataaaatgctcatgtactcatgtaaagtgtctaattttttggaaatggcagtaataggagccagttaatatcagaattacctgaggagggtattcaaattatagaactatagattcttatatttattccatttctttttgcctcgttcccccaaataggagcatgttataatctagggaggagagagagaacacagtgtgaacggtagcaacagaagaatagatctgggccgggcgtggtggctcacacctttaatcccagcaactggggaggctgaggcaggtggatcacttgaggtcaggagttcgaggccagtctggccaacatggtgaacccctgtctctactaaaaatgcaaaaattagctgggtgtgatggcgcatgcctgtaatcccagctactcaggaggctgaggcaggagaatcacttgaactcaggagacggaggttgtggtaagccaagattgtgtcattgcactccaacctgggcgacagaacgagactccatctcaaaaaaaagaagaatagatctggaaaactaaacgcttgatacagccgagcaagtcattcatataaaaattacgtcactataattattgaagaattgtttactgtagattatagaacatgggattgatgtgatttcatgaggtaacaatgacacttggtgatcaagttatatgcagtagactgggagttgaatctaggaacaaagaacccttgaaattacagcaaccttgctagttatgaacaagttatgaaggttctaaagtgtcagattatagttttgaaaacatttattctatgctaacatctttttaggtctttgtgctttttcacatttaagctcagtaaactctggaaatgctaaccaggaataagtcaggtccagatactcgaggtagacaatctgctataaacaggagaaaacttttctgagtaattctgattcagtcttcatttccactttcccacccttctgagtatcactgatctaagtgtgaatttataattgctatttgtaaataagttggacttcgtttactcaaattttccttgcatgtatataaccctttaaatatcaaaagtattaacacgaattttaaaaattttctgagcaggcatggtggctcatgcctgtaatcccagcactttggaaagctgaggtaggtggatcacttgaggccaagagttcgagaccagcctggccaacatggtgaaaccccatctctactaaaaatacataagttagctgggcgtggtggcatgcacctgtaatcccagctaccctggaggctgaggcatgagaatcgcttgaacacgggaagcagaggttacagtaagctgagatcgcaccactgccctccagcctgggtgacagagcaagactctgtctcaaaaaaaaacaaacaaaattattctaatctttgctgccctattttaatgttacattatttttatagacattttcctttttgaattcagaactgtcatacataaagtacacagaaatgaagagaaaagtcgtgaatactcacaagctgagattgagtcctaatgaggaagccttcattttgaaggaagattatgaaagaaggcgaaaactaagattgctacaggtatgacttatttgtaataaagttttaaattcctttcttcctcaaattacttgtattcttttacattagagtgttctaaatgttgtatttaaaaacctcttctgggtatacgagagccctggttatttggtattaactagttttggaacacttgaaaaataggctgagatggttaagtacattgtagaagagttggaagataggtattatttgactcgaatattgaaaatagctctttatcttttttaaaaatggtctgtaattggtaacaggaagcttagatgactttgaagaatgctaattggaaagattattagctgctgaaacaaatttatcaggaaattgcagataacccttttctagaagtgtttttaaagtaagtttttgtgaagtatgtttcaggcaccattctgtctagaatcagaaatgatgtacaacagaaatggagttctcatctggctctgtctgtactctgggctatagattttgttgaatcatatttatcgctttagcttttataggttattagagtgataatggcagtccttttgggagtgggcgctgaataaaagctatcagtttggagacattagatatagtcttgagatttttactttttgtacattcactcagattttctgctttaaatagtctttatctaatacaagatgagtatcaaagagagttgacagacttaagagaattcatttgagttcctctttccaaatagcttttcaaaaaagtttaagtaaacctcctttcatataacctgttaaatatgcattctttaggttcgagaacaagaaagagatatcgccttacagataagagaagacataaaacagaggagaaatcaacaatttacacgtttggcagaggagctaagggcagaatgggaagaatcacaaactcagaaaatacagaacttggaaaaactgtatttggcaagtttaagaagtatgggagagggacatcgacaggccaaagaaaatgtgagtgagatcttatttgactaccctgttgtggcagtaatattagtaaaaagtaaattatagttgttgaatgcttttctgataacattttcatgcattgaatttctttggggcagcttgaacttttttataaatttaatgtaatttgtgaataataggctcatttcttactaagagttatttcaagtaaaatccatgtcaaataaaattggtcttcctatgatgttcaagttagcattattctcttccagtactcctctatctggggaaataataatcttctgaatcagaagttgttgtccatctcaggcattttttgacagatttggtggggtgaattcaaccccccaacaaacattttttgatgactttcagaaagtcacagtaagtctgccccattattttgatttattgtgatttatgatgtggaaatactacagtcccagaatcagtcacatacagtaaacaagctagttacaaagaaggtaaatctttgataacaactagtgagaaagaaaatatcttaagactgtggcaatctgtttcatggtccttggttttagtctgtgtttttagtaatagccgtaagttctgactcaggtttttgtggttttatgcatgccacattaagtttgtgcctaatgcaatgtttcccaaacctctgttatttgaataccatgttcacaatttttgccctgactgggaaactacccatatcactatatattttacgtactttaaccatgtcctaagtagttcgatatcctatttatatttttgtaataatgttaattgattgcattaactttacattaaaatgtttgtgtttgtcccccctaatatggcatatcatcagtggtactgttgtcatgctctgggaaacactgctatagtatgtagaaagaagatgacaaaattgataaatcacttctgatatcatatgagacacatttctattattcttgtttaacatgacattttaagtaatatatatttttaggaacctgatttggatgctttggcacagcgggcagcagaaaggaaaagaaaagcagatttgaggcataaagaagccttgaaagtacagaaaaatcaaaaagaaatattactgaaacaaaaaacctggtaaagtaataatttttactataatctcaactgaaactaacatggttgaaagtagaggatacataggatactgtgtaagcaaatattaaataaacatagtagcatattcattgcatttgttaaacttgatttaaaaataatgttggggacagggaatgatttgcttaggtgaacatagtaactaatgagctttcttttctagttgtagtttgagttgagtttagcagcagttactaagtttctgaaaaaatatatggctacttcagaatgcatgtcaaccaatgtctgtttccgatgtaaacatgaaataaaaattgatgtgattaagaacattaaaagaggttgtagactctggaagtcattagtattttttgcatgttgtaaaaattaaagggccattcacaggaaacgtgagtgaagcaaagtaaaaaattaagggccctgttactagttagcaacagccatttttaacaacatttctgtttttttttttttcactctaaagaacattataagtttcttgggttggtccccaccatagagctttctgtctttagataggcctctctcaatttgtaaacattttcttaacatatgtatagactctttacacatgtaaagcttactgagcctgtggaatcagactagaggatttcttgagcctatgacttacatatttttaaccctgttgtactataatattatcactgagagattaattgatgacatctcttgtttcttaaggcatataaaagctcgaaaggaagcactgcttgtggaaaaagagagatcagccaaaattacaagtctgccacctcctcctccaactctttttgaggtgagtttgagtattaagaggaactaggtcataattcttctttactattataattcagtggaggtcagaatgactatcacttaaacttaattgtacaagttttcttgtacaattaaaaacttgtacaggagtatatctggagtatgttaaaataattctagatatcatttcacctgtaaatactttagtatgtatctctgatgtataaggacttttttcttagtataatactaatattgtttccaatattatttaatacccagtatttgttcagccttcctcaatgatgtcaaaaaaattttgttgtttggaaaactataatggttttggttttgaaaaatcttttaataattctgccttttgaaaaaataccctttatttatttattgggggaaaaaactaaactattcgtccattaggctttcccacactctgaatttggcttattttaaatggtcaatattttacagataagtttcagttaagttaataaatttacataagattataaagtatccaggtgtgattttaaaaaagaaaagaggaaaaaaatattataaaataataaggatctattttttatgggagtaaaatgtgtgcttttgtgatttgaagcttattttttttaaaaaaatgtaattaaagcagaaattttttaaaatacttgttctccacattagcttgttatagttattgaaatggctatttggatgattgtcaaaattacctagttatttttatctgaagaatgaagtagaagtaaacccagaaatacatagttgtacatacaagtatattctgtataagcataagtaccagatactcacttcttaggcctttcagtttgtcagccttcctgcttgtacgttgagccatctaccatgtaacatttgatccaacaaaattcagacggaaaagttgtatttcagtcactccttcggtacaaagtgacatgataaaagccaggcaatgtattatccatgatgccttttgattatttttgtcttaattcttagtatttataacaagccaaagtcaaaaatttataaaaagtaaacaaaactctgtaagtgctttgacaagcatgaattaatcagtgggcatgaactatttagttctttttttcttttgaggcagagtcttgctctgtcacccaggctggagtgcagtggtgcaatcttggctcactgcagcctctacctcctgggttccagcgatcctcccacctcagcctcctaggtagctgggattataggcatctgccaccatgccccgctaatttttctgtttttagtagagacggggtttcaccatgttggccaggctggtctcgaactcctgacctcagatgatccacccacctctgcctcccaaagtgctaggattacagatgtgagccactgcacccagcctcgttccttttaggaaaacaggatatattccttgtttttcctctctgccagttttcagagtaaagggttggggtaataatcaatgccattggtggtaaatgggtttttttttcctttctcttttgttactatcactgttaacttgtgggggttttttactcaatattacatagtcaattatagtcattctttttcttctcactgatgttcgtaatatctgaaatttggtcagcaggagacttgaagttgtttcttgcgtccccgtgactccatgagcatttccttgctctgtgccccagcaaatgacctaggcttaatttactctgtcccgtatctggtatctccaaagacccctgattctttttagtggagaagtggtacttataaactaagatctgggtgattatattcttgtttcactaaaaggcattattttagaaaaatacattacccaagccaataaaggtgtttgggataaggcagtgtttctgaatgtcttgagatggttgtgaatttatggcatagaagggagggataggattttagtttgggaaaagctaggttgtggggtatttgggggccagggaaatgcaccatataagaatattgtgtcacatacacaggatatagatgcatctgtatcactgtttctccaagcagataaaaatataaatgctgaaaatcctggggaaataaacctagactgtttagtcttctcaaaccaaggtctttccttaatttaagaaaatattattttttgagagagctatttacatggtgaagagaattgatacttcttgtgtacctaagattttatttatgtcaggtttttttattcatatctaatttaatcacattagccctgcatgttagatatttccatttaacaaatgaagaaaattgaaggtcagaagttaagtaacgtaaccaaagtcctttaataggtaagtgcgataaccagagtttatgtcaaggtctatttctataaagctcatgatctttttactgtgacacttagcttcccgtgaatatacttcagagttcatgctaactgttcaagttaactacttatatattaaagtctaggaatgtaaacaaccataatcttttcataggtctgttaaagaatgaagtttgtattgaaaaccctgagatgctatgaagacttctcatgtatctataccagatgcaagagaaaaatgagctttgttttacttcttcccttgcttatacctttttttttttttgagacgggatctcactatgttgcccaggctagagtgcagtggctcttcaccagccccatgatagctcactgcagccttgaactcccaggctaaagcaatcctcctgcttccgcttcctgagtagctgtgactacaagaatgtgccacagtgcctggcattttttttcttcttttccattgctgcatgagccagtgtcaggtactccagagtagaaagctggttttgtcctgtacttgggtagataaggctagaaatagttactgtggagcaaaactaaggctggaagatagaacacaggaagtaaattaagtgattttaaattattaacagatcatcctaattctgccaggctaaggactgatttcactaaaaacttaggtgcaattcactggaaatcctgttataatcaataaggattcatagtaatcaaaatctcaaatcccaattttgggaggattccaaattcaatctatacataattgcctttactctggaagtactggtactttaaaatgtgtaaactgaatcccatttgtatatcaaattacatcattttagagacttgttttcttcagagttcttccttgtcaagaagcctatggtttattttttcaaggcattgatttaaagtctactaagattcttcgtagagtgaagcattctaatgtgtactaccatctctgaatttttgttttgtgacttcagtttcttactgaactttaatattaactagttaaagctgagtgtggtggcacctgcctttgatcctagctactcaggaggctgagttgggaggattccttgagcccaggagttcaagaccagcctgggcaacatagcaagaccctgtctcaaatatatatatgtatatgtgtatatgtatgctagttaatgttttcattagtggtcagtttaatcctttacctaaatgataagaccctgaataaggtcctctattgtacatatctggatgtatatccaggtatttgccaattagttatcttctgactggtctaggtaattctcaactttggctgtacatttatcacctgtgcagctttttttttattttttattttttgagacagaatcttattctgtcgcccaggctggagggcagtggtgcagtctcggctccctgcaacctctgcctcctgggttcaagcgattctcctgcctcagcctcccaagtagctgggattacaagtgtgtgccaccatgcctggctaatttttgatttttagtagagaaggggtttctccatgttggtcaggctggtctcaaactcctgacatcaagtgatctgcctgccttggcctcccaaagtgctaggattacaggtgtgagccacaacgcctggccgcagctttttaacaatgctaatactgggctctgttccatggattctgatttaattcgtttggtgtggggccaagacacgagaagttcttaaaaactactcagataattctgctcacatcagactgtacatttttacttggattttcttaatccccccttcttttttttttttctttttgagacagattcttgctctgtcgcccaggttggagtgcagtggcacaatcttggctcattttgcatcattgcaacctccgacccctaggttcaagcagttatcttgcctcagcctccctagcagcagggattacaggtgtgtgctaccatgcccatctaatttttgtatttttagtagaaatggagttttaccatgttggctaggctggtctcaaactcctgacctcaagtgatccacctgccttggcctcccaaagtgctgagattacaggcatgagccaccgcgcccagccccttcttgtcctttatattgtttctgttcacttgagtcctcctcatcattccacactcatatatgttatagctaaaactttggttaattctcaacctattcttatttaaacttttctccctcccaacctgtgttgcatttgtgatgtcattgaattagccaggcatggtggtacatgcttgtagtcctagctatggtaggccgaagcgtaaggatcgcttgagctcaggagttacagtgcagagtacaatgccactgtactctggccttgtcaacaggccttaaaaaaattaaaagtgctttttatacattaattgattcttacagtaattgtcacaatgatcatatggtatagcgatagctataaacccacttttcttgagaaagccgagggacagaaaagttgagggactttgctaagttttcactactgggatataatacagaagacatccagcagaagtgttagcatttctttgtggatatttttttcatcaaattatctgtaaaatgcatggtttattatttaatttatgtgtaatcgttagaacttctagttagaactgttactgtgagctccttgaagccaggggccattattttattttacttctcgttgtcgttcacagtgccttgtgtaatgtttaacacatagtaggcacttaatattctttgtcagtttagttaattaatttaacatcagtatgtgataggttgtgatggactgaatctgcctttactacaaaatacaggaaagggaagggggaaggtagtttactttcattcttctgagagttgttttgttctggagtaagtgtaatttaaatatattggcaagtgtttcaggaccaaaattcaaaatacgtcattaaacattgagaaaataagactaatgtgaactacagtagaatttttgtgattagatatggaagaggacatagtagtgcatgttgttgtcttataaatataatgaagtgcttttcatttcatttgatatggcctgtaagcccttctatattcaggagatttaaagatgaaatttctctataaataacttaaaaattgagatgaataaaacacatttagttagcgacaccttgaagatgatttgaaatactgatgaatctggtacttttattaaaatttgaagtaatttaactcaaaaaatttgatttcattatgagcagatatttagcatgttttggatgcggagaactcattaaaatacaaaattactttttttgcattggattcagctttaagtgaaaattaatgcttttaacctatttttttatgttctcttttccagaacatcgaagtaaaaagaatttctgcagtcaaaaccaatagttctacctaccatcatcttcacacttttgtgaatagagagacagacacaaaacgggtgattgacttattgtttcttcatgccctcgctttattatttctgtgtgcattgaattgaattatatcttagttatatgtatggtgttcccagatttcaaaatttggacaattgataataataatcaaaaccttttaaatgctttgaattttcatgtcaggcatatgatggtttaatatgaattaaagaaactagttggctatttaaatggttattttaaaatagcagattttaaagctttttttatcataaaatattacatgctatttgtggaaaatttggaactgtacatataagtgtaaactattgggaaaacaccaattctgtcaccaaagtggaatatagttaatgttttaataaattcattataacctttatttaaatataaacatatacacacacttttcaaaacatgatttttagtggccacttaatatttcatggtagcatttatttaaccattattttattttttgcttctgtaagtaatgtaagcattatcttgcacgtttttatccacatctctgattatatataaattcctgaaagagaaagtattggctccaaactgtgtaacatttgatacagatcattaaattgctttttaaaagcatcagcaacataggagaatgaccaccttaccatagccttttctgcactgaatattatgttttaaaaattattgccagtcttaagagtaacaaatgatatattgttattataattgctatttctctgtgtcagtgggggttttaatttttttcatgttgaatatatttctctactaggaaaataaattttatagcattcctgtggcatttagaatgcaacaaatacacattttggttgactgcttaatagcaggtattaaaatattcagttaagaactaaaatgaatatcatcacagaatgaacttctaagatgcaagagtaaatctgagatttatttaaaattgtaaagtattattacagtttcgatattatgatgtaggaacaataacttcaatttgttgctaactgctttactgtttactgcatttttgtgatttgaaaagatgctaccttttaactaagattgatgatgaatttttttttacctaactctgtcagcatagggtgctgctgatggtattaaattaatatccataagctttcttttttgatagtaaccagaaggcctacctccttttcaatttttggacttaaaaattagatcagtagttataatgataaagggttagaaaaaagttcgggaccacaaacaaattttgtttctaacagttttatgaaagtattcccacaaactaaagctttgtgtactgaatgaagatatgatttctgaatattttcagaaatgggtttattactgaacacatttttattcgaatattttcttttatttgctgctttactgtatcacttaggaaaagtctgtccttaaactttggatttaaaatgtgatgaccaatgtgcttggctttcaagataaaattacctctgaattttcatctgcactcaacttatatcacatgcacaataattttagcatcttccctggaggagtacgatatgatctttacagcaggtatcatataaaaaatatttgcacgcttggcatatatgtttgggtatttttctttagcagctttctgcaaataaactttcatttgttcagtcagcctttttagcacataagagctgctattgtgtgtgtgtgtgtttttaatatcctgataaagtaattccaaaatcttttatatgtcataatatatatctttggctgaagaagatttatgaaagtggcctgctgtagtcctacttacagccagtaattctctacattttgttttgctacattcgctacctctacacacaactgaacaaaacatcatacgcttaaaagtcctacattacatattcatgggcttcatcatgtctattctttgtcagtgacagttacgtagcatttttttcaaatgaactttgcattctgaaaatattcagtcagattaactgtattgtttgtggtgagacccagaaatgtctgcagaaaagtgaagctgaatcagttaaattcatcatcaattttccatgctctattatatctaaaaagatttctgtccaaatatctgatgtacaagattcagaaatgtatttaataatagcatttatcattcatatatctttgatcttcacatactgaaaatagaatctaacattatttcaaccagatttatggttatgtttttaattgcattgacacaaatctataggggattgtcttcctaaagctgtattataaatcttgttttgaagtatgatcaataagaacaaaatttgtttgtggtccctaactttttctctaaccctttattcatatcctttatatgcttttttatatctggactgatatttatcattcatgttgtatgctattttgaaatttttcctttctttaaaattttggtttaccaaaattgacatactgcttttaatttatcttcaagagatgtgaagaattcataaacaacttttttcttgaaaacctcatggctgaaatggattgaaatattgttctcagaggttatattatttaatatcatacatattgatatactaaatactcctacagattataattttgatttaatctaactttttttgtcttacctgatgttatttagttttgcatgaatatttagtggctcaaagcggttatattcttgataaatttgtttggccagtgtactctttgttaatttaataactgtcaatctctctacctatttatctcaccatgtgagaatttttaataatcttacacttgaagttaacagcttttttggtcatcattaattgtttcaactggctggcagaatttcaacatacaaaagacagaaaaagacttttactgctggttacatttagaatatttacctatacttgaaagtgaatgttcagataataaaagtaaatccaggctggatgtggtagcttacgcctgtaatctcagcgctttgggaggccgagatgggaggattgcttgagaccagcctggtcaacatagcaagacccatctctttaaaaaaaaaagtaaatccagactctgtgcctctttctcttttttgtgttatttatgttaatgagatttgtgggtatttacctttcaatactgtcattttaatgaagtttccttttttttatttttgagatggagtcttgttctgtcacccaggctggagtgcagtggcacagtcttagtttactggaacttccgcctcccgggctcaagtgattttcctgtctcagcctcacgagtagctgggattataggtgcccgccaccatgcctggctaatttttatatttttagtaaagacagagtttcaccgtgttggacaggctgacctcaggtgatccacccacctcggcctcccaaagtgctggaattacaggcatgcgccaccacgcccagcaagagatttctttgcttacaaagtgatggataaatgtgtttggaggagtataacctcatctggtttaaaatgagtaactcgtaaagctttatactaacaatttgatccctttcataggtacatgccgttgataattgtggacattttaaaatataactcttcttatattttatatatgtagaaaacatgattttaaggttgttttgttttttagttactgcttgtctcacactttaaaaattttgcctacaatttttgattgactgctagccagatgctcgtttggctgctgaagaggaagctaaacgattggaagaactacaaaaacaggcagcacaagagagaatggaacggtttgaaaaggcacatgtacggggattccaagcaatgaagaagatccatttggctcaagtaagacttatattctacccatgaccattactcatggacttactaatagcattgcaggactgattagtgaatgagctcaaagaaaggtaggaagggtgggtgttcaatatagtctctgattcatatgatttcaagtttcccaactttctttgccctccaatttcaagttctgattgggttaagctattctcccagtgtattgctattctaaaaattttactaatgaatttattaaaagtttaatattttaatatgtccaaaaacagcctgaggaaaaaaatcactttcctgattatttcaatagcatatgtgctctataaatttgaggattcagttcattaaatttgtattgagcaaagcacttgttggctttgcagaatgttgtttcaaaaataaagtcatgatccttgctaccggagcttttaaaaagtgacagtcaataggccaggcatggtggctcatgcctgtaatcccagcactctgggaggccaaggcgagcagatcgcataggcccgggagtttaagaccagcttggaaaacatggagaaaccacgtctctacttaaaacagaaaaattagccaggcatggtggtgtgcggctgtagtcccagctactcaggaggccaaggtgggaggatcacctgagcccgggacaaggaggttgcgttgagctgaaatcacaccataccactgcacgccagcctgggccacagagcgagaccctgtctcaaaaaaaattaaataaaaagtgactgtcaagtccagtcgaggtagctcaggcctgtctcaggcctgtcatcccaacactttgggaggccaaagtgagcagatggcttgagcccaagagttcaagaccaggctgggcaacatggtgaaaccctgtctttaccaaaattccaaaaattagccaggcgtggtggcctgggactacagagtcaatacagtcagtcccagtttgggactgtgttgtggcctgggacctcatttcccgagaaggctgaggtaggaggattgcttgagcctggcaggcagaagctgtcatgagccgagattgcactattgcactccaccctggtgacagagtgagattctgtcaatcaatcaataaatagtgactgtcatcaatatgtaaaatattgtaatgaaagctggctttatagttttagcttaacttctgtcatgcttattgttcatttagtgcttagtcttaaaatatagcataaaaatgattcatcttattagaagtctgattttattttctgaatttgactaatgcatttggattttttaaatacccatcttaggaatgagtttttaagtacttcttaaaaatgcattggaaattaaattttcttatgaaaggttatttttatagtttgaactaaatcatgagcttctcccttaaatttttagctttcataaactaggagtgaattatgactaaaataactgaatgtctgaattattatcagtaattctccccatctaaggtttaaacctatagtaaaacagacacaaaaagcagtcataaattgaacagattcttccataaaagcagtaatgtttagtagttaagcaagtgggcttcacagtcattctgccaggatttatctgtcttcttcaccactcagctgtttgatctcaggcagattagttaacctctctaagttctgtttcatgtgttgtttttttttttttttttgagacggagtctcactctgtcgcccaggctggagtgcagtgctgggatcttggctcactgcaaccttcacctcccggattctagcaattctcctgcctcagcctcctaagtagctgggactacaggctcgcgtcaccacacccagctaattttttttttttttttttttttttttttttgtgacagagtcttgctctatcactcaggcgggagtgcaatggcgtgatcttggctcactgcaacctccacctcctgggttcaaatgactctcctgccttggcctcccaagtagctgggactacaggcacataccaccacgcttggctaatttttatatttttagtagagacagggtttcaccacgttagccaggatagtctcgatctcctgacctcatgatccgcctgcctcagcctcccaaattgctgggattacaggcgtgagccaccatgcccagcccaagttttttgtatttttagtagagacggggtttcaccatgttggccaggctggaactcctgacctcaaacaatctgcctgcctcgacctcccaaagtgctgggattacaggtgtgggccaccaagcctggctgttttttgtttttgttttttttttttaacctcccctgccacacctctcctgatcatctgttttgtgaggattcaatgagttttccaaagcccttggaaatgtgcctggaatttcataagctcagtaaatgttagtggtagtggtcattgttataaataatccaaaaggaataatatactagcttgcagtgagctagaatagtacacttactcaaacaactttagataattagaatcttagtataaatgaaataagttcatttataattttccttttcaggacatggcaaaaaaaattcatcctcaaaagacaaaatagttaaaactttacaaaagaataagtaatgtatatatgttatcactttttaatttatttttatttattttttattttttgagacagtgtctcactctgttgcccagggtagagttcagtggcgtgatcttggctcactgcaacctctgcctcctgggttcaagcaattctcccgccccagcctcccgagtagctggcatttcaggcgcatgccgtcacgccctgctactctttgtatttttagtagagacgggatttcgccatattggccaggctggcctcgaactcctgacctcaggtgatctgcctgccttggcctcccaaagtgctgggattacaggtgtgagccactgtgcctggcccattaccatttttttaatgcaggatttctctacgttatagtagacttaatgttccttatataagaaggttgttaaaaaaaaaaaccgtgcaatctcactgctaatagaggatttcatttttcctgtctgaacctttttgctgcatactgtattgtggcctgggaccttatttccttctagtgtctatattaactaatatttgacttctacctgcttctccagttttatcttccttccctaatcatccttgccctccatgccctagctataatgaacagtgtgctattttctgaatatcccgtgccttcatctccatactgttgtgctgcagtttttttcttacatgtactcattctctttcagccacttttgtctggctaaatccttatcccatcccaaggaacaagaagtcttgccttgttctccctccttaccttctaccaccaaaattccattagataacctcattaaaacactgattaaactttcatattagccatactctttaagcttaaagaaatacattcagatctcctttaataatggaaattcataagagtgtgaggtaacaagaaatattctatgttaagccacagtcaccctgggtcttggtgcttacctgagataggtatatggagaactggaacaaagtacatcacaggagccatggcaacttatatagacattaacttcatgactttcctcagaaaggaaaactgtagctggcagacactttttgcagctttatggcctaaccagtaccactctttcattgtacttactaacataacactacttatttgttggtcttactactagggtagggttgagattgtgtccctagcacttaatgtggtatctggtattcagcaaataattgttgaatgaataaatgtctgtcttttggctgaacaaataatagaggagaggagagaagcttagaccctgatcctcatttcccctacctgcaacattgttaatattaccatacaaagtttgtgactcagtttttgttaattctctttattcttgaagaatcaggagaaactaatgaaagaactcaaacagctacagcaagaggacctggcacgtaggagacagactgtagcacaaatgccaccacaactagttgaacttccatacaaacgcagtgaaatgaaagaagactggcagagagaattggaatttgcctttgaagatatgtacaatgcagacaggagtaagatattttcagtagggctttcaatagtgattttatacgttttggtgggaaaatatgtttgtaatgataaagcagtttttatcttgaaatgagttctctgtttgaaggaggccccccatattttagattgagacattaccgtggcctttgcatttttgtgatccagttatttttaatcattttggaatggaaacgtgtctctatttttcttttttaagaggtgaaagggaatctgattctgcaccttgaaccagagcccttgcccactgtgactaatcagatccaagatgaagagctggacctttcaatggaacaagaaaatttgggtgcagctgaagaccttccagtgacagaagctgaaatatgttctagtgaaacagatggtaaaaacccttctgagctaaatattacagtatttcacagaaaaaaaaaatgctaaccattagccagcagttaggaaaatctggtctgatataagtgcaagcaatgagtaatactgatgggagcagtagctaaaggatacaacgtttttatatttccatcattgacgatcctttttcatatgtgtaggaggaaagtttattcagacgtacagatgatctgaagattttcaggttatttgagttgggtgctcaattctgaattcattagaaaggttgcatggtaaacatatctgatagcaataacttaagcataccctgagaatgaccctgtgtggcatacacacctgaatgtgtgttctgagctagggaatctgggagtagccaacctggaggttcatttcttgtctatgaggaacatctgagcccctgtcccatcccgtggaacatgagccatacagaggatcaaggtgtcaagttttgggttgaatgaaagttgtcaggtggagatcgttaggaaaagggtactaagtgacagtactatttaaactgcatgctttttgcaagcggttgcagttcttctgtccagcctgctgccactggactctcccttatgtgtatgccctcagtgaaaccccaaatctcattggctagctctggatctcttatttggcatcttgaacctggtgccatccccatttgagtgagtagaggttcagcacgacaaagatcagcatagacttgtcagatcatcagagatcctactggtattcagttatttctaggtacttcgtgtgtaatgatggatagcacaaattttgatctctcaaacatctctatctccaacattctgaacttttttacttggctgtcccatagttaaaactgcatgtctagcaataaatttatgatcttctcttgcctactaaaactgtctctacctgtcttttctatcttagtgaatggtatcacagtctgcagttacccaagccagaccactgggagttacctttaatactttccttttacctgcatgtctccttaaagaccaagtcctcttcatggaattcagctatttttgccccgtatctactggtatttcctttgtttaaaaccactgaggctttcttatcgtcttcaccctacactgtgaacatagccttttgggattccaactttatgtaggcctcctattatgtaggcctcccatatctactggtatttcctttgtttaaaaccacccaggctttcttatcatcttcaccctacaccgtgaacgtagccttttgggattccaactttatgtaggcctcctattagactcctcaagtgagggctctaggccttattcatgtctcctatgcctacattgttgtccaaacggaagcctaaggttactaccagcaactggggaaaaaaaagcagcagcagcttaaggttactgtgttttgactttggcataagcttagcagaagatggtttcagggctgacttgccttccctccaagctttccacttaaatttcatttctgtcctctgcagaaccttttcttttcatgccaggtcagctgtgtctttgtttgtttgtttgtttgtttgttttgagatggagtcttgctctgttgcccaggctggagtgcagtggcacgatcttggctcaccacaacctccacctcccgggttcaagtgattctcctgtctcagcctcccaagtagctgggactacagccacacaccaccatgcctggctaatttttgtatttttagcagagacggggtttcactatgttggccaggctggtctcgaactcctgaccttgtgacccgcccacctctgcctcccaaagtgctgggattacaggcatgagccaccatgcccggccagcagtgtctttaaaaagatattcttacagccaggtgcggtgactcatgcctgtaatcccagcactttgggaggccaaggtgggaggatcatttgagttcaggaattcaagaccaccctggccaacatggtgaaaccctgtctctaccaaaaatacaaaaattagccgggtgtagtggcgctcacctgtaatcccagctacatgggaggctgaggcaggataatcgcttgaacctgggagacaaaggctgcagtgagccgaaaccacaccactgcactccagcctgggcaacaagagtgaaactccatcttaaaaaaaaaaaagatatttttactctttcatgcagctttttcagttattttcattgggagtatcaatatctagtttgtcacaatggaagtcttgcccaatctaaagggacagttacactttagctcctgctgatctcatttggtcttattggcttggtgttgccaagttgtttgtttgtttgtttgaagctagaaatctcattgtttttaaaaatccttacttttaaatattggcaatgaatttacttcttaaaaatgagtgggttgtggactaatggtaaatgaaagaagccaggcagaaaataatacctaaatgtgtgattccatgtttatatgaaggttttaaaaaaacaggcaaaactaatctgtgatcttggggttaaagtaggggctgtttttaggggtgtattgactgggaagggacatgaaggaaccttagtcctggtaatgttccacatgatctgaaaggtggtacattgacatatgtgaaattcagtaagctatacacttaggtttttgtgcaccttgttctttgtgaattataactcaattggaattttttttaatataagttagacaaaactacaatctgcctattttcaacctcttaaagatattcttaaattttattccttgactaagccagagaaatatgtacttgcatcacacttttgtcctcttagagaactgttcgtattatactgagttttggcattaaactatcagcccacatgggaaaatgtttgaagaaatacttgtgttgtttttttgtttttgtttttaactgaagggatctctgtgtgaagatgggtgggagacatttttcccagatagtgccaagaataatttgggagcagttgatttgcttttatggctatgatgttttcctctgtagctcactaagaaatacagagccatatttgggaccattctctagtgtagactatagaacctcacagcatatattttcaatactaatcttaccagcaaattaattagaagttacacattcatttatcatttagcaagcaaaataaacatcttcctgataagttttttaggcttgatatttgtgttgcatacatgtttttggaaaatacttgaattttggcacttttactattttcagttgaaaaaattatttctagttataatgattggagtcagatagcattgttgtatatactgttaaatcgtaaatatgaggaaaataaaactgtgcttttaactagtggttatagcagtaaccgaatataagatggaacaatttgcctggtaatacaatagatgctaaataagttttttccctttttctttcttttagttcccttggtaatgaagacccaacagattccttcaaaagttctttttaaaaaattattaaataagatccgaagccaaaaatctctctggacaattaaatctatgtctgaggatgaaagtgaaatgattacgactgttagtgaaattgagagtaaagcaccaacggttgagtcaggaacaattgccagcaaagagagaacgttatcctctgggcaggaacaaggtatttctctccaagagtctcattttctataaacccttttaagttgttcaaaagtaggttcgtttctgaaaaatcaaagaatagaggttaaaaggaacaaaacataatcctgctaattaaaagcaacaaagaaacattataaaagccttagtgaatcttcttccggaccacttttaatctagtatagttatttatatatattaattgcaaagtaatcaatgaatcaaaattaaccagttccttattgagatgttcaggctgttttctaatttttcttggcatttttgtgctacagtgggcatccttttagtgaagtctttgcccacatctttatttccttaggaaggactctttaaagaataactcctgatcaaaggatatatgagcatgttaatggcttttgagcgtgttgtattcccactaggtatttagtttcttatttgctaattttaaatacttttctgattggaaaaataggctattaactatatttccagaagttacaaagtatcttttcacacacaattcaagtatctccttgattgggatgattttaaaaatgtgattggatttgtatagaaatgttttgcttctatgcttttgataagagtgacttgtggtctatatttgggttttggattttatcctgagtcccacaggaagccttcttgaagtattttcttcccttggccccttgacagcaccttcacttggttttcgtactttactattttctcttgcattttcttcgctgtttatccacatctccataatgactaaccattgttagtcgttggttagtctacagctcattccgcaagtcccttctctttatatcaaaactccctagttgatctcaaatgtcacactttacattatcatctgtaaactgatgtctcccaagtatgcatttctatttttggcctcctgtttgaactcaccttacttatttaactgtttccttctcttgtatatctaataatatcttaaatttcttcagaagtgacctgttgatatcccctcccaccacatacctgcttttcctacagtattccacatttcagtatctggcaatatgttaattcccttgctcaagccaaaaagcttatagtcattctggttccctcttttcatatcttatgtatcttatgtccaaactattagctgatccagttggtcctaccctcaaaatatatccatagtccaaccatttctttccacctacatcctagcttaagccatgttcatttcctagggtagattcttgtagtagcctgctatcatcagcctttgcacctccctgttattgtctattaacatagtggtcctcttaaaaacaagtaatctcatgtcatttctttggatgaagccctccagtaactgtcagtttcactcagtaaaaaccagagagtttatagtggtttcaaagccttatgtgacctgcacacatacacccccaccaccactactcccatactcactacctctctgacttcatttgcctgccacacctccctacccatcttctgcactgtagatgccagcttgctcgctgtttctcagacagcaaacataggactcgtggtcttagcaattgctaatctttttgactagacttctctttttcttgggtatttccttgactcactccctcacttccttcacatgtttactcaactatccctttctcagtaaggccttttctgactatataaaatggcacacttctaccactccccacctctaccccaacctccacaccttttacttcctatcccctttaccctgctttccccccatagctcttatcaatatctgatgggcccagtaaagtgactggtgcttattttgcttattatcttaatgcctaccccacccatccataaggacaggagctttgattttgtacattgctatgtccccagagtctagactactgccttgtacaaaacaggtgctcagttaacattcgttgaattaattgaataatttaaagcaagagaggtaaatttggaatctagacatatatatgatatttaaagccatgggcatagaaaaccacttggaggggaaataatttagtgaaaagagggcttgtaagaccatctgagggattccaacatctagaagatggctagagaaagggcagatagcaaagtcagtaaaaggagtggccagagaagtaagggagaatatggtgttgaagtccaaaaaagggaactctcatagtcaatccgtgaccaagttcttttgataaagggcctggctgggcgcagtggctcacacctgtaatcccagcactttgggaggcccaggcgggcagatgacgaggtcaggaggtcgagaccatcctggctaacacggtgaaaccccgtctccactaaaaatacaaaagattagccgtgcatgggctgggtgcggtggctcatgcctctaatcccaacactttgggaggccggggcaggcagatcacgaggtcaggagattgagaccatcctggctaacatggtgaaaccctgtctctactaaaaatactaaaaagtagctgggcatggtggttgtgggtgcctgtagtcccagctacttgggaggctgaggcaggagaatggcgtgaacctgggaggtggagcttgcagtgagccgagatcgggccactgcattccagcctgggtgacagagcgagactctgtctcacaaaaaaaaaaaaaaaaaaaaagtgagccaggcgtggtggcgggcacctgtagtcccagctactcgggagcatgaggcaggagaatggtgtaaaccagaggcagagcttgcagtgagctgagatcgcaccactgcattccagcctgggcgacaaaatgagactccgtctcaaaaaaaaaaaaaaaaaaaaaaaagataaagggccaatatgagcaggctttcaccattctcatcttgctttattctcccccttgcctgactaaaaccatgcacactgatctctcagtttcttgaatgggccaaggtttgtttctttatcctcacggggccttttatacccattggtctgtctggaaaggtctcctatacatcttcatgttgtttacctggctggttcttccttacctttcaagtgtctgcttaaatgtcgtttcctcagagaaatttcatcttgcccagatttattatactctattgtataacccttcacttttcttatatagtacttattacaatttctaattttataatttttttctgggataattataagatggttctgccacctactctgtaaagcctccttgaggcattttctcatttactgtggtatccccagcatctgccacataagtaggtaccaaatgaattaatgagtgaatgaacggatagctccatgcagactatctggctacccaaatatgatcagaacaaattgctttaacttccttctctgctctggtttcacaaattattttttaaaaacctagtatccaaatatatcaaagatacattgacattttgttagcttctcctttttaactttgataccttgttgtttccgctctttttatgcctttctcctatgtttgaaatcctatcagcgtatctattaaatcagttcttcacgttttcacaatttcagtctttcatctctgttgttattattaggcttgggtttaatgagaaatatatctgatcatcaggaaggttactggatcttaactagatgagacattcagatggccctagattgaatgtgttaataccagaattttgttattttgctttaagtttgacaatgattatatattcaaaataacagtggtattatctattacagttgttgaaagtgatacactaacaattgagtctggaccacttgctagtgaagataaaccactttcgtgtggtacaaactctggaaaagaacaaggtatttctttttatcacatcctcaaattaaatttgactccttgcatcttttttttaaataaaattacatgtgatatattaagaaagggcattatagtggtgtcaaaattctaaattattgaaactaatttttgtttggggcattcccctagaaataaatgagactctgcctatcacaactgtagctcagagttcagttctacttcatcctcaagaagcagcagccaggattagaatgtcagcaaggcagaaacaggtaatttgaaattttatttttaaaggtttatttttcccctaggtactattatataattttgtttggccaatgaaatttgtcttaatgtctggctaattttgatatcatgtttttgacattgtcttacacaaacattcagctgataaaatgcgtgttgtctttgcccatactgctcattcaacccttattgtgtctgctttatattttatatatttgtatagatcttccctataaaatttattagcttttaaaaagcagagactatcttctttaaaaaattcaatttatcctacacagtttctgatacaatgctttgtacatagcaagtatacaataaataattgttgaattaacaagtccttgtcataatattagacactcagatgggctttgtaatcccacaagttttttgaaaaataatacttcagaggaaaaacttttaatatacagcgccctttttttgctccgtcgcccaggctggagtacagtgacacgatcatcgctcactgcagccttgacctcctcagttcaatcctctgacctcagcttcctgagtagctaggactacaggtataggccaccatgcccagctaattttttttttttcctagtagagatgacgtcttgctatgttgcccaagctaaactttaacttctttaggctgggcatagtgactcatgcctgaaatcccagcactttgggaggctgaggtgggcagatcacttgagcccaggagtttgagacccacctggccaacctggtgaaaccctgtctctactaaaaatacaaaaatcagctgggtgtggtgacacaaatctgtagtcccacctacccaggatgctaaggtgggaggattgcttgaacccaggaggcggaggctgcaatgagtcaagatcacaccactgcactccagcctggatgacagagtgagactctatctcaaaaaaaaaaaaaaaaaacaaaaggccgggcccggtggctcacgcctgtaatcccagcactttgggaggctgaggcgggtggatcacgaggtcaggagatagagaccatcctggctaacacggtgaaaccccgtctctactaaaaatacaaaaaattagctgggcatggtggcgggcgcctgtagtcccagctactcaggaggctgaggcaggagaatggtgtgaacccgggagacagagcttgcagtgagccgagattgcgccactgcactccagcctgggcgacagagccagactctgtctcaaaaaaaaaaaatcctccttaacttatgactttggtctcatctacttttaataaaatatttttttaacccaacttacctcgaaggaggctaattattactaagcaggccagtttatagtcctagttagttttttcaaaaatacagctggggaataattccgtgagccagtatttcttctcagataaatactttctcaggccaggtgcagtggctcatatctgtcatcccagtactttgggaggcttaggcgggcggatcacctgaggtcaggagtttgagaccagcctggccaacatggtgaaatcccatctctactaaaaatacaaaaagtatctgggcgtggtggtacgcacccacaattccagctactcagaaggctgagacaggagaatcgcttgaacccaagaggtggaggttgcagtcagccaagattgtgccactgcattcgcctgggcgacaagagcgaaactatctcaaaaaaaaagaaaaaaagaaaaaaagaaaaatttctcatcaatagtctagaacagtattgttcagtagcactttctgtgatgatggaaatgttttatatctatgtacagtatgtacctgttagccacatgggctgttgaataaaatagtgtaactgaggaactaaattttaagttttatttaattttaattaaatttaagtagtcacataaagctagtaaccactctatggacagtacagttgtagatgtactacagaactgtaaacagtctaaattcaggggctcctatgagtaagggaaagtaaggaagaggaactgtctgggaactcagttgaagccactgttgcctaactaggaataggtaaagaatcaggtcaaaacattttttattttgaaaacaagatcattgttcattatctctagtagaagtgctgctctttatataagaaaacaacgtgcattcctttttttacttattcagtaaatacttgtctgtttatcagggactgtagagtagtccctgcttatccacagtgtatatgttccaggacccctagtggatgcttaatagtaccaaactgtggataatattgattcctgtatatactatgggtgaatttatttttccttctttataattccactgatagaagatttacttttaccatagatcttagcaatcagcgtataattttttttctttccttattgagaactttcagcttttcactaaaaggaagcactttacagcctctctttgacatatcaaaattgccagcattactactcttatgctgtggagccactgtgaagtaaaataagggttatttgaacacaagcactgtgatgctgcaacaggcaagtttttgtaaccaagatggctactaagtaacaaatggcctggtccagtttacagcatggatatgctggacaaagagattattgatgttttcagcagtacagagtaggacagtgcaagatttcatcacactacttagaatagtgcataatttaaaacttatgaattatttctggaattttctatttaagattttctggctgctgttgaccctgagtaattaaaccacaaaagctaaattgcagataggaggggactaaggtgctggatttggcaggctagttttgtcctcatgaaactcatagttactcaaacatgttcatattacttagagtgtgagtgtgcttgtatagtattagagtttatgtgttatctttctgccattttcttctgttccatgcctgacaaaaaagacacagaatgttgttcattgcttctagataactatccctcttaatgagcatggttaagaagtcaaagtattttaggaggccttgatatttaatttctttagtcattatttatactattaaatgtgtgaacatagaatttggctgtacatcatttgctacttcaaggtagttcttcagtggtgatcagggtttcactgtgctctcagaaagtagaaatagttaatgtatttattctttcttttccttctgcctttttttacttctatccctttttctctttttcccatttcccatcttttactcccatcctcagtctgtcagtgataacaacagagataaagcatcaacacttacttctttgaaaattggtacccttggtgaagaaacctaatttcttttaaatggaacgtgtgttatctttgcctttgtatgagtttgttgttaatagatcaatagtattttgttacctagataatggaaatagaagagcagaagcaaaagcaattggaattacttgaacaaattgaacagcagaaattaagattagaaactgactgcttcagggctcagctggaagaagaaaaaagaaaaaaaactcaaccgactggggtaggatgcagaaaatctcatcactacataaatcatttggtaaggggggcaagaaaatatgagcacttgtagcgtttagaaaagtaaaatggatggctgggcgcggtggctcatgcctgtaatctcagcactttgggtggccgagacaggcagatcacttcaggtcaggagttcgagaccagcctggccaatgtggtgaaaccccatctctactaaaaatacaaaaattagctgggcatggtggcacgtgcctgtaatcccagctactccagaggttgaggcaggagaatcgcttgaacctgggaggtggaggttgcagagtgagattccatctcaaaaaaataataataataaaagtaaaatgcctttgtaattcttatttggtctttttttgatataatgtatgtatatatgaataaatttgcatcagttacggctttcatctttcagtttctataggatactaatagatacgaccatggtttgtaggtaatgcgtatgttgagcttttggacctgcactgaaggagaatgacagattagttcatttcttactaatggaaatgccagtcattttataaaaaataaagctgtatggaagtttacaattatagaactgtatgtaaaaatacttcaatacttacttctaaatttgctttttaattagtaactttgtcttttattaggttggcattgctccagcatcatgccctgtaatttctgatgaagatagtcataggcagatgattcgtaactatcaacatcagcttttacaacaaaacaggtattagctagggtataatttatatgtgatcgtatgtggctacatttttaggatttattgtttcatttatatgaggatctaatttggatttccttagaattatggcatttagaactgccattcttaaaggacaatgtgagtgtaatttcttttcaccatgagtattgccaaccctagattgctgtttgttaaatttaatgtatagacatggggctttttatttttcattaaaaaacaataattgtttgcttttgtttttggtaggttacacaggcagtctgttgaaacagccaggaaacaattacttgaatatcaaactatgttaaaaggaaggtgcccatcggtgtcagctccatcattgataactgattctgttatatcagtgccatcatggaaatctgagagaccgactgctatatcagagcattgggatcaaggtcagagactcaagttgagtcctaacaaataccaacccatacaacctatacagacctccaaattagaacaagatcattttcaggtagcgagacaaaatcactttccacaaagacaggtggaaacaacagaaacattacgcgcttcagatattttaaccaatcaagctttagaatcacaagaacatctaaggcaattctctcagactgaaacacaacagagagactataaattggtccccaaagattctgagacactttcaagggctttgtcacatgacaggcagctaatatcacaggatgctagaaaaatatctgaaacatttggggcaacaacttttcaaagtttagaatcccaacaattgttctcagagaatagtgaaaatatatcttaccatttaactgaaccttcttcatttgtaccactggtacctcagcattcttttagttctctgcctgttaaagttgagtcaggaaaaattcaagaacccttttcagccatgagcaaaagtacagtttccacaagccattctataatcagccaaatgcatgataggcctttgctgccgtcagagaatatcacagcccagcaaggtaatatgaaggccctccaagaacagttagacctacagaagaaagttcttcaggcaactcaggaagctcaggaacagttgcttttgtgcaaacagaaagaagtggaacagcaaacgggcctctcggtattccttcccttggtaactccagattcatctgctttattgccttctgccaaagcagatttggggagaatccaggaatcttcaccaaccaagaataatattgcagtttcctcagaccatcatgtgatctcacaacttcaggataagcgtttgagtctttcacagcctatcctatcacagcaaaataattttaaatttctccaagagcagttgaatattcagaaggatagccttcaggctaggcgagaagcccaggaagtattgtatgtacataaacagagtgaattggatagaagagtatgttccgaacaggctgagccctctttcccatttcaggtagctcagcatacatttacttcactaccatctgctgatacaaaatctggaaaaatacaggagcaacattcatctaagagcgagaaaggacttgtttcatgccaatctgacatccccatatctcaggatgggtctttgagtttcctacagcagttcctacctctacatgatagtttgaagttgctccaagaacagttgactaaacagagggatactcttcaggctaggcatgaagctcaggtggaattacttttacatagacaaagagatttgggggacagtaagtctgggctggtgagctcttcatcctcaccagtggttgttcagcattcagttgcttcacaagcttctgctaaagctgagcctaggagaattcaggagctttatttatctgagaaggagaatgtaggtccctcctgtcatttgataatcccaacatttcaggataagtctcttagttttccacagcatagcctggcacagcaagaaaatttgacaatactccaagaacagtcacaaatacaaagggtaatacttggtgctaaagaaggaactcaggaatttgtacacacagaaagtgaattggagaaaagaatttcttctgaacagactggcacctcctcatccctttcccaggtggatgaatctgagagattccaggaatgtatatcaatcaagagtgacagtaccattcccttaagccatcctaagatcccaagatgtcaggaaagacttttgagagtttcacaacatatgctacctctacaagataatttggaggaacaccaagcatggctagacactgagaaagaagcctttcatttcagccagaaaacccaagaaaatacatcttctgaacaaactggttcatcttcattcataccccagttggtacagctttcatttacttcgttagcttcagctgagtctggcacaatcctggaacctctttttacagagagtgaaagtaaaattttttcaagccaccttcagatcccacaattgcaggataggcttttgaggatatcgcaacttatccagcctcaacaagataatttgaaggcacttcaagaacagttagctacacagagagaagccatcattctagctagacaagaagctcgggaagaattacttttacatcagagtgaatgggagggaagaatatctcccgagcaggttgacacctcttccttacccctagtaccacagcattcattcgcctcattacctcttaatgaatctgaaagaaaccaagaaccatgttcaattaacagtgataatatagtatcctcaggtcactcagagataccaacattgcctgatgggctgttgggtttatcacatcttgttttacctcaacaagataatttgattgcacttgaagaacacttgcatgcacagacagatttccttccttctattgagaaaacccagaaagaattggttttgtcaaaaccatgtaaatttgaggaaaaggtatcttctgagcattttatccagtctcaccatggtgatttgcaggcacttcaacagcagttagatacacagaagaaagccattcgatctatacaggaagtccaagaagaattgcttttgcaaagattaagtgaattggagaaaagggtatcatctgaacaagtttgctcctcttcatttgtatcccaggtgcctgttgctgactctgaaagaacccagaagtctttcccaaccaaaagtaatgatactcttccctcaagtcatcgtgagattccaagattacaggatagacttttgagtttatcaaagcctattctgcctcagcaagataatatgacagcacaattggatgcacaaagggaagtgatgtattcttatgagaaaccccaggaagaactgtctttaaacaaacaaagaaagttgaacaaaagtgaatctgctgagcatactatcccctctttgtttctacccaaggaaacagagcattcgtttattccactaccttttgcagaagctaaacctaaaagcacttgtgaattgtattcatcccagaatgaacatgcagcccccccaagtaatcctgtgatcccagggtttcaagatagacttttgagtttttcacagtctgtcttaactcagcaagataacttgggacttcagaaacagttggatctacaaagagaagttctgcattatagccagaaagcccaggaaaaattgcttgtacagagacaaacagcattgcagcagcagatacagaaacatgaagagactttgaaggatttctttaaagacagtcaggtatgttttaaacctgaataataatgaaacactagaagtttaaacccaaatcagtttttaatactaggattacaagttttcagttattgagaaaaagtagtttgaccttaactgtgctttgatttttcaccctaaatgatgtggaagttaaaacaaaaatcgatccacccacatggtgtttatgaggttaatagttacgtgaagtccaattaatttttttaaattttcttttgtttttgctttttttttttttttttgagacaaggtctcgctctgttgtccaggctggagtagagtggcaccatgtcggctcactgcaacccctacctcctgggtttaagtggttcttgtgcctcagtctcccaagtagctgggattacagacatgtaccaccatgcctggctaaattttgtatttttttttttttaatagagacagggtttccccatgttgctgggattacaaagtgcggggattacaggtgtgagccaccacacctgacccaaagctcaattaatttcacctgcaaacacaccacaaaacaatgtagattcttattttagagttttgttttaatgtattttaagcttaccataagatttaaattgtaaaaataactggttagcagaatttctcttatgcagcaacagacattgtgctctttgttgacatttatatacaaatcaaaatcaataccatcttttttctcaagtgacactattatggtttgttgtaaaacgggcatgattttaggctgatgtagagctggacctgctgcttttatctgaattgttcataagactcggcccagtgactcattcatagttgccctatctgggagacaagggtatgttctaaatttgaatgtatctgttttattttaaaaggccagttctgctggacatggtgactcaggccttataatcccagcactttgagaggccgtggcaggtggatctcctgagcccaggagttcaagatcagcctgggcaacatggcaaaaccctgtctctacaaaaaatacaaaaattagccaggcatggtagcatgtacctctagtcctagcaactctggaggcttaggtgggaggatgacttgagcccaggaggttgaggctgcagtgagccatattatgccactgtactccagcctgggcgatgagggagaccctatctcaaaaaaataaataaatgaaaggccacttcctaaatttattatttagtctaaatagaattctacaaatcctttgatgtcgagaagaagcttgagttgggttcaggaagagttaacgtcaagagatttactggtcatttaaaggaaaagtaatggcaaaagaaaagcagagggaaatactcaaatataatctcttatggaaagatgaaatggaggctaagtttttttttgtttgttttttgtttgtttgtttgtttgtttttgagacggagtcttgctctgtcaccaggctggagtgccgtgacgtcatcttggctcactgcaacctctgattccctggttcaagcgattctcctgcctcagcctcccgggtagctgggattacaggcatgcaccaccatgcccagctaacttttgtattttttgtagagacagggttttgccatgttgcccaggctggtttcaatctcctgacatcatgatctgcccaactcggcctcccaaagtgctaggattacaggcgtgagccactgcacctggctgtaggctaagtttttaagtccaaggctgtgaatggttgttgtttttgttgttgttgttgttgttgtttgagacgaaatcttgctctgctgcccaggctgcaggctggagtgcagtggcacgatcttggctcactgcaacctctgccttccaggttcaagtgattctcctgcctcagcctcctaagtagccaggattacaggcatgcacaatcacgcccagccaatttttgtatttttagtagagacgggatttcaccatgttggccaggctggtcttgaactcctgacttcaggtgtcctgcccaccttggcttcccaaagtgctgggattgcaggcgtgagccaccgcgcctggccgaatggttgtattttcaatggaaatatccttttggcattagaagcatatcttattttttatatatagataaaattttgtgattgatggaactatttatttggtttacgttctaatttaagaagggagatataaatctaatgaataatgcttcacatgatcccccaacttgtgcttccccaccctcatctccactttttcagataagtaagcccacagttgaaaatgatttaaaaacccagaagatggggcagctcagagactggtttcctaatacacaagacctagcaggaaatgatcaagaaaatattaggcatgcagataggaacaactctgatgataatcatttggcttcagaagatactagtgccaagcaaagtggtaagataattgtgtttgattgtaattatttcactgattattccttgttttcgtcccctgtagcttgctagttgaagaaaagttagaagtatgttaatagattttgtattgtatccaactttgtcattgacttaataggtgagcatctggagaaagatctggggagaagatcctcaaagccacctgtagcaaaagtcaaatgtggtttggacttaaaccagcatgaacttagtgctatacaagaagtagagtcaccagcaattggcagaacttctatactaggtaaatagatgctttgataaaacaagatttttaaataatttgccagttttctactttttttttagatggagccttgctctgttgcccaggctggaatgcaatggtgtgatctcagctcactgaaacctctgccttctgggttcaagcaaatctcctgcctcagcctcccgagtagctgggattacaggcgcccgccaccacacccagctaatttttgtatttttagtagagacagggtttcaccatattggccaggccggtcttgaactgctgacctcaggtgatctgcctgcttcagcctcccgacgtgctaggattacaggcgtgagctaccgcacctggtctacattttttcagagtgctaaatgttttttgttaaacttatagcagaaaaaggagatggaaaaaaaaaaaagaaacctagactgactttcatgaaaaggaaaaaatggcttatttaaacagtatttaaaatttggacttaaggaaatgtggcattggtaataactatgactatgtagtttctttatcttgtatatggggaaaacaacttattgtaggcaaaaattttttggttttccatcttctgacagtcttgctccccgtttcctttcatgtctgccttctaaatgtgtttcttttaggatacactcaggttttttttttttctcttttcctttgtcactttctactttcctaccttcactgttctgttcttttcttatatttttataggattattatgcttaaatcctggctttgtggtcaattagatatatttattcactgtactactttctacatccaggtgtcagaaaaaaataataaaacactcatccctgtaattctttttttttttttttttttgagacagagtctcgctctgtcgcccaggctggagtgcagtggcgcaatctcggctcactgcaagctccgcctcccaggttcacgccattctcctgcctcagcctcccgaggagctggaactagaggcacccgccaccaagcccagctaatttttttatatttttagtagagacgggatttcaccgtgtttgccaggatggtctccatctcctgaccttgtgatccgcccgcctcggcctcccaaagtgctgggattataatcttgagccactgcgcccggccccatctctgtaattcttaataaatagtcttatgtgaatttcataattttttttagaattcagattcactaaataattttctcgatcaaatttatcaaaataaattattttttaaaggggaacattagctttgtcaatagaaaggtacttagaagttgtatccccattagtatagtagttgaaaaaaaagctgtaatgttaatattagctgtttgatcttcagctataaaatattgtacctgtgtttctgagcatttgaaagaattaagggaggtatgccaggtgcaatgactcacacctgtaatcccagcactttgggaggctgagatgggaggatcgagaccagcctggtgtaatgcagggaaaccccctctggtggcgcttgcctgtagtgttcagctacttgggaggctgaggtaggaggctcacttgagcccagggggttgagactgcagtggtttcttttaagtctaggagtaagtctaaataagtcaagacccctaggtaggtgaactaaaatccctaccaaaacccctggtaggtgaactaccaggccctcatgatctttctcttcctcccttcaagacttagtaagtgtcattggtttggtaaacttattcagatttccttctcatgaagtcttggtctcatcatagcctttaccatacttcttagggtaatacttctatcatcatattacatgcaagtaatttaaaaagggaaatagcgctgaaaggtataacataaaacagcagttcttcctgcccctacacaccctttaataccactcactagaggcagttacttttcaagtattttaagtatttcttcttgtatttacttccatagttgcagtgggtttaagcaaaaattaagctaaattgtcattatggtgatacatagaccttttttgctgcggagtccattagtatattatgttattatattttatttttctaaactttttttcatgtagtaaattgtcttatttatttaatttgcttaaagtttttagagtgtctgtctttccactctctactacttcagttaaatacctctcaatataatgtagtttgtactattttctctttttgtggaacaccttttagttggaagttgtatgggccgtgctatgcattcttaacaagggtgttttttcccccagagggataaaaattggttcttggggaggtgaaaaaaaacttttactatttatatgtacaaagcacaaatatgcataaatagatatacagtatatttgtggttattaaaactgaacgggggtagaggcagtttaaaaaggaaaagtctaaaaagactccttaagggatgataaaaataaggttgagaaatactgatctatattgatctttccattttttcttctctttctttttctttgggttttgttttgtgggctaattttcttaattttgtgttctgacttttcttttgaacttttgatgatcaaattgtagtttctaaaaggttactctttttctctgattattttctttttttatagcatcctgctattgtttcatggatgcagaatgttgtctactttaaatatttacagtggattttttggtttgggtttttacattttttagttctttcatttttttgttgtctctgtcttatactttagaacctttcctctaatgtcttcatatttgaacgggatgctaaaaggccaattggaggttctcttggggtgaggggctatatgtgctgttggactttattggaaaaagtatggctttgtagtgaggacgctcaccttagtatctgtagttccattccttgagagaagtttagtttcttcaaagaaataccttttaagcttgatataagcctggctgttgatattattgagccagacctaggagatctggattgaggatgcagactttaacaccctctgatttccttatggcattctgtcacccccttccactcttgcctgctttctgtgcctgatcccctggaccccagagtgtatcagattcgttttctccagagaataaacctttagtttcctctggggatgatgttgatggacagggatctcaggagagggataactcttccaagtgcatagtcttaaatgttctgtttttagtttcctgctgcatgtattccttttgtagtagtgcctagcgcccttaattcccaatttttggggcgatgctttatcaaaatataaccttcaaagaggtgcacaaatcatgtttgtttcatgtaaacaccaccaggtcaagaagtggaacattagagaacccagtaaacacttctcttttaccttcccagttatcatcccctgtcttctaaaccatatcttgattcctataccacaaattagttgtggttatttttgaactttatatataaattatgaatgcatgttataatggctggtaaattctccacgaattttctttgtgattagtcaatactgaggcataatctgatgtggtgaggtagcagcatcattaaaagcttagtaaaattgaatacaaataatataaaagcttgactgtgaaaggtaaggaattattgctatatacagtaagtctttaagagcttagatttctacccataatataaattggcactttagttctagctattaatagttccagaaattgaagtggaaatattttttcccccccaggtaaaccaggtatttatgaagacagagaccccctgcgagtctcaataagccgagaacaaagtttctttgggagcccactggcccatgatccgtttagttgtcttcaactggttggccaagagaatgtctgtggtgatgactatgatgaagcaggtgagaaataaatggaaagtggaattgtatgcacaaggatatgtggacaaaagatatttattattttgttatttgtaatggtgaaaaatggtaaataaacttagttactgctgttaatggaatcgttatgatgcagttaactatattgttctatgcagttgttaaatgagtaattttgcttttaaattgttttattaaatgccagtaagaagtttatcaaggtaggagttttatacaattggcagcatccataaattttatgtttaagcctatttgtaacaatccatatctaattaaatactgttaaatattttaaaaattctatctgtgggcattctaaataagctgttttatgtttatttttaaatatttggaaaaataaagataattagaaggaaaaatatttaaatcacttaatcctaacacccaaagacagccaatgttaatcttctcgcttctgaatttatatatgtatatatatatagcacaggatattttatatataatttgtgtactgatcctacaaagtatagttgtagtactattttattagttgtaaggcatcttttaagaagttacattttggccgggtgcagtggctcacatctgtaatcctagcactttgggaggccaagactggcagatcatgaggtcagaagattgagaccacggctaacaccgtgaaaccctgtctatactaaaaatacaaaaaattggccgggtgtagtggtggtcacctgtagtcctgtagggaggcaggagaatggcgtgaacctgggaggtagagcttgcagtgagccgagatcaagccactgcactccagcctgggcgacagagcgagactccgagactccatctgaaaaaaaaaaagaagaagttacattttatagccagatttatttttattttagctgtacacctagtaagataatttacttgtatctatacaagataccttacttgtatctatagttgagtggaatgagagatgaaggaaagggatattcttttgagggtttattaaaaaattgactttaacatctctttaaattgtggattaaaataactgtaaaggatataattttcagtgagctataatttttgacattttaaaataaaacagattattctttttttaatttttaatttttgtggctacatagtaggtgtatctatttatggggtatatgggatagtttgatactggtatacaatgtgtaatattcacatcatggtaaatggggtatccatcacctcaagcatttatactttattacaaacaattcaattatagttttagttattgcaaaatgtacaaagaaattattcactatagtcaccctgttttgctatctaactgcttatttgtgcccattaaccatccccactcccccaacgacccccaactacgcttcccagcctctgataacctttgttctactctctatctccgtgagttcagttgtcttaattttgagttcccacaaataagtgagaacatgtgaagtttgtctttctgtgtatggcttatttcacttaacataataacctccagttccatccatgttattgcaaatgacatgattttgttcctttttatggctgaattgtactccattgtgatacgtgccactttttttttatccatttgtttgttgatggacacttaggttgcttccaaatcttggctattgtgaacagtgctgcagtcaacatgggagtgcagatatctcctcagtgtactgatttactttcttttgagtatatacctagcagcaggattgccgaatcatatggtagtaatatttttagttttttgaggaacctccaaactgctcttcatagtggctgtactgatttacattcccaccaacggtgttcccttctcaccacatctttgcaaaacattcattattacctgtcttagataaaagccattttaactggactggcaggatatctcaaagtagttttgattagcatttctctaatgatcactggtgttgattgagcaccttttcatttgcctgtttgccatttgtatttcttctgagaaatgtctgtttggattttttgcccattttttaatcaggtaattagattttttcctacagagttgtttgagctccttatatattctagttatgaatcccttgtcagatgggtaattacaaacattttctcccatcctattggttgtctcttcactttattgattgtttcatttgctttgcaaaagctttttaatttgatgtgattccatttgtccatttttgctttggtttcctgtgcttgtggggtattgctcaagaaatcctttgcccagaccagtgacctggagggtttccccaatgttttcttttagtagtttcaaatttgaggccttagatttaaatctttaatccattttggtttgatttttgtatatggtgagggatagggtctagttttattcttccatatgtgggtatccagtcttcccagcaccatttactgaagagactctctattcccccatgtacgttcttggcacctttctcaaaactgagtacacagtaaatgtatgaaattgttcctgtgttctctattctgttccattgatctgtgtgtgtctctttttatgctagtaccatgctgttttgattactgttgctctgtagtataatttgaagttaggtagattcctccagttttgttctttttgctcaggatagctttggctattctgggtcttttgtggttccatataaattttaagattttttttctatttctatgaagaatatcattggtattttgatagggattgcattgaatctgcagattgctttgggtagtatggacattttaataatgttgagattcttccaatccaggaacatggaatatctttccattttttgtgtgtcctctttaatttcttccatcaatcttttacaagtttcattgtagaaatctttcacttctttggttaattcctaggtatttaattttctttgtagctgttgtaaatgggattactttcttgatttcttttcaggtgatttgcttttggcatatagaaatgctactggtttttgtatgttgattttgtatcctgcaaccgtactgaatttatcagttataatagttttcttgtggagtctttaggttttttccagatataagctcgtatcaaaggataatttgacttcttcctttccaacttggatgctctttatttccttgtcttgtgcgattgctctagctaggacttccagtaccattaatatgttgagtaacagtggtgaaagcaggcatccttgtgtttcagatcttagaggaaaggctttcaggttttcccccatttggtatgatactagctgtggatctgtcatatatggcttttattgtgttatgttccttctgtacccagttttttaaggtttttatcatgaaggaatgttgaattttatcaaatgcttttccagcatcaattgaaatgatcatgtggtttttgtccttcattctgttgataggatgtatcacattgtttattttgcatacattgaaccatccttgcatccttgggataaattccacttggtcataatgaatgatctttttaatgtgttgttgaattcgatttgctagtattttagcatcagtattcatcagagatattaacttgtaaattttattttattgcatctttgtcaggttttgggattagggcaatactggccttgtggaatgagtttggaagtatttcttcctcttctgtttttcagaatagtttgagtgggattggtattagtttgcctttaagtgttcggtaaaattcagcagtgaagcgatagtgtcctgagcttttctttgctgggagactttttatttcagctttgatctcattacttgttattggtctactcaggttttggatttcttcatggttcaaccttggtaggttgtatgtgtctaggaatttattcatttcttctagttttccaattttggcctatagttgctaatagtagtctctaacgatcctttaaatttctgcagtatctgttgtaatgtctcctttttcatttctgattttatttggaccttctttttttgtaattagtctgactaaagatctgtcaattttttaaatattttcataaaaccaatttttgttttcttgatcttttgcattattttatttgtttccctttcatttatttctcctctgatctttattatttcttttcttccaccaaccttaggtttgatttgctcttgcttttctagttttttaagatgcatttttaggttgttgatttgaagtttttcttctttttttatgtagatacttaaatagctataaatttccctcttagtactgcttttgctgtatttcataagtttgggtatgttgtgtctccattatttgtttcaagaaattttcagtttctttattagtctcttcattgacccactggtcattcaggagcatactgtttaacttccatgtgtttgtatagtttccaaaatttatcttgttactgatttctagttttattccactgtggtcagagaagacaagtgttattatttcagttttgtttttgtttttgtttttgtttttgtttttgttttgagacagagtctagctctgtcatccaggctggagtgcagtggcacgatcttggcccactgcagcctccatctcctggactcaagcaattcttctgcctcagcctcccaaatagctgggactgcaggcatgtgccaccatgcttagctaatttttgtatttttagtatagatggagtttcaccatattggccaggctggtctcaaactcctgaccgcccaggaacaagtgatccgcccacctcagcctcccaaagtgctgggattacaggcttgagccaccactcctgggctatttaagtttgtttgtttttttttttttaatgttttaagccttgttttgtggcctaacatgtggtctgtctctgacaatgatccatgtgctgaggagaagaatatgtattctgtagccattggatgaaatgttctgtaaatatctgttaggttcatttggtctatggtgaagattaagcccaatgtttctttgttgattttctgtctggaagatctatccaatgctgaaagtgggatgttgaggtctccagctattattttactggggtctagctatctctttagctgtaataatatttgccttatatgtctggatgctccagtgttgggtgcatatatgtttataattgttacatcctcttgctgaattaaccccttatcattatataatgacctgcttttttttttcctatggtttttgtcttgaaattttatttatttatttatttttttaagacagagtctcactctgtcacccaggctggagtatggagtacagtggtaggatcttggctcactgcagcctccgcctcgtgggttcaagtgattctcctgcttcagcctcccaagtagcttggattacaggcatgcgccaccacacctggctaatttttgtatttttagtagagacggggtttcgccatgttggccaggctggtctcgaactcctgacctcaggtaatccacccacttagacctcccaaactgctaggattacaggcataagccaccacacctggccaaagtctattatttctgatataagtatagctactcttgctgttttttgttttccatttgcatctttttcaatgtttttgttttcagtctgtgtttctttataggtgaagtgtatttcttgtaggtaacagatcattggatcttgtttttttatccattcagccacactatgtcttttgcttggagagtttagtccatttacattgaacattattattgataagtaatgatttactcttgtcattttgttatttgttttctggttattttttggtcttctcttcctacttttctttcttctgttttgttgttgttgttgttgttgttgttgttgttgttgttttagtgaaggtgattttctctggtggtatgttttgatttcttgctttttatttttttttttgtatctgttgtatgtttttaaatttgaggttaccctgaagcttgcagataatatcttataacccattatttaaaactgatgacaacttaggaatgattgcataaacaagcaaagagaaaactaataaaagccctatacttcaactttgtgtccctgctgtttaactttttgttgtttctatttatgtcttattgtactgtctatatcttgaaaagtcgtacatattatttttgatctgttcatctttttgtctttctgtttaagtatgagtagtttacacaaaacaattacagttttataatattctgtgtatttctgtgtacttactattaccagtgatttttgtaccttcagatcattttttattgcttactaatgttttctttccaattgaagaactcccttgattatcccttgtaggacaggtctggttttgattaaatccctcagcttttgtctaggaaagtctttgtttcttctttacttttgaaggatatttttgccagatccgcacttttaatgtgtcatgccactcgctcctggcctgtaaggtttcctgaaaagtctgctgctagacgtattggagctccattgtatattatttgtttatttttttcttgctgcttttaggattctttctttatccttcacctttgggaatttgattattaaatgccttgagatagtcttctttgggttaaatctgcttggtgttctctgttcctcttgtacttgaatattgatatttttcgctaggtttgggaagttctctgttattatccctttgaacaaactctatccctgtctctctaccttctctttaaggccagtagctcatagatttacccttttaaagctattttctagatcttgtaggcatgcttcattctttttaattctcttatcttttgtctcctctgtgcattttcaaataacctgtcttcaggttcactaattcattgtgcttgatcagttctactattaagagactgatccagtcttcagtatgtcgattgcatttttcagctccagaatttctgcttgattctttttaactatttcactgccttcattttatttatctgataggattctgaattccttctctgtgttatcttgagtttctttgtttcctcaaaacagctacttttgaattctctgtctgaaatgtcacatatctgtgtctcagggattggcccttggtcccttatttagtttggtgaagtcatgttttcctgtatggtcttgatgtttgtggatgttcattggtaccagggcattaaagagttaggtgtttctttcttttctttttttgagacggagtcttgttctgtctccaggctggagtgcagtggcatgatctcagctcactgcaacttctgccttccaggttcaggcgaatctcctgccacagccacccaagtagctgggactacaggcgcgtgccaccacgcccagctaatttttgtatttttagtaaagacggggtttcaccatgttggccaggatggtctcaatctcttgaccacatgttccacccgcctcggcctcccaaaatgctgggattacaggcgtgagccaccatgccctgccaagagttaggtattccttacagtctttgcattctgggcttgcttgtacccatccttcttgggacagctttctgagtattcaaagggacttcagtgttgtgatctaagtttttggtcactgcagccatgtcttcattaggggataccccaagctcagtaacactgtagttcttgcagactcatagaggtactgccttggtggtcttggataagatccagaagaattctctggactatccagcagagactcttattctttaccttcctgtctcccaaacaaatagagtcagtcagcctctctctctctctctctctgtgctgagctgcctggagctggggggaggggtgacacaagcacccctgtggccatcatctctgagactgtgctgtgtcagacctgagccagcacagtactgggtcttgcccaaggcccactgtaaccactacctgcctaccatctttgttcattcaaggccctagggctctacagtcagcaggtggtgaagccagctggtcttatgtccttgccttcagggtggcaagtggccccgggcaaatccagagatgttgtccaggagtcagtgcctggaatcgggatctttagaactctactgggtactctactgtggctaagcaggcaccaaaatcacaaacaaagtcctttccactgttccctccccttccttaggcaaaggactctctccccttgtccaccaccaccacaggcctatggagagtactatcatggtaccactgatgatcacttaaggcccagtggctcttcagttagcttgttgtgaatgctgccaggcatgggacttccttcagggcagtgggcttcctcctctctgacccagggtaggttcagagatgccatccaagagccaaggcctggaatcggggactccaagatcccacttggtgctattccccactgtggccaagctggtacctaagctgcaaggcaaagtcccctttattcttccctctgcttttctcaagcagaaggggtctcttctcatagccatcacagctgtgaatatgctgggtcacacatgaagccatcatgtctcagagtctcacctaaggcccatggcatatactacttggctaccactgctaggacccaagggctctttaatcagcaggtgatgaatcctgccaggactgggtccttcccttgaaggcagcaggttctcttctagcccaggatgtgtccataaatgtcatccaacagctaggtcctagtatggggacctcataagtcctcccagtgccttattcttctgtgactgagtgggtattcaatttgcaaaacaaagtcctctttattcttccccttctctccgcaagcagaaggagggggtctcttttggagctgtgagctgtgctgcctgggattaggggaggggtagcacaagcactcccttcgccaccctagctggttttcactaggtcatgtgacccctccaagtctacaagctctgagcccagcacagcactaggacttgcctagtgctgcagttgcagtctttgtggcctaaacagcctttcaagtttgtttaggactccagagcactaaatttagcccgtagtgacaagacttgccaaaactcaacttccaactgctagagtggatacttcccctctggctagggctggtctaaatgctccctccaagggcactggcagagttctacttggtgctggccacactgagttccaatgcaaagtcccagaatggctgagctctccttcccccaagcatacagattctctctccgcaccatgtggccactgcctggagatgagggaagggtggtgttggcatttcaagactgtctttgctatcctcttcagtgcctctgtcagcgatatgaagttaaaaccaggtactgtgattgctcaccggatttttggttcgtatgaaggtacttttttatatggttgctgttgtgtaatcaggaggaccagggagagaccttggggtgtatacaggagggtatctttattattgagtgcactcagacccagcagactcaacgtctaaagactgggcgcagaacaaagacagtacttggcttttatacacacttcacaaaagggggtgggctagcttgaagcaagcttacagtggtgtgaaagcagggatacagaggcaggacaaagacagttaatcaaattgtaacaagttcataactcaggattgcacatgaccatcgctgtgcaacccagatgcccattatctagattttgctctaaagagccttgcactggtttatctcgtaaccttcactatggtgcctaggcagctgtagttcaggcctgcttaggcttctcatgacctttgatgtacttcttagacaaaacagaattcttgaagttactagttacagagaacaggaatctataaaatctataaacttataccataaaacaaaggaaaatttgtttttcttctccctatgttgaaggagtgctgggagagtctacagagcacattagataatattattaagacttttcctgggtctgggctgtgcctgttgctgcctctgggacaagtcagcctaatacaggaaagcttatttctctttaattttatttttctttaatttcccgcctcagttgccaactttgaagttcctgtggtgaggacagttggtggaagcttctattccgtctctcttgctccacccctacccgctgcatcacttttttatttacacaatggatatttgcattttctttttattctatttgttgataacctctagctaaagactacgaggaacgcacctatagttgaacaaagctgagcgtctgacctgttgcggtgagggggaatgcataccatgggcaaccacgaggcatctcagtaaatggctatttaggaaggacttataggatttgggcttgttttaggggattgggagaaggattcaaggaaacagagctttttggtaattagtattggatgttgtcaggaagcaggagtaattctgtttcagtacctgaaaagttcttatctaggaggtggtaagaatggaagtgaagctaaagttgtaactggtaaaacagcagcagtcactcctattagccaggataagggaatgcttggccattcttgtggtttagacaatattcatggttttgtctgtgttcagatgtggttacaaggggtctcattttttttttctttatcagggtcacagagtggccatttctgagactggcattccatggaattgttgatgtttaacagaacaccagggcattacctgatagtgccaggtcagctcctggataccagggacggcttttctctttctcagaatcattcccagattcagattgtttcaaatttcttttattctgttttgagacagggtcttgctctatcacctaggctagagtgcagtggcacaaccacagctcattgctgccttgacctcctaggctcaattgatcctcccacctcagcctcccgagtagctaggactacaggcatgcaccaccccacccggttaattttttaatttttgtagagacagggtctcactgtgttgtccagactggtcttgaacccctaggcttgagcagtcctctcaccttggcctcccaaagtgttgggattataggcgtgagccaccacgcctggtccagattgtttctattttagaaaggtctgtcttgttactactattccattgtttctgccccacatcttgatttaacagatttttaagatggagccactaactgcaaactttgtactgtctgcccttgtaggaaaacaggaaatggtgccttcctgcatggcatgaaaagatagcagtaaggtgttactttcattatgtcacttcccctttttaggaactgttatcagtgaaccacatcccaaatgacgacagttatttctcttccagctttcagggacctatccactgaatctttgaacatcttcagtgactctgatcttgctcctttctctcacttttatttttcacttcttactaccacgcaaatgctgccttatttattcatacctccactgagggagtcttctaggtatattacagataacagtaaataattgtaattattattagtgaattgaacatcccagattaacttctcatttcccaattagcttttaaaatgaactgcttaagaatagaagaaaaaattaaaactcactataaaatttcaccagccaacctgggtgacagagcaagaccctgtcatccaaaaaatatattgtatttaaagacaaatgtcagccaggcacggtggctcacgcctgtaatcccagcacttagggaggcccaggtgggcggatcataaggtcaggaattcgagaccagcctggccaatatggtgaaaccccgtctctactaaaatacaaaaattagccgggcttggtggtgcgcacctgtagtcccagctactcaggaggcagaggcagaagaatctcttgaacccgggaggtggagtttgcagtgagccaagatcgtgcctctgcactccagcctgggtgacagtgagactccgtctcaaaaaaaataaagacaaagatttgcgattagctttgtttccacttcattaatcataatatatattattttatgaataaatatctgtacttacatacagatagatgtgtacgtgtgtgtgtgggttgttttttttttccgggttttttttttttttcctgtttttttttgttttgtttcaaggcacagttgttcacactgttgcccaggctagagtgcagtggtgccattatagctcattcacaatccaaaatcctgggctcaaaccatccgactgcctcagcctccgaggtagctaggactacaggagcatgccactatgcccagctaattttttatttttttgtagagatgaggtcttgctaggttgcacagactggtctgaaactactggccttaagcaatcctcccacctcaacttcctgagttgctgggactagaggggtgagccaccatgcctacctgcttgtttactaggtctacatttgaaaaataattctcctggtccgaatgtaatgagttatctcaattgattatttacagtcagttacagatcggactctttgttctattcttttccctgttctcactactgcacttgactagtcttaaaaaaaaataaaatgaataattaataattgttacataaacatttaagaaatatacctttaatgtgcataccttctaatatcactgagattatgaagcagaattttgtttatattcagtgaagcagttttaattgtatttttcagagccatagactacaatatgtcttggtgagctttctcacaagtgtcagttggtcacttggaataagaaggaaaataagctcagaatacatgattgttaatatgagacacaaagtataattttaatgttttaatatctcaaatataattaggaatgataattcatcataaaagtaatatatgctcattatgaatttagaaagctgtaaaaaaaaaaaaaagctgggcgtagtggctcatgcctataatcccagctactcaggaggctaaggcaggaggatcacttcaggctagcagttcaagaccagtctgggaaacataacaagactctgtctcgccaggcgtggtggctcacacctgtaatcccagcactttgggaggccgaggtgggcggatcacctgaggtcacgagttcgagaccagcctggccaacatggtgaaactccgtctctactaaaaatagaaaaattagccaggcatggtggtgtgtgcctgtaatcccagctactcaggaggctgaggcagggagaattgcctgaacctgggaggtggaggttgcagtgagtcgagattgcgccactgcattccagcctgggtgacagagcgagagtctgcctcaaaaaaaaaaaaaaaaactgtctctaaaaaaatgaaataaaataatagaaggcactaaaaggtacagtacaagtaaaaattactccttgtgctaccattaataaacaaccactggttacattttggtgtggttttttgagacggggtctggctctgttgcagaggctggagtgtggtggcacattctcggttcattacaacctccgcctcccaggctcaagcaagccaccctcccacctcagtctcctgagtagctgcgactacaggtgcctgccactgccccaggctaatgtttgtaatttttgtagagatgaggtttcactgtgttgcctaggctggtctcgaactcctgcactcaagcgatccacctgcctcagcctcccaaagtgctatgattacaggtgtaagccaccgcacctggccctggtgttttctttattgtctcttttatatgcatgttttcgcatctttaggaccacactgtgtttatgatttaatattcttgcttttccacttaaaacagtggcaaaagcatttctcatcacactggttcttttctaggttttagacctaatattcaaatttcttaaagcattttattcataaaataacaatagctacagttttccaggaaaaagtatattgtgctgactagtgaatgtttttaacaaatacggtgaattttttctttgatctaagacaagacaactttaagaagcaaaatgagaaagtagattgtaggaaagcagggaatggtgtcctgtggtgctaagaatttgatttgtcttatcccaactatatttttctcccatcttgaactccaaaatccatttttcagttaagctgaaggaatctgttgttgaaaatcatgcagtgttaagttatgctgtggaggaagaacatgcatatttgggtccaactgtgaagccagatgataaggttagtaatgtcttaatgttcactcgatttttagagctgtttggcttcgtattctcttttgtttagtttacagaagctatgttataacattaaagtcagtgctttctgagatctgcttttagtgaagtggatcaatgatgaaactagccaaatctgagcatcagaagtctttccagtctacctgatgcatgatctctacagttctgagaagcaaaactataaaacaatgtaaaacaataagggcatatgtctggtgtgtgtgtgtgtgtgtgtgtgtgtgtgtgtgtgtacgcacatgtgtttataaagataacagctgtaggaatgaatgagattgagggtgggggggtgcgtatgtatgtctatgaaagcctaatcatttctgggcaatgatgaaaaggttttactactgatctttgtaactatgatggtttctacacttgacctgagctcagaagtgacaactgctggggttggtgatttggggttttcttacatactacttgctacattgtggtatgatattccccttaatttctaggctaaaacactgtcttatgaaccattatcttcagcaactgtttccactgggagccttttaagttatgaaaacacagatttgagccttacagatccaggtaataaggtcaaaatgtttataaataagttgaaagaccggcaccagttgagttgcaatacagtgatggaaggaagcattgggttttcatgatacaccatggggaactatttctctaaatctcacaagtaaagtatggccaggcgtggtgcctcacgcctgtaatcccagcaccttgaggtgggaggatcgcttgagcccaaaagtttgagaccatcctgggcaacgtggtagaaccctatctctacaaaaaaatacaaaagttagccaggtgtggtggtaagtgcctgtagtcccagctactcaggaggctgaggtgaggggatcgcttgagcctgggaggtcaaggctgcaatgagccacaatcacgccactgcactccagcctgagcaacatagtgaaaccctgtctcaaaaaaaaaaaaagtaaaatattcacacccagcaaaacattggcgcatatggtattctaaatattactggaagtaacagggatgctctgtagatccccaacaatacttttgagaagcagttgctgatatatttttccattcagtggaaacctatccgagcaaatttcatggttgcactgatctcttaacaatatgtattaccatgcttctccactaaaatatgtctgtaaggaagtacccagtacagtatgtctgtaaggaatattccattaaaaggaatatagtgtcgctgtcaattacatttttttttcttttgagatggagtcttgctctgttgccaggctggagtgcaatggtgcaatctcggctctcccgagtagctgggactacaggtgtgcgccaccacgcccagctgatttttgtatttttagtagagatggggtttcaccatgttggcgagatggtctccatctcttgacctcgtgatccacccacctcggcctcccaaagtgctggtattacaggcgtgagccatcacgcctggcctatttacatattttcattaaactcaattttcagagtcattttcagagcacatggatgatagcaagcaagaatctaccaccagtaaagaagaggaaacaaatattataagttccatagttccttcaacacaagatatttatcagcggcagaactcttcagacgttcataaatctctgttgcctgcagtggatgaaactacatgtggtcacacacactttcagcaaatgatagacaagtacattaatgaagcaaatttgatacctgaaaaaacagatttgcaaggtaaaattattttaaagcaatacttttatgtaaattaagttttaaattttcacctttcatcattttaaattttatgcagtgattgtttgagcttcatgttcttatggcctgctacaacaccgttttaccacagaatatattgagggcatttagtgagaaaggggatctggaaccaattagactcactgaggcacatttataggagattaattagcaaatcttcctttgccattgcagagttagctattacggctgaggcggtattactgataaataagagcaggagctcagaaatcatacagttctggatttgagtcatagcctgaccatttcctagctgtaaaaccatgggcaagttactttttaatcttttataaaagaggaatattatagattaaatgagatagtgcacataaagcacaatgtctggcccatagtaacactgaatacagtgagcctttttccttttttaagcttatactgaagcagtggttacatatgtcctgttgatcctcattagcctcataaggctgtggaaatggaaattcgtatttgtcaaaagtttgttcatacctgtaatcgtagcactttgggaggctgaggcaggaggattgcttgagcccaggatttcaagaccagcctgggcaacactgagaccccatctctattttaaaaaaaaattttttaaatttaaaaaaattaaatttctctaaaaataaaacttaaaaagttttggtcactgagaggatccatattttggacctttgaaataatcatgataggacttaactttaaagcatctgctgatcatgggggaaaaactgaagtttttgttacactggagttacctgaaaataagcgtttatgaatatgttcttaatactccttttctagtgtttaccttaaaaataaatttatgatttttttccctcaaaaattctaacagttgaccttgactttccagaattggaacacatttttcctaatttgcatcatcagctgtttaaacccttagaaccacatccagattttgacttatcatcatcatcctctgggatttctccagacaacagagacttttaccaggtatattaaagtagatgtcccattgcagtgaatatctaaaaatagttttaagccatttcttctactggaacaaaagttcttctaaacccttacctagaatcacatggaagtctgggcacagtggctcacacctgtaatcccagcactttgagagcccaaggcgggcagattacttgaggccaagagttcgagaccagcctggccaacatggcaaaaccctgtctctactgaaaatacaaaaattagccaggtgtcgtggtgcgcacctgtagtcccagctactcgggaggctgaggtgggaggaccacttgagcccaggaggtggaggctgcagtgagctgagatcgtgccactacactccagtctgggtgacagagccagaccctgtctttaaaaaaagaaacaaacaaacaaacaaaaagaatcacatggaaaacttaaataaaaaataaaaataaatcctattgtccagactacaccctagaccaattaaagcagagtttctgggagtgctcagatagtactaattattattattattttttaagctccccaagtgattctaatgtggaaccaactttgaaaacagctgcattgggccgggtgcggtggctcatgcctgtaatcccagcactttgggagtctgaggcaggtggattgcttgaggccaggagtttgagatcagcctggccaacatggtgaaatcccatctctactaaaaaacacaaaaattagttgggtgtgatggcatgcctgtagtcccagctactcgggaggctgagaaccgcttgaacctgggaggcagaggttgcagtgagccgagatcgtgccactgcactccagcctggacaacatagtgagaccccatctcaaaaaaaaaaaaaggaaaacagctacattagaattttgtttgtcccatccacctgtctccacctagggagtatgatgccataaaaggcttaataacaacttttagttgtggaacatatttaaacagtaaagtaaatacaattttgcaaaatttaaagtatcctcctacacagtcaaaggagctgagatttaaacctgagtctttttgcttccacttcctgatggcctgacattttaaagtctctttcatattgattgaaaagaactggatttgaaaaagcaaatcattgctgtcatagtgaagtgataattaaggaagagtaataccaaaggaacacaatgattattgtttcaattgttaatacctaatcagtatttcagcctttcccttttgtttcctgccagagatcagattcttcatctgaaagccactgtgctactggattatccaaaagtacagtttatttcacagcactgaggaggaccagcatgcattcttctcttaacacaagtccgaatcaacaacctgacactaacttggctcatgttggagctcacagttttgctacagaaaatattattgggggtatgtatgactaagttagaaaaagttaatttttccatgattttttacatccatttccttagaaattaagcctagcacctcttggtttgtcttcacccctgctctcacccctatcctgggtgttaaaaaatatttaaattacagaagtaatacatgcatttttttaaacaatactgaacattatgaaataaaaggaaaagtgttgcctcttgttcctcaatttccctacctcaatcattatgtgatagttaacagtttaagtattatttttttgtttgttttttttgtttttgtttttgtttttattttgtttttgaagactgagtttcactcttgttgcccaggctggagtgcagtggtgcaatcttggctcactgcaacctccgcctgctgggttcaagtgattctcctgcctcactcagcctcccaagtagctgggattacaggcatgtgccaccacacccagctaattttctatttttagtatagacagggtttcactatgttggtcaggctggtctagaactcccgacctcagatgatccactcgtcttggcctcccaaagtgctgggattacaggtgtgagccaccatgcccagccagtttaagtattcttcttaggccaagtatagtggctcacgcctgtaatcctagcactttgggaagctgcggcaggaggatccctggagcccaggagttcaagaccagcctgggcaacatagaaaacaagtattcttgagcctttggtacaaatgattatatatacacacaaacatacatgagatacacaaggatgtacaaattatatatacacacatggataattgagatacacatggatgctttattctcttttctgttattaaagtcatattcagttcttatagaggaaaacatcctcagtttatagccatattgtccttattaaatattaatagaaaaagaaaaaatacttggtgtgagctgtagtttgagaaatcactgtgaccatccttatctttgtattcatgtttatacacatcaacttttatgcctaaaattgtaggttacttgcaattggatgataaactattagagactgtcagtatccaacttttacaacatgtaacgatgattaactgatttttgaatttcttaatgcaggatctgaacaatgttttgaacagcttcagccagaatattcttcacaggaggagagccagcatgctgatctaccaagtatttttagcattgaagcaagagattcttcccaaggcatgaaaaatcagaactatccctctgaagaacatactgaaatattacaaaacaagaaaaaaattgttcatttccagctttctataggaaacttaagttcagtctacagttcatctgatgaagctaatgtatttgatcagttaaatgtacagcatagcactccatgtggttctaactctagtgagtgctcaacaaaacaccaactagaaagcagaaaggaaagtatgggctttgaagaactatcaaaaagaggggttgttacaatgttacaaagtcaaggactcattgaagataataaaaatgaaacctgtagggttttagacataaatccacaggtagaggaaactgactctcgattatgtgtaagaacagtggagatgggaacttcaattcaggcaccatattccttaactactcaaaatgaaaaatattttgagaattcagctgaaacagacattccaaaaatcaccaaaaaactatctcaactaggagaatcagagctttttgcaagttctggatcattttcattacagagctctataccagtctgggtaagtgaaatcagtgttgtataaataacatttaaattcctttttgggaaaaaacttttttcttctaaaattagagatgaagttcccactatgctacccaggctgaactcaaactcctaggatcaagggatcctcctgcctcaacttccgaagtagtttggacacaccacaatgcctggcaggaaaaacctgaaacaaaatacaagcaaaactgcttgttaatattgctatccagcttgtgatcactagaaatatccagcataatgcagaaacttaaaaatttgaaaactgtcttctgagagtattttacaaaagatcctttttctcccaattcagatatcctttctccaacttccctgaaaaatggtggttctgcctgtgcttcagcactttcagtgttgagcctcattccagtgcaatgaattcatccattattggaataagtattggaaacctgctcctcatattaagcaacttataatctgcttgctttcaacaccagtcaactggtgactggttttcatctagcagtatgtgcagtttatccttccacaaataaacataacagattgaaaataagaattacaactaaaccacgttttatgtggctgcttttgttcttgttgtgtttagatacttttgaaacattatctgttagcagtcagtggcccacatttggtagcagcccagtcgacccctgctccctttaaaggatacaattcggcacagccaacctgcatttatattttttgcccaacactacaagcatttaggtttgtaatcattgtggtagatacctttcagtccattgtcacactatttcatcccctccccaaagtaggctccagtatttctacaactgaatgctggagttatggaagcctaaggaaatctgatctgttggtctttgccaatcattgcttttcttcctccattttcacatttatatacacttgcaaaaaatgtgcattatatacaaaacgattagtttaagtcttttaaggctattttgacatggttttccttttaattgtggttcacaggaaacagaaactggccatggtataatggaagaaccagaacttactttaataagcaccactgataccagtattgctgaaatggattttgcaaatttaaccctagaagagaagagcgagaatgaagcaaaatgcttctttcaggtaaatttaagctttccttctattttattctattacaagcaaaccagttgatttgtctcttacaacttatcagaaggtactcattggagggaattatgctatgcatttaactaagccgacacccccaccagctctcaatttgtcttaaaccttcactattctgtcaaccattgtgcattttcttttaatccccactccaatttatgcctgtctccaagactggcagaactaatcttatacacctagtgttatagtgccaagttggaagttttacctaaacttattcccagatattgaaaaatgacttcagaacaactggtaattttactaggggagtagggaggcaataagaataaagctatctaaacagaggcctagaggtgtgagggcagtggagcctaagcccagttcaagaccagcctgggcaacaaggcaaaacccaatccctacaaaaaatacaaaaatcaggcatggtggcgggtctctgtagacccagctaagattgaggctgcagtgaggtgtgatcatgccgctgcactctaatctgacagcagagcaagacccgcttaaagcgtttaaaaagagtaaaacatgcaactttcttgccattaggtgagtgagtttctgcctcttgtatcagcaacagaagcctcagattatccagctgtatcagaactttccatagaaaaaccaaggacagcatctacaggtaagccttggacggcctccacacttctaatggaaagtagatactttgcctatttctgtcataaatttcttttcccccagcagaaacccctcgcaggcttacacctgtaccagggagcttacaagaagcatttataaagaggaaaaaatcatttatggagagatcccaccagaggcagaaagaaataaggaataaaattcatgtctctgaaaattctcaaatcaaaacagttaaagagaaaccatctataagtatgttgaatttttaaaatcttcaaccaactccctgaaatgtttaaagccttgtgtttacaacttgatttcacttttctttcctcaggttcatctgtgagtcgtctaaagggcgtgaataaagtcagagcatcttttcctgaagacagaaagactacacaggctctaaggcaccaaaggggtctaaggtagggttaattttttttttttttttagtgattcactttttgcagtgtttgtctctaattctatataaattctttacaggttatacaatcaactagctgaagtgaaacaacaaaaggaagaaaaaacaaaacaagaagcttatgcccaaaacagagcaagggcaaaagaattccataaggtgagtataactgagggagaaggacttaatttttcaagcatgaagtacacaactgaaactcaaatttttattccttccacagaaaacactagagaaacttcgagccaaaaatacatgctgactttctagaaatagtgtaaaggttttttaattgtgtatatgtagcattagacaaaattatttaaagtcaataaattgttattcgagg

SEQ ID NO: 652 - DNA, 121861 bp, Homo sapiens
tgggggcgtcctccttcgtccccgcccggctgtcaagctgtgttctagcggccgagggaccgaggggggctaagaaagggggcgcccagccatgcagaggcaaaaaggcgctgcggaacggggtccccgtcgccagtgctgaggcaggaggtcggagccacaagtgaggggctgggaagcaggacccagcacgggcgtcttggcaggcggccgggcgcagggccaggctgctggggacgctcagggctttccacccaagccatgggcgctgtcgggcactcgggggtcccctcgtggctccggccactcggcgtgggcattacgttggcttcacatcgccatccagcctcgaagccaacaggactgaaaaatagcttcggccaaacgttctcctcccgctaaggagaggggtcgagtgcgtcagcccgaggggactggagagggatgccctagccctcgaggggcggaggacccgcggttgaaggaggcagcgggagcggagagcgccctccttgaccatcgaatgcctccttctgtgtttccattcctgtcgagtgggctgggccacgctgaccaccctggaggagggacggacgacgctcggcgggctctgaccgtgccgccttcttgtggctgctgactgggatccaggagggagtgggcatggggcgcagccgcgcctccctccctccccgcctcccgggcgccggggttggcgatgtggagacgtgaggggacccgtcggctgctccggcttctccaggactccgccaggcgcccgcgcgtccctcctcacccggaggaggagaggctccgcgcggggctccgaggcgggcggcgcgcggagccggagtcccagcctcgccatgggacataacgggagctggatctctccaaatgccagcgagccgcacaacgcgtccggcgccgaggctgcgggtgtgaaccgcagcgcgctcggggagttcggcgaggcgcagctgtaccgccagttcaccaccaccgtgcaggtcgtcatcttcataggctcgctgctcggtaagcctcccgcggggcgcctccggaccgggcctccccgagggtacaggctcggagagccgggagcagggccgcccagccgccgtgggtttcgggtgcctggcaaagtgcagagagttgaaggaagcttaaggatcccgggtagctgcagtgtagttaagcagggacggtggactccagcccccacgcgggagcagaagagttcaaatagggctttctcgtggcccgaggatggagcgggatccaggcgggagtccccctcctcagatggccccggcggaatgctcctgggtgcccggctggcttcagctcttgtttacaaatagcgaggaataaagattctgtgggaatttgttactgataattgaacggaatgttacccattctgttaaagatgttttgcgatcccatctttccatatatatctcgaaataataatatatacaattattttgatagacccttattttgtgcgtgttttactgcgtgcttcttcggaacaccaacctgctggtaaacaaccctgtgaagttaaactgtatgtcgcctgtcgattatttaaaaaaaacaaaaccaaacccactctacttccccatctatgtgttgtttaaggtacagaataaaggtaggataaaacacacacacacacatcccagatttaggtatacttgttcagggaagaaaagatcaacgaattaaaatgagtggctagtaaaatattagcctactagtgtgagaattacctgtacttctcactactcttaaatgataatagtctttatcgctcctcttcaaacgttaaatgatacaagcaatattcatttctattaaggtctgttgaacatactgcataccacttggatatatgtggcttcctttcctgtgtccccgatatggcgtttataaggatgtggtgttattggcaagaacagtcgtaaagtttcaaagtaggaataggttactttttgtagacacttgtgaatttctatggaaaccaagataactgacatttaatagactatttttagaagaatttcagatgtttggaatttcccttcatactttctctaattgtcatcattccattttactctatcatagtatttctcttcgatttttttgttacgaggatattttcaggagtagatactactattgctatatctaggggtgtgtgtgtgtgtgtgtgttttaagatgtgtttttatgactgggatgttaaatgcacattagcaaagcaaaagcctatgttcaaaatactttaggtattcatgatgcattgtaggttattgggagttaaattctgagtattgtcacacttaaagtgtgggttattggagaggtagtagaagtgactgtatttttatttctgcaggttttcccccaatatacatatatatacatacattcatacatacatgtatatatatttttccctcccccacggataactttaactctgaagaaaggtggtgttgggaggagaaattctgagaaattttctcatggtttgagtctaaaaatttgagtactattgaagtagaagacaggacatgtatgtaaaagacatagcaaatcgtaaacatttaatgaatgttacttctgttatccatgtcctttccatttttgtagcttgcattggattcaggaatttctagataaatctgtccttatttcagcttttctccacatagcacttgtgagtgacatgcaaaaccttctttagtagatgtctccaaaggacaaactgatttcctcttgatctatggtgcctgatgagctaaggagtcttttttttttttttttttttagacagagtttcactcttgttgcccaggctggagtgcaatggcatgatctccgctcactgcaacctctgcctcctgggttcaagtgattctcctgcctcagccccctgagtagctgggattacaggcacccaccaccacgcctggctaatttttgtatttttagtagagacggggtttcaccatgttggccaagctggtctcgaactcttgacctcatgatgcacctgccttggcctcccaaagtgctgggattacaggctgagccactatgcccggctgggagtcttctattaccccttccacgttacatggaccctcctaaaagagaattcaatttgctcctttttatatgcagaaaaaaacccataaatatggacagtatgtctggtttccttaaaagttcagctgggcttggcgtggtggctcacacctgtaatcccaacactttgggaggccgaggtgggcagatcgcttgagatcaggagtttgagaccagcctggccaacatgatgaaatcccgactgtactaaaaatacaaaaattagctgcatgtggtggcatgcacgtgtaatcccagccactcgggaggctgaggcaggagaatcgctagaacccgggagacttaggttgcagtgagctgggatttcactgctgcactccagcctgggcaacagagtggagtctccaaaaaaaaaaaaaaaagttcaatcacaacattgccctgtatacctgttacttatttttattttttttttgagacggagtttcgctcttgttgcccaggctggagtgcaatggcaggatctcagctcagctcactgcaacctctgcctcccggcttcaagtgattctcctgcctcagcctcccaagtagctgggattacaggtgcccgccaccacgcctggctaagtttttgcatttttagtagagatggggtttcaccatgttggtcaggctggtctccaactcctgacctcaggtgatcaacccaccgcagcctcccgaagtgctgagatcacaggcatgagccatgatgccctgcctacgtactggtattcttgattcattgttttctaaggacttgtcccattcaaacacatctgtgtacattagaattctgataatgtctgttgaggctcagagcttaagtttcaaagccatgtgcagtcagaagcaaggcaagaaaacttgggaagcacatttcataaagcctccaaatagagaaaaatcatagattaggaataaaagaaaaggaatctgtatgattgaaaagtaaattgtgggaggatggaatagtacctggaaaaaataactgattaagtaacttacttttcttatttcttctgcccccaaacatagacaaattcgtttttctttatttttttctcttgaaacaaatttaaatatacttcttatattctctaaatagacttcttttttattgggatttccagaggaccattattatgtgaaaataattcatttgtactactggtgtcttgtacctctttttgaaaactgttttagtgtcttgtattaggaaaaatccctaagaacttggaataactgtaatattccaaccagaaggaacattatttgctgtgttgaaaatgaacacaaggcttgtacataatattattcaaataatatgtattttgggggtttgcgtaaaccagtgtttctcagccttctttatacaacatcttggcatatctttaggtatgttgtagatactgaaatagagtaaaataatttagattcctcttcaatggcaccaatcacttttagtagtcaagagtgtgaaatcaaagactccaaaagatctggaatcaccatttccaattgaactggaaatggtggattgaactcctcagagttaatatttctctttttccccttctccttagattcacagtctaagtaccaagagaactgggctcctctctggtgctttgacttgaaaaaggtaggtggctatgatctagcctattacctctgagctcctcctacacaggttgcctgtcatctgtggcaatcatcatcagaggtataagagatttttataaatgaatttgcttttatttaaagaaaattaacatggtgggcaataacccacaagtatgtatcctacattgcaatttattttttaattctttttgttttgagatggcgtctcactctgtcgctcaggctggcgtgcagtggcacaatcttggctcactgcaacctctgcctcctgggttcaagcaattccccctgcctcagcctcccaagtagctgggattacaggtgcctgccaccacgcccagctaatttttttttgtatttttagtagagacggggtttcaccaagttggccaggatggtcttgaactcctgacctcagatgatccatccgcctcaccctgccaaagttctgggattacaggagtgagccactgcgctcagctgatttttaacattttttaaatagagaaatcagctttcctttgtctggctagaccgcaaaatgtatggttcttattcttaagctatattccctttcctttatagactgaatgtttatattccccctcaaattcatatgttgaagccctaatccccaatgtcatgttattaggaggtagtacctttgggaaataattaggtttagatgaggtcatgaggatagagttctcaagatggaattagtaacattataagaaggaactagagagcttgccctctctttctttgcaccatgtgaggatatagcagaaggcagctgtttgcaaaccaggaagaaggccctccccagaacccaaccacgttagcactctgatctcagacttcctaacctctagaactgaaagaaatgtctatttttaaagccacccagcttttggtattttgttatagcagctggagcagactaatacacttatgaatggtctgtagtgagcatgtgaaattgatgaccccaagtaaagatccaacttgcctgtggcttgattccatgaggtggttattgaagtattcatttgaagggaaaggtgggaaatcgacttgttaaatctgttcagcagatctgttggatagacactagttttgctcatgcttgcttatagtctttgagcaaaatcatatggggtaccagcaaggttcatggtacttgtttgatagagaagtatacttgtgcttttgatattatttgaaattaaccagagaatagctggattattcttggagttccttagttaaatgtttgatagaagatgtgttaatactataatactagtttgcacttataatttgtaattactcaggatcatttttagttaacaatacttacagccaataataatataatatcaacagccttacttctacatggagtttctgtcttttgtatgcctaaaaacctagcagactacgttaagaataaggtatcctgggccaggtgtggtggctcatgcctgtaatcccagcactttgggaggccaaggcgggcagatcacttgaggtgttcgagaccagcctggccaacatggtgaaaccctgtctctagtaaaaaatacaaaaattagccgggcatggtggtaggcgcctataatctcagctattcaggaggctgaagcaggagaatggcttgaacccaggaggcagaggttgcagtgagcagagatcgtgccactgtactccagcctgggtgacagagtgagactccttctcaaaaaaaaaaaaaaaaaaaaaagaataagatatcctgaattgatgcctaaggaggcaggaggtggtaggatcaatagttactagcttaatatattgaatcaaattgcctcacattgtcttttatttctatatgatgtctatatgatagaattcttcctggaaattaaattctctggtgaaaatttaaaaaaagctttattgagataaaattcatacaatatagaatccatccaattaaagagtacaactcagtggtgttttttgtttgtttgtttgtttgttttttgagactgagtctcactctgttgtccaggctggagtgcggtggcgctatctcagctcactgcgaggtccgcctcccaggttcacgccattctcctgcctcagcctcccgagcagctgggactacaggcacccaccaccatgcccggctaatgttttgtatttttagtagagacagggtttcaccgtgttagccaggatggtcttgatctcctgaccttgtgatctgcctgccttggcctcccaaagtgctgggattacaggcgtgagccaccgcgcccggccaactcgatggttttttagcatattcacaaagtagtgcaaccactactactactgaattccagaaggtttttatcatcccataaagaaaccatgtaacctaaagaaaccatgtatccttcggtagtagcactgcctttttcccctcaataccttgagccctaggcaatcaccactcatttagtttctttccttctttctttcttttttcttttttttttttgagacagggtcttattctgtctcccaggctggagtacagtggtgcgatctcagttcactgcaacctccacttcccgggctcaagtgattctgcagcctcagccctctgaatagatgggactacaagtgtgtgccaccatgcccatctaatttttgtactttttgtagagatggagttttgccacattgcccaggctggtctcaaactcctggactcaagcaatccgtcaacctcagcttcccgaagtgctgggattataggtgttagcctccaggcctggccctactttctgtttctataaatttacctgttccatagatctgtcacacaatatgtggtcttttgtgactggcttttttcacttagcataatattttcaggattcatccatgttttagcatatattagcactttattttttattgctgaatcatatttcattgtatggatatattacattttgtttatccattcgtttgatagacatttgggttgtttctactttttggcaattatgaataatgctgctctgaatatttacgtacaagtttttatgtggacatgtgttttcagttctcttgagtatatacctaggagtgaaattgctatatcatatggtaactcttctttttaggaactgccagacagctccaaatatccctggttctgtaatgaatatacttttgttttatttggtgacattttgtagactaggaggaaatttgtctcaaaatgggaacaaagaaacatagctatgttttcctgtgggatgtccaagtctcaaagtctcttgtccctagagtttgccaaacaatttctgcatatgtcacttaatctaaatctaaataagccatttagattctgtagtgactgggaactgttgtgaaaggttgttttttccttttcttttcgtttttttttttttttgagacagggtctcactctgtcacccaggctggagtgaagtggtgcgatcacagctcgttgcagcctcaacctctcaggctcaggtgatccttctacctcggcctccaagtagctgggactacaggcgcatgccaccacacctggataattttttttttttcttggtagagatggggtttcaccatggtcctcaggctggtctggaattcctgggctcaagtgatccacccacctcagcctcccaaagtgctgggattacaggtgtgagccacttcacctagccatgaaaagttttattgtcagagagtttccacattagctgggtggaagattgttgttagtcatatagcgcaaaaacagaggcatttttgcctagcctggaaggtaggagtggctctaggcaaaattttgtagtaaggatttaccctaggcaaaactaaaaaataagaaaactttatcttaaaaaaatcaactctcattttcagtttttattgcatgtcttctcataaacctcgttttcttgttcattttggatgcccaatgaccttcttctgagttgctgacttgtcccctctcttccaaagttagcagtatctgtattccattccttcatggtggctaaataaatcatgttaaatgcagatgttaacagatgttagtgtattaaagtattttaaaatagtgatctttgaaggtacttttttttaaaagaagatatcttaagcataaaggatgatttgaacatttcatatatttgagaggtaagagagagaaatgggttggatggatcttttaagtttgattctactaaaattgtatcatgaagctagggattattgacaaaaggaaactaagtataaataaaacctcccttaacatactgtaaggcatgaccaaaactcaataagctaagcatgtagccctgaaccctctcagttatcactgtatcagtttttatagaaagcatcctcccactgcagcacatatggagacatttcttcatggcttctcttactgaaaacttttgaatgcccctgctcaaggaggaaatttgttgttgttactattgttttcttttgtttttgcatttgcaagcaatttccagagaaatgccttcaaactgacttgagcgatattttgatcagtggccacatttcattcggaagaatcatatacgaaacagttgtttctggcctgtactgaaaacttgcttcaccataaatgagatactgaaaaactttcagattaagccacaagtgtttaggtatgctggcactaaataagtttgtaacaatggtttattatcagttttggaattgtttatttattttttgctttttatatttttttctgattaaagttcctccttagggacaaaattacagagttaggggcaaagcatgaaacctgtccagactctctggtttactcactttttttcttttgcagagtttaaaaaatacagaaaaaaattaacaaattattataaatctaccactcagaaataacaaatgttaacattttgtcatgtttctttcatatattattttattttattttattttatttattttatttttttgatacagagtctcactcttgctcagactggagtgcagtggtacaaccttgactaactgcaacctctgcctcctggattcaaatgattctcctgcctcagtctcctgagtagctggtattacaggtgcatgccaccacgcctggctaatttttgtatttttagtagagatggggtttcaccatgttggccaggctggtcccgaactactgaccttaggtgatccgtctgccttggcctcccaaagtgctgggattacaggtgtgagccactgagcctggctgttttataaaaataaaatgttgcaggtacagttgaatctcccctattcctctcctcaaccttttctatcttgtctattccagagctagtcacggtgctgaatttggtgtacagtataaacttcttcctgtctttgtcctgttgtttctgcctgttgcttgcctgtgatcatgaagttggtatttttttttttctttttgagatgcggtttgctcttgttgcccaggctggagtagagtggcgtgatctcagctcactgcaacctccccctccaaggttcaagtgattctcctgcctcagccccaccaggcccagctaattttgtatttttagtagagatggggttttaccatgttggtcaggctggtcttaaactactgacttcaggtgatccaccagccttggcctcccaaagtgctgggattacaggcatgagccaccatgcccggctgaagtttttaccaattgataccgatgctttctgtgtaattaggtacctttgacttatctccaatgtggtaactcccaaccaagagtattgcattagccttacatttacacatttatagtttacaacatataccacattatttctttcagtcatcataataaccttgtgaaacaatgtagggagcattttctgttcttattttctcagcacatcccttcctcctagcaatattgctctcccacaacacgtgcacttccactggtgatattcccttcctgtattcatcagcgttcttagttgcagacaacagatcctcctgtcaaaagaagacacagctatgaaagcatttaaagaaaaatgtttccttgtgaaaatggattgcaagggagttcgggctttaaaaggactagcttgccaaatgaaatatacaacaggtaattaaaagaaaacctcaagattaccaaatttacagttattatgttggttgtgaaaaaaagctagttatttcatgagtgttataacctcaaagattgtatcatcccttcagatatcagcattaaaagagaaataactttgtgaaacaacaaagttgtttgtattggaaagcagtagcttaaagaaaaggctcaagttttcatttattttgagaaccagaactacatagaacggccttagtctttttaaatgtatgtctttgttttgggagagggaaggggttctggctgcaagtgttttgtttttcttctggctgtagggtgtaatgtgcacccacttgcataatgcagcaggacaaagcattagttttacttctgtatcaaactagccagtgtatgaagaaagaaatttattacaaagtattatgttgcttttagaatttatgagagggtctgggaaccaagcttagatgccacagagccagggacgcagtcaagaaatacgtacagtgatttcactgttcgagcagaaaccatgaagctgttgccatgtaccaactattacgtgaggaagtagtcacataaccctaggacacagctggtccagaagaaccagaggcatccatcatctccctgaccttacagagagaatctgatggctctgcatccagcccctaccccacattaatcacgtccactttccttgggaacatctgttgggcagaacctgtatcataagcctgcaccctcactgcaagcctgtctggaaagtggtgttttaaactttccagcctttgtagcagaaggtagcaggtggttgaaagattacagagggaatattgagtgaaccagactacagtatctgccactttatactttgtgtggttttttaaaatatgacttcccctcacagtactctgtatagccccactcccaccctgggatacaagggtgagcacatgattcaggctttactgatcccagtatcctatttctttgtccatgaggattagaccaggaatggtcataggatccaagcttgatcaatcaaatcaatcaacgtccttgatatagagatgttgctaaaggcgccatctttttccacaggggctgataagcagggattatagaagccaggagtatctgcttaggagagaatgaggatagagagagaagcagaggtgagggtgagatatagacacagggagtagggggagagaatgaatcctgatgatattgtttgtatccctggagggcctgagcctaattctaccccttgtgttttccaattacatgaacaaaaaaaagaaaaaaaaaaaaagaaaatctcctttattgcttaaacttgtttgagttgggtttctgtcacacaaatatcctgactgataacatatagtatttttgtactgttggcagataagtcagatgtacgattcatatcctacatttgcatgaacaagttcagggggttagtgactcatttaatagcacattctcacagccctgcagggcctgatgcaatggaaatcagatgcccagaagaacagcagctgcaatccagagcctggagaattgagcaggagctagggatggcctggcaactgaagagatgctcatagacactgaggaggatcataaagcctgccagtggaagaaggtgggaggagaaagtcatgcttaggctccaagagcccagggatgtaaagaaggctggaagctgtgggactggcaaaggttcatggatgtgcagaggcagaggtccaggggagattttactggaccaggaaatactggggcaactgtcccaaatcagcacacagcctctgattctttttgtctcttatttaaacatctattttttttaaattttgttttgtttttgtttttgagacagggtctcactctttcacctaggctggagtgcagtggcatgatctcggctcactgcaacctccgcctcctgggtttgagcagttcttctgcctcagcctcctgagtagctgggattacaggcatacgccaccatgcccggcctaaacatctatttttaatcaatagctttttatatataaatagtttctgatagttaattaacataaaaacctagtggcaagaaaaaaaatctagctgtgttagaaaagggaaatattggcactgttcgatgtagccccccagaagatgatgaactcaatagcctctaggtcataaaccggcttcagttttcctgaatgtttataagagcttctggggaagtcagcaggcagggagggctaagggtgagttctggaaacacagctcttgctacagtcaattatggggtgtggatgaaatactggacatatggcaggtgtatggttgggaaaatgagctgctccatgttttctggtttagatggctagtggccagctctcaggattgtcaaaacagaactctcctttgggggtgaaatgagtgtcctcagctgatccaagctcagggcttggagggcagagcgggagctttgttagcacaaagcccaggcatccaaatggagataagagtctgggctagatcacgtgggcattgtcaagttaaatagacaatgcaaaggcagaaggcaccgagcaagaggtgaaaggtggagaggagcaaagcagagagatcctgaacagcctctaaactatttttatgtttctttaactcatcaagcttaatacttgcaaagaccattgactttgctgttctctctgccttagaatgttctttcctagatgcgtcttatggctggcttgtatccatcctttaaattgcagctcaaatgtcacctctaacgggtcttccccaatcacttctatcacatcactctgtttatttcctctgtagcagttataactccagaaattatcttgtttgtgtggtgttctcccttgctccattagaatgcagcaccttgagaactgggactttatttcatgcactgctgtgtccccaatatttagaacagtgcctggtgcatagtttgtgctcaatacatagtgattaattgaatgaagtgcttggggacagttacataggatgattaattaatcactattttgatttgcatgagacttaggggccttgtgaaaataaacatgaatttcatccatagccaggattcaaacacacatggccatgcccagtgaactaaagtggtgcttacaaaagccagatatccggagggacaacaggtctcttgataggaaatccacaggggcagaaggtttcacctgatttaaataagaatgagcctatgacataagacaggcagcattttaaaccaggcagcataatgtgtgggggatgtccttatagcttttggagtctttgggtcttagacaggtcaaaagtatggccaaaagcagcctggggacatgacccttcctatggaagagtggccgagaggcagtgttgtcatcagggagctatacatgacatttggctgcctgtgctgacacacatggctattaggtgtgtaggatcagaatggcatccttgagtttctgtcaactgttaggggaccaccccttctacccatctatctggaaggctcagtagtaggagtggggttgtggaaaaagggctgaaaacaatagaatattttgactgcagccaaggaagcctgcaaaaattaggttgaaaaccatgctttttgcacaactaaatgccgtaggttttacaaataagtcaaagggtcttccgctgatagaatgtgtatcagtttaataaaggctggtcgtcactgttgcttccatttgtacacacaaaaccttcagcatctttttaaaaactgaactttttactttgagataattgtagattcacatacagttataaggaataataaatacagagagatgcctgtatcctttacccagtttcccccagtggtagcatcttgcaacaaacagtgcttgtgtgtgtgtagtttgtgtgtaaggtgggtacaatacaacaaccaggacattgccctcgaaatttccatcaccacaaggattccaactgttgcattgttatggccacacccatttccctcccacccgatcccctccttcacccttggcaaccactaacatgttctacatttccataattttgctaattcaagatcgttatagaaatggaatactgtggtatgtaaccttttgggattggttgtttttcatgcagtataattcttgggagattaatccaaattgttgtgtttgtcaacagtttgttcctttttatttcaattccatttatatgactttattttttctgacacagggtcttactgtcacccaggctggagtgcagtggcatgatcttggttcactgcagcaacttcttgtgatcaagcaatcctcccactgttatgtgccgccacatcagctaatttttaaagtttttttttttttttttttgtagagacgaggtctcactatattgcctaagctagtctcaaactccaagtttcaagtgctcctcctgccttagcctcccaaagtgctgggattacaggcgtgagccactgcacccagtctatatgacctttttgaatgaaagcatgacaaccctgtaacttttctggttattcttaagtcacaaaacactctcaatttagtacataatatttgttgtctgctgataaaagaggcaaaccaccaaccttgatttaaaataaagaattctctcctccacaaaatccctagtgcaggcctggtgcctgggagaagcctgaagttgaacacaggagtctagtctgcttcctcctccattctgagcttctggccaagtttgcttggctctccaagattgcagctgggctggggttggtggttgtaggggctggaggagggagttgtaggaggggcaggaataggcttacatgatgctgatggtgttgtgagtggcttcatactctgggctgttgcctgtttccttgatggtgatgatgccctctcatattctgtccttgctccctgcaaatgctgctctacttctagctcctctctgttgaagcctgtttacctgtgcaggtgactgtcttggacaagccctgacgtgaccccatgccattgctctcacaccctggtctatacccattatacaggacacatgcattctttgcccccataagttcggggagtgcaggctgcccactgtagcctcttctttgagcagcttatcagcccatctcttgctcttcaggtttctcaaacagaaaacaatcacaaattcacagtgaaccccaattgcaggggacacaaatcaaatgtctgcatgggcttgttgaaaacccctaaccaggcctgagggctttgatgagcacccccacccttccttcctgggtaagtaggactcacagtgcacccacagttctctatctattccattatatcctccaggttggtgaaggtttgagtcttatacctcttgactacacctgtgaaacatttacatcttgatctgatatcttactttatatctattatatcttgatgccttggtagaattttctgcttctgattatcaaaagcatgtgaaccagagcaactccatcttgaacagaagctgggtaaaataaggctgaaatctgccgggctgcattcccagacagttaaggaattctaacttataggatgagatgggaggtcagcacaagatacaggtcataaagaccttgctgataaaacaggttgcagtaaaaaagccagccaaaacccaccaaaaccaagatgacaacgagagtgacctctggccgtattcactgctacactcccaccagtgccatgacagtttacaaatgccatggcaacatcaggaagttaccatatgtggtctaaaaagggaaggcatgaataacccaccccttgtttagcatatcatcaagaaataaccataaaaatgggcaaccagcagcccttggggctgctctgtctatggagtagccatccttttattcttttattttcctaataaacttgctttcacttcaccctatgggattcgtcctgaattcttccttgcacgagacccaagaatcctctcttggggtctggattggacccctttcctgtaacacaatgaccagacactatgttaatttagaagcatttttccccctacttaaaattcatgatgcagttttgttcaaagtctccatatgcctcttcaacatcagcatctgctttggctggaagcagtttggagccatctcatacagttttttggaggcccatcatcattacttaaacctgtgtaagatgccacacttaaaaaaaaaaacctcacatatgatgtagccactgaaaatattatgctaagccacaagtaatcattctcatttttttaggactgtttttctttcttctccctgtttgtctggttgccattcacaaatgccatgacataataatatatggatttttaaagagagcttataaaacttacagttgtgaactcacacacccaggaatgatgaataatttgcttctttttaaaacgtactgcatcagatgacctctacaggaagcccaaagtagcatggacagagataatttcaggtcatcgtgccttctccaaacaaagttccaaataatttgttatttgtttcgaataaagtacagatgctccttgacttatgatgaggtgtcccagtaaatccattgtaagttgaaagtataagctgaaaatgcatttggtacacctaaactgccaaatatcatagcttagcctagactactttaaatgagctcagaacacttacattagccaacagttggagaaaatcatctaacacaaggcctattttataatgaagtgttgaatacctcatgtagtttattaaatactgtactgaaaatatattgcttttgcaccatggtaaagttgaaaaattgaaagtggaactctcataggttgggaccatctctaattgagagagtgccttgtattaggagtgactttgtattttctgagcaagaatttttgaggacatctctgccttgtatagaatatgtgatatttactccctggttccctgggcatcccttgtgtgctcatttgcacctttaattacaactactttttgttggggcttcctgtgtagtttcttagggcaagaaacactttcagaggctgctaaatgggaaggaaagaataactctctgaagtcaacctgagtgttaattcaatttccaggaacacagagttcaagcgagactccagcagagacaaaataatcaaatctcagttttcagaccctttcattgattgatgagaatagcaccttttgtatttgacctgttgtttctgtggcctgctcccaaggttgcaagtctttagtagcaatgaatctacaaatgaccagaagccttaagatgaagctttctgcgtctgccaggtgaaaggcaggattagggactagagggctaactgcctgtttctctgcaggatgctattattcttaagattggatggaacttttccctgaagagtgtcaaatcatttttcttgttaataacaaatcaatgggctctagcaggtaaggatcacaccaggtgcttgggaagggtaaattctagcctggccttgctgctgaatggtgggttgagtgctggtaaatcaccctgcctcttttgtgattgtacttgcaaggcagagattcttaaacctagtatgcataaaaatcacttgtcaaaatgcaaattattgagtttcaccaacagaaattctgttttagtgggtttgacatggggtcttggagtctattttttcgttttctttgagacagagtctcactttgttgcccaggctggagtgcagtggcacaatctcggctcactgcaacctctgcctcctgggttcaagcgatccctccacctcagcttcccaagtagctgggattacagacatgcaccaccacgtctggctaatttttttttttttttgtatttttggtagaaacaggctttcaacatattggccaggctggtctcgaactcctgacctcaaattatctgccttccttggcttcccagagtgctgggattacaggtgtgagccaccgtgccaggcctggagtctatatttttaatgaacatgctaggtgaccttgatgccggtgcttcacactttaacattgatctaagggatgcctgaacaacttcttagtgtccgtggagatgacaggtgagcatcagggatactcccaggttatagtgccaggagagttgggaagggaaaaagctgtttaagataagtgctaaggtcattagaagacttttttgttgttgttcctaggggagtaatagcattgcccaaagccagcttattcttgcaaagagaatggttgggacagagaagaagtagaaatttaattttggggttattggtaccagtcctacccatcttttaataactagtgttgcttaagggctgaaggtaaaatggaaaaatatagagactttaatatgaataggcagggccccttccgtaatctgacttatagaaactttcctaaaaattttatacctaagatcattggagttcctagttctgcttctgccaaccatttccatatcattccatatcctataagtaataactaaattatttattcaaaaaggcaggaggggagttctatttgccttttgggtacatcttgttattaatataaaggtagtgttgggtattaatataaagatcattgaatttcctagttctccttctgccaaccattttcatatcattccatattctataagtaataactaaattatttattcaaaaaggcaggaggggagttctatttgcctttcaggtacatcttgttattaatataaaggtagtgttggggttaggtgaccgcttcccattctcttcaggcacttgttctctgcctcacaacctgatatctcactgtggaggagcagctggaatacttggctgtcagaaacatgatagaattgtctgaagctttctttttttctacttctgttctaattctgttcttggcagttttttaaaaattcacaaaactttcactaagatagaattggaaacttcagaccatgtgcaccatgtcagggaactcatcatctgccactcctcatgttgcaggctcctctccccttcagccatttcagtcatgctgtgttctgccttcttctggaatggtgggtcaaaggttgttttcagctgggcacaaaagagaacagagggggcaagtgggtgatcagaaggaccaattgagggctgtttggctttgggataattgttactgatttagcatgcaaatctcttgttagaatatggacaacgggagtacgtgggcagctttaaaagtaactgtacttccatttggtctgcttattaggcattcttattattaatatcagacatctttaatttgtgtactgtttcaaggcatgaatgcaaaggctacatgaaatctccatggccaacttgtaatcttaacatgagtcttatgttgttgtggatgaagaatgtaggtttaactgaattcacatattatccttcatgttaacttccatatgttgactaattgaaattaacctctactaccattctcaagcctttatttggcttactgctgttaggcttcttcttttttttttttttaaacatccttgtttttattcaatttaggagccaagattagcactttatcttcatcatttaaatttacctagattttatcatttaaatttatctagattttattttaatttatctaaatttaactaacatgttttaattttttgtatcaacttgttaatttttttggtgggggaacatgattatactatataacattattgctctaagtgatactacctttgtatcttttgtatttcatctaaattataatttttaaaaaagagtttaacggtcaggaagagaaggttggaaatcttgccattggagacctgctagaatctaggatgattttaatttactagtcaaaaccatttggggatgatcattaagccagttatgaatgcattcaatagaactctcacccagcccatatttccttatcttgataacaccttgtcaagactttaatacattttgtcagatacattaccaaaagccagatatactatgtctactgcatcatttaggcttattgatgtaagaaaataaggagaatctacatctacatgatttattctagtgtatccaagctggctcctagtgactacttcttgccttcctcttgatcattcattctagcattaggttgaccaatatgcattttgctatatttttcttgttccccttttccttgtctccaggcttctggttcctttcttattatctgtaattccttaaagttcttcagagttgatctggcacttctcatacatcaatgtgtaaaagaatctgctaggcatcttgttacacaatacaggtccaggaatcaaggggtagaaacaggagtggctccctttactgtcactcctagtgatccactaggaaaattgttgttttccatccttagagacttagttccaaagggagggatagtgattcccttgaactggaagctgaaactgtcatccagcccctttgggttcatgcctctcagtcaacaggcaaagcagggggttgctggactggctggtatgattggtcctgattaccaagggtaagctactactacacaatggaggtaaggtagagcatgcccaggaggtctacgatggagtccaggattctgcatttcctgcaaatgtctagctgatgttgatgctgctggtccacaggctatattttgagtagctagggactagaagacttggtgttttaggtaggaggtagctttcagtgctcctctagaacaggaaggaggtctctagtgggtagtgctctcaagttcttattcccacacttacaaactcaccagtgtccttatcgtccaacaggtatgtcctttattctttcatcttcaaggtctcttgctccttgaccccttctcccccacccacacagtgctttctttcttcttcctttcatagtcatacttcttggaagagcagccttaaattttatacttccattttagccctccccaattactctgcaatcaacaactctgatcatgtctctttactctttgaaaccctgccctggctcctcattccctctggcttcttgtagtgacatcccctacatggctcctgtttccctccctagctcgtctctttacactccaggagttccaaattacgcttggctcccagggtacattattctctttccagtcttcttgcatttgcttttgctcttcctctgtccataaaagctcttctctgctttgttcactggctatctcctctcattcttcagctgttcctttcactctctgtctttgcttaggaacctaagttcctttctttgcttatatgtattatttgtataattcaagaataattgaaaggaaggacacctgtgttttccctctctggggtgcatctgtaactgcagaattattttaaggcggtattatcttgacatggtagtggtcaatcttactgaagggttttaaggataccaagtaacttggcaaagtcaccgtaaatcttgtttgaaaaaaaaaggggaagacttaatcaccactctgtacatgaagaggaacattttaaattagtttatcattgtgtgttactctagttggtctacacaatattcactgacattatggtttcatgaaaatgaagcaataaaataaagataataagttttatcagatgagaatgttttcactaatatggtccccagagacagtgatgaatggtaaggttttcagatgataacttagaattttgacaacttcttgcattggtcacccttgggagcagtgacagatagggtcacttgctggttaagagagtggcctcatgcacatcactaagctaattgggttttctcaacaataatagggaatagagatggagagctgccagaaaagatgcagacactgaggccttgatggattattagctgattagtcaagctatatctcaggctcaggacctgagataaattgaattaagtccaaaagaaactaggctatggccaaataattttttaaaaataatatttggggctgaggcaggagaatggcgtgaacccgggaagcagagcttgcagtgagccgagattgcgccactgcagtccgcagtccggcctgggcgacagagcgagactccgtctcaaaaaaaaaaaaaaaaaaaaaaaaatatttggatgtttctcatgatctctcaggcaatgagtgcaatttgctatcagctgcattgttgcaatggcacttgcagatagcagaagggatggtgaaaggtggagggtgaggcattcatagacttaaaacttcatttgcaaagtggccttaatgtgtgtgtttgagagataagtcttaatctcttgcacacagtaagtgttttgtaaatgtgtatagactaagttgtgtgaaatatttaaattaaatgaaaggaatgcccttgctttcaggaacagttttttatagtgtggttttgtgtctgctgtatcatgttgtgtcctagattcctgtcacttttatggagaaaggcatgcaaaagagaatcagaattgccagcttcattaaggatacagcacagatataatttccttttcctcagggtcatggaactgttgatgagttattttctagctgacatgcttggagtgggagctctggcctcttttctcattactgatttcctgggcaatctgtctttgggtaatgactctcttggtttgtgttgcatttcagcataatgcatttttccagactgaactctgtcttttatataggttgtaccagcaaacgaagaaaccacaaccagagatagaggcagtgttttaaattgtgaaatcccatagtcataatagtttattttgtgagaaagtacttggtcacacaaatctattcctctctctctctttatagagacaggatcttcccatgttgcccaggctagattcaaacttggatcctctggcctcagcctgtggagtagctgagattataggcaggtgccaccatgcctggcttattcctcttctgaggatgatgttcctgggactttacctaagacctgtgtggggtagtggatcaaagggatttggaatcagccagctctgagtttaagtcctggttctgccctttgctagtgttttgtccttgagtcagctttgattatcttaaaaataactttttactaattataaaatagtagagaatttagagaacattgaaagttacaaagaagaaaagaatattcacgtaataataagataaaatgctcatgaataacattctttgaaagtatcaatttatatatttatatgagattcaattatgtaaccatgtaaccattcttatattttttgacattgaagatatttcttggttggaccattataaacagtattgtcatgaaggccagttgggttagctttcacctttaatcccagcacaggctgaggcaggatgatggcttgaggccaggaatttgagactagtctaggaaactttgtgagacctgtctaggaaactttgtgagaccctgtctgtacaaaaaatgaaaatactagctgggtgtggtggcatatgtatgtctgtagtcccagctactcaagaggctgaggtgggaggattgcttgaacccagaggttccaggctacagtgagctacgatcatgccactgcactccagcctggacaacaaagcgagatcttgtctctaaaaaaaaataataatataaaaaattctgaaaatattgttgtgatgaatctcctttaattacaaaaatttaagtatctttttcaatggagtagttttctaggaagagagttttgcttgaatattttaaatatttcctatcgaagcttttaatactggaaagtttttcagaaaggctttgatagtttatagttttaccaataattgtggaagagtaaagggtaagtaatttaactgagcttcagtttttaaatatatttgcatcataacattgggaggatatggcctaacataaagtacctagctcagcgactggcaaatattattaatgtttttagtgtctgctttaatatattaagtgtccataccatatcattaaatgctctaccaccctcatcatccattaaaaaaagggaaaataagcttttacagagttgtatttgttgtgatatagaattatgtgtgagtatctagcctaatgttctctttttgaaaactgccttttaaagtaaatatgtttattaaggtgaaaagtagaggggaaagacagtgtggtatttattaaaagtatttcttttgaattaatttttaaaaaccaggaaattatggcagttctttgaaagcttggcccaactgttcattgtatttatactggttttaatatagtgtcaaatcttatgttgcacaaatgcttgaattcaatgtgtgtttcagttgcatgtgtattggctggtgggagaagcaagtgagttagagatcgccctccccctccccctccccctcttcctctccccacggtctccctctccctctccccatggtctccctctccctctccccacggtctccctctccctctctttccacggtctccctctcatgctgagccgaagctggactgtactgctgccatctcggctcactgcaacctccctgcctgattctcctgactcagcctgccgagtacctgcgattgcaggctggcgccgccacgcctgactggttttggtggagaccgggtttcgctatgttggccaggccggtctccaacccctaactgcaagtgatccgccagcctcggcctcccgaggtgcggggattgcagacggagtctcgttcactcagtgctcaatggtgcccaggctggagtgcagtggcgtgatctcggctcgctacaacctccacctcccagccgcctgccttggcctcccaaagtgccgagattgcagaaagattgcagcctctgcccggccaccaccccgtctgggaagtgaggagcgtctctgcctggccgcccatcatctgggatgtgaggagcccctctgcctggctgcccagtctggaaagtgaggagcgtctccgcccggccgccatcccacctaggaagtgaggagcacctcttcccggccgccatcacatctaggaagtgaggagcgtctctgcccggccgcccatcgtctgagatgtggggagcgcctctgccctgccgccccgtctgggatgtgaggagcacctctgcccggccgcgaccctgtctgggaggtgaggagcatctctgcctgccgccccctctgagaagtgaggagaccctctgcccggcaaccgccccgtctgagaagtgaggagcccctccgcccggcagccgccccgtctgggaagtgaggagtgtctccgcccggcagccaccccgtccgggagggaggtgggggggtcagccccctgccaggctagccgccccgtccgggagggaggtgggggggtcagccccccgcccggccagccgccccgtccgggagggaggtgggggggtcagcccccaacccggccagccgccccgtccgggaggtgaggggcgcctctgcccggccacccctactgggaagtgaggagcccctctgccaggccagccgccccatccgggagggaggtgggggggtcagcccccgcctggccagccgccccgtccgggagggaggtgggggggtcagccccccgcctggccagccgccccgtccgggaggtgaggggcgcctctgcctggccgcccctactgggaagtgaggagcccctctgccaggccagccgccccatccgggagggaggtgggggggtcagccccccgcccggccagccgccccgtccgggagggaggttggggggggtcagcccccaacccggccagccgccccgtccgggaggtgaggggcgcctctgcccggccgcccctactgggaagtgaggagcccctctgccaggccagccgccccatccgggagggaggtgggggggtcagcccccgcctggccagccgccccgcccgggagggaggtgggggggtcagccccccgcccggccagccgccccgcccgggaggtgatgggcgcctctgcccggccgcccctactgggaagtgaggagcccctctgcccggccaccaccccgtctgggaggtgtgcccaacagctcattgagaacaggccaggatgacaatggcggctttgtggaatagaaaggcgggaaagttggggaaaagattgagaaatcggatggttgccgtgtctgtgtagaaagaagtagacatgggagacttttcattttgttctgtactaagaaaacttcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggctgcagggccctctgcctaggaaaaccagagacctttgttcacttgtttatctgctgaccttccctccactattgtcctatgaccctgccaaatccccctgtgtgagaaacacccaagaattatcaataaaaaataaataaatttaaaaaaaaaagagagttagagatcaatattctcgatatgccaaattgtcagtgttaattaaaatgatttgagggtggtgagccaccttaaaagaaggcataaaatggtatggtaattttaataactaaatcaagaaataatgaaactttatatcttatttttctcatttctacctattctacagcatagagcttggccgcattagtttcctaagactgctgtaacaaactcctacaaaccaaatggcttaaaacagcagaaatgtattttctcacagttccagagaccagaagtctgaaatcaagctgccggcagggctggttccttctgaaggctctgagggagtctgttcatgcctcagtcctagcttttggcggctgcctgcatccttggccttccttggcttgtagctgcatcactccagtccctgcctctgtggtcacatgggcttcttccatatgtctcatctgtctctgtgtgttctctcttcttataaggaagggctcaccctaatgcaatgcgacctcatcttgattactacatctgcaaagattgtttctaaaaaaggtcgtattcgcagctggccaggggagagggtgaggtagaggaggggttattacatgaacatatctttttgtgaggacacagttcaactctttacagtggcaaacactaagttcaaatagaaactcataatctctgcttcctccacatccactactgtcatctctaacttcagtttatttggtcatattacttaatgtaatgtaattacagtaggcttcccatgcctactgtatttggtttaagtttgtctgcttggctctacctttgatagacaagatgatttctgatagtaagaaatagctctttctcagcttgaatcttactttttttctctctttgtgctgtcacccctgcagggaaggcctcctttcttcatctaagtaagtcttattcctaaggatggggtgcttcatactttctttttccctatagcacctggcacagtgctaacacatatgtgctcaataattattttaattgattttcagataaagtagaaggatatagattatagattggaaagaaaagtaaataatggctttacatgcttgagtcccaaaattcaagttgcttcagaagaaaattcaagttggtctgcttgatagcttcaattaatcaagtagaatattgttttctctttgttttaacatttctacctggagcactagtatcattttttaattttaattttatttttttagagacaaggtctctctctgtcatccaggctggagtgcagtggtgcaatcataactcactacagtctccaactcctgggcttaagtggtcctccaacctcagcctcccaagtagctggtagtacaggtatatgccaccactcagtactgtattttagtttcattctggtgcccgtctgttttggctctaagatagcatgaacatgccaggcatggtggcacatgcttgtaatctgagtgctttgggaggctgaagcaggatcacttgaggccaggagtttcagacttagactgggaaacatagtgagaccatgtccctgaaaaaagtcaggtatggtgtgtacctgtagtctcagctacttggaaggctgaaatgagaggatcgcttgagcttaggattggaagctgcagtgagctacgcaccactgcactccagcctgggcgacacagcaagaactcatctttaacaacaaaaaaaccccgaaaatatcatgagcagttgctcctgtcaagagcatctcttgagagtggccctttggaattgagtagtatagaatcatatactttgattttgactgtaaattatactttttgttttatttttaaacaggtttgtggcatttattatgtgccaggctctagtctatttgctaagcaaatagaagtttttgttatttattgtcaatactgagctcagtgtctgaaagataatttcttatcagtggtataatatctaaaagcataaatgaaaccagctgtgtagtttgttttatctttattatcatcattgttacatagctaaaaagatttaagaggttttgctcatctattcttctctacctcttcaaaaagaggcccaaggcaacactgctacctcccccttgggttctgtcttactccattaaactctacaattataaatttgaagggatatataccagggtgccaaatttagtatatggccttatggaagcctagtcaagcccaagcccaactcatccatggtctggtggacctcagctccagctcaggtttcttaccattaccaggcccagagccattaactgggctctgatggtgagaagatttatgtttctgttttgtcatgggcaaaaggataggagtcagtaagggttcctttgtctgggtgatattgaacacttgtgtgtgtgtggtatttgtagctagaatgaatgaatatttgctaagcaaatagagcttggcacataataaatgccacaaacctgtttaaaaataaaataaaaagtataatttacagtcaaaatcaaagtatatgattctatactactcaatttcaaagggccactctcagaatctccatactttcccagtggtctgcgcctaaggcgtatctcctcagccttccattcacctctgttttgagatctttgtccttggtctgttaagtttcataaactgtaacttttggcaaatgggaaatgtcctcacaaaggagtcccttcagttttcagtgcaatctcttctatagtgacctgcaaaaaacccgaattagaaaattagtgtgaataggtatttttacaaaataagttggcacttgctgagcttaattttttcctgcctttatgttcacagaaaagagacattgtaagtcttaagggcagtggtgtgctggtaaatgtttaacatcaggctctctctaagaaaacccaaatttgtagtggtttgtgattttcgtaggctctaaaaaaagccaggcgtggtgatattttcatatcatcatattgaaaatgatgatcaaaattttcatcattttgaaattggccatgatgaaaatatcatcattcaaactcccagtgtgacctcactgaagtggagttgggcagatatatggacataggctctaaaacacctctgcaataggccttgggtagatggagaattgaggggatgtgccttagatctggcgcttagagaggctatggagatgctgagactagcttttctctgtgttttcttttgtgcatacattcattctacaaatatttactaagcacctgccatgtgccaagcattgctctaggtactagggatatagtagggaaccaaacaaagtccttacctccaaggagtttgcgtcccagtgaaggtattcacaaacttgcaatttcacctccttgggaccctagcgttctcatatttgggacagttagagtcaaggtcccataacactttaatgttttgttttgttttattttattttattttattttattttattttattttattttattttattttattttatttttgagatggaattttgctgttattgcccaggctggagtgcaatggcacaatctcagctcactgcaacctccacctcctgggttcaagtgattctcctgcctcattcccccaagtagctgggattacaggtgtgcgccaccatgcctggctatttttatatttttagtagagatgaagtttctccatgttagtcaggctggtctcgaatttccaacctcaggtgatccacccacctcagcctcccaaagtgttgggattacaggcgtaaaccactgtggccggccaatactttaatttattaaatgaaggaaatagcatgggcctattttagttttcctagttgtaaagcagggattatggaggaggaggtagaattgctctctgaattgtctccatcttggagtcacagagatctaaaccttgcaatgtcaggagcactggcttatcttacatgggaaactcatggtagataaagcttagttagaaagtttgttgtgtagattctctgatgccctctccaggctgataaggttctaacgtaatctctggtgatcagcctttgtccttcctggattcctttttaaatagctggtgcctcaagggggaaaattggagagcagggatgataagagtcttgctgggagttccagtcccctaactaacccagaggaggtgactgtttatcgcaaacaattacctgtctcattaaaagttatcacagctagaagcttatggagtggataagcttctggaaatggaaattgtgtctaagaatcgggaaggttcatatcctcaagatgggtaggaaagggattgatgaggctactctgatggtagaactctggagagaaagatgatttacacattgtaggggaagaaaaaaaatgttctctttacctttctgaattctgggctgggacccttgtaacaaaaggtagattaagaggagaagaataagctgggcaaggtggctcaaacatgtaatcccagcactttggaagtccaaggcaggaggatcagttgaggccaggagtttgaggttatggtgagttatgatcacagcatggcactacagcttgggcaacagagcaagagtcttagccaagtgtgatggcctgtgcctgtagtcctagctgcttgggggactgaggtgagaggattgcttgagcccaggagtttaaggatacagagagctatgatcatgtcgctacactccagcctgagcaacagggtgagaccttgtctccaaacaaacaaacaaaaaaaacaaataaaaagcagattcccttcaccccccaaaaaaaccaacaagagaaaagcaagaagttaacacatatgtgttatatgtatatgggagataccagagaagtgaatagatctcaaagaggtggcttagtactctggctttacagcattttcaacaaagaacagtaaatatttagataaatgactgcagaaagggaaaggaccttgagtctctaggcgtggcaaactgtgggaagacaaataaaatacatgggaaactcctggtagataaagctaagttagaaagtttgttgtgtagattcattcctctggtgccctctccaggctggtgatcagcctttgtccttcctagactcctttgcagataggaggatggcagagagcttcttttatatctgcatcttcccagttgccttcaactccaaataatccttatgccaaagtggcatattttgggatggcatattcagctacccttcaacatactcctctggaagaggatttaggattctcagtaaagaactttgaatctttccgcttgaaaatcattgtgccaggcttactaataggtggtatgatttgagcgggtgagattttcttctaggaaaataagtcctcaggaaattccagaagctttagacaagtaaaagcagaaaggagacaagcttttttttttttttttttaaatttaaattaactgttggatgctgcataaatcctggtcaggtttgcatgattctgcagagcctctgcctttgctgtttttcacctgttggatgaatgattcatttgcccctgctgtttctcacctgttggatgaatgatgctgctgttttacacagcggcattccagcaaatgtgggtggtgggccattcacctctttgtgttgatctggaaatatgcattgttccatttatgcctgagccacctcagtcttcctcattagcaaggacttacatatgcactatgctggcttggaatttaattcttgactgtgctgtttttaaccaaataaggaaaaccctggcctttttctgcttctaggacccagccacttttgagttgccagtgtgtttccaagtatggattttggattacctgcatcagaaccacttcctgtgcttgttaaaaatattcatttctgggatgcactcccaatctactgaaccacagcctctggagtgaggcttaggaatttgcatttttaatatgtttctcaggtaattcataggtacatcaaagtttgagaatcactggtttagactcatagaatattagagaggaaataacctcgtgttcccttggggtcccaacgtatggcccattggaacaaatgcagactgcttgatgctggagttaagcctgggaaaggttggtagcatactttttccatttaaattaggaattaggatacccacacaatctggtaggtcagtaaggacaaagccccctcttaaggatcactattatgtgacaccttgctattagcaggcccaggtctgtcattacagttgaaggtgaacataattaattacaggcatttcattttcagctgttacagtttaattctcctaatgttatattatggaaccggaacatttgcataataatttacaaaggagatcagtgtgagtaagcactttttgtgcctttgactcaagctttgtcactctaattagtattcgtgtgccaagtgtggattctctcaactcattaaaatttttgagatcattcaggcttcacacttagatgtttcagaccatttggcccaccgttgagggaaaaacaacacagatatcttaacttggtccaatgctgtaattttatagatgtgaaaatcaagatgggggtgggggatgaagtgacttgtgcaagcatgtcagggctggaacaagtccccaggttgtgctgcttctaggtgggtgttctttccttcttactgctgacactcagcaggagggaagtatacctgtaaaattctctgctgagtcttacagttcctggtaggcaaagtctaatattcccatttctttctttctttttttttttgagacagaatttcactcttgttgctcaggctggagtgcaatggcacgatctgggctcaccgcaacctcctactcccgggttcaagtgattctcctgccccagcctcccgagtagctgggattacaggcgcccgccaccatgcctggctaattttgtatttttattagagacgaggtttctccatgttggtgagtctcatctcaaactcccgacctcaggtgatccacccaccttggcctcccaaaatgttgggattacaggcatgagccactgtgcctggcctaatattcccatttctaaagatgcattgtttagtgttcccttgtgaaagcagggaaattgcattgaattgtctattcagtatgagacttggagaaactgtctttctcttgtcttctacatcagtgtcttgttctacatcactttttgagataggtacagtgcatggctgaaacatgtaattatttttctttcttgccataagcaaatggaatcagcaatctattattttctatttttcttacatataacaagatccagaagatatatgcatagcaacaaaaaaggacattgtgtgattacaaaattcctatgataaatctttattcagaaataaagattctgaaataaagattgcttcatacctagatgaagcaatctagaccaggggactgccctcagtgcctgtgagagcaggtgtgttgtaattatcaagtcctgtgataattgtgctacacttaattaattggaagacttgtctctaatttactttggagacctccaggtgattcagttaatggggtagagcaaggaggtgggggatggatttgtttttattttgcatttccatttttccttcttactccctgatttgctttggaggccatcctggcttttaaaaagggcacaaatatatttcttatgtggaattggcaggaaacacactctgttgaacagagcaatgctagagggttagcttgattccctcagaggttgctgaggagctggtatatctttatgtcctcttttcaaatgctctttgaggttgttgctaaagtagtttttttataatagagtgtgtgatcaatccttttggggaaatatgggtaacataagtcaattgtgaagagtaagtttgatggcaaacgatcgggaacttagaactatttcttgaagggaaaaaaactgaagttagtagacagtttgaggtttaagttgatggtttttgacttgtagaacttagcaaaaactttaaatgttctttatcctgtggcagcctctgctccttgcctactcagtatccatgcttttattattccttatttaaaggaccccggttttgtttagggcaacaatgtgcccagataaaaataccttccagactcttgtgcagagtgggggtggctgtgtcaccaggtctgaccagcgggttgtgagtggaagtttactgggtggagctctgaaatgctatttttcctggtaaaaatgaaaagctggggcatgtcttttgcccttggccttgaccctttcccccttctgcctggtatacaacacctaaggatacattctgcctggatacaacacctagggttagaataaccatcttgcaactatgagaacacaaaccatgtgggaagaatggcagggaggaaattagaagtctaggtccttgccataatgacttctttgagcagctgccccagccctcttctggaatgtgggttacatgagaaaaacaacctttatcaattaagccattgtagttggatttctgatacataaagtcaaatacaaacttggaaaactgctagttaggtggtccttatacaaggtgtgtttaatcatagtataattcaatggacagtttagcttattacatagagttggaaattttggatatagagagattcccatgtctgctaggcttattttttggaaattacaatatgcagaaactttccaaatattggtccacgtaaggcagtgcctaacagcaattgggtattacctgcactgtttgcagctctttgctgaaggagtattatgtcaaaagtcagagggattaggagccaacaagttagtgtgaccccttgtttgaagggagtgggcccagaggggtttgcctacaacccacaggtaagctctgtgagcacgacctggtaactgcttctgagagatgtttggagttcttttatttttcctcttctggggcagagatgttggtccaggatcacatccgtccataaatctgttaccttatttgaggcagttccattgagcaggctttcttgaatacattcattaatcagcaaataaccatatttctgaataaagatttatcataggaattttgtaatcacacagtgtccttttttgttgctatgcatgtatcttctggatcttgttatatgtaagaaaaatagaaaacaatagattgctgatcccatttgcttatggcaagaaaggaaaataattacatggtgaacgttccaggacctttagacctatgaagaagaaaattgtccaaggaccacacagaatattgtagagagtatttatgtgccatcatgatgtttctcagacttttagcaactgcagaccacctagacactgctttatgtacgagtagaccataatttgaggtaaatttttaagaagtaaaaaaattttaataatgaaaaacttgtttgataaatgagatgggggaaactttgggaggtgatggatatatttgtctttccttcatggtggtaatggtttcacgagtgtataccccaaactatttgaattgtgtacattaaatatgtatagcttttttcatgttactcatacctcaatgaagtgtttttttttaaaaagcatgcttgaaaattaatagtaaacgtttctcatatcagtgaaagatagtataattctgaagtaaaatatctaatatttagctatatgatgggttccttatctagtgttttttccttcttcattattttaccaaaatagaaaatacttcgttataattagagtctgtcaagaatagcagtaaatgtatgatggttccatcagtttggaaagtttggataattcagattgaaactgtctagaaatagtggcaagatttccacctgaaaatcagagtcagggtttcatcacgtacgaagtctacaagtctctaagcacatcttcaaacttgctgttcagtcttctcaaagaagctctatacttactctcagtgttcaacataaacatgtttgggttctggatgagaggatcaggaatatccagatactaactgcattgccgacatttgccacttgaagctatggaactgctccttcctgacattatctgtgtggaacaggaatgttccagtctcattcatcatttcaaaagtctgcatgagcacccttgatgacaaccacagtgcttctgggggaacaatcagtctaatgccctctgcccatttctttgcagaacatgctgagaaaacatatactcagatctgattatattcacacttgaaactattttctacaacaccacattaagattagaaaccatattgttgtgtgtcatctgttttggtgaataaagaagtgggtgttttggcataaaggtaacacttttatttgtgtcacaccttcttccttgctgcaaacatagctggttatttcatcagcactgatcctagtgaaccttttccaatttatattattgcctacaaaagaaatgttaactcatgaaaagtctcttccgtagattgggttcttggtaacacatagagccaagagtttttaagtacttatccctcaaatatgttccactaatatgctagttgatatgcatactctgcatatcattgatttcacttaactataaggcaaaatacatgctagtgtacatatgtgattgtaattcttccacattgcatgccgttgatatgtaatgtttgatagagccattaataattttgccaatacttgcatagtccaattttcctctgagcatgtgatttgtcattaaccttgtgactggctttatcagtttcttagaaatagaataatctttatttgttttgtctcaggaatataactttgagtaatgcttctgtagttttggtctctttctgcccttaatgacaaaatgagtcaatttcattccagaaagcattattttgtacttgttttggaacaattcaggaagtttaatagggacattgctgtgcacattttgaaatgtagtttgaaaatgttatgaaatctttgacgcttctagctgctctttgataagaatttgtgacagaaacacactggcaaatggaataattgtccaatatattccttggcagctgctgggaccaacttcacttgtgagaaaccatcccagttgcatattcacattttttacttgtactagagtgagattcactgtttgtatttaaaacattattgtgaggtctaggatttttgttgctatattcattactatgtttatactgtaatgagcacttttgaaccatctattcatttgtgtgagctggggataaaacaaaacacattagtaacagtgagaaatgtaaatttcattaacagagagtaacacacaaagatgttaaactatgttaaaagggaccagttgcactcagtactgcttttaagattgtggtgagtgtgatgattattaagaacataaccgcattgctgtgaaaaatcctaatcagttttgcattcaagtgtaaggtgtatgggaataaaacaatttctctcaaacagccaaatcccgccactggacacttgaccgattgattgcctgagaacgctatactgttaggtcctttagtgacatagtaggtagtaggtagacagtcatgccttttaataggaagtttctaaatgtatccattcattcatcagcattaattgaatgctaaatatatgccaaccactttattaaatgctggagatataaagatgactaagattcagttgcttccccagggagccggtttatggtctgttggggaagacagaaatatgaactaagttataattcattatgctaagtgcaatgctggagacaggccagtgagagcaaagcatggtacttggagatcatagacagggtggtgggagcataaattataaggtgaaaagtgaggctggaggggtgggcagaaactagatcccacaagatggaactggctggttaggaagctttgagtttgtcttctaggcctcaaggagccatggagtggttttaaacagggcagtgataaggacaggtttatgttttagcaagataattctgtgggctgggtgaaggctggagatgatggaggtaaaactagaagtagggagactaattatgaggctgtcgtgatttctagctgagatataatgaggacttaggcaagggcatggcaacagggttaaagagtttgtgacacattcaagaagtaaaggagataacattttcaggacttggtgattgaccaggggtgaaggttgcgttaagacagagccaaggatgatgcttagttctctatattgggcttctgagggggtggaggggaaagagagagagtgtgaaagagattgagtttaggagaagcaggtggggtaaaataaggtatataggagacaaagcattaggtattaagtttggtacaaattgactttgaggcacctgtgaaatacccaatttgatctaagaatctaaagctggagggtcatcaagtattgaagtcatcaaaattgagtggtagctcaaaccatgagagtagatgagttcacctaatgtagagtggaccttttaacaagcaggtttaagaagaggagtgccatataggagacagcagacagtaaataaatggtcaaagaggtggcaggagagctgtggtagagaagtgcctcagaagcaaagggagcagaggatttccaggagggagtgataatagcatcagacccagcagggagagaccagacagtgtccactggatgcagaggaatgcatgatgactttgggagagaactgtttcaaaagagtggtgggggtccattgctgtacttttggaagtgagtggaaggtgagagagtgaatttctccctttgaagccactgtgccaggagttgaagatttcctagccagagaagttctgagtcttgagaaggttgaaggtgttcactgtgtgcatgagtaaagagcaggttaagttcatttgttgataagtataggaattgtgggtcttgtcacccacataggactttgaaattatcctaaataatggcaaggcctgggtgggacagaggctatgagtcagatactaaaatctttagcaaatgagaaggagttacctggaggctgataggttacaaaaacaaagagggagtagaaagagatgtaaccagatgacaggagttaaaggagtctggattttatataaatatagaagggcagtgtgttagatgtacaaatagggagtgagtgaggaataggatgaccttattcccaacttcgaggtggggtgcccaggagactgcacagcatccagtggggaagcgggcccttgggttttggttaaggccaaggtctgtgaggtaggcacgatgttgtcaagtgttagtcctgtcatgcaacaagttgcagagggtccagtaagaggttagagaggaaaggggagtaaggtcaaggagggggagctctgagcagcatgggcatgagggtttgagagtacagttttgcacatatgacaaggatgtgaagtgtggtggcattaattggcctgaacatttcaatagacctttgggatgaagttgctttaggtttcccacaggcatctaaatatcagctgatgaccactgacctgttccagtcaaggctgtgtggctcctgggaccatatttttccaacattactgaaggaggttaagtgggctcccaagcagcaacaccctcattggtcaaggttttagtactggacagggagttaagaaacagggttttaggctagctttgcctctaacctactttatggacctgggcgaatcacttaaacttttaaggcctcactttccttatttttaagtgaggggtaggcccagtagtctgtaaaatgatagttgacccatttgttctctagttttcttccattaaatgtggcacttacggtactgttgtagtatcattacagcactcagtaacctctcagtaatcttcaccaaggtgtaccacccttcaggcctagccacatatacatacatccagcaacgcctactctcatcttacctcatctgtgatgttcaggaaggaccgtgtcctcagtgcctaaatacataggggtttcttcagtgttggcctttcggccagccacccctccctgactgtcactctggtcatttactttttgttttattctcttctttagaataatagtgagctttattatccaaagagctttaaagtggttttacaactaaaggcaggaaacctcgtacactggtatgaatgtaaattaattggaacaaccatatggaaaagggtatatagaggttcttaaaaaaactaaaaacagaactaccatatgatccagcagtcccacttatgggcatgtatccaaaggaaataaaattggtatctctaagagataactgcattcctatgttcattgcagcattattcacagtagtcaagatatagagtcaacctgtgtctgtagacagatgaatggataaaaaaatgtgatacacacacacacacacacacacacacaaatattatttggtcacaaggaagaagtcttgtcatttgcaacagcatgggtgatcctggaggacattgtgctaagtataataagccagccacaaaaagacagtactgtatgatttcacttatatgtggaatctaaaaacattgaactcatggaagcagagggtagaatgatggctgtcaggggtgggagaaatggggagatgttggtcaaagggtaaaaaggttcagttgtacaggattaatatgttctggagatctgaggtacaatgtggtgactactgttagtaatactgtattgtacacttgaaatttgccaagagagatcttaaatgttctcaacacacacacacacacacacacacacacacacacacacaggtaactatgggaggtgatggatatgttaattagcttgattgtggtaatcataatgtacatgtatatcaaaacatcatgtataccttgaatatatacagtttttattttcagttatacttcagtaaagctgggaagaaagaagtgcttatagtgaaggaaaatgcggctgtgtcattgttttgaacatctctgttgggaaatactgcatgagtaatggaaagagcatggagttggggcagggtgcggtggctcactcctgtaatctcagtgttgtgggaggccaaggcgggcagatcacttgaggtcaggagtttgagaccagcctggctaatattgtgaaaccccatctctgccaaaaaatacaaaaattagccaggtgtggtggcgtctgcctgtagtcctagctacttgggaggctgaagcaggagaattgcctgcacccgggaggtgcaggttgcagtgacctgagatccgtcattgcactccagcctaggcaacagagcaaggctccaactcaaaacaaacaaacaaaaaaaaaaaaaaaagaagaagaagaagaagagcatgtgattaggagccaggagtcctgggcttgatgcatctgcgacctagttcataggtgaatgctaatttaatacaaggcaataaaatgtttagaaaaatatttgctcacatttgatggaacatcttttgtgtttgcctacatttggatttgggggaatttggggtgaatatgactataaatgagtgtgttcagggatgttcacttaaacgtatcagtgtggctggggttgggggagaggagaaacttattctcctcttagctttgtcctccatcttgtttttgtgttttctggcaacagtaactttgataaaagagatcttcccaagcctgatgagacagcaaactagggaatgaaagaagggaggatataaatagcactgaggaccaacatggatttttttaggtgtttcagagctgctagactcaataattgggttttcttatgagacttttaattgctttattaagaaaaataggataaaataaaattgaacaaattaggcagccaagctctggaactagtaaagaaggctctatttgtgagttgaagaagtaaccttattttttccccctgattctaagactactttgaaggaacagaagataatgtagatcacctattctctttcattctctctctctctctgtctctgtctctgtctctctttctctctctccctccctccctctctccctctctctctctctctttttgtaacagggtctggctctggagtacagtggtgggatctcagctcactgcaacctcaacctcctgggctccaaccatcctcccacctcccaagtggctgggactacacacccagctaatttttgtattttttttttatagagagggggttttgccatgttctcactgtgaaaatttactaccagaaaataggctaagaaaaataatagctttcatgagatactggataggccattccataataatagcaatagaaattaaattataaacattaacataaacatcaacatcattaacattatatccctcactgaaacaactggtagaacaccactttgagaattgcagctcatactgatcttgtatgcaagaagatgagagagaaggtgtgtttaaatccaattttattaggccttagttcgctgtgcacaagagggtagtagcaatggatttaagttcaaaggaaaaagaggttcctgaaattctccctgaagtgtagcatctgctatttatttcacatgtttactatcaattttgaatatatgttagtaggaccatgaaagaagttatatgtttatgcagctgaagcatttatttttattcttctgctcaattctcttcttcttcttctttttttaaaaatatgtatttcttgagtcagggtctcactctgtcacccaggctggatcacccaggctggagtgcagtggcaggatcgtggctcactgcagtctcaaactcctggactctagtgatcctcccacctcagcctcctgtatagctgggactacaggtgtgtaccaccacacccaggttaaatacatatatatatttaaattaaatatatacatatatgtaaattaaatatatacatatatttaaactcatatatatatatgagttaaacattgggaggaataaaaatagattacaaaatattgcaaaaaagtacacaccaaataagtcagatgatgacaggtggtggtttgtgtatgtggaagaaacttctttgagttaagcaagatgataaagggagtattttaaatttttatcatacttaatgattttaaaaacattttcacatatgttattcacttttctcaacatacccattaggtaaggaggctcggcactaaaaccccatttcctacatgaagaaattgcaagtcaggatttgaccaagctcatggaactgagtggcagattggataagaatctgtttgctgactcttgatccagtgggcttcctaatactgccgattgtctatgaatagatagcattgaaaagctcaatatttacaaatgagtcaattttgcttgtatgtgagaacatatgcagttctccaggaatgctttaaagtgtcagctccaagagtgatatgaaaatatttgtccatctagcatggattctgcaaagacaagtatttatctgaaaacaccttaccaaacaaattatttctttgtagtcaaagaaacaatagaaattccaatttgtattgtcatgataatctaagacatttttagaaacggttggtttttgcttttatcaggctcaaaaagcgagatagtggctcccatatttaggaattttgaaactattaattttgacaggtagaaacaaagccattattccaaacaaaagtgagtgaactctgcctggcaccaacagatggcagtattggttgtgtactgggctccatgttctgttgttagtctatggtagactcacgtttgctggaattgcagttaattttttgtttgtttgtttttgtttttgagatggagtttcgctcttgttgcccaggctggagtgcaatggcgcgatcttggctcaccacaaaccacgcctcccaggttcaagtgatctcatgcctcagcctcccaagtagctgggattacaggcgtgcgccatcatgcccagctaattttgtatttttagtagagacagggtttcttcatgttggtcaggctggtcttgaactcccgacctcaggtgatccacctgccttggccccccaaagtgctgggattacacacatgagccaccgcacccagctggaattgcagttaatttttaagcatttttgtgacattattaacctcatgtaaggtgtatggaaagcaatgataataagaaacattctattactccaagtcttattgacttttaagaaagtaaagatgataaaaggtgaagcaacaatgatgacttccctaagtatgcaagagaagaatcacttgacaccagattgtttctgaatgacaaactgcagaccatgtaacacatgtaaactactgtttcaatgcagctaacaatacatagcaagatgaaagaaatgtgactgaggagaaggaagaactttggaatttgttattgcataaagctctgtcaatataaaaaaaagatgccaattaggctaatatttggagaagatgagaaggtttggtctggtgaaaatggatggtatcacaggctttatgactgttcccatcagcagatcatccatgtgagatgtcattggtaagcatctgacataacccctgaggggttgtcaactcttggggagttactattgaggggagttacttaccacactacaggtcaattttggaaaaagatgcccaaatctaaggaagatcaatgaaaagaagaggaggatgactggtgttgaaactctgaagtgtcacccacctgtttggtggaaactcatatagagactgcagacttacgtaagtcacttgagacttacagacatcttctcaatacctaaccttcgtgcaatacattttgagttcttcatgtcattaggttttgggggaagcatggctagttgatttcatagatttcctttttgcacagtaatttaaaaacctgcccttgaaaatctttaatcagaaacacttagcaggggcaaatttttatcagcttgaatttcaccatctgactttgtacttttctgcttggtgataaagatgtagttaatgaatagaatggccaaaagggggacaagaatagaataagatgaaagacaaatgactggttgacaatcgtgggggctggcttgtggtgatggtgaaggtgcagggtgcccatagataagtgtcagtgtctcccacttggttggtctactaggaagctacttcaccttctattgaatatatattaataagaaaaactagtctcaaaaaaaaaaaaagaaaagaaaaactagcccatggctggttaatttctcatagaatgaggtgctaatgtatgagcctaggtcacccatgaaattcacagattagctcttcatttgctgcagccagtgttgtagttttcggttctatgctgtcatcttggcctgtgatatccctacctgcgcacagctggtatttttggttatatttgatttctctctcttcctctttctcattcccaaattgattctgcccctgaaatgtttcccattatcacttgccactgctgtagtccagaccttattacctgagaaacagtgtagtaaaaatttgggctttggagtcaaacttgacttaagaacctgttccttccacccactagctttatgactttgggagagctgcttaacttctctaagcctctgttttctcaggcagaaaatgtggttagttatagtacctactttgtgaggttgtcttgaagatcagataagacaatacaagtatagtgcttaatgtttaatatatgttagctatcagcacctgtatttttcgaatggactcttcactgtttttcatttctctgatctttagcttcttcaagccatttctcctactgttaccaaagttattttcttaaagcactgtttggattctattactctcatgattacacacacacacacacacacacacacacacacacacacacacacacacacacacagatattttggatatttgtccccaccaaaatctcatgttgaattgtaatcctcaatgctggaggtgaggcttggtgggaggtgtttgggtcatgggagcagatccctcgtgggttagtgctatctttgcgaaaagtgagtgagttcttgtgagatatggtcttttaaaggtacgtgtggcacctccccaccaactctctctcttgctcttgctttcatcatatgaatgtgcctgcatccctagaagcagttgctgacattatatttcctgtacagcctgcagaactgtgagccaattaaacctcttttcttgtaaattacccagcctcagatatttctttacagcactgcaagaatgctctaatacacacacactagcagcagcaacaaccacacagtgaagtcctttcctggtatctcattacctagaggataaagttggtctattttgatctcttaacaattgggtctcatcctgcaagggatgtcctattgtgtccagcctcatgtcctgctgtatccagttgtcagcctgtactcctccttctcatactccccatcttctctgtacacatcgtgtatgtttagctttctctccaccattgacttcatcctgcttcagtttggaatgaacatcccaaatgccctcacctattcattcttcaaggcccaccatgtcagacttcatacctcttcttttctcctacaatgttgtttatctctctattatacaacttatttcttcttgccttaaaagagttttactgagttattttcatgcagctgccaccagcatattccaaccttgggaatgtaaggaacttgttttaggaatctttgtattctctatagagcctaactcagtgggttgcatatttgtaagtgctcagaaaataaatgctgaattggataaaattggcctcattatccctttcccattaaaaagcaatctaatttgctaattcagggtttatttatgaatgtctttccattttagcttttaggtcactcagtagggatcagtacatagcatggtattgacattagatgaatgtatgtgctttgaattcaaatcctaattagttagattcccaggcaggttgacttttttggttgctaggaaatcaagtaatagaaaggtatcactccatcagtcattggtcacctgcatgggtggaaaagttcgtgcagatactcttgagtttatttagggaagcttgggaaagggttttgaagcttttagccatacagcggtgaggaactacagtagagtattaggaaaggggccatgaggatgaggtcaaggtgacaatcgaagaaggcaacttgagcatgtggtgagcactgtctgttgtgtactagttctgttaaaggcagtgaatcctgccctgagggatggaggaagtactgtatttctctctacagaaatactttgcaatgaaacatactcctacatctccactctctaccttgccctgtgtgataagagatggaaggatattaacaaagaatggtttattagtccccactttttctttatggaactctcttactctttgatatcatgtcagattggaacctcaaaatattattttttgactgctccattagacctcagtttggtgttcttcatctgttttgggccactggcttgttgaggatatgatgcaagttatgaacccattccttagttaaatgcacacgtactctaaaattttcatataatttcagatagtttattgaccctcccaaagtctgtccttacaattctctttttaaattctgtgcttgccaactgtattagttttctattatgcttggcagttagtgacttaaaacaacacaaatgtattatgtcagtttctgtgggccaggattctgtcatgggtaaggtgagtcctctgctcagggtctcactaggctgaaatgaaggtgtcagtgggggctgcaatcttatctgagattatcttagctgaggtcctcttccaagcccattcaagttgttggcagaattcaatttcttgcaattctaggatggggtcctcattttcttgctggctgttacctgggactctaagctcctagaaacccttcctcagttcgtagtgagagggccctctcacagcatggcacctcacttcaaagtcagcaggagaatctcagtcagtgggctctgacagagtctcatatattatgcagtgtaatcaagggagtggcatcccatcatactcgcaggtcccacccacattcaaggggagaggattatacagggtatgtagaccagggattgggaatctggggggctcaatttagaattatgcctcccacaccaattctccattttgttagttttctggttttggtgttatgacacactgataagtaaagataagttgtaagatatcacaaataatctgttatcaataaagtactggaatttatcattttcttctaataggaagagatttgcggttatcctttaaatgatgtcattcccttttgctgctctcttgaagggaatagaaatggatggagttgctatagcccccctgtagtaggcccccaagatatccatgtcttaattcctgaaacctgtggctattaccttatatggcaaaagggattttgcagatgtgatcaaataaaggatcttgagatgggagattttcctggattatctgggtgggccttaaatgtcatcacaaatgttcttgtgagagcgaggcacagggagggagatttgactacagaaggaggagatgtgacaatgggggcaggaagttggaatgacacgaggaagggatcatgagcagccttcagaagcagaacagcaaggaaacagattctcccctagagctgccaaaggaactggctctgctgacgccttgactttagctcaatgaaactgattttggacttctgccctccagaactgttagagaataaatgtgtgttgttttaagccatgaaatttgtggttaacttgttttttagcagtcctaggaaactaccctttaataactgtgtttacttctagatatactaatgggacaccaccaccccacatctatgatgtctacattttaaaaaaaatatgcactgagactatttggggataaagttggaagaggtcaaacaaaatggggaatatttctaaggatcaaatgtgattggggtaaaggattaatattgtgctattgcaaagagacagtaggcctttgaacaagagttcaaaataaataataaaataataaataattgagagaaacaaaagaatgaagggattaaaaagggaacaaaatgtgaggaaatgaagatgaggagaagagagaagaaaaaaataaggaatggagaagtacaatttggccacagatgtgctctgtaaacagcttgtgacaagtggctcttgtctgggaggattgatggctcagggctgcacctctgggagctgagacacctgcccgaggtcggcatcatgacaaagctgtttcttctccacagctcggtagcgatgtcatgagcaccttgccattgcctcttgtggcttcaactgctgtgtctgggactccagatccaagaatctctgccttcttttaaaatagtttgatggaggaaaagatatagggtattttttatttcacctaacctaagtattttccaaaatacccatgatagagtcctttttaaagtaaaatgatggaccctaaaatagcaaaataaaaagctcaccacagtgttcttttttttttttttttttttttaaaaagcagttgtgggaatgaaggacagtgctgccacttgaacagaatgcagaggggagtgtatacacagtgcttttggaaactcagatgtctcagaaaatgttctgtaggactaagcacttatttgggggaatttttttttttttttgagacagaattttgctcttgttgcctaggctgtatttgggggatttcttacttcactagcaagcccatttcccatttccggtgacctcagactcttttatgaagccagacctgttacctcatcggacaggtcattcaggtgaatttcaggtatctgcagaggacagacactggcctggctcctgccccttcgtatgggcacaacactgtccaggtagcccctgcacaaggactggaagctgatggttactgagattttggtctgtcccccacatttcattgtaaccgctgggttaatgggctaatgttagcactaattaaagatgtctctcttaaagcctttatcctgagcattcctaaaagtccaataaaaaaacccacagcaagtgttttggcaaagtagttctaaaaatgactgtatgcataaagcattggtttgtctttgagtgacctctttgactgacctagataccatgattagccatgtgccagttccagggaagatgtgcccaagttgctaattcctacttcgtatctcatttgtatgtcttactaaaatcagaagatcccccttctgccctgctttcatttagaagctgcctgatactcacagtcagcatggggaccctgcttgtttttaggctggtttatggactgcctttgttgagaaaaaccactctgctgcctgtattctgatcacatcaccaatcacattgctcctgaccatcagtcacatttgtcaaaaaagtgacaaggactccaagagcctggagaaacccatttgtgggtggctgttcgtgatcccagacttttgttctgctgctagcttcctgctcctgctttctccttgcaccagtgtaaaactcagttcattcattcctggtgccctttgcacttagctatctcttaatgatggtagaaggtccttccagccccccatcccacttatctagtaagatgtcatttattatcttaacaggtggcatcatggcttaggctttggttggatcagcctgagaaaatagctggaatccaggtaataatataaacattgaaagagacttcaaacctcatgtaaaatcttgccctccagccactcaaactgtctcctattccaaaatacttgagcagagttgctgtagttcacatccctcatcatagatggtcctgagcagtctagatggtggtcgggatactctgggccccactctgccttagccttgtgtccactcctcacttcactcttttcctcttttctctcctgtcagtttgacctcataaatatgcctccaggatctgctctttctccgctgtttactcacgtcttggggagaggtgctaactagatttctgtccctcctgtctcttgctcctccagttctaaaatcctccccaccccgcatctgctgatttcactcagccacctaaaatcctcctttggccctgagtagcctccagcgtgaggttcaaaccctggggcctttgaggcgtttcccagctggcttgcccctcacctcccctcctgccagccatgactttggcatttcctggccagctgtgcatttcccgatgtccttctctgtgtgtctgctgtcttctctcccatccttctctgcctaacttattcttattgtccacatttggaatctcaacccccagtttgagtccagttttccttttctgtggtcccattgcaccttctagcagagtccttaaactggacacagcatcatggtggtagagtcagttggccttggccccactacacatgtagcccatgtattatgggactgattggtatcagccggcatgaacacctgtaaattcgttttgcactttatagcttcatctcaggacatcacctgccaccttcctctctactctcagagtaagaaccatcttcctaaaattaatctttcacttggattctggactcctcatgactttgtgccacatgttgattatacctcatatgaattctctttctcctctctggatgcctgcccacacctcaggtttccattctttccttctctctgtcccttgcttgatcctgctgtaccctcttgttccctcagttttagaacacgggcaccactactcactccaccttgctccccctttgtatgctttccaatctgacttttggacagtccaccttcctcatatgtttcagtgatttatttcttcacacatttatggtatcatttaaaatagtacatttaaaaagttcaactttattttagattcggggatacacatgcaggtttgttacacaggtgttttgtgtgatgcttacatttttgaaaatatttttcaaagtaagaattatcacatttctgagttggtacttttatacatatatttttctcttagagtatcttggttcttagaacattaatatactcacttaaaaaatcctataatatacttaaattagtttcaaaattgctactgacagtaatcctactagtgaagtttgctatttcttactatccattttgtccttagactatatattgacaaggatgtacggtgttcaaaagtttcttgaaattattctttctttgtgtagttatgttactaatgtgagacaattacatttacttgtttttgttttgttcaatcatagggtctgtttttccccattttagtttaatgtaatttattaaatatgttaaacatttactttgttcaaaatggagaagtatatcgagagggataattagaaaagtccagcctgtcctttccacagcatccaccccaccccttatagatatccactttccatacatttttaaatttatctttctggtatttcttttgcaaaaataagcaaatatgtagtatatatattcttattttccactttttcttatacaaaaaatagcataccatatattcttttctacacttttctttttcacttaacaatatgtcttggaaaaaatcctttcatatctactcacagagatcttgctcatccctttttatgattcacagaactccactgtgtgtatataatttatttaactggttccctcttggtggatatctgttttgtttccagtctttcaccgttacaactaatgctacaatgaataactatttcatatattgttttatttttgtcaaagtgtattttctagatgggttcatagaagtgggattgctgggtcaaagggaaaatgcatatgaaattttgttagatgttgccaatgcatatgtaaatttgttagatattttttccatagggtttaaagaaattggtggcagatggcactttgatatagtccttttttggtataaatttatggggtacagttgtaattttgttacacgcatagatcacatagtggtgaagtcaggtcttttagggtatccataatccaaataatgtacattgtacccattaaataatttttcatcatccatcctccttccacctcctcacccttctgggtctccattttctgtcattccatgctctacctccatgtgtacacattattaaactcgcacttataaggaagaacatatggtatttgtcattttgtgtctgatttgtttcacttaagatactgatctccagttccatccatgttgctgaagaagacatgatttcattgtattgtatggttgaataatattccattgtgtatatatgtaacattttctttattcatttatctgttaatggatacttaggttgattccatatctttgctattgtggatagtgctgtgataaacttatgggtacaggcatctttttgatataaggatctgttttcctttgggtagatacctagtagggggattgctggatcaaatgatagttctatttttaattctttgagaaattttcatattttttccatagaggttatactcatttaaattcccatcaatagtgtataagagtttccttttctctatgtccttgccaacatttgttattatttttttctttttaataatagccattcttgactggtgtaaggtgatatcttattgttgttttaatttgcatttctctgatgattagcaatgttgagcgttttttttttttttccacatgcctgctggccatttgtatgtcttcttttgaaaaatgtctattcatgctttttggtcactttttaatgggattattgggatttttttgttggattgtttgagttccttgtaaattctggatattagtcccctgtcagatgcatagtttacaaatattttttcccattctgcaggttgtctgttcactcttgattattttgctgtacagaagcttttttagttgggttaagtcccatttgtctatttttgtttttgttgtctgtacttttgaggtgttagtcgtgaattctttgtctagaccaatgtccagaagagtttttcctaggtttccttttttaagttttctgtcctcacaatctgttcccatttcctaggttttcttctagtatttttatagttcttaggtcttacgtttaagtctttaatccatcttgagttgatttttgtatatggtgagaaacaggggtccagtttcattcttctgcatatgccaatccaattttcccagcggcatttgttgaaaaggatttcctttccccagtgtatattcttgtcagttttgtcaaagatcagttgactgtaaatatatgactttatttctgggttctctgttctgatacagcccttttgatgtggtgacagtttaatgatctgttaaactttcaaccttaaaaaaagaataggtgaaacaaacatttgttagttcatctgagccttattccattgctggtcaggagtaggggatctgagtaccaagtggtaagaaagggggtcaaatcaggcagcatctggtaggaaaccactctatgtgacatagagtcacatatttaccacgcttttcagcttagtaggggttgttttgtatacctgtttattttctgagagttcaaaaattattcaagggaaagaatatttgaactatgatatgagcccatattctcaacaccagactgcagtggcaatcttacactcagtaatatacaagccttatattcaatacatagtcatgctttgcttaaccatggggatacattttgataaatgtgtcattaggcgatttcatcactgtgttaacaccatagagtgtacttaaaaaacctagatggtacagcctgctacgtacctaggctagattattacacagtggttaagtatttgtgtatctaacataaaaaggtagagtaaaattacagtttaaaagataaaaaatggtacacttgtatagagtacttaacatgaatggagcttgcaggactggaaatttctctgtgtgagttggtgagtgtgaaggcccaggacattactctacactactatagactttataaagactgtacacttaggctatgctaaatttatttttgaaatgttctttcttttaataataaattaataaattaaccttagcttactgtggctttttaaccttacaaacttttaaatgctttaaagcttttggattcttttgtaataacacttagcttaaaacacattgtatagctgtacaaattttttctttatatcgttattctatattctattttaaatagaaaaaattattttaaaaatttttattttttaaacttttaaactttttgttaaaaactaagacatacaggagatcaagactatcctggctaacacggtgaaaccccatctctactaaaaatacaaaaaaaaattagccaggcgtggtgatgtgcacctgtagtcccagctactccagaggctgaggcaggagaatggcatgaacccaggagaatggcatgaacccaggagtcggagcttgcagtgagccgagatcgcaccactgcacttctgggcaacagagcgagactctgtctcaaaaaaagaaaaaaaaaaaaaagaaaaactaagacataaacacacacattagttaggcctacacagaatcaagatcatcaatatcactctcttctaccaccacatcttgtcccataggaaggtcttcaggggcaataacaggcaaggagctgtcatctccaagataatggtgccttcttctggaatacttcctatagaacctgcctgtggttattttagtatatatatatatgagatacactctaaaataaagattaaaagtataatgtggtaaatacataagcaaaaagtaccatagtagtttattttcattatcaagtattatgtactgtgcataattgtacctgttatacttctatatgaatggcagtgcaggtttgttcacaccagcatcaccacaaacacatgaataatgcattgtgctatgactttaagatggctgtgatgtcactagaccactaggtgatagacatttttttagctctattataaccttatgggaccaccattgtatattcagtctgtcattgaccaaaacatgtttatttggcacatgactgtatttatagaattgttgcaagtgtgtgacctgaaactaactgtagtggtccactgacttttggaaaggattcttagaatctgtatgattttcacctctgtagtgtttatttacatgaaccagctcacatgccaacaaatgcatcaaaaagcctgcttttcctgatggggagactatcatcacttatttcatcaggtaggatatcatgtttaaaagttcttaccttatattcttacaggtaagctcaagctttttacacttttagcaaaattactcgtaatacacatttttcttttctttttctattccctataccttactgctcagaataaaacataaaattttgataattctgtttttagattgtaccagtaaaaatttaagtttaaacaaccaaacactgagagtggaaccaggagaagtgaattctcactccaagggcaaaggtagggccagaaatggggactaagccaagagggtcagcagttctagtcaggcaaccactagagtggcagtttctaaaggcctccggaggagaaaagggtcctacacaataacctagaacagagagggactcagccgtggtacttgggtatgtcatcttgttaaaaggcacaggattcatttgggctgataattcaacattgattctaaagacctgcaacagtcgtcttaagatttgctgtgcagctactgctttctttgtaaaacagacctttaacattttgatgagaaatttctgaattgaaatactagcaactctccagctggcagccagctgatgtctctctgatgtgaactgatgtcagatttcctgctgggcacactgtttatgtcactctttaagagtacagaatattaaatggagattgtcagaaatcctgaacaaaaaagaaagatttatcttgcaaagccaggttaaagatacaatttcttagacacatcaacactaaaatataggatttttttttttttgagatggagtctcgctctgtcaccaggctggagtgcagtggcatgatcttggcgcactgcaacctctgcctcctgggttcaagtgattctcctgcttcagcctccgggtagctgggactacaggtgcataccgctatgcccagctaatttttgtatttttagtggagacagggtttcaccatgttgatcagggtggtctcgatctcttgactttgtgatctgccagcctcggcctcccaaagtgctgggattacaggtgtgagccaccatgcccgggctaaactatagttttataattaaattatttcagacactctgcatattataagtaaagtagttcctaaaaagatctgccatgtttacgttatgtcatggttgataaactttgctagctgtcatattgtgtggcttttttctcttagataagtagggtgtttggaggctttccatctagagtttgttaactctagattgtttagtcaatcagcttggtgagacattggactcttaggatatttcagggatttatagttggtatgaacagagggcttgcagtcagtactatctcagaacctccattagtagtgtttctcttcttcagagtaattgatgctaattcttttaggctttccacctggtaccaccttcccaaatggagccagtgagtgggcattccaaggcgcccagcaccatattaattgagaatggaacttacgtttcattttcaggtaggtatcagtatcgggaaagttgtaaaaaccagaatgtaagtactcacagaagagcaaagtcaatcaggctcttcatgactcggagtagcgtcagcctaaaatcctcatcggcaagcaggtctaagttagcttctcctatccatactagggtaagcctgtgttatgagccttcaggtctcttttatttccctgatttagccaatcatgggatgtatagtcgatgacttaaaaatgattataaactaaggcattttctcaacagacactctaaaattacagctaacagagggagtagaagctggaggaaaaaacacatgattgggaatatttgccattgacactgtgtatgatgcaagaaggccattgaactcccctagaaactgaaagcagtcagccttgcttctgttctcctttgcaggagacatggagaatgcacaaagggtatgcacttccagtgccctgggcaggggaggaatgtgctttttcccagcatcgatgatgctagagaagctgtttcttggctaaggatagcctgaagctcatcagcctgaaccccggcctttaccaggacttgaaacatttatttaaaaatcctctgtctacattctttgcattgcccatcctctcatccactaatgaaaagcatgtattcacaccattgttaattcattcatatggatagactttttttattactctagtattgttttcagtagattatcaccttgaaatctgagggccaaggaattaatacaagtggcctatatgttgagtttgaataatttctgtaatttgaagaagtaacaatggcttttttttttttgatttaagccttttttattgtggcaaaaaaaacacatgccacatatttaccatcttaaccatttttaagtatgtagttcagtagtgttaattatatgcacattgttgtacagccagtctccataactcttcatcttgcaaaactgaaactctacacccattaaacaactccccttttctccctcaccccagccgccgttaaccacccatctactttctgtctctacgaatttgactactttaggtacctcatataagtgggatcatacagtatttgcctttgtgtgactggccgattttacttggtataatatcttcaaggttgatccatgttgtgggattgctagatcatatggtagctctacttttaattttttgagaaatcttcatactgttttccatagcagcttgcaccattttacattcccaccaacagtgcacaaaggttccaatttctctgcatccttgccaatactttatttttgttttgtttttttttttttcacagtggccatcctaatggacatgaggtgatagctcattatggttttaatttgcaattctctgatgattagtggtgttggacatctttttatgtgcttgttagccatttgtatatcctctttggagaaatgtctacacaagtccttttcctttttttaatcaggttatttttgttgttgtgttgttaggaattttttatatattctggatatacatataacatatatacatacatgttactttttcctcagatataccttttttcagtgttcattcctatattacgattctattctttcttaaacatctttgatcattttaaatatactcattttataatcttttaaagatttttctatcctagtttttgggtgccagttttcacatttcttgtgtctgctgattctcatgatgatttgttttctcacaaaatttgtattttgtggccaggtgtggtggctaacacctgtaatcccagtgttttgggaggcccaggtgggtggaccacctgaggtcaggaattcaagatcagcctggccaacatggtgaaaccctgtctctactaaaaatataaaaattagctggtcatggtggcatgtacctgtaatcccagctactcaggagtctgaggcaggagagtctcttgaacctgagaggtggaggctgcagtgagccaagatcataccactgcactccagcctgggcaacagggtgacactccatctcaaaaaaaagaaaaaaaaagaatttgtattttgtttttaattgtgagttattatcctttttttctcactctgtcacctgagctggagtacaatggtgtgatcactgctcactgcagccttgacttcctgggccccagtgatcctccctcttcagcttcccaagtagctgggactacatgtgtgcaccaccacacccagctgattttttgatttgtaaaaacaaagtctcatcatgttgcccaggctggtctcaaattcctggcctcaagtgattctccctccttggcctcccaaagtgctgaaattacaggcatgagctgctctgcccagcccttcaatggtattttttttttctgtaggaattcagtgcattctgagttgcaatctttcatagaacagttttgtattcatttctgccaaagcctcagggattccacaaattcaggactaaattttatatttcttgatttgggattcccatattatgcttggtgcaatattggattttatttctaacagaatttctcttcctacccagaccttctgtcttcttgcttgctttttttctgccagtaagcaccgtttttctagttcccttttcagactggtcaaccttgcttgggtcatagcttcatccaggtgtctcatttccagctcccagatttcctcttcctccacataagcatgaaaaccctggcccccaggtcttatggcctgtgtagagctggagatttcagtactggcttagagtttccttttttttcttttttctttctttctttttttttttttttggagaaggagtctcacactcttgcccaggctggagtgcagtggcgccatctcggctcactgcaagctccacctcccaggttcacgccattctcctgcctcagcctcctgagtagctgggactacaggtgcccgccaccatgcccggctaatttttttttgtatttttagtagagacggggtttcaccatgttaggcaggatggtcttgatctcctgaccttgtgatccgcccgccttggccttccaaagtgctgggattacaggcacaagccaccgcgccctgccctttttttttcttttttgagacaatgtcttgccttgtcacccaggcttgtgtgcagtggtgcaatcacggctcactgcagcctggacctccctggctcaagtgatcctcccacctcatctttccgagtagctgggactacagacatgcaccaccacaccccactaatttatgtattttttatagagatggggttttgctgtattgcccaggctggtctctaacttctgggctcaagcagtcctcaacctcccaaagtgctgggattgcaggcatgagccactgtgcccagccgtatttcctttttaaggctttcacttttgttttctttcaggctcagtgattcagtattattattttttattgtgtcatttgtgtatgtttgtatttggggcagggggaagtaagggttgggttaatgagtttgccctgctgccagaacaggaagccaacctaaattccctctctgaacattcatggactttgacattcatcaagattttgtccactgctcctttttatcctacctttttctggattatctcatacacacccatggctttgcttacttgcatatgctgcttatttcacatctatgtgagctatatacagttagacagctttccccaaactcaaccaataaatatatatggaatgcctactgtgcactggaatcttccccaaactcaaccagtaaagacatatggaatgcctactgtgcaccggaatcttccccaaactcaaccaataaatacatatggaatgcctactgtgtactggaatcttccaaaaactcaataaatacatatggaacacctactgagtactagatattgcagatctaacaatgaacaagtcatagtccatgtttggtagccagtctccaagatggcttccaatccgcccatctccaatgtattcatcccattgagtgtgattagacttagtgacccacttctaatcaatagaataaggcagtatgtgacttggagactaggtcttaaaagacattgcggcattattatcttgccttttcttggatcagtgtctctgggagaagtcagctgccatgtgttcagacagccctgtgaaaaggttcacctggcaggaactgaggcatcttgccaacagccatgtgggtgaacagagcatcctccagcccgttaaccttcagatgactgcagccatgccccatagcttgaccatagtctcctgagagacgctgagccagaccaccagcccaactactcttgtattcctgacttacccatcatacatagttgttgtttgaagctgccaagttttgatgtaatttgttatgcagcagtagataactaatatactgtctaaagattatatttgtatgagggatagacagtaagcaaataaatgacataattgaggaaagtagtgagtgttgtgaagaaaacaaagcagcgtatggtaaaggtgtgtggctattttggataggattgtcagaatgtgctttgtttggcctgcacagtatgttttgaggaactttaattccagaccctttagattgggcatgcctccatgtccagatgttgaccagagaggtggcatactgctgtcgttttgagcatggttctggaatcaattgcctgggtttgaatcttgtctccttcacttactagctaggtgatattggtcaagtgatatatttttctgaatttgtttcggcatcttaaaatgcaatgaataatgatatctactcttatggttgttttgaggttaaatgaatttacatatgtaaggtggttagaacatagcactgcagtcttagtaagtttagtaagtgttactgtgttattgctgttaatttcctggataatccaggtacttcctccccaaacttaactgtctttatttgatcagagtttttggttgcaaacagcagaatccactttgctcagctgatgggtattttattagaggatatttggcaactcacagaatcttagagatggccacataactcaactgagttactaaacagaaacaatacagccaaaagtgcagcccagaaaatccccagccacactattctagtggcctttataatgctggggcttggatgccagaaattctgccacagctgcttgcgagaaccaaaactcctgctgctgtgctcaccagaggctccactcttcccacaggaagaggaaatcacgcctctgtacactagtggcaggggatgcttgggaaatacatgatctctaagctctgcaattattcctaaacatagtgtagcattttaggtgggctgtgaattgacgagaaataggaccagggcttatttgaattcctcatgccttcactatagttgggacacacaagacgaaattggggaaagagtaaaatggggaatgtggcttctttattggaaggttcttcatgcatagttttggagttttggagtaaaatagcattggcgatgtactttgtcattgtaatacatggagaaaatagtattcttttagcaggtactatgaaaattccttctgggaaagactcatctttgttaagagagttctttgatgagttggcataataagaccctttgggacaagtttcaaggtttccaaggagagaatgaattacttttttttttttttttgagacagggtctcactctgttacccaggctggagtgcaggggcatgatcatagctgactgcagccttgaactccttggctcaggtgattctctcacctcagcctcccaagtagctgggatcaccggtgtgcaccaccacacccagctaattattatttttttagagactaggggtgtggtggggggatgtcttactatgtttcccaggctggtcttgaactattggcctcaagtgatcctcccaccgcaggctcccaaggtgtttggattacaggtatgagccactgtgcctggcttgatttacttctgagtgggaggggaaccaagggaggagaggggagaatgaccacaacaggagacactgttgagtcttcctctatgtgactgatttctatgctccctaccaagatttcagagaagtaaccccaaatcacagaactcttggtatgggctagatttttgttattattttattttgttttattggagatcagtaaagagaaactaagactatgtcagggaacaagatagagtgagcacaaatggctacagaccctgagattctaaattcataggacatgattcatagaagtcttaggtaatactttggagttttctacaccataaaagtaaggggttcaaggaaatttccactccttatgatatagtattagagaggccctggacaccattttggttatataatcatctaaaggagctgattcaaacctcaaacaaattgcctaatctttggaaagagacactggaatgagaagacatctgagattttcttttgggctagagtttacatcacaggtcctgattgccttgggagaaccttattgtctggggatccttattgtctgctttcctgagcaactcaggaaagtcttgctctgggcagtgctctgagattgggttagtcagaagcatcagacttttgaatgtattacagactctccctccctttccctcaatagtttcctggtggcaaatatggaaggatgtatagtagactcattttgtaggcaacttgacctcagtttactgtgtcaaatacaagttaaggaaataaaaacttcagtcttcacctagagttaaataataataataataattatgatgatgataattgtaaggctaacatttttaaggctctgagctatgcattttatatacccttattgaacagaaaactcttgagcaggatttaacaacctgacactattgacattctgggaccagataattttttgttgttgggggatgtcttgtgctttgtgaggatgtttataatagcatccctggcctctgtcttctaggtgcaagtagcactcctgctcccagctatgacaaccaaaaatgtctccttacattgccaaatgttcccagggggacaaaatcacttctgattgagagccactattctagaggagaaagaaatctttctgttcattgatttaataggtattttaaaaaattatgttaaaatataacataaaagttaccatcttaaccatttcaagtgtatagctcagtagtgttaactatatgcgcattgttgtgcagctaatctccagaacttttcgtcttgcgaaactgcaactctacatccattgaacagcaactccccttttcctccttccccagctcctggaaaccaccaatctactttctgtctctatgaatttgactactttagatatctcatataagtggaatcatatttgtctttttgtgactggctgatttcacttggtataatgtcctcaaggttcatctatgttttaatatatgtcagaatttcttttcttaaggttgaataactttccactgtatgtatatatcatgttttctttatccattcatctgttgatggatgtttaggttgcttccacctcttggctattatgaacaatgctgcaatgaccatgagtgtgcaaatatctcttcaagattcagatttcagttcttttgtatatgtacccaaaaattagattgctggattatataatggttctattttttaattttttgaggaacctccatactgttttccatagcagcgatactattttacattgttatcaagagtgtacaagagttccaatttcttcacatcctcaccttgttattttctgtttttatattttttaatagtagttatcctaatgggtgtgaaggtaacaagaactttttgagtgcctattatgtgccaaatattactctagacattgtggatataatggtaagtaagacacacaaactgtgttcctaatgggtttatatttaaatatgtgccctaagttgcttttctgttagtaatgatagttttgagctgatattcatacatgcttttaaaatctgacacttaaaaatgtctgatgtagtatatacttgtggcatagctggttaggctaagaatacagcagtgtttgggcaagagagaaaggctaagagacccatctgggattcctctatgactttgcatttgcatcatattttaactgcctgagttgatgggtgtggactagttcactttgcaagtgagttattcagactcgttttcagattgttttgcaaaatcttagctcttgtgtaaggattagtttttgactcctacagttaaacagagtgctgaacttgacattttgaaacactagctaagattctagtacccagatggcaaattgcccatgtctggaatgttgtgttgagaaagattctgaggtcttatactgggctcagagggaaagagggctgttgtagattttcagtgtttgtcatgggtgagatagagggagtggtagtgtaggtgcactctaaggccatttggaaacccctcaaacaacaaatcactgccttcatgattttttccctgtttctcataatattacaattgagaaaattcatcattctttttttcttttctgggccagcaggaaacactagaccagaagaataagaccgtgaaagaaagggatatgtaggacctttccttcaggatatttcagtaggttattgttgccttgtgggctgaatctgattacatgtctttatgatactcctggggcacaataccaaaagcagactgttcaggagctgatagcagccaaggaagcacttacaatcaaaggtctaattaagggacaaagctggaaatctttttttggtcttggtctttagtcactatgacgttatataaacaaaacatatctcagacaaaagagatgactggaaatggcaacaaattcttcatgtgctaaaatatatgttgggaaaaaaagtgctactcgaagtctgtgttctgagaaaaccattttggtgcgtgaaattgcagtcgctatgacaaccaggggctgcagcccactgactcgcatttgtgaggaaaacaagagttgatgttaatggatgagaaccaagcattgccttaacagaaaagactgagttctggatgtgttcatttaagcgccagaccctcatcatgtgtctcagggcaaataagttttctaaggtcattcagtgatgtctaactaggtgaagcacccttgtctgacctcaggaagaaaacacctacatgagaacatcagtttgagtggaaaaaaatatttcaagtagacagtttgttgacagcttcagggtaagcaaccccatcttgctctggtattaaaattcttgaaaaaatgatggaattgagagtttgtgactcagcagtactttcttgtttttggactttttaggcttatgttttcttcatagattttattcaaagtactgtagcctgtgtgaaaccttgaaagctcttcatgtgtaggggcaatgagttacatccaaattttgaatgtttttaaagaagaggataaactaattgaacaatcccaaatgttttaaatcttaaatctcaaatgtttctgtagaacaaaattgtccttatctcagtaaatgatggcattatctgtctgacagttgttcaagtaagaaacgtagaggtcattttcaactttgtctttcgttcttcacagctaatttatcaacaaacattgttgattctgcctcactatatgtcccgtatctacttcttcttttttcaacttccagcatgttagttctagcatggtcatctcttgcctggataacttcgtgttttcctaataggtctttcttttgccactattgttttttgtttttttgtttttttaatcattcattctccccacagctgacaggatgatttttttatttttaaattaaacattttattttgagctaactatagattgacatgcagatgtaagaaatagtacagatcccatgtactcttaacccaatgtcccccgatggtaacattttgcattattgtagtacaatatcacagccaggatattgacattgataggtcaagacacagatgtttccatcaccacaaggagccttctgttgcccttttataaccacacctacttcccttccacactaccctctctttaaccctctccttaacccctagcaaccaccaatctgttctccatttctatgatttttgtctttgcaagaatgttatatggttagaatcataccatatgtatgtggaacttctagcattattttgaaaaagggtattggtaatggatatccttgaattgttcccagtcctggggagaaagcattcagtctttcaccatcaagtatagtcatgtgcttagcaaagctcagtcagcgatggaccacatatatgatggtggcccctttagatgatagctgaaaaatttttaatccctagtgacattgtagtcattgtaatgccatagtgcaatcactcactttgtttttaaaataaatttagtgtagcccaagtatataatgtttgtaaagtctacaataagcatcatgtcttaggccttcacattcactcactgcttacctactgactcacccagagaaacttctagtcctgcagactccattcagggtaagtgccctatacaagtgtaccattttaaaaatcttttataccatatttttaccataccttttccatgtttagacatgcaaatatttacaattgcctttcagtattcagtacagtgacatcctgtacaggtttgtagcctaggggcaataggctatatcatatagccgagttgtgtagtagactgtgccatctaggtttgtgcaagtatactctgtaatgttacacagtgatgaaattacctattgacacctttctcagaatgaatctctgtcattaagtgatgcctgaccgtataatgttagctattggtgttctgtaaatgtttatcacgtttaggaagtttccctctcttcccatttttctgagtttttgtatgaataggtgttaaaatttgtcatgtgcttcttcttcattgattgacctaattgtgattttcttctttagtgtgttaatagagtagattatattgattgattttcaaatgttgaaagcaggcttgggaatggtgtataattattttaaagtattgttgaattctattagctaatctttcgttaagactttttgtgtaactattcatgagggatattggtctgtactcttttgtactttctttgattttggtatcagtgttatactagcttaataaaatgatgtgttcctttctcttctgttttttggaagagagtatgtggaattggtgttaattcttcttgaaacgtttagtagaattctccagtaacactatctggacctggagatttctttttgggggaagtgtttaacatattaaattgtcttaatagtgataggattgttcaaatgatctgtttcatattgagtgagctgtggtagcttatgtttttaaggaatagtcaaatttatgtgtgtatggttatttcgttattatgctcttgatgtctgcaggatccatatagctatcccgttttgtttctgatactagtagcctgtgtcttctctctctttgtctttgtcagtcttgctaggggacctatcaatttcattgatcttttcaaaggaccagttctttatttcactgatttttatctattgtttttctgatttaaatttccttgatttctactctttattatttcctctcttctgcttttttttcttttttttaggttttttttttttttactttgctttttttaggtttttgagttgggagcttatctgagacattttctcattcctaattataagcttttagtagtgtaaatttctctctcagcactgctttagctatgtcccacaaattttgataggttgtacatattttcatttttgttaagttcaacatattctttgacttatgttgaaacaccttttcagcgcatgaataatatagaaatatgttgtttagctttcaaatatttgaagatttttctgttgtctttcttttactaatttctagtttgattccattgtggttggagaacacactttgtatgatttcaatttttaaaaatgtattagggctattttatggccatagatatactttatcttgatatatatcttgtgggcatttgaaaataatgtatattctcctgttgctgggcggtatgttctataaatgtcaattagatattgttggttgatggtgttatggaattcttctctttccttgtagattttctgtctagttttatcagttgctgaaagaggggtggttgacatctccaactataactgtggatttatctaattctgctttcaattctaagttttcgcatcacacattttgttgtttgatgcatatacatttaggattactatatcttcttatttgattgacccttttatcactatatatgcctctctgtgtatctggtaattttctttgttctgaagtctattgatatggtttgactctgtgtccttacccaaatctcatgtcgaattgtaatccccagtgttggaagaggggcctggtgggaggtgattgaatcatgaaggtggtttgtaatggtttagcaccatctcccatgtgctgtcttatgatagagttctcatgagatctggttgtttgaaagtgtgtagcacctccccctttactctgtctcccactgactgtgtaaagatgtgcctgcctccccatcaccttcggccatgattgtaagtttcctgagaccttcccagaagcagaagcctgtacagcctgcagaactgtgaaccaattgaacctctttctttataagttatccagtcttgggtagttctttatagcagtgtgagaatggactaatacatctattttatctgatattaagataaccatgacttcttttttttttttttttttttttgagacagagtctcgctttgtcacccaggctggagtgcagtggtgtgatctcggttcactgcaacctccacatcccaggttcaaagaattctcatgcctcagcctcccaagtagctgggattacaggcacatgctaccatgcctggctaatttttgtatttttgtagagatggggtttcaccatgttagccaggctggccttgaactcctgaccttaagtgaggccctccttggcctcccaaagtgctgggattataggtgtgagccattgtgcccggcctcatgagttctttatgtttgcatgatacagctttttccatccttttactttcaacctgtatataacattatatttgaagtgagtctcttggagatagcgtgtagttggatcacatttcttgatcccctctgttaatctctttcttttaattgctgtatttggaccatttgcatttaatgtgattattgatatgttagggcttaagtctgctattttattttttgttttctgtttattctctcagctttttatttatttttcctgatttcctgtgggttacttgaacattttcctaagaattccattgttgttttttaatgaacctcctatattgctttcttagtggttgctctaggcaatctattaaacacatataacttatcacagtctgctggtgccattgctttaccagttcttggaatagaaactttttctccctttatgtccctttactctttccagttttttagttgttgtaactatttcctctatctgcatttagaaccacattagacagtgttacaattttttgcttcatttattaaacataatttagaaaacttgaggaaaaaaattatattttctgataattttaccatttctattatctttctttttctttctgatatcccagtattcctccttttataattttctttcttagagactttttgaaaaatcctttcttttagagtaggtctgcttctccttcattcctgaagaatattttcactggatattcaattctggcttgaaagctttctttcagcacgtgaaaaatgttgtgtcacttcttcctcacctgtatgatttctagtgagaaatctactttcattctagtttcttatccctaattggtaagatgtcatttctgtcgtgcttactattttcaaaagtttttttctttgtattagtttttattgtattgagttttagttggtgttttgtgataccactatgatagaagatgctttgttagtgtcaattgaggatagatgttcaggttccccatctggcctctgttgatatggaagaggagctgggtagcggtggcagttctagctctctgctaggcctctactgatgcctgttaccatcctttcttcaaagttaaactataaactaaattcctctcatggttagcttggcctatgcccaggaatgagtgaggatagctagcctgtgaggctagaagcaagatcgagtcagtcatgctagacttctcttgctgtcataatctttgcaaaggtggtttcatctctactttcagagtcttctcatgtttgttgtatataatgcccagagttttaaatggtaccttagtgggacaaatagggaaaagtatatctactccattttcacagatgtagaagtccagaacgatattttcaaaaagtaaaatgttgctctcctgtttgaaacccttcagtggctttgattatactgagagtgaaggctcatctgtggcccacagggcacaaccttgtcataacttcttttctgtcctttgcctcatgcttttctcctgttttctcactttgcttcaggtacattggcctttttaaaattaacattctcaacaaaaatacattaagactctattatgtttcagttactggtctaggcctcaggatgtaggcacaaagttcctgctctctagagcttacgtagtttctgtttctagaacaccaagctcgtttatgcttcagggcttgcactttctgatatactgtttgcccagctctctcccgcttactaaggtctcaattcaaatatctcctcagacagacctgcccttcccacctgcagcagggttttcgcccttggcttatatgttggaatcaccaggggagcgttaacagatcccaaagcccagttttaccccagactaaattaaatcaagcgtctgagtgtggcccaggcatcagtgtttttaaagctttaaagggggttccagtggacagccatggtacttaagagccacttaaggttatctagtagtactgccgctccttttctttatctcttcttatcactacctgaaattcatttcttcatttgttaactccttagttttcctctattttctagaccttatctagtagataaagtgagtttaaactccttaaatggaacacttagttgcttatttgcaataattgtgtttctgctttagattctggagactgagatttatatgagagcaaggacttcatgtgaattgatctctgtgagctcttggtttaaaagtacccctcaagggctctgagttttctgttttcgaacccaaccttatgggcctgaacctgggcctggcctaggtaggaatagcctctcagtgagtgctgtcctggccagaattcttcttcctcctctgagagccttttgcctggccaagccctgacacctctgtctgaagtctccatggtgttgcctccctggtgccggtaacacctatgctctgaggagctggctcttgagatacggttagaactgggagtaggggacccttttatcttggtttgccctggattttcttagtttcatccttgaaagtcctacatcctactaactttcccagtcctggacaaaccaggatggttggtcaccctaggagagtctgagagtcacctcagtaccttttctggttggatgtcaggagggaagaggttgaggggacatttaagtggttcacgatcagtgttgggctgcccaggtttgattcttcaaagccttgtactgttgaggccttgttagaacgtgtgctctgtaaggtagcaaacccaggaaaagtatgggcacttatagggcctggatctatgtagcctataggttcttgccccaaattctcacctgatctatttttttttttcagtaggcggtgggggcagacggggttgggggctcccattaggtcctcggaacagattgaaagaagatttcttgatctcttttcaggggtcctcttggctgatcctgtgactgtggtgagaaccatggaacactgtctaaccgtggtttggattctggggtagatgaatagctaaactgatagctatataatgtagattgaggataaatacatattttacagcaggatttccagatgtgtggttggaaactaccttttcaagaccgtctgggagcatattaaatacagattcctaggccaaacccccttagattatgaatcagcatgtttgaggtggggaccaggaaactatatttttacaagcaccccatgtaatattcatgaatccggacatttgaggaccactgttcttgtggtgatgtccggaggatatcaggggaattttgtatctgattttagtttttgttgaaaggggcatggagaaaactatttgggactttgaagagttttattttatattattctactaattgtgtggcattaaggtttgggtgagatttagaacgctagtagcaatcctcttgacactttataaagcctgttctttctacctttagtagtagagagagaacttgggtggaaagtgacaaataatattgtcgtagcagtttaacagatttttctctaagctttataggcctcccctaggactgaagaggaaattaaatgagggaagtgagtcaaaatcacatagaaaagaagatagcacttgttgcctgcattctgaaagtgggataaattcccacgagatctttaagctatattttgttgaagtcagcatttttctctgttaagtgcacctgctgccatcaaatgtctagtattctaaaataatatctattctagagagagatttattgtattataaacccagatgacatcttagctgggaatgtggctttctttcctacctcaggcatagctatgcctgtgtaatctcttacactggcagagagtactattgatctgtcaatcaactggcatgttcaacctccagatgtgggctcacttgcaaaatgcaattctgggagtagctgtttgagttattgtaactgggactgatctgggcctcttttgaagggtatgctgcagtcgatagcaattttcattgtcttggtgtatggggtgtgagtgtctggataataggtctgcaggatagtaaaaataatgattttttcttgattataagttacctttgaaatacatatgattgaggccattttgtactatcttttgtgccctacttggaggacatcagcctcttcacattcttctccccactacaagtatttctaggacttgcatgggacattacacacatgctctcaaaagtctagattcccacatgacagccactcttatttcctcttctgcttcaaccagcaggctatcataccatgtctactggccaccatgactcttccctcctgcccagtactcatgcacaaagcacaaaagaaagctccccccaccacttttttttttttaatagtgtgaatccagtgctgcttttagtgttgttggtgacagcctcttctctttgagtatgattccaagaagttgctgagctggggatgaaacccacagggtgatggctttctgtattcagaatctgaagtctgtcctaggcaagtcctgtcatgcctggctttccttcctccagagcaagttctccctcagccccttgtacagacttttggtgggcctacctcactgtattagtccattcaggctgctataacaaaataccataaactaggtggcttgtaaacaacagaaatttatttctcatagttctagaggcacggaagtctaagatcagtgtctgatcttagaggcagattcagtgtctgatgagagcccatgtcctgcttcatagatggccagaatgtcttttcactgtgtctctttatggtggaaaggggaagggaccccttttgggcttctttttataagagtactaatcccattcatgaggactctgcccaaatgacctaatcacctctcaaaggccccacctccaaataccttcacactgggttctgtgttttggctctgtgtccccacccaaatctcatgtggaattataatcccagtgttggaggaggggcctgttgggaggtgattggatcatggggtggtttctaatggtttagcaccatccgcctaatgctgtcttgtgacagagttctcccaagatctggttgtctgaaagagtgtgcagcactccccacttcactctctcttcctcttgctcctaccctgtaaaatatgctggcttcccctttgccttctgtcgtgcttgtaagtttcctgaggcctctccagccatgcctcctatacagcctgtggaactgtgtgccaattaaacctcttttctttataaattacccagtctcaggtagttcttgatagcaatgtgagaatggactaataaactggggattagctttcaacatatgaatttttgggagagggggacacagacgttcagactatagcactcatcattagtgagatgagctcaaaaggggccccctcagtgggttcagtgtagtctccaactgggatccctactgagagctttaatcttaatgtattaagttgcaaagctaccatgtgtgtaggattataactactgactatatgttggagacaaaaaagccattgtaatatgtctgccaaagtttataagtaagccacatttggtcatgtagcctcgtaaacctatcattttgtcaaaatgatcagaagttatattagtttcctgggctgctgtatcaaagtaccataaactgggtggcttaacacaacagaaatttattatctcacagttctgtaggcgagaagtctgaaatcaatgttggcaggaccacgctgtccctgaaacctgtgggggaacccttccttgcccattcctcacttctggtggtttgctggcaatctctggcattcctcagcttatagatgcatcactctagtcctgtctttacaagaccttcttcctgtgggtcttcctgtcatcttccctgtgtgtgtctgtctctgcggacaaatctccccttttttataaggacaccagtcatattggattagggcccaccataattctctcattattacttgatttgctctacaaagaccgtatttccaagccacattctgagatactgaggacttcaatgtattttttggggtggggtggggtggggacacaattcaacttataacagaagtgtatgtgaaatgctcagcatagagcctcacacctagacatcatcaatatgtattggtcgttattatgaccattgtcaagccttaatgggcaagggacagctagctagcaggattcatccttaataattgcagccatattcacaatctagttataagtgttaaatgatcaactacagttcctttcagggctaagtggtagttgggtaaaaatgaggttttaaggacagctgcatgaggacccagggcagcagagagctggggaaacaacaggtaattttaagccagaggatctggagtcaagttcaggttccattaattactatgtgatcatgtgcaaatcatatggctttctttttctgtttcctcagggggcaactagtaatacctgcctcaaattcagatcaacaaaaatgtattaccacacattaaatgataggatacatgtaaaatacttggtaaatattaaaatggattgcccttccaacttcctcatgggctatttttttaaatttttttctgtggttttatttctgtaatattttaagtcagattccttatttaaaatctgaaatggttagatctgtatttaaggttacaatcgacttggttcttacattgacaatgtcaaatatgtctatcttactacccttcttttttattattgttatacttcaagttctagggtacatgtgcacaacgtgcaggtttgttacatatgtatacatgtgccatattggtgtgctgcacccattaactcgtcatttacattaggtatatctcctaatgctatccctccccgctacccccaccccatgacaggctctggtgtgtgatgttccccaccctgtgtccaagtgttctcattgttcaattcccgcctatgagtgagaacatgcggtgtttggttttctgtccttgcaatagtttgctcagaatgatggtttccagcttcatccatgtccctacaaaggacatgaactcatccttttttatggctgcatagaattccatggtgtatatgtatcacattttcttaatctagtctatcattgatggacatttgggttggttccaggtctttggcattgtgaatagtgccacaataaacatacgtgtgcatgtgtctttacagcagcatgatttataatcctttgggtatatacccagtcatgggattactggttcaaatggtatttctagttccagatccttgaggaattgccacactgtcttccacgatggttgaactaatttactctcccaccagtagtgtgaaagcattcctatttctccacatcctctccagcatctgttgtttcctgactttttaatgatcgccattctaactggagtgagatagtatctcattgtggttttgatttgcatttctctaatgacgaccagtgatggtgagctttttttcatatgtttgttggccacataaatgtcttcttttgaaaagtgtctgttcatatccttcacccactttttgatggggttgtttgattttttcttgtaaatttgtttgagttctttgtagattctggatattagccctttgtcagatgggtagattataaaaattttctcccattctgtaggttgcctgttcgctctgatggtggtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttgggtctaacatttaagcctttaatccatcttgaattaatttttgtataaggtgtgaggaagggattcagtttcagctttctacatatggctagccaattttcacagcaccatttattaaatagggaatcctttccccatttcttgtttttgacaggtttgtcgaagatcagatggttgtagatgtgtggtattatttctgaggtctctgttctgttctatatctctgttttggtaccagtaccaagctgttttggttactgtaacctagtagtatagtttgaagtcaggtagcgtgatgcctccagctttgttcttttggcttaggattgtcttggcaatatgggctcttttttggttccatatgaactttaaagtagttttttccaattctgtgaagaaagtcattggtagcttgatgaggatggcactgaatctataaattaccttgggcagtatggccgttttcacaatattgattcttcacaatgcttgtgatttttgcatgttgattttgtatcctgagactttgctgaagttgcttatcagcttaaggagattttgggctgagatgttggggttttctaaatatacaatcatgtcatctgcaaacagggacaatttgacttcctcttttcctgatagaataccctttatttctttctcctgcctgattgccctggccagaacttccaacactatgttgaataggagtggtgagagagggcatccccgttttgtgccagtttttgaagggaatgcttccagtttttgcccattcagtttgatactggctgtgggtttgtcataaatagctcttattattttgagatatgttccatcaatacctagtttattcagagtttttagcatgaagggctgttgaattttgtcaaaggccttttctgcatctattgagataatcatgtggtttttgtctttggttctgtttatatgctgggttatgtttattgatttgaatatattgaacccttatgggctattaatgtaaaacttcacgttttattaacaataattgcttctttagctgaagaaaaactgttttctttctttagactaattaagaatcagtaagtcatcttagaatttaaaactttgaaaatcttattttttcttcttttagtctacaatagtaagatgaaggctgagcagcaaaatacaatggaatgttttaagttttatctacatttgatttaagcaaatggggcatttattttgagggagcatcagaagatgaagtggaaaaggtcagattacttagagattcattttttagctttgtagatttaattctttagagtatcctacatttaaattgttgctttattgaaaaacccagcatatttgtccatatataaaaatattcagaatgcagaaacttaatgcatctatgacaacctaattttgttataagtcattagtcactcaatgagcaagcacctttttaaaattattacagcagctggtaccttttgacttttttttttttttttttttaattaatggagttggggtgttggtatgttgccaggctggtcttgaactactggcctcaaactatcctcctccctcagccacccaagtgctgggattacagacatgagccaccatgattggccagaacaagcgcatattaatcacctaccatgagccaagcactatgttgtactctggtgatgaaaagacaaagataaatactgttcttatccttgaagagttaatgagcttttggaggagttagtcttatgatcttatgagggccttacctcataaggttgtagttgagattaaatgagttaatgtatgtaagatgcctggcttgtaattattgcgcaataaatgttagctgctactactactactgttaccactactagtatcaccactactgtgctaagtgctgtgttaattaatgtaaacaaagtataatggagaaacagaagattaaatttgcatgggatctgtggaatcaaagaggtcttcatggagaaggtgacattggaaatggatccttaaagcttaaataggatttaccacgtatgtacaagaggcaagggaattcctacacaaaagaaagctatcaggtaaagacataagggagttggagtaaatggcacactcacagagtgagaggtgatccaggaagctagaacccaacctgcaatcatggtaggcagtggacagagagaatcttaggactgctggtcaggcacttatagtactgtgcaaaggaattgagattttatcctgtgagtagagaacaggcattggaggatttttattagaggactaaaaaagatgagttctggtctttaaaagatgactggcgaaaatggaaaagcttagaagagattcaagaccagactcccattaggcagtggatattgtgaaagtccttccctagactgataactcagctttttcttgttatcagtttgaatagacttcaacattttttaaagaattgactttacctcttcggcaccttcagttaattaccctctgtgtatgatgacttctggtattagtcagatgtccccatatataggatcagaaaaatatctagaacacattgatgtagttgaatgtaacactgcattattgttatttgccatgaatccagttgctcactgacaaacatttagtaagcatctccatgtgccaagtactgtttttgactcaaagaacaaggacatttccagaactaattttgttggttaacaaactaaaggggacccagagtaaagggttttccctttctccttctcttagaacaaatttatgtgaactttatagccctgtccccctagaagtctctctcagtctctttataaattttataaaaaagaagtgccttctgaagagtctgcctaaattaaggaggtgggtgtttgtgttggtccatttatgttgctataaaggaatacctgagactgggtaatttataaagaaaagagattatttggctcatggttctgcaggctgtacaagaagcatggtgccaacatctgcttctggggagggtggcaggaagcttccactcatgcaggaagacaaagaaggagcaggcatgtcacatggtgagagaggaagcaggagagagaggcagaggtgctaggctcttttaagcaaccagatatcatatgaactcaggggaaggtaccaagccatttatgagagatctgcccccatgacccaaacacctcctacaaggtcccacttccaacaatgggaatcacatttcagcatgagatttggagaagacagactgacaaacaatatcagtgttgatgacagtggccaagaccctggtatgttttccagtatcctttccactctttccagaacaatagaaacactctttttatatttacttatatatttgtttgtttgttttgagacaggtctcactctgttgcccaggctagagtgcagtggcacgatcttggctcactgccacctctgcctcccaggtttaagcaattcttgtgcctcagcctcctgagtagctgggattacaggcatgtgccaccatgcctggataatttttgtatttttattagagactgggttttgccatgttgaccaggctattatcgaactcctggcctcaagtgatctgccctcctgggcctcccagaatgctggggattacaggcatgagccaccatgtcaggcctgaaactctgtttttagatggacacattgttttccagaataaagacaggctccatggcaaccagtatggtcacatgactgatgcaaagtgtcacataagagtttcctgcagttttccttaaagacaggtgatactcactgccctttctccagcttcttcatcccttttccaccctaattcctgaaatacagatattttgctggagctctagcttccaccttagactctgagaatgggggcccagtattcgggatggtggaataatgagctataaagatgctgagaattttttggggcagagctcctataatcagtcctggactatctcttggatttttatatgagacagaaaaacttctttgtcttccttaagctgttattttatatttagcaaaattgaatcttttgctttttgttttttaataaaatttttaatttttattttttgtgagtacatagtaggtatatatatttatggggtacaagatattttggccgggcacagtggctcattcctgtaatcccagaaccttgggaggccgagccggtggatcatctgaggtcaggagttcgagaccagcctgaccaacatggagaaaccccatctctactaaaaaaatacaaaaattaaccgggcatggtggcacatgcctgtaatcccagctactcgggaggctgaagcaggagaattgcttgaacccaggaggcagaggttgtggtgagctgagattgcaccattgcactctagcctgggcaacaagagcgaaactctgtctcaaaataaaaaaaaagatattttgatataggcatacaatgtgtaatagtcacattagggtaagaggtatacattacctcaagccggtatcctttgtgttacaaacattccaatattactgtttttgttttttaaaatgtacaataaattattgactataatcacccattgtctatcagttactagatcttattcattctatttttgaccccattaattatccccacttttcctcagcccaccactgccctaaccagcctctgctaaccatcattctactctctatctccatgcgttcaattgttttagtttttagctcccacaaaaaagtgagaacatgtgaagtttgtttttctgtgcttggattacttcacttaacataatgacttccagtcccatacatgttgttgcaaatgataggatctccttcttttttaatggctaaatagtattccattgtgtatatgtatcacattttctttatcattcatctgttagtggacacttaggttgcttccaaatctttacccaaacctaatcttaagtggtataatgactctagggagatttcataacccttcttggaagcttattatagggcttgctcatccttaaaatattcctttttagttttaaaaaagtatctctgatgtaatctgttctgttttctcttttccaactctctgaaaatggaaaataattgattggcttctttctcataataaatcttcatggaatataatatttttaattcacattaattttatagcttttgtcaatcagtgggtttaaaactttttaaattggaaatattcagagctggattctttttcttcgtaagagatttgtctgtgctaggtttgggttctaattttgcctgtgatttgttattagggactacaacaagcttgctcttagcaaaatgaataaactactgaactgtgaaaggaggaaacatagaatgcacttataatatctgcggagaattaatagaaaatggactttctctctgtgtgtacatgtgtgtgagaaagaaaaagaatgtcatcaaagcagaacacttcatgtgtttaattgctgccctgtttcatggcttcctggggagcaggaggcacatctcaataggggagcaatgtcggcttcctctagtgcatgaaattggggccactgtctgaggtgccagactcatttctgcgccagctgtctttattctttgacttaattgggagaccgcaatcccagcaaaacagtcactaaaagcaacctttaagggaagtgtaattaaataaatattaggactttcctcagttttgtgctcatatcttcagtaatgtactgactcattttttaggaataacagctttattgacatgtaattcacttaccatacaaatcactgctgtttgttgtatgattcactggtttttagcatatttacaaagttgtgtaaccattactaaaatcattttcagatgttttcataactccagaaagatactgtcttctcattagtatccacatgtccccccaagttcccttcgccctcagccctaagcaatcatgaatctactctctgtttctaaggatttgtctatcctggacatatacaaatggaattgtacaatatgtggccttttgttactgacttctttatttagcatgatgtttttgaggttcatccatgttgtagtatgtatcagcacatcattcttttttattccttttaatatttcattgtatgattataccatattttctttgtccattcatctcttgatgaacatttgagttgtttctgctctttggctattatgaagagggctgctatgaacatttttgtacaagtttctatgtggacatgttttcctttttcttggatatgtatacttgggagtggaattgccgtatgtgtgggaggcagcagaataatgctcccaaccccactctctcccaaagatgttcattccctagtccttggaacccatgaatatgttaagtctcatggtaaatggacatgaagttaagtgtgcagatgaaattaagctgctaatcaactcaccttaaaatacagagattattctagatcatctgagtgtgcccttagtgtaatccaaagtgtccttaaaagatagaagatggaggcagaaagtgccagagtcatgcactgtgattaatacttgaccagccattttggctttgaagatggaaggaaccacaagtcaaggaacagggacaccctctaaaacaagtttgcccaacctgtggcccctgagctgcacgtagccaaggatggctttgaatgtagcccaacacaaatttgtaaactttcttaagacattataagatttgtgtgtgtgtgtgtgtgtgtgtgtgtgtgtgtgtttagctcatcagctatcattagcgttagcatgttttatgtgtggcccaagacaatttttcttccagtctggcccagggaagtgaaaatattggacacccttgctctagaagctggaagaaacaagaaaatggattttcccctagaacccccggaaggaacatagacctgctgagaccttgattatagcctttggagaatcactttggacttttgaccaccagaactgtaatataataattttgtgttgttttaatcagcaagtttgcggtaatttgttacagcagcaattggaaacaaatatactgaatcacatgggaactctatgtttaaccttttgaggaactgtcagaatgtttcctaaagcggctgccccattttgcattcccaccagcagtctatgagggttccaatttctctacatgctcaccagcacttgttattatctgtctttttgattatagctatcctagtaggtgtgaagtggtttatcattgtggttttgatttgcatttatctaatggctaatgatgctgagcttcttttcatgtgcttattggccatttgtatgtcttctttggagaaatgtctgttcagatcctttgcccccttcattgcactggaacatggtgtgtgtgtgtgtgtgtgtgtgtgtgtgtgtgcatgcacatgtgtgtgatattagagggagcaggaccaattctgggacagttcatgaagagccttgtataccatgcaccagggatttgggataaaatactgagagtgataagggaagtcaatgacggatataaagtcaggcttcctgatcaattctgtattttaggaaacattctgaggagccagtggaggatacggagggctgatggaaggaggagacagaggactagtggctgagagatattgggccactggagggatgcaatcaagaaattacgaggtttgaaaccagggctgtggtggtagggcagagaagagtttacagattgaaggattttaggggagataatcaaatctacagtattttgttggatgtgagggtttaagagcaaaagtagcttgagaaaatcctagatatctggtttgggccattgagtggaaggaggtacattttatggacatagagagccctggagcaggaacatttgggggcaggtaggaaaccaacaatggatttagttttaaccatgttgactttgaggtgtctgtgaggcatccatggggaaatgggttgtttgacatgagtttgaaattaaggagagaggtctgggctggacagacacatgtaggcatcaataccaggtcaatttagctgaagctgtgatgtggctgagattacctggggagactgtgtagtgtgagaagaaaagaaagttagggataggaacatcttttgaggaaacagacacgaaagaggaaccaatgtaggagatgcagagaggttggcagaagattctttatctgctgaggtttggcagtcatagaaaccaaggcaactccaaatttccattgtttgctcaagtacctaaaaaccaagttaacacatgcttcagtggtctccaaaaggttcccccgttccaaccttaagctaaaaagaactgtttccatttttaatgactctaaattagcttaatcaatttaaaacgttcaaagataatgctctttgatcttgaagtgcttgaaaactaaacatggaatgtagtggaggcttttgcttatactgacattgactctggggcaaagcagaagtccacttttgtgtgagagtctctgtttatattctcttggatgaggccttctagcagttgttattgacttatttccttcatcctttcatattctaacatttcttaaattgggttatgttttacaatcaagtattatttaaatcaatgagatattttagaattaagaaaatagagcattaaagttgaaatctcatgtcatttgtgaacatttttgctttttctattttgcatagctgcagctattaacatttagcacacagagtagagtcactttaattggcaactcatctgctgactctcacttttttcttcaaagtgattctagcctctggcctcactaaactccttgctattgccatatccatgctgtgcaacttgcctgcatgcccagggtgctccctcttccagtcctgtctctctcttttgtctgcctggtcttccagccaagactcagatcaagtgtatcctcttgtggtgttccacctcccactccagcccattgggtcctccttcctcttcccatatattcctccatcatttgtttagtaaatacttatctatctatatgtcaaactcgtttgtcaactccttgagattttgtcttgtttatttttgtaaacctggtacttagctcagagccttgcagtctaataaattaataaatgtttgttgaataagtaaactatttttgttattctcttatacacagctcattgattgttcagtatcaaagagtagtagtttgtaactcttaattaagtcagaaaaatgaacaaatgctgataatatgttcttagcactaccttaggattttcttcatactagttgtcttatgatgcagaatacacacggtgatttgaattctgtgaattagtcacagatttatttagctaactggttgggaatgtgtatatatatatttatataaattaaattatataattataacagtactggtattaagaatatacaaagttatttgagttgttctagacagagaagataaaatatactttccaattaacacatatcacccatccttgtgtgaacctcgcagctttaggtagtagaacaacttagagaaaaaaactgttgtactcatgccaactcagaggcagaggctgtcctgtttgggacaggcttcctccaatttcccagcttggaaaggagagacagggactgaggaatgggtgaatgttggccttgaggttgcgatttaaaatcttcagattggaactgtaaagacagataaccaggcgttcaggtgggtgggaacaataccaataaagtgaaatcaataaacataagtgtttataacagagaaagtagtcaaaaacaaattagatcatatagatatggtttagctgtttctactttaattttaaaccatagtctgttaagcaactaatggtctcaagtcctttctggatgtgtccccaagcccaccctttgttcctgagatgactcacttttccctgtagatcctgcaacctcactctacagggctttcctagatttgacctcagagcattgtgagctccttgtgtcctgcgcacacattgcccccatggaactttggcattctttgtgacctcatggctttcttactctcaccaagttctttccctgatccattctgatgcccgagtccaagtggcttttccagcgacacatctttggtctttgttctcagtgttgggggttgcgttgtgaggtgttgtctcttcatgagaaggcagtgtgacgtagtgatcacatcccaggctctggagttcaactgcttctgtctgaatgccagctccactgcttcttatttctagaactttgggtaattaacctttcagtgcctcaatttccttatttttaaaatgggatagaatagtacctaactcattgagttcttgcaaatatcacatgatacgcatacttagacaataagtattcactaaattctggctagtagtatcattctttctaatgttagcacactaaatctacttacattccagctactccagcatggacataccgttccacatacactgtgacggggaggacagttttgctgtactgtaaactcatccaagccaaagagcctctgccctgaagttcacactgtggtgaaagcagtagtttgtttccagggctttgcctgtgaggtgtgccaatgtctcctgaaactcttattgattctcttggtgctttataacaacggcaggtttttttattttattggagcagaggaaaatcacacttttctgattacttgtcctgctccctgagtgaatcaaaagaaaccacgtctggcacctttgatctctgctggtaaagctgctctctcagccagtgatgctgattctttgaccccttggcaatccctgttggcggcccctccagctggcagagggccaactcagtgcttgtgctaatccccaaagaaccaggaaggaaacctgagcagcatcctaagtagcactggcctcaggcagcagtcaatgtatgtgccccatcagcccctccacgcagtgtcttttcctctcttttggttctccttcctagacaacatgttagtgtcaacgagatgcatgtcagtcaggccatgagccggaggcctttcctcctgcctttcccacacagacacctacctgtcctagttaagatggttctgtcagcttgctgtcggggctggaaagcaaccacagcattttctctcccacctctgggtattaagggctgaaaaacaacttcaggaatatttgtattttaacaacagacttttagaaatagaaaaattaatccctaaagatgacattttcaccaccaggctagctaggggtggaaagttgtctatttcataaacaaattaagtcacacatttattataccatctcccaataccacttcagttgagataatccatgttgacagcctaggatgtagccttccacatatttctctgtgtacccatagggacatgccacaatttatcctaatgatggacattcagattgttttcatttgagagtcactgtcaacaacccttcaacaaacacatttgaacacacaactttatacattgattcttttatttgtaggatagttttacaaaagtaggattgtgcaaggtacatgcatttaatattagattggtgcaaaagtgattgtgtttttttccattaaaagtaatgacaaaaaccacaattgcaccaatctaatagatactgccaacctacctttcagatatctgtagcaatctacctgtccactgtaaaataaaaataaaattctaagctccccaactgactgaatggaccttctttggccaaggggaccccagagtaaccttgaaaactgagttcttggccacagtgggatagaagaagatggggcatgcttccttatgccctctccttcattaacttctattagactttcttctctaagggttcaacagaaactaactctttcaaaagactccacactgatatcaactaacaacctcatgccgcccctccttttttgcctgataagagaccactgaccatggagtggctctggccagtctggagagggcacagtaaagccctacatgtactctgcttcaccttttgacagcagagggctgaaaactccacccttagatcatgctaatgctgctatttttgtcacatgagacccatgaaagggcatgaagctcaactgcatgtgcgtacatttctcctttcatatatattcatgctcctcctatagcttgttgaatatgtatatttgagcacattgtttagcataaattcctgttccttttttcccctcccttgaagtatctgtttttagcatagcctccagcctgtcaaaatggcaccctgaaggcttcaaccctttgtgagaaataaagctcccctttgcaaatgtatgaacctcgtcattcttcagtggacaccacccaaaacatataaggatgcttatatcttcataccttttaatacttgatcatattattattattgttattctgccaagcagtggtggaaagttttttgcatttttccccatttcattaggatacactgtgtcagtggtcagggttcttccttggaggctgactctgatggcatctttgggactgttttcaggccccctctggcttctgtttactccaggcaagagctgaagaagcagcttcaatgagcaggttggattttaatcataggagctgatgtgtgctgtatgaatttaaaataatcaaaaagatgggtttcaagcaaatggcatttgaaaaggttacattaatgtagaggaaagaatagctaatgtgtgttcacagttgctaggggcattgtggctttgcccagctctgcaatggtcaccttgctgtgccctgcacactgcacaacatgcaggagccccctgtaggtggggaggaccttctactcagctatccatatttctcagtggtccccctttcctgaggttttctgtgacttttaagcacccctggggtcctgtctttactccagttggaaatctctcaaccttgttccagaagtggaccccttttcagtgtgctttgctgagttgtgaatgggtttttctagaagtgactttccatttctacttctagccttcactgtcaattccctcatctgctgccctgctccagcttgcccagatggcatgtctctcggataagaatttcagcacaatcctggggagttatttgttgtggattgaagctttcctctgaggcataagcttgcttttgtttccctctcctggcacactgtccttctcatcctgcatgctatgaaataggcatcccagagcagtgcgtgctcacaccctcttaggggttcttcccccataacggcagtgaatgtgatgtgagagacagggctctgaggtaagaggatctgcttgactcacttagacctgttgctgcacttatggtggactcagagaaccatccaaccctgaaccagctggattacttttcagaaatgttatagtaatgcatttggaaaagcatatgccataaaaatgatgcctcatccatgaagcactgggtactgggcacaggactactccttctgggtctccaccaagcttctcatccactgattggcaaaaatcagtgagatgtgatagcacctgctgcaggcaggaatttttggggaaaaggctctacaaatattgctggcggaaatgagaaatcaatatcacagatataaaaacaccagaaaataagcatatttatatacaattttttttgtttataatggcaaaaacccatgaacaaggcgagtgcccatttgtaggacaaaggctgaataaattgtaatatattcacactgtggaatagggagatttttcccattatgtaatgcatatatataaaataaaattatatttttacaaaataataataccatatgtctgtaaatacaatgtaaatgtttatatatgatgaaataatgataatggagaaaggtatattcacattatatatataagaagatggtatccacaaagaacagcatgtgtaaatgataggccacttacataaaattaagtatataagtgtatatattcacagagacatgtatgaaaaagtgaagaccagaatatttaccatgcttttcttaagatggtgggatttcaggtaatttttctttcttcctatacttctctaaaccttttttctttttttgaaacagactcttactctgttgcccagactggagtgcagtgatcgtggctcactgaggccctggcctcctggtctcaagtgatcctcgtatctcagcctcccaagtagctgggactataggcatgtgccaccaagcctggataatttttctttattttttatagggacagggtctccctgtgttgcctaggctggtctcaaattcctggactcaagtagtcctcccactttggcctcccaaagtgctgggattacaggcatgagccaccacatccagcctgaaccattgtaacagtaaacatgtattagtttaaaaaaaaatcaggaagaaactaaaactgttttcattgtgaaaaagcagaggggtagagggataaaatgttgagcttgtggatatgtagctcagcatcttgtttctgggttcccctcaaacttggaatccaactaggatcctacataactagtaagcatggagctagtggaaatatgcttcccaatgttcatttgctttttcatttttttccagttaacaaatacatatttagtgttcatggttaccagatactgttctaggcattggggctatagtggtaaaaatatctgatgagatccctaccttcataaaacttacagtttagtggagattggcagagatagttgactaatcctcaatataataattgctacaaacaagaaataatcagtatgatgagaactgaagccaggcaggcctgatgtgcattggtggttctggtggtgagggagggtttcttggaagaagacctaaaaagtgaggtaaacttagtgaggatgaggtagagggcagaaggaacggttgtttgggggtctgggaagcctcctttgttactcagtttgcattactataaaatactacctcagactaggtaatttaaaaagaaaagaggtttatttggctcacagttctgcaggctatacatgaagcattgtgccagcatctgcttctggcctcaggaagcttgcagtcatggcagaaggcgaaggggagccagacagcatgtcacatggcgagacacagagcaagagggagagaaggaagtgccaggctcttttaaacaaccaattcttgtgtgaaccaccagagtgagaactcattcattaccatggggatggcaccgggccattcataagggatccacccccatgactcaaacatctcctactaggccccacttctaacaatggaggccacatttcaacatgagatttggagaggacatgcatccaaaccatatcagccacccaggcagaggagaactttgaagttttagggattcaagtgaaggcccatggggctgctactctcccttgtccgtaggatagcagtactctagggggcaccattcacattcaaagtcatagacttgtcatctattgtaaggagcaggaagggacagctttcctaattctcacagtctagcggtgggcaggctagacttttggtttttccctttacaaacaatgggaaggcaatggaagtttcaagaaggggagtgatgttcctaactgctgttaaaattgttggtctggttgtggtgtggagaatgtgttagatgggctggaggagcagtgtggggagaccagcgaggagctgcagcagtggaggtgagggtgacaggccagagtggtgctagtggggatggagagaagcagctgcattatgcatttattctgtaggtagagttgacaggactaaatattgcattggatgtggggccaagtgataagaaggtggcaaggattcccatgtttctaacatgagcaaccagggggatggaggtatcattttctgagatggataatattggaggaggaagagttttgggaaaggtcaaatgcttaggttggacatgttaagtccaagatgattgtgagagtccaaagtaaagaagtcaagtgggcatatggatatctggttggcttatggatatttgggtctatagctcagataagaggtaaagtggaacaatacacatgaaagttattaaaatttcacctaaaatagtctagagaagaggatagcatgagaagggtcaagactggggcctgaagaaggaagagaagccagcaaaaaatactgagaaatagccaaagcagtagcagggaaaccagaagagcgtactctggacataagtgttgctggaagtttctaatgtccaactgggaacagaccaaggccttcgaatgatctggttaaggtcatcccataggctaaaggtaaatgctaccatccttgagtcctcattgccatcccataggcctagccctcagtgttagtgactgatgtgccttgactgtggcttttatggtgtttccaacagctacttatcagggaaaaatcacggttggacagtcaaggagctacattttctgatttcattaattttactgatggaaagaagttaagctgataaaattattttaagaactattaattgtttaggttttggtgttctttatatttcttagaaagtcagagaataaaaaggagatttactttgaagagttaaaagagcttaaagtttacatgattttttaaaatttgttttcttaaaggaagggtaagtaaaatctgacactgagaaaacattattttgtggttgctcagtaactactgtgatgccttttatgacttagaaataagtctcactaatttatagtttcatgatgatcagcaaaataaagctcacaaataataatgctttgtgatattatagttatttaacacctgtaatgagtgaggcagtgtttggcactttttatatatctcatttaatacgacagctctaaaaggtaaattttatcattttcattctgaagatgaaagaagtaagagtctatgcaaagtgtctaagtagtagacctcaacacatagcagcttaaagcaacagttattatctcataatttctgtagatcaggaatttaggaacagcttagctgggtatttctgggtcaaggtgtctcataaggttgcatcaagatgttggccagagctgtggccacctgaaggcatgagtggggctggaggatccacttccaagttggtgcattcacatggctgttggcaggaggccccagttccttaccacatgagcctcttcataggactgcttgggtttcctcaagacgtgtcatttggctttccccagagcaagtgattcaaaagagatgaggacagaagtagcaatgccttttgtgacctagccttggaaatctcacagacatttctgtcatgtcctattgtttacacatatcgacttcattgactatgggagaggcccacacagggatgtgaagatcattgaccatcttagaggctgatgaagaggggcttacaatatttgcttttgccagaactcttaacagttagcaaaaatagcttttctttctgttacataagacttacataatcttatctggaaacaaggaaggtgtagataacttttccaggttccttccatccatatgagtatataaaatctatttggtgttgtagattaccttcttacccctattacaaaatttcagagttctttactggaaaaataatttaaagagttgcagcatgtcactgatctttgcatatatgctcacttttgtttccttacttagggtaatattaaaatttattggctaatatttatcatccagtgatcagtcttttgttgtggtatttgcatacttaagcctttataagaataacaccaagggcaagactaatggaaactgtggcttaatgaaaatgaacagatttatattttatattatttgcttcatccacattgagtcagtgacattgattgcactgtgaaagccaatattttacaaactgagaaagtagaaaatcgatctttcccaggatagaaaattctttcccttgcattttgttttataatgagaaaataagaggtcacatctcctcattgatcttactgcattaaacaggctaatagcattttcaaaattgcattattttgaaccagcaggaaaattacatggtaaataactcaatgttattcaaatcaactaatattagagtaaaaatgcaggaattggaaactgattattcatgaaatgctaaaatgttaggcgaattctctgcgtatctgtgtcactgtggccatcaccatcatgaatcttggatgcttagaaaatgttacaaagcaaagaaaccttttgtccagttttcagcaacgtgactaatgaagattcaggcacagaaagtctccgttgcttaaagtcactgggaaatgcttatacaaaatagcgcttagcatggggagagaaatggaactgaaataagtctccctgttgttttgctctctatttctgccctcttctcttccactctctccatgtttacttgagggagggctgaagaagaaaagagagaaaagcaagtattaggatttgctttccaaaaggtgttgtttctgcccacccacatgcacttcattacagacaagtacttccaaaatcatgttacatctgcaaagcccttacatacactttgccagtttagttcttacctcaaaaggaatcatagatactctgctagaattatatatattactacagatattattctgggtctagaatcatagatattctgggtctaggccagagtgtcttagttatcaagttccttccatgctaccattgtgccaatctgttattttgtttactttgcccctctccctccttcctacagagctctaggctcccagcattctgtttgagcatttattccattctcttattgagctggctggctctcatggcctgtgagctataactcatcctttcaggtcagagcaaggttaagtgttctattcttgaccttgctgtgaccttcgatgatccatcacttccttccagagccttccctgtcttggccagctatctcctgcctcgtcctggatctggctacccccagctcttgccctatctgctattctggctctcccagctcctcactgcgcaaacactcctctcctgctggccttctccttccttgcagggacaggagaaagtggtgaaggacacacaggaggtctgctctagagcaatttaacctcctcagtagtgggagagtgtcccaaatctgttagaagaattggaatgccatttctagctccttaccctcaggcctctcctttttctcctgccttgcctactaaattcagctatagaaaaatgaatgatattttcagcttttaattaatgtcattgtcagattgtgtcagatcataaggagtaagaagctttcatttccaaaatcttatttctccagttcacatcagctatgctaggtcccagtggactgaagcacgatcaggctcactttcctttcttagtcctctaattatcgtacccttggggtctttggaaatatttccaacatattttttcctttcagactgcataattatagttactgggacagagggagtagaatagagtgcatgagtattccctgtacgttcactagactaattacagtgtagcatgatgtatcattgttgaatacatctctctaagcagctctgacactgtgtgttggcaatgggaagatagtaaacattcagcttgttggttgaaggtagttctcatcagtaggtatagttataaaagtgagtacacaggaaaaaatgatgatgctgttaagttatattaaacttcaggttttaatttattcatctatttaggtctttatgaagcaacccctagatataaaaccatgtctggtgctaatgagggttgacagagttttcagataaggttcttttcaggctccttaatcttacaatatgcaaggggagaaataacccatgaagcctaagtgcaatgtgaatggtgcagaagatatggaccctgccttttgcatgagtaatttaatataggcaagggcctgttggtaagatagcctgtgtagtagatatttaagacagtgagctgttgcacgtccactccatcaagcgtggcttgtttggatgctggtccaaagggagcatgcttaacaatgggtagagttaggtaaaacttttccttcttttctctggaagttttctccatatacctatagaaagggaagtagggaagtggaacctgttgctattaaagggtttcaacactgtcacagctaagtagggctgatgatttcaaggctcttgctatagcttttcagagaataatgtgcttctcaaggaggttaatagacctaatatgagcaaccagagagaaagcatcttgtgaagccgtgaaagttttccagttgatttatatggaaaaaattcaagtcactgaaaatataaggaggagagttatcaattcagattctgactgtgtttttcttcttactttatggctccgtatctatgttgctgtgtgttgagagacgtgaatgactaatttcaggggctttgtgaattccatgagagagccccaaggatggggcagacttgactgtggtcgctgaaatagttttgttttgatcgtgctgtacagtttgccttaccctttgggataccattattgctaaaagatatgcgcatttgttgtagactcacctaaaatccattgtgtggcctcacaggagctgactggatgaagctattgttggagtctctttatatattcttatatattacagaagtgaatcttgctaatattttatctgcattattctttgggaacaagtattctgagaagaaacatccataggggatatatatttcttaagatgcttttcattcaaagtaattatttaatattcaccatgaattttaatgaacttactacatagcttcttcctgttaattcaactcctgcttagtttgaactttctgcatcatttcagaaaaaatcctctggaatcaaattaattgtagctaaaataacatgattttctcatgccaatagcaatcagcttaaactgagttgggcaggtattagtttaatcataagttacagcaaactgacacttctttagtgaggaagaggctcaaacttttagactggcaggaagagcaaattgtactgaacactgccaggcatagccctatggctgcaagctggttttcccctacattctttggccataattcttctgataccagtagcaaaaatcctcaaatcaaaaaacttcttatcactctgtcaacactgactctctggtcacttggaaaatgtatctgcatagattaaagaacaatattgttaaaaaatcaaagtaagatagaatcctttttagagctatttagaactttttagaactatttgctttggaagtgtgaactatgaaactcagttgtttaatgttggttccccacccgccgtcatactccctgctccacagagcttaacagtgcctttttttgaactctccaggtatcatttgacttctctacgctgaggagttctgtattcctatcttgtctttccctcgctctctctcttgctctctctcttactctttctaattctctttggaggttttgcttgggcagcagctgtaaggactcagagaaaaacatgaatttgacctttagatttccaggattatcccattccatcacgatgctgcaacgttagttagtaggtgtgcgggtagccaggggttatatcttaaagggtgttgtatgatgttgagaagtttaaacttgttttattttaacggcagtagggaaccattgaatccctttagtgaaatcaatcaagttacttttgtacctctgctattcttcaatatggatttaagtgtcagtctcacaaataatgaatattctctggcaatatttatgtatttatttacaaataatgaatacataaccaactcttttcaaaaataagtgtcatagtgaaactacatttgaattatacctaaacaaatagagcagtgccctcagatattcaggaatgctttcactgctttctagtgatggtggcaaaaaatggaatagtttttttccgtcttgattaaaatttttagttgctcatcctgtgagcctaaatgcacaagggcgcttgctggctacctactgggaacatgtcttggattgattaatgtttttcaaagctttttttttttttttgagacagaatcctgctctgttaccaaggctggagtccagtgttgtgatcatagctcactgtagcctccaactcctagactcaggtgatcctactgcctctgcctcctaagaggctgggactacaggtgcatgccaccacaccaggctaagctttcttatttttaatttttatttttggtagaaatgaggtcttgctatgttgaccaggtgggtcttgaactcctggcctcaagcaatcctcctgccttggcttcccaaaatgctgggattacaggtgtgagccaccacacctggctggttgttgtcttttattaaacaagtaaccaagcatagttagaatcattgttttattatttgtaacatatccttggtcagataacattttagaaaactctttccataatgatgaaataatctcatggttgtttcaagatgtctagctaattggatttaaaacactatcagccagttatcattactttgagatttttactttttcttaatgaaacaatgccaaggtcattgatatcttttttgattttcataaccttgtgtggtttttaattcatattggcattctattaaggcatgtcatgtttgtgtgctactgcaggaattctgttagacattttattttgttattgctttttaaaaatatttttcattgacaaaaatggtatatatctgtgttgtacaacatgtattttgaaataggtgtataatgtggagtggctaaatcaagctaattgacatgtgcattatctcgtatttttatttgtgctgagaacacttaaaatctacattttaaagcaattgtaaatatataatatattgcttactgtagtcaccatattgtacagtagacctcttgaacttatttctcctaacagaaagtttgtgtcctttgaccagtatctctccaacgcttcgtcctactggcagcccattctacactctgcttctatgattctggatgttttagattccacctgtaaatgtgatcatgtggtctttgtctttctgtgcctagcttatttcatgtaatataatctcctccaggttcatctgtgttattgcaaatgacaggatttcctccttttcttaaggctgcagtattctgttgtgtatatatgccattcgtccatttatccattcatcctttgacagacacaggttgattccacatcttggtgatcgggaataatgctgcaatggacatgggagtgtagatatctcttttagatactgatttcatttcctttggatatatacccagtagtgggattgctgaatcatgggatagttctcttgttacttttttgaggaacctccctggtgtttgtcataatggctgtattaatttacattttctgtgtggtatattgaacgttttatagtagacttgatagattctataagcaggacctatctggagaagggatatccttaatctgagatgtttcatgtttgctttgagtcaaggttgaacattcttggaaaagcaggcctcacagtggttcctgccctctctgctagagagaaagaaaggcttttgtgaagtcactgaatccagatgacagcaaggaggagagagacaacttgtgtctctacaggcctgaagaagagcactgagtttgccacagttgcccaaacttcatggtcccggggcacccgttctgaccacatgagacaatctgatgtgattctgccagaggagcaccactcaaggggccttcacagggcaaacctgggtgattctcccatgggagacctcagtgttccatttggaaactggggccagtcagtcctaccatgtcacattcctggctgcttcccaaggccctctgtctcccttctgagctgtccccttctgtctcctctacacacagctccatgtttcttttcctctggccaaacctctctctttttctgtctttcagaccttttcttggttccctctgaaaccatgtaaataatagtaacagtaacatataacacttaaacagcacatactattcacaagaagcagttctaagcactgtacatatattactgtattgactaatttagccctcacaatgcctcttgcacatagactttgttattatgttcacattatagatgatgacactgaagcacaaagaaggtaatttacccataaccacatagctggtaagtgacagagctgggtattgagtctgggagttgggtttcaggatctatgtccttagttattaaaatattctgcatctccctaggataaaaatttcgctacaaacttaacctttctcagaatgatctgtcagccatattgtcttttattggctcacaaaagtgcaaccaagtactaatgtgtgcttggccagccacttggaacacttctatagccaggcaatataacctaccacagaaaaacaacccccacagactatgagctcataattgaatattaggaaccatctgagaaaaactagaaaggagagcaagctgacccaacaggtggcaaaattaattcttctagaagtagatacaacagaataatctgaaagaaaccataagcatttaaaaaatgattacagattaacgaaggaatggaagccatagtaaactaactgaatactaggaataaagaataggccatttgaagtagacgcaaatacaaattttaaataaaagaggggatgatatgattacttccagatgaattgagaatggattaaaaattgaaggtaaacctgagaaatatcacccagttttcagaagagggtgaattgatggaaaataagaatgagtggttaagagatataatcaatagaatgaggtctgacataagtctaataagaaatccagaaaaagagaatgaagagaaagaggcaggataaaattcaaagaggcaatggatgaaaattttctagaaatagaaagacataaatcctaggatagaggtaacatgcacagttgcaaacattttagtgaggctgcagaacttttagcacttggggaaaccaactttctcacatgccatggttgcaaacattttagtgaggctgcagaacttttagtgagcatttggggacaccaactttctcacatgccatttgtggagagtcctttggtaatatatattaaaaatgtgcaagctgtttaacccagaaattctgcttctagtaatttatcctcagtaaatattcagttcaattcccaaagattatatatatatataaggatgttgatgtcagcattgtataataatgaaatattggaaacagtttataaaacccatcaatataaaatagataaaatgaattagggcatgaccatgaaggcactgttgcctttatgtagctattaaaatgatgataaaagacatcaaaccgtagtcctaaccaaggtgtgtgcgtacacacacacacccctagacacatcatatttaactacctagacacatcatatttaaactgctataaaccaaagaaagaaaatcttgaaggaaggtagagaaaagaaaagacacattatacgcagagaagcaaaggtaagagtcagtaaacttactatcagaaattgtgtaatccagaagacaatggagtgatatctttcaactgctgggtgaagaaaccctctcaactcagagtattatcctcagcaaaaatactctttcaaaaatgaagaaaaaagaaagacatttttcagacaaccaaaaagagggaattcattactagcagacctgtactgcaagaaatgctcagggacattccttaggtggaaagaatgtgataccagacagaaacttgtgtctacacaaagaaataaagatctccagaaatgattgaaatggaggtaactataaaagattttttcttatttttaattactctaaacgttaaatgactactgaaagaagaaattgtagcaatatatattgaattacagtttatataaaagtaaaatgtatgacaacaaaaatgtaaatattctaaatataccaattaaaagacagagattgtcagatcagtttaaaaagctgagaagaggcccaggcatggtggctcatgcctgtaattcaagcattttgggaggctgaggcaggcagatcacttaagcccaggagttcgagacaagcctgggcaacatagtgagaccctgtctctacaaaaattagccaagcatggtagtatgcaccagtagtcccagctacttgggaggctgaggcaggaggagcacttgagcctgcggggagcggaggttgcagtcagctgggatcatgccactgcactccagactgggcaacagagcaagaccctgtctcaaaaaaaaaaaaaataaagcttagaagagaggaattaggaatatacttgtattagtcagggttctctagtgggacagaactaataggatagatgtatatatgaaggggagtttattagaagaattgactcacacgatcacaaagtgaagtcccacagtaggccgtctgcaagctgaggagccaggaagccagttcaagtcccaaaacctcaaaagtagggaagccaatagtgcagccttcagtgtgtagccaaaggtccaaaagcccctggcagatcactggtgtaagtccaagagtccaaaagctgaagaacgtggattctgatatttaagggcaggaagcatccagcacgggagaaagatggaggccagaagacttagccttagccagtctagtctttccacgtttttctgctgcttttattcttgccgtgctggcagctgattagattgtggccacctagattgaaggtgggtctgcctttcccagtccactgactcaaatgttaatctctgttggcaacaccctcacaggcacacccaaaaccaacactttgcatccttcaatccagtccagttgacatttagtattaaccattacaatactgttataagattcttatattacatgtgaagcagtataatagtatttgaatgtagattataattcatgatgtatgttgtaaatataggcaaccacgaaaaaaagtaaaagaagtataaataatcagccaacagtggagataaaatggaattataaaaaatattcagtcacactgtgagcatcctaaatctgaaaatacaaaactgaaatgctccaaaatctgatttttttttttttttttgagacggagtctcgctctgtcacccaggctggagtgcaatggcgcaatctcggctcactgcaagctccgcctcccaggttcacgccattctcctgcctcagcctgctgagtagctgggactacaggcacccactactacgcccggctaattttttgtatttttagtagagacggggtttcaccatgttcgccaggatggtcttgatctcctgacctcgtgatctgcccgccttggcctcccaaagtgctgggattacaggtgtgagccaccacaccccgaatctggaactttttgagcaccaacatgatgctcaaatgaaatgctcattgaagcattttggattttggatttttggatttgaggtgctcaactggtaaatatgatgcaaatattccaaaatctgaaaaagtttgaaatttgaaacacttctgattccatgcattttagataagggatactcaacctataatcctaaatcagaaagagaaaaaggaaaaaagaacagatgggatcaataggaaacaactggcaggatggcagattttaatacaaccatatcaataattatattaaatgtaaatgttctagctgggtagagtggcgtgcatctgtagtctcggccacttggaagactgagctaggaagattacttgcacccaggagcttgagagcagcctgggcaatatagtgagatcctgtctctaaaaaaaaaattaaaattaaaattaaaaacacaaatattctaaatataccaattaaaagatggagattgtcagatcagttaaaaaaagcaagagccaactatatgctgtctataagaaagctactttatatataaatgcatagttaggttaaaagtcattcctgttgttacctggcatattagttaaaagcctttcctaatatgcccttcacacaattctttaaacccaagagactcttcttggttacattttggactgcaaactgaagcaaataaggcatttaaaaatccagcaacacaaagtagtggttggctggttgtttcttctattatggggttactgttacttgtttaaactttcctcttgcatcacaaggtgtatactaagtgtaaaagttcctttgtaggctttctgacccttgtcgatccactttggcctccctcttggcacagtctgtcataggcttttccttgtaattttatatcacctccactttgcattagcttttctcaagttctagtttttagaatgttctgggtggcatgttatctttctgtacaagcatggccatggatattttactgctttaagtctctggggaagctggtagttttcaaagaggtaatgtgtctgttttcccagaaggattctcagatgcacacgatttcccaatgctcttttggaatatctttttcattttagttactagtctctttaacaggccagaattgttgctctcaaagatgcaaagccaataaaccggtttaaaaggacaaccaaagctaaaattttgcagaggcaaaatttagttggaaaaaggttcttcattatcaatcaagcactgtctgtcagagttgtggttaattcacatggctttgtcttccacatccactatctttgactattaagtatattacagaacgagaagtcttaatttgtattttttttaacttttatttaagttcagggccacatgtgcaggatgtgcaggtctgttccataggtaaacatgtgccatgggggtttgttgtacagattatttcatcactcaggtcttttttttttttttttgagacggagtctcactctgtcacccaggctggagtggcacgatctcagctcactgcaagctccgcctcctgggttcacgccgttctcctgcctcagcctcccgagcagctggtactataggcgcccgcaaccacgctgggctaattttttgtatatttagtagagacggggtttcaccatgttagccaggatggtctcgatctcctgacctcgtgatccgcccgcctcagcctcccaaagtgctgggattacaggcatgagccaccgcgcccggccatcactcaggtcttaagcctagtatccgttagttatttttcttgaggaatgacatagttacagcagtcccagggagggcagacttgtaccaatgtcaccactctctacctcttatttcctttttggttgtatgggctgtatgtcctaattgtgttgctgtgtccacagcaatggcgttgagtattgtcatggaattaaacattagaaagtataatgggaatacatagggaattggaatggttccagagcttagatcatttctagggtagattaggtgacttagaatgtgacctctaaaataaaaagtatatagaggttgaaaattttgttacttaaatatataatgagttatccttacttggtatgccttgtaaaacgaaggagaatctgaagtgctaatgaggttaaataatcatatagttatcttgctttgttgctgtgtgggcatgcacatgtacatgcacacgcacacacacacacacacatttatttttaaatgtgtaaccaaatgggtattgggtatgggtgcttgtatcctgacatgttcatccaattcaggttcttagaaccaaatgagtcagttttaaatgaggagagagcgagagcagaggtttagagaatggaaagaacataggactatttagcctcaggttcttaatagcagaagagattaggctctgcatgctgtctagaggcatataaatagatggaaataaaatgtgattatagcagtctcgggttttaaagaaataacagcatgaaaacaactttcctcattcatgagcatgtaaatgctaataaaacccctcagcaggctgcccttcacacctgaggactggttccctgtgagagtctgagcatggggctgtggactctgtctaaaagtggtttaaaagaaactgtagtctgggggccaactgtaccaacgtgcctgttacagttgcaggttcccagtttcatacttatgcactgtgattcagtatatctggtacagtcattccgacgtatggtgagatttgggaactgcttgctgacttagaatatctttacatgacatacatactacaaaaggggttctcttaccacagggacttttgattaccgtgtgtctgcttattttacaaattcatttcttcaacaaatatttatcaaatgcctactctgtgccagatactgagctaggcatggagttacaacagtgaacaagattgatacagtttttcttcatgaaatggagagataacaagtcaacaaatgaataattgtgatgagaactatgaaggatgcaatgggatatgataatggagcataatggaggcaggagcagttagtgtttaaaataaaataatggttagagaaggcttttttgacaaggcagcatttaaactaagactgggatttaaagtaatcagacatatgaacaacatcccaagcagtataagaaaatgtatacaaaggcactgaggcaggattagccctgatgtgtttcaggaatggcacaaagactagagtggctggagcccagcaagccaggggaaggaaggtatgagattaggcagcaggcatcggagtaggtaaacccttgaggaacatggtggggattgagaggggtatcagaagtttatctggaaaaaggattctggagttgaggggaaaaccctactttaggacatgaatttgggagtcatcagcattttgatggaaaattaccagaatgggtagtctaacgtagggagaggctattgagagaggatagagggggcggagctgtaccatgctcttctgtaaaacctggtaagagtagacttgcagcagccaaggactggcggaagcgggagggtggaaggaaaaccaggagattgtaggcctgtggaagccacagaggacaatgctcaaagagagatgattggttgcatcattgctgctgaagtctagaacagtgctgtccagtgtggtggccactagctgcatgtggctattgaaaggtgactagtgcaaactgagatgtgctgtaagtgtaaaataaaatgcacattgcattttgaagacttagtacaaaaacaacaatgaaaaatattaataattttaaagtaatcattacatgttgaaatatttgggatctgttgggttgaataaaaaatattattaaaatctcacctgcttctctttacttttttaaaacatggctaccataaatttaagatgacatgtgcggtttgcactgtatttctgttgcagagtttggcaacatggaggtcactagaaaacttgataagagcagactgcctgggattaagtaataactagcaaattgtttatacactgatgagactaagccatcgttataatactattttgcccaaaattaaatagagaaactcaccactaaaattttttctagacttattgatatgtgatttaataatttcacataaattgactgtaatgtatcatatatgttaaattttaatattaggatttacattaaatcttttgaaatcaactctcaaatgtgttttttacattttttaacctgtacttttttcctttttttagttcttaaatttttatttaaattattttattttctttcatatctgaccaggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtaagatcaggtagccaggagctaacttttttttttaagttgtattaaaaaattagcatcatgaagcaaatgatgagtagtcaatgttccgtatactgctttttagtcagcttgtgatcaacagaaagggaataaatgtgcaaaacagatgcctcacaaaggacaggtggatttagcaacagccatggaaaataaaaccattgagagaagacctggggatgggagttccatggtgaggatgctggggcagagctgctagatcatggtgtcagttcagcttggttgcagttggtggtatttgtgttgcaatttgcagtagatttttcatctgattgataactctgcaattagggctttttgatgcagtatggaacatctctgaaagaacaagggaatgattcagtggttatttaacaagcgattagatggtccacttggatctggctaggtaacaccagaattcctctggaggatttatttccaaggcttcatattgcagtggtgattgctttctcttcctatcctctttaaaaagatgttcatttggaagtgaaccttacatcttagttactgccattctacataattttatcaattttatcaaagttgcataaagatctcataatcagcaaattcctgcctttctcctttctagctagtgcttcatgaatacagtttagataatattttctagagaattgaattaagtaagcaaacaagaattgaaaagtattttatgtccatgagtacttttgatttcaagattaacatagaggaaacgttgctgaagggaaagtgcaggctattctgattttatgccctatgttaaaatttaactacattttagattaatttgaaaatttagaactctttgtccattcaaaacataataccttaatgacctgtgagggtattgattgtagaacccatctatagagtcatttcagcctctcaggccagggaccctgatttcttcagctgcctggtgctgtctgcatggagggacacagagtcacacgaagcccccagcatactgggagaagtcattgccattgtggttaagagaatggatgttggaatagaagcctggctttgagtcctgcctacatagctttctagctgagtggctttgggtaaagctgcttaaactttctgagcctcagattccagagcagtagaaataattaagtgaattatttatggcctgtgttaggatgggctgcaccaatatttgcctctctttctcaggcttcccttctgatggcacattcttccttagatatatttctgcaatcatgttaccatcagatcttgctgggagcagctccagctccttagaagggactggaatctcaccatccatggagccaaacaaggcaggtgacaagtcaagcaataaccaggttgcaattgtggcacgtggagagtgtgtccacattctcgttcatggggatcagccgctcagcagttgcagctaataattgctttgtaggaatctagactcggtgggcaggacttttttattctttcagaagaggaataaaaaaatttagaattccataatttaaaaatgttggcaattatttttttttttcaaaaagtattatgtgggtcatgtgaatcccttcagcaagatgaatgtgtgccctgagatgccaatttgccacgcctgctttatggtgacgttgcatgtctcttccattgctttttgaatatctggaaagtgccattgcacaggactggaatataagagtgaagtcagagtcctttctcaagagtacttccggtgggtacactaatgcattttatgtcgaaccattttgtgttcagtgtccttctgaatgcccctggtagtacctgctgtggtaaagtcttaagtcttcagtttgatattctggactgagatataatttacatattataaaattcacctattggaagtatacaagtcaatgaattttaatatatttatagaattgtacagccatcatcacaatataattttaaaacatttctattacctcacaaagaaacttgtgcccatttacttacagtcactccttgtgcccatccccagaccataaacaactatgaatctactctctttttctatatgtttgctttattggacattacatgtaggtggaatcatacagtgtgtgttcttttgtgtctggcttctttcactcagcatgttttcaaagttcatgttatagaatgtatcagtacttcattcatttttcatggccaaataatatattcatttaattttaggagtatactaaatttgtttctccatttactagttggtggatatttaggttgtttctactttttggatattgtgagtaatgctgctatgaatcctgaaagtttttttttttttttaaataagactcaacaaggagaatacattattctgaacagtttgctgttatacctggaagcaatgcaataatccctgtgggttacttctggggccttggtcttaaacaaagaaatacgaaaacagtaagaaattctcattttctttccagcagaaaagctattgtaaatttatcataattttaaaaagtaaaacaagtccttttagtaggaaaacagggctggtgaattcctattttgttattcacagatgcaaattacttacaagcatccacatgtacacctgaagaagagaagacagtcttttctctcacttccttcatagctattcatttcatggtactaagtcagcaagttcatcgggaggtcatctacacttcttgcatcactgtttagaggtgtacacactaagaacattatttatagtgagcctgtgtgcttatgttgcaatctgtttcccaacatgtaacgggattggaaattaatggaagcctgggtttgttacatgtcagtgagcaaatggcagtcagagccagtgaactcctaagcatctattcatgtgtacaggtggggccatcacatatttactgagttgtcattacaaaactatctacattcagagaaaaaaaaatgtgaaagcatgcatcacttatgcacttctttctctttttccctcctcccagaaagaaatctagaacatatcttaccatgctccctccttccctgattgtccatggtcgctattgtgtttgcatcccatctctttcagcctggaatgttccccttcagctggtccccctgccagactccactgcagtgtctccctctcttgctattttcccaggtggctttaggcgctacctgtacctcctttgtgcctgcctctagtagagctgtcatctccttgttcgtaattattagtgtgtgtatctttgtccccgttgggtttagagacattcctgtgtcttttcattcttataacccagtgccaggcacaggacctggtgcataggtggtgctcagaagtacctgttacaggaggctgggcacggtggctcacgtctgtaatccaaccactttgggaggccgaggcgggtggatcagctgaggttaggagttcgagaccagcctgggccaacatggcgaaactccgtctctactaaaaatacaaaaattagccaggcgtggtagtgcatgcctgtaatcccagctgctcgagagactgaggcaggagaatggcttgaacccagaaggcgaaggttgcagtgagcctagatcatgccactatactccagcctgggcgacagagtgagactctatctcaaaaaaaaaaaaaaaaaaaaaaaaaagaagtacttgttatctgaaagcttatgtgcttacttgccctatgagtgaatgggtgtcactaaggttgtaaggtcaaccccagcattaactgactgcacagatatggccaagcaaatgtgaagaaactgaccatatctctgagagctagtggcagcccttttactacagatgtggttctagggtgcaaagagttattcagttccctcaaatcactggtgatattgaaacggcatgcttttggaattctgtttaggtgcttacagaatgatcaagttaaatattggaaggaaaaacaatgtctcatctgattttaacaaaaatctaattgtgcaggcattttagacctattaattgcccttagggttactgagtgattatcatgggagcaatgactgttgagcaggcataacttttgtcagctgaattgatttttgtggaaggaccttgtcggagtccattcttcatactggttcttctgccctgaacaactttaattgttaatgatatctggactgtggcataagtctgctttagatatgtgtgtagacaaacttatttctgttggtagctttgaaaattgccctaaagcttctttagcccatataaaattgtttaccaattaccctttaccctcaaattgaaaagtagatatctttatagcagatggagaaatcttttatatggagggtactgtttgcgatttcatcctggtagcaataattataaagctagctatgaattgaaattatttacttgttttcctgtaaagcctcatgaggacaggtttgctgctcctttggaaaggtttttattttttggtctagtgacgcttcttattgtacttgcaaagtcctcaaaacttaggtctggcttcctggattcccccagtgcttttctgtcttaggccgaatagaagaacttgacctttcttccctctcatctacttttggtgatttaggttcccctaatttaaaaagtatcttctgtggaattaattttgtttgtgtatcttgcaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctagcaaggattgtaaattcttggaagcaacggggagcttccatattcccaccagagtgtgggaatgctgtggccatgtgattgtatgatctccttgcaactcagtgtgagttgattcctccaatatgggccagatgcttttgaatgatagggaaatctacataaaatccagtgtcctctttattgagggagtatatgtatccatctcagtgatccatgtccttagtgaagtccacattattctctgtggggacaagagctgggcagttttgaatgggtcttgaggtgggtaccccatgtgcactttctgaggatgcctcacttccctgggctctgcagagaacacacagagagaagactttcagagctcacaggagcagggagcaggagcactctaagggaattccaagatcatgatggagcatggtggctccagagaaaatgcctgtttgatgaacttaaacatgtcaaacattttctgttgagaaggtagggatttggtgtcttacactgtttctctggaagccccagtcatatgactcactgtttctcctgatacccttcgtccctttcattgggatgtaggtaaggaatgacgattcctcacctatggtacacatggcgatagatgtgcccgggagtaagggagatattttgtccttgataattctgattttcccttggcatcaccaacgcctcagagagatacacctgcaccctccagtcagggtcagtgttggctggaaaacactgaaaagtcttcgctctgtctttcaccttaaattgtgttttctcaacaaatgagagagaagcttacgggggagatgcctgagagatgcctatggcgctgtagtttttttttcttccctatgatctcacatgaaaggtgctatgtaacaaccagtatgagtcaaatatattgaaaaaatcatcttatgcaaactttaggaattaaaaggtatttttaaaatggagagttagtgtaagctgggtcctttggaaacatcaaactgaaaaggcctgatttggaaaggtgactctgcccaaaaggttggcaagaatctgacaaagatggtttccttccgaggaagactccggaactcaggtgtggccagtctccttttcagtctgtttgtacagctgcggttctctcttaattttggacacagaggaggaacagaacagggagaaataatcattgtagagtgccaaggcaacatctgacccagatgagctcttcacttcctccttccctgtcgttgtagagccagactgggtagaagagggagggcagtgtcctcaactcatcagcctcacaagcaatttgggacccctctggggtggatttcaccaggttgaattagaaccgcagataatacttccctgttagtgaggacaaaccaagcgccagctctgcccttttctctagagtgttgtgttcttgctcttggtacttacaggagctagtctggtgccttgagcaagcttgaagggaagtgggtgtcctcaccagcaaacttccacatctcaactcgtgccctcttttggccacactggccccgtctcttggagggagcccagaccctgtagggagttttgttttcctttcttctcttgggtgtggtgtcttgtgtttctgaatgtgaacccaaagaccctacccctggagaggaagcaccttcctctttgtgttggtctcctcatagcactgtttgctcacagcagaaacggggctgccacagcctcctgcggctctgctgccttctgggccctgcgtgcatggcatctatagctccttgccctgatagtcaatgctgtggcccttcaagcttgtctttcaaagctttcacaatcattacaacttttatcaaggggaataataatctctaggaaaattatgtccactttaggagaatctgtcaagtgtagccactttggtgttgttctgataatatactgtatatgtacaacttaataaattttgatgaggcagaatctggttgggtatgtttcttatatatgtttgaagcagatggctgactactaacaggtcattgccaggtgtatttctatactctttgaagaataacattttaataaaaaa

SEQ ID NO: 653 - DNA, 4574 bp, Homo sapiens
atcagaggaagaggaaggggcggagctgctttgcggccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaaggtgagcactgaaggggctgcagtggaggaggccgaaaggagtgctggggctgggggctggggctgatgctggtgcgctgggctcagaatgcatccctgatggagagggtggcatctacaatccatcactgagtttgctcccctttggggacacccatggctacatgccaccatcaccccattgtgacctttgtgaagtaagaaaataatgcagacagtgcctgaggaagtcagcttgccaagcaaaggcctcatgccacaggccgctgagctaaagaagaagcgatggcctggtgctgcctgagttacagggcaatatctggaaggcaaaggtgtgcactgagcttggtgcactgagtcctgcccagccccagtttggaaatggaggcccaaggggtggtggccaggggttggcctggttcctctgctctgcctctgatttctcaccatgcgctcctcccactgcagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcaggtacttatcgtccgtggaaacccaggaagggaaaagaaaggtgaatgaaagtgaagggagaagggaacctggggcattgtctctgattgctctagcatgagtccttagtgctcttcatttggctcccctaatctgactcctccttccctttctactgttttgccgcaccaggctttttttttttttttttttttagtttagtttttgtagagacaagatcttgctatgttgcccaggctggtctcaaacacctaacctcaagcaatcctcccgcctcggcctcccaaaatgctgggaccacaggcatcagctactgctcctggccctccctttttttttttttttttttttttttttttgagatggaatcttgctctgttgcccaggctggagtgcagtggcaccatctcagctcactacagcctccacctcctgggttcaagcaattctgcctcagcctcccaagtacctgggactacaggtgcacgccaccacacccagctaatttttgtatttttagtagagatggggtttcaccatgttggccaagatggtcttgatctcctgacctcatgatctgcccacctcggcctcccaaagtgctgggattacaggcatgaaccactgcacccagctttccagccctccctttctactcttatctccagccaccctccttcaaaggtctggcagcataacctctctatgccccagctgtgtctttgctcatgttggccctctggaaatgatttcccccttttttttaagtgctccagtttttcccaccttatccatcccatgtcatcttccctctgtgtggtccttgcttcccattctagctaactcttatccctcccccatactcctggagccctctgccctcagagtcttttgtgtcacacagacccaataattagaactgtttggtctctggctagactgtgagctccttgcaggtggggaagatgtcatgtatgcttttaccctccacccaaatgcccagcacaggaggaccaggattggaacaagtgttgacctctcatgtttactttgtttcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgagggccagtagtgggaacacggtggtgctgggggacaagcaggctcctgttgagctggagcacctctgggcacagaagttttattttcctggcattcccaacaagtgttccctggggattcagctcatggtcactgttgaaagccttcattcagtccccctttctctagccagggctgcctggacccctggatgccctgattaccatccttaattctccctactaggtgcatataattggccacattcccccagggcactgtctgaagagctggagctggaattattaccgaattgtagccaggtaggacggagatgagggtgggaatagggacagggtgagtgtctgaaggctgaaaattcccttgagcatctcaccatccctgttgtcccatggagtggggaggctcctcactagaacaggttggagaaagagggcatcctatctccccagatgtcttcctacccctccctagaatcttctgaatgtagtaccttctggccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggtgagtgaggcagaagggagcctcccttatcctggagttggtgggataggggaaggaggttggagccagagcctgcaaagcatgggcaggatgtgtggcccctccctggagttacccttgctccttgcccctccagtcagccccacatccttgcaggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccaga

SEQ ID NO: 654 - DNA, 143830 bp, Homo sapiens
actagagggacctccaccccaggttgcgagtgcagcgcggcgggacctgggatgattcgggggctttccgacctgcttagggagggcggctcagagacaacctcaattttgcctggattgcacgcgggccgaggaagtcgggatgctccgaagggtttctgctctgggagtgcctctaatgtgggttttctatgctttctctcttcgcaattctcgacaccgtttccttcttcctcgctttcattccctgtgaccggagaacggcgctgaaggactggagaagcccaggagactgggagccggagcgccgggtacccacccgggcctccccgcaaccggagctgtgcggaggaggaggcgcggcgaacggggcggggctcccggaagggggcgcggtccgccgagagaggcggggctggggcccggacgcgcggcccagggggtggggacgaggcaggttcgaaggggcggggctgaccaggccggtcccccgggaacaggaaccctggtggacgggtcccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccaggtcagtgggctctccccacaccccgggcttgccgcgcggtcggggttgggatccccgtcgggagcattacctagggagtggagcgcccccagagctacgaaccacggggacgtgtgggtcagtgtctctgtgagccccggagcgtgtcccaggctcgaggacggggacccttctccaactccactggccagaagcctgggaggagggcagaactcctgtgggttggctgcgaatctccacccaaccctgcctgggatccgcggacagtccgcactcctgcaggtgccagcgtggccctggagatgcgcagggaggtggggtccctgagttctgtgcggcgcgtcccagccctgctcagcccggggagcagcggcgtggactagggagcctaaggaggttgcggaagctttaggtctgtcagcccaggcaattctctggtggacacagcgtgtgtctagatgcagggcctcggctaaagccagttctgtagtgtaagtgcaaaaatacagcacactttttaaaatctaaagccgccgcgtcccagtagactgcaggatggggacggtcctatttaaaagtgggctccctcctcacctcatcacatcagattccagacccgcagtttttcctcggatgaaaataagattatgtaacaagagaacagaacttccagcgtttggataggattaagacaggcattcttgccagtgtttaatcttcttaaaaaacgaatctaattatatttttacttttagagcagccagatatttggtatagatccgtgtcccttttctatattttggtctacttcctgtctttctcttcgtctctctcctttctcaacccctccttaattgattgtaatacaaatctgaagtgttttcaaatttgtagtgtattatgtgaagttaaatggtcaactacagaaaagtagttggttttcgacataattcatcttcagcatattcagtctttcattattataggtgtatggaaagctgtaagtgttatctaatttagaaattatttctctttggcttaagagaggcaacccatttgtactttgcttaaattcatagctaaataaatttgaagtgggagatggggatgattgatgaggttttcactgattgcatttatccatgttttatttaacatatttcaattattagtaatactattttaagatttggtgatgtgacagttgttagcttattgctactggagagataagctgcttaccatgatgccttctttactgggtagctaagggagatgcgctttgactttaaaagagtaagtggaatgagatcaatgacatgaaggcggtaggaacaaagttatgggaattcctgtctttcatctgagcagggaaatctgggataattttaagaaagggtgatgtgatggacctcaaaggatccctcctggggtttttgaggcagagaagggtagagtgtggcctgggctgtgacaactgtgtgggcaggcaggcatggactcaccatgagaagtggccagtggtccagcttggctcttatgtcaagtgctagtcaggaaagctggtgacaaggctggaaaatagtcccagctgtccagtacagaagtctggacttggtctgaaggcacagcaggggactgactgatggttctgtgaacttctcaaagtcaaagaccttggtccttgaccctcccaattcctagcctgatacagagaaaatccagtaaatatttgtggagtgcatggtctgacaacactgtagagcagagcttctcaaagttgagaatcctgtggggatcttgttcaaatgcaaattatgattccataggtcaggggtgggacttgacattctgtgtttctaacagattcccaggagcttgctgatcatttccctatgtgtagcaaggatttagagtagcagtttgcaaacctggctatgcctcataatcgcctggggagttttgtaaaacgttcagattaagtagtctgggatgtttttaccaagttcccccaggtgattctgttgacaaacccgaaggcaactgctgcaatggcaaagttctgggagtgtggtgggaagcaaactccaagggaaaaagacagtgggggcggcgaggccggataggaaaccgggaggctgatccagggtcaaagggatgaggccttattttgggcctgagagagtgatgaggtggggacaggtagggagacttcggagagatagaatctgtaggacagaggactagggaatgggacagtctctagactgattagatgcaatgagaagtgaggagggagaaacaatgctgggaagattcagctttgggcctgaggaatggtatggcctttagactgtaatgtttaaggtaaagtttatgaaaggttcttgtattggttcgaaccccgagagcctgccaacagacaacatgaggcggtgtggggcaacgtgctgttttaacgagcgcctgggtgcaggtgggctgaggcctaaaatggcgtcagcaccaagtgaggacgaggcaggggttttatagtttcctgtaaacaagaagtgtctcagtctgatgtaacttctgcacagtacccagacggcccctctctctgtcttcaaggggtacgtgtcttccagccagggtaggtgtcttctggccggctgtcttcctgcttctgctgtcttgctgatgcacactgctggcgcaactggccttgcaccttgggactgggcctgagaagggaggagttactcatctcttcaagctttcagaccccggggagaatctttcattcctgtctatttggttatagtaaaaagggaaaaggggtgactttctcaataactacttcaggcgtgacttaggggtggtgtgggctccttggaaaaagaaaaacttaatttttagggtattcttgagagatgtgttggtatccatcgtgtcgttgtagcaggagcatagtctgaattgtctggtggctaactgtagtttcaataagagttttagtggcttttattattagtgggataacacaggggagaaaaagtgatgaagattactgtccctaccagggttttaaatcctcctaaattagagaactgttgtccggctgctagagtgagagctcgagtgagggtgatgagttcagctttttgggaggtggtgcctgggaggagcagattggcttcaatagtgtggggtctttaagggtaatgtggacaggggtgtggtgttttgcaactgagggtgtggaaatatccctaacagcggggttaactacagataggggtaaggaaaggttgcatgttttagggtgggaggttggaggagcagaagaaagctagaagcctcggaggggtctgggttgatgcgttgggtactacggggaatgtggaagtggagagtagtgtggagttttgaaaggatgtccctgcctaggagcagagttgggaatgagaccaggtttggggtgaaaaagtgagtgaaggaaaaggtgtgcaggaagcagaaaagtggaggggtggctcggggttaggagacttgtccatcaattcccacaacagagacttaggaggactgggtgggtcctgaaaaattaggtaaagcagagtaggtcacccatgttgattaaaaccatcagggttacccttggctcggatgaagtgatggtagttgccggggcatccattccagggcaccatcagtcttcagcggcaaggcaaatgagatccgagtaggaggttttggcctgctcatgaagggatggggggcggtccctgcaggggccgctcatagtccgacttccagtggggtcctccgcagagggggcacggcctggtgggcttacctgggtatgggcattgtctggaccagtggctttcattgccgtacttgaaacaggcgccaggtggaggtggattgctaggaggcttctgtgtggagctgtggccccgtgggcctgcagggcccctgatggcggaggcaggcatttgaaactctgcctgtttttgccttttactttcctcatcatgattgttaaagactttgaaggctaaattaagaaggtcttgttgtggggtttgagggccgtcgtcaagcttctgaagcttgcaccgaatatcgggaatggattgggagatgaaccgaaggtttaagatagtggttccttctgggttggctgggtctaggttggtatattttctcatggcttcagttacatgagagagaaaaagggctgggtttttgtcaggactttgggtgatttctggaagtttttcatagtttaccactttatgggcaccctttttgagttctgcaaggaaacacataatcgtgtggtctcgatggcagcatctagaggccctgtcttgataatctcagtgggagtcctggttggggactgcctctgcaccagtaggcttggcaggagcttgttgatgaattgtgtcagcatgcacctgagctagggtccagacacagtcctggtcttctggggtgagggtggaagaggggataacgtagaggtcatgccaagttagttcataagactgggtaaggtactgaaactccctgatataagaggtagggtcgtctggaaatgaaccgagtcttttgttaatttgagagagatcagtgagggagaagggaacatgaactcttaacaataccttcagctcttgctacttcccaaaggggacactctagcactggcgctgaagtgagggtggggcatgagccaaagatggcgctcgagcgagtatgggcgggagagaaggaagaagtcagaagtcgttcctgctgagggtttgaaggggaaagggggtttgagttgataagcagtggaggacagataggggcgtaaggtggcgggatgggtttacaggcttcaggagagggcagtgaggaaggagaatgagtacaggcagtgctagagttgtcctcaggagaggacagtgtaggaaaagaagtgggtactgctgactgggaagatggtggctgggaagatggcagctgagaagatggcgactgggaagatggcagctgagaagattgcggctgagaagataaagaggaggcttgcggggttaaagaagatggttgagagggagaggtagagtctgggaggaatggacagcagtctgctggatctaacggggaaaaagaggtatggtcgggaggagaaaggcgatcagggctgcgagaatggaggagaaggatttgaacaggtgagcaagaattgcagaggtcgggttgtgatctgagtgccaaaaggcctggaaataaggaatttcttcctatttcttcggtcgttggcaatacttgcttaaatcagttaaaactgtaaagtcgaatgtttcatttgccggccatttggaccgttatctaatttgtactgtggccagactgaattgcaaaaaaagaaaaggcgcttagggcggatatcttgcctgaggcctaaggtttgcaggttttttatgaggcagcctagagggctgttttttagaatggagggccgggagtttcccataatgaagggtaggcacaggagaacagggaaaaaggagacagtcctggacagccggacggagacgataaaaggagcgatcgtcaccactgcctttttcattcctggaacgggatcaaatggcttagaggtgtccccctaagaccagatgatcagcgagtgcctggcacacgctggagcctttttggaccaacgttggattttcggaccagagaaaccaaaagaggccgagcacgtttttccctgttaaccaggttcccggggaagcttaccagtaggtgagatcagtgactgatctgcatgcacagagaggcgactggaggctaaggagcttcctttgtccagctgctgtggcctgctttccagcatagaggggtaggtccacgggggacacagacccgagcctctcccaggtttcggcaccagatgaaaagttcttgtattggttcaaaccctgagagcgctccaacagacaacacgaggcggtatggcgcaacatgctgttttaatgagcgcctgggtgcaggcaggctgaggcctaaaatggcatcagcaccaaatgaggacagggcaggggttttacagtctcctgtaaacaagaagtgtctcagtttgaggtagctgctacgtggtacccagacggcctcccttttggttttcagggggtacgtgtcttccggttggggtgggtattttccggctggctcttttcctgcttttgctgttttgccgacgcacgctgctagcacaactggccttgcaccttgggactgggcctgagaagagaggagttactcatctcttcaacctttcagaccccagggagaatttttcagtttagaagtggttttttacttggccataagattttttttttttttttcctgaaatgcaaatctgttcatgatgctgtcgtgtttgaaatcctctggtggatatcctaatgcaaaatataagaaggaagcactaatataaacacaactgataacacttgttccattctacagcctgttcatccccattcaagatgtgacattcagtccccatttggtgtgggcacaactaggctgaaacttttggcagctttgtttattcctgagtcactattttccctgcgtccttcttcttcagaggagctccacctcccttggactttatgtttcttagtatcattttttggttccaatgcttgatggcacctatgtgtctctgtcttcatggaatctatgtagttctaggaaaggtgggctttatcctttatacacccttaaagccaagtcttgtttgactgtggatcttcacaagcttcattcttatctctcactcatctggtaaataagcctctaaaagaggctgtcctagaataatctgtttagctttaggcccagatctccttagtgcctcaagttccaggggactgctgactccgagctttgtcttcagcaaatgtatgatttctgtttgccttaaggtcgttggcttggttctccctggttattcttactttcacttcctctctctgtcatgttcatatgtacacatttatgcacactgaaagctgagcattcattgtgcttgatgcttttaatcaccctgttctatgttgcatagtaatcatgatccctaacatacctgtagatgggaggcctagacacagaaggaataggactgtctctctgataggataaaatacaccatccttgtatggcattcaaatctctacagtggtgggccctactttagctctccagctgcctctccactgttccccaaactgagaagctgagtaatttctattcttttgtgcctatctgcatttgcatacactattttatcttcctggaaagcccttttgtctctattctgcaagattattaatccttcaggatatagatcaaattcttaaagctcccttgcccctaagtcgtttttactcttctgttacatacatatcacatcaaacaaagatctgctatgctatttcatcactttatgtctatgtctctgtccatattcctccaaactctgagctgctttagggctgtatcagctcttgtgcgtggccccacacttagcagatgtccaggaggagtctgtggtagatatgggccttaagctggctggctttgcaatgtttacctcagtaaagagggaaaggggctggttatttcgtatggtagacgagagaaggaagaggagcagaagctgaaagactgggaggaaggacaggcccagtgaagagtgggcccatatggctagagtcagggggttgggtggacactgggagaggtgaagatggagtcccaggctgggaagagatcatggaaggccttgaaagttggagctatataatttaaattttattctgatgacattaaagtttccatactcaagtatggaaaagacgtggtaaaactgttcaggatgattgtggctgggaagggcaggttggagggacagggaggaacttcttatgagcacaggctgttagaataacccactgaggtagctcaggacctaaatcaaggcaatggcagtaggaatagagagaagggagcagaggcaagtgaccatgccaagaaatccggcaggatttggtgactgattgtatttgagggaaagagaaaagcgtcaaactggatactgacgtgtgttagtttgctgggagaagaatgaggcaactgttagtagcatgaaagcatggaggaacttagtggaagggggaagggaaatgaaagtggttgattcttttggaatcagaagggagcctcgggtagtttcttgcttgccctttatatgtttacccataagaggatggtgaagcccagagaaacctacccaagatcacttagctcttgattgtagaacccaggtctactggcattatggcctgggcttctatcttctgtagcacatgagtttagccagaggagagctgccagaaggtcgagatggagattccattaggcaatgaaaaatgggaatgagaccaggtttggggtgaattcagcctgcagaacagctaaggctggagtcttataggtcaagcacccagatgggaaatgtctgctagttgccaatgccatgggggcccgaaggctcatgaggcctcctttttgccctgtggcctagctgtatgtggggctgatgggagatatgaagtacttttagggtatcagcgctcttatacttattatgctcaatgtgggcacgtgtattaattttcttctgggaatgtaaccaccaatcaatttatcaattccatgggaagttgtattccaaggcccaaacacctcctctacccagacttcagggcacatccagccagttcatgagaagttgcctcttatagtgttggagtggggatgggggtacagggaacagctagctagggaaggcaaccagccatgaggacctcatccaagcagggtccggtgtagagtcaggatcggggactcagatggctggatgagggctacagctgtccgatgaggagtgaggatcttatctggaatctgcactgctgtcgggagactcagtggccctgaggctggagttcttcaatcctcctcacccctcccttccacacacctttgcccagccaggctcctcagcctccagcctcccaggatggagtcttgtctttgtcatggacgctgacacagtggtcacttctgtttcttgaggaagagccaggtttatgaatgtgaaacatttgaattattgtctgagttgtggtagttgccaaataaaaacatatacacaaagaatactgggagccaacgttgaaggaaaacttgtcaaacttccctttctcttttgagctttgtagtggggtcttgccagtttatacctcatcttgttctgaaggttttttgtttctgtttttcatattaaggccaaaatatgtgcacgagcctgctcacccatggtaaagtgtcagggacagccacaaattgcacagattacagacgtagatttgcacttcccatttcttaggaagtaggtgggtggaggaaccactaatgcatctccaggaagggatttgttagctcaagggaggctatggggactagatcctacattgcctcttcccaggcttatggtcgctgtggtgttcccaggtggctctgcttcaggtatgtctctttcctcctgggaatagggaaggaggtgatccagatctcaggatttctctgcctgcttagggatgccagtgaggtgtgtttagtggggatactcttgtccctgccctccagggtaaagttacacttccacagtaacttgtgtgcatggttgaaatgcagccatcacatgcagctgggcctctcactctgacctggagggccactcctgtgactgcactgattatcccaagaggccttcttagcaaacttctccaagttgcttctggcgaaaggttcagagaactctgccaaaaggaactacttggttgacaactctgtgtgtgtgtctgtgtgtgtctgtgcgtgtgtgtgtgtgagagagagagagagagttgtgtaggaatcaagaggtttgtaatagggacaagggggacagagagggggtagagccacagctcaagcttaggaagatcaaaaatgggttacctctttcttgcctgcttaggcaagaaagcctctatcttcaggggcaacagtttccttctcccaacacacaagtccatgttccctccaaatcaaagaggtttttacacaaataactagctcaatgctggactgcttcatggaggcagtggaggtgtagactggccccacagaaagtttcttccacaggaaaggatagagcagaacttccaactttggtggatttgacaaatggcttgtttcatgaggtcagggtagtgttattcccattttatgggaaacaggtgccagagaagtaaagacacttttgaaggttccagagtattagatttaatgtaatttattgtccgaactgaacacttttgaaagtgaaagtaggcacataaatgctaaactgggtggggactggggaagatcaggatcaggcacattgggatgtgtggtttcaaattcagtgttcaaaactccaaattctatgagcaatgggggcagaaaagggaaggggtggggtgggagagtggattggcctgagggggtggagatcgatttgggataggaatagcagattcttctaattcaacatttcaccaaggcagaggaatagttcttgactctgacacctgaccttgactggatgtcatgaaaaagtttcattacataagctcttcctgcgaccaaccagccaagacatctggttcttggatgcatgtgctcacctggtaacaacaacagccttgtgtgtctgtctgggttttcactgtgcctgctcactggtgcggcacaatgccccgggcagggattattgttctgcttgtggaaatgaggaagctgactcctcttgcctgtcctgccccctcattctatcatggcaggcaggaggttttctccagcatgaggacttggcctccctaactcctgtgggccctggtagctctagagtggagggtttgaatcagacagtcctcgattaaaatagctctacaccaattcgctattgctccgtacctctttgagctttacattcctcatctgtttaatgggaacaataataggccaattcatttggtggttgtgaaaattaaatgagatgaaatgttgactccagtgcttggcacatcataggtagtcagtaaatccttttattcccgtctcaggaagcttgagagaaatcatttatcaagagatatttagatcatccagagggcttatcctgaaatttcaggtgggaagttgcatgctctgggcttccaggtatgacacagaaagggcaaccatggtggcggtgagcagaaattccaggaggcagaagtccatgacaaggtagagaacagcccggaatcaggtggctggtcacccacgtacaggacaaaagcagcaaacagcgcagagtccaaaccagctggatgagatgtggcagggttaagtgcaaagtcctgcccttaggccctgaaaatcaattgtgtgagtgtcctacccatctatgtggaaaagcccaatacattggcttagcctggctacattaattgaagtcctgggtttagaccttggtagaggatcttttccctgcattggctgagactggccacacctggagtgtgcaaagccggtatccctgtcttacaagctttggaggggcccaaggacagtcaggaagatataggggaatgactgctattttcaggtgggcaaggtgggcagcatgttctttgttgctcagagggcagagatgaaggcctatggtagtgatgtcaaagaaaactaaagacggagcagattctactttgacataatgtaagaaattttaaagaactcaggcttgtctctagggccaaaccgctgttttagagcagatattggagtctacctgcaaagggtattgttcaagcagtattgactagagaggagtttatgaaataacagggaggaaggtatactgaaaggttatagatctaactaaagtgctgtaagattttggcaaagggaaggctttgtggatcaaccaactggggtgggatcctggggagctgggaagaaaaggctctctggggatccctggtcagtcaagtgagtaaaaggcatagaagcccaagtgagtgaagtgggatcgagaaataataaggaaaccagcttagctagactcttcccattattaaaagtcaaagaaagaagttgggactctaagggaaaaggaacttgaatgccaaactaagaagctggactttaccctgtcggtagtggggaataattggtggcttctgagcagaaatgacttgcagcagatgtaggctggagtgagggtgggaggctggggaaagagcagccttaaagctgtgcagaagcggccgggtgcggtggctcacgcctgtaatcccagcactttgggaggccgagggtgggcagatcacgaggtcaggagattgagaccatcctggctaacacggtgaaaccccatctctactaaaatacaaaaaattagcccggcgtgactatgcggaagcttctctatcccaagtcgcaggctgaacatcccacttagtgacaagggctgggagaggggaaaggctctgagcaaatgtctttgtgggctgaaaatgagactatgatcccaagaagtgactggactgtgtatattctttgctgatgcctaccttggcccaaccatctgaaagctgttttagactcacttgccaccccttgaagattttgagaacacaccatcctgagacctggagaaccagggtatgtggtgtgagacagctgggttcacagcatcctagagggcatagcaggtatagaagggagtgatccaggaggacactggtcacaagaatgtcctcctggatcactcccttctatacctaccataccctaggaagtctgactgtctgcaccttgggccatagagtgagcaaggttccatccctgggaggggaggcaaggaagggatgtgggtaccagggcctcattcaagtaggctgaggttttgggtggggtgtggtgtatgggaggagagagttgctgtggttaggcaacgtggatgtctgagcagtgtgatatcttggtctgggtggcagggaaggagtctggcaagaatggtaggaagagtggccatggaaccccaaggtcagaactggcccattggatctggggaaacctaccctttagcagcagaggtagagcatacttctcaggtactgtggaatcagtaggattgtgacagtatttattatttcagcctctaaataatttttgaaccattgtctatgctgagaatggtgatgatgggaccacaagatgaacagacatgtcccctgactgaatggaacttaagaaatgtacccccttactcaaacagatagtagtaactgctgagaaaatacagttaatattcagagaaagatgttgggggggcctggcttgctgaggaggtggcatttgaggtgtgtcctgaaggaaagacagggaccagagttgcccgtttctatggggctgaagggaattgctggcagagggaacagcagtgcacaaaggaaggcatgagtaatgccaattaaggggcacctgtggaaaacaactggcggcatgatttggctggaactgaagagtaaacgaagttaaatagggcaccagggattggaaattaccgtctatgaagtacccatcatgcatcaggcattgagcacagagtctgtgctcacttaaatttcaaagcagcctttcagggctttaactgaggaggaaatgggcttcaagaagatacctgatcatctcaagtttccctaggtggtgagtggccaaaataaaattgatgtccaggctgcctgaccccaaactctgttctttccacttaatcttgccactatgtttagagtccagattatgcagtcttaaatttacagtgaagacctgttcttaccgtatttaggcaggaagatggtcagatggcacatggcaaaccacattaacctttgagaggcacttagtggacatggccagatagtcacaaagcatatctgagttctaatacatatatatgcatgcatacacatatatatttaggaagttaatctctaacttcctaaatgcagttttcacattacaatagaaactgttactcccagaccactataggcaatttctgaattgctggctgaattccagtattttctcatcccttcaataaagtatattagaatggggcaagataagcctgaatcttctctaatttatacaaaaagcttctatcattagtaacaagttacctacaaccaaccttacctgtttaggataccaaggtgtcagccctaagagatgtttagcaagagtggtactccaagaggtttggaagcgtgggatgagggtaagagtcagagaaatgtgggcagtaacccaggtggggctgtaggggttgagaggagggaccgatacagttcagtaagcatttgctgagagcctgcccatgcaggggtgtagagtgggtgctgggatacctgcatgaaaggacaacattgttttcacagatcacatgttcaagctctgagcaggtgggtgttggtgaggactgcctgctcaagttggggttcttatgcgtatatctagtacagtcagccagtctttgttgctgagcaggtctgcccagggcccagttctccatccagtttggccttcctcctggagctcagaactcagatctagccctggtggccacgccttgcttctgtcctcagggtggacccagggtccttcagacttcctaatgggaggcttttcctcagcctggagagaaaagttgagaccacctgcgaggcaatagtaaccactgagaagacagaggaaatattcagaggaagaagttgggggagcatctgggctgcagtgacgcaggatttcatgttaacaggagacaatgtgggaggaagctctacctccttgtcctaccacttaataaggtacactgtgagaacccgttaaaggctcttccagggtcacaaatccagtcctcaaatgttatgatttatatttaaaagagaattttagataagccaagtgacagctgaatgggaaatggagttaatgagacagatcttatcggctccatgaaaaatgcatctcattacatcactgttacacatcgtatatggaaaccttccctcagtaattcctggagtgattgcctgtctggctatcggtgtccccaaagagtgtggtgtccactgagaataaccgggaggcctttctcagataccagtacggctcagccatcttctctcaaggccatctctagagttattatgggctctcttgatgccagtgcatggagccagggactgctgcaccgaggacaaagccagccagccatgaacgtggtcaagacttggcccttcccctccctaaccctacagagcccagttcagctttagcctccatgtttgaggcctcccaaaatccatttccccagcggtgtcttctctgtcaggtacctgcccctgggatggcccctgagcctcataactcggcctgttcactgttcctaagcaggtcaccttgtgaccctcgtggaatggctgaggaaggaaccgaggggctgtaagagtggccgtgtgatccctaggaaaccttcagctctggaaggccctgtggccctaaccttgccctgttttgtcaggtactgctagagagacgcagaaaacctggagcatgtgtgctgtttgagctgctgtatcccagggtctgccactttgggggctacctgcaagagatttggcaacttctcaaaggaactcaacatcatggttgttgtttttttaaccctgatcccaacatttaggccctgatgaagggtcttggccaaatccatcttctggaatagtacagttgggaacatgttctctgatgtggagaggcagagtgttacatacttactgggccaggcactgaggtgggtagtttattctgtcctctttcttaaccctctgactaaccctgtgtaaggcagatattatatccattacatagtaacctgagaggttaatgtccatattacccaaggcaaaaaacgaatccagctcataagtagtggagcaaggatttaagcccaaatctgtctgactttgctatggtctgaatgtttatgtctcctaaaaattcatatgttgcaatataatccccaaagtgatggtattaggaggtggggccttgggaggtgattaggtcatgagagtggagccctcatgcttgagattggttcctttataaagaggccccagagaactagctggtttcttccaccatgtgaggacatagctggaaggcaccatctgtgaaccaagaagcaatcctgctccagacactgactctgctggtgccttgatcctgggcttcccagcctccatagctgtgagaaatacatttccattgtttgtgagctaccttcccaatttatggtaattttgttaaaacagcctggacagactaagacaaagcttgggctctttctgctgcatgctgctcctctctttcttcaggggaagaagcacctcacttgggaagaaaggagcctcagaaggcttgaggctgggggtatggggacccagcgtctatactaccccttctgtggccatttggagtcacatagacctctgtaattttcactttttcctttgattctgaggaactgtttgggtatcttctataggggaataaagactctgctttatggaaaggaagagctgagaaagatgggagagaggtcccaggagatcattagaccttcccactcccctggagtccagctaacaaacttccaggagcaaaaccacttgggcctgcagggaaggggctacctagtacagtgtcattctccagcaggcctgtctttggcctgcaggaacacttgtgcaagtgggggattcctagatcacttttcttgggaaagtccctaaaccactttctggcctctgaactcttaggggagggaagtgatccaagtggcaaatatcttgtgactggcaagccaaggttagggaccaacccttcccctgcctccccacatgctggagcttttgaactgagttgaagatagctgggcccagggctcttggcccttgaatgcagcttgacatctggtcaggctgcaggatcttagggtttcctctttgtagcatcctaaaatctggcctcactaaatggtctcggtccagaggtgggattcgacttagagctgacttacaaagaatacagataaaggaatattgggaactgtgcttaccttgatgtggtttaaggtctgaggatgtgaagaaagtctctcctggattaagagggaaggggaacaccagtgggtcaggatagaggccgacagccctggagaggaggctgccttcttcccataactttcccagctgcgtgtgtaggatcaaatgggggtgtgtgttagtttgcttgggctgccataacaaagtactggggggcttacacaacagaaatttattttctcacaattatggaggccagaactctaagatcagggtgttggcagggttggtttcttttggggcctctccttgacttttatttattttttattaattttttttttctttttggagatggagtctcactgtgttgcccatgctggagcgcagtggcacgatcttggctcacagcatcctccacctcctgggttcaagtgaatctcctgcttcaacctcctgaggagctgggattataggcatgtactaccacacttggctagtttttgtgtgtgtgtttttagtagagatggggtttcaccatgttgtccaggctggtcttgaactcttggcctcaagtgatccactcacctcggcctcccaaagtgctgggattataggcattagccaccatgcccagcctctccttgacttttagatggctgtcttctccctttgtcttcacatggtctttcctctgtacccatgtgtcctaatctgctctgcttttaagtacaccacctattggattagggcccaccctaattatctcattggaatgtaattacctctttcaagaccttatttccaaatatagtcacattctgaggtactgggggttaggacttcaacataagaattttgagggtgtgggtacaattcagctcataacagggtgtttccaaaatcctcattgaacaaggctcagtgtcatggtgaagcatggagaggcacttactactgatcctgccaaccttgggaccaggagaggatggtggacccagctagctagtggaggaagcctgactggcctcgtccaaaggctcagctccaggccgagctgtttacttgtagtcaggctctctggcagcagtagtttctgtgcagtgtcttcatctggctcccgtgtggccctcggaactccagtgaacacagagctgctaataccctccagcccaggccttcgggggaagcctccttctcctctgatggaggcagaggccaggctgttgttgacagtgcacacaggcctgtctttaaagaaattctttggtcttctactgacttaactttttttattgcaaggggaaaagcattgcattgaatcaaaattaaactgttcaacaaatgttgaaatgaaggctcaaattacagaatacattttgattaattcaattagtgtttacctccagcctgccaaattctggggcctattcctcagcaggcagccagggaggctcgtaggagggagttggctataggcaaaagttacgcacgctccagctaatagagaaaacttaccaattcatatctgtttttttttgttgttgttgcttagcattctaaaataatggaatagggagaagtgcctggttttattatctattaggggaagtgacatccttttttctcattggtccttcaggaatacaattgcatccatcagttatgtctctcactcatgccaggcccaagcgtaagttccccttatggtagagacgctttcacctctgaatatctggctgtaagagagaagggaccccaggtgtggagaaagttcgatgagagaggctgtcatggatagcccccaatccttctttcagagtgctggccaaggttacatgcccagcctcccttcactttccactcaggtacacaaacacttaacattttgtgtcaacaaacatttactgaaggtcctgtgccaggttctttgctgggctctgaggatagaaaggtgaatggagcatactccttgctctctagcagttaatctagacagggaggcagacacattgagaaataatacaaattattatcatcttcataaataatatagacagctctgacgataaaggtgtgtaccagatatgacaggagcagagctgaggcatccagcaccttcagggatgaggggtaatggtgttaggaaaggttttctggcagtggtcatttggataaggccttagcatgggtgggatttgaaagtagagatggagaaaagcacccacgtagaggaagtacagaaaatggggtatttctgtatgcgagggtaggacgtggtccagtgaagctggaactcagagtggtgaggactatagcggggaaggttaactgtattagaggactttggcagagctgcaaaatgcagcttctctcctgaaagcactgtgaagccgaggaatgtttgagagcagaggagcatgtcatgagctccatggaacatgtcttgcctgcacagggaaagaaagacagattgcagggaagttggctagaggtagaaagcccagaggaagcagcttttgcaatctggctgagagatgatgaggttctaaactgtggtgaggtgagaggtaaggagagtttggtggaatgttaggacctattcagggagtttgaatggcactgtagaaagagcaccaaatgagtcatcaggaacttaggttcaaatctcagttctgctggaagggaaagtagaattctctgccccctgccctgaaaagtccacatccccaggtggtggtttggttttttgtgttagcctgttactataaaaagaattcaaatgtacacagaaatagaaatagtaaaatgcatcctcttacccatcatttagcttaacctcttgcttgtattattttttaggggggcaatttttgagatgaagctttttggaaatattcactttgaggttgcatttgaagcatttctctgaatctgtttatgatctggttgaggcaatgaaataatttcacgtccatttgttcctccctggaggtaaattgtgtgtatgcatgtgtgttctttgctgtaagaaggaaaatgagggtagcttcccttgaagggtaagttctggggctgaggaggcacattgccaaccgggtcctgtcaggggcatgaggctctctgtctgctgtgggggcaggtgtggtgtggacaggggagagaatggaggtaaggactaccacaggtcagacacccttatccattcactgggaggggcttgttgcccagagcttaattcacactgaccaacctgacaaggctggtccataagccagacaccaatttaatttactctggcaggcattgtgcagtggccacaacgcaaatgcctgctttcccagaccgccttcctggccttaccccacctggcaaaatgaattacagcatcatccgcaggttgctggggagccatgctctcaaatagaaggcaccatgtgcattgcaggtgcatcactacaggccctgatgggacctcataggctctttctggtgcaggccacttcctttgccaaggtggctctagggagaggggaggatgggctgagctgcacatgctcagttccttctttcatttccaccatcagatactgagctgtttcccaggggaggaaatcctggaaagagaggaagttagtatcctcccattgggtcttgcccatgacaacatgaagcagaaactaaatggaggtgggagcccatgtctcagccaagattcatttcaacaggcaggggtggggatgctgtcatagagaaaacttgcctgagcattgaaaaattagttttgatggacagagattggggaaggggcctttagttgaggaaacagcatgacaaaggcacagtggcataaggatgctctcttgcggctggggtatcaggaacccaggagcaggtcaggctcagtgaggaagtgcgtccagcgtagtggttaggaacataaccttggagttggactgcctgaattcaaatcttatctttactgcttcctggatgtgtgatttgaccaagtcacttaacctctccaagcttcagtttccttatctgtagaatcgggataataatagttataaatattgagatatgagataaacataagaacttagctcagtgtagaagtgagtgtttaataaatggcagccattataactaccatcatgagaacaggacattttcgggccggctccaatttggatgccagctcatgcgttcagactgctgtgggagaggccaggtgttactcaggtgagaggaggttctccagtgccctggttctgaatacctgaacacagtctgggcagtaggagtggaaaggatgagatggagaagagcatccctgcaaggggagaccacagagacctggtggctcacacgggaggggagtagggtggggaagcatgacaggtgaatgcaggctgcatagttcaatgagggacccggagagcgcttctcccaaatgccagaggaggagagtgtcaccactgatgagatgccaaagaaggcactagagcaaacgctgactgatggcgagtctaagcgctttactctgttaacatttaaccttcacaaccaccctttcaggtaggcagttttattattatcctcatcttaaagatgagaaacccgaggcacagaggttaagtgtcttgccctgggacatatagtttctgaatcagggctgtcaccgaggcagtccaaccccagcctgggcttttaaccccaccctagaccgcctcttaaggaaatgggaacacaagcggctggctggatgagagcatggcacgggtgcacacggatgagtgacgtcccaccactgggggtgtcagagagcacgggaggtaggcagtggggctctgaggcaaaggggaaacatggaataataacagtagggtgcagggtcaaaggacatgttctagaatagcagaggaaggagcagaagagggagagagtgcagattcagtttggagggggaataattgagaggttggatctcagtgatgatcgaagattaggggtcacagggaggaggggcaactcttagacagcatgtgaagagagggtaagagatgagagaaggggaatcaagtggttttgtttctcattaaagaaagatgcatggtagtttgcagagggagtctgacacgaagaaacatgagattagagatcccaggcgcatgaatgtctgatggagccgtatgtgttgtgtagcatcccgggagcagaaggaagaagagacatgtgaacctggttccccaggcagagggagagtgagcgtaagttgtgaccagagaggtagaatgagctgaggagcacgttcaagctggagagaggtgaggactctacactctgatgaacagagccagggagagagcctccacgttgtccagaatagggctatggtgaaagaggaaatggagtcaaggaagtgtgggaagggagggaataggtggggacctgaagtgggcaggtagaagggacaggctggcagaccatggttatacttggggaggggaatccagagagatccttgagctccttgagaaggatccttccttcaggtccccgcctcctcctcctacgttattgctgggaagagtgggtggcttctaggtggctccctcagtggttgtcattgcctaatggctacaggccatgttctaggggtgacaggtgagagacccttctcaagctggggcagcttcattcgctgtcactattcccctgctctctggccactgagctacatctttgtaaaacagggctgataattgtactatatccctcacaggacccccttgaagattaaatgagaaaacaaaaatgaggacactttttttcccccccacagaggcagcagcttctcaaaggagacaggaaacctgtgaactcccagagcaggtggtttttacacacaggtggatattgcacaggctcgaaataattcaccatcatcttgatctattgtgaatggctgtgtggccagggcaggcagccaaatcttagaacgtgtgagttatctgttgcctagtcctggctcttcacatcttagccttgaaagatagactctcatttacgtttacttcttagacccactctttctgagcggttcagaaggaagggaaagagcctcctctccgaaagttctctaagtggctacggtgggccctatccccatgagggcactgatatacttgtcttacagtattgaagggcacactgatggggtttggtgatgctctgctccctggatgctgtctggctccccatctcaattcttcccaaaggcacagatccctgcctcgcttccctgccctccccgctccccactccccaatccctctccttgttggagtacctgcactgtttgacctttggcatctccccaaaccattctctgacagacctggcattaaggcatggccttggttgtggctggtttaccctaatcagtgcttgagttgggaaaaggatcagcttggagagagaggggaacaaaggcagaatatcgagagcagaaataggtgagaagagtcagaggagggtgaagcgagcattcaacaacatcaagcaaatacggtgaaggaaacttgacatcagcttcttagtgttcctgaagcccagaaggtcagatgtgcttttgggtgtgagccatcagaacctcagactcacacccgtttcctggccagaccctgcgctcctccttgtgggctgggctcgtggtgtctcattctcatgtctttggggtggtgtttctcttaaaaagcttgccatttccagtaggaggaggatgtcgctgctgagactgtgggacagctaggctcagagggagtctgacttcggggcacccggaggtgaggtctcagtgcctgttgctgctctttgccttctttagaggacagtgtgcagctttctgactgaatgccctgctgttgtgatatgttgctggaaatgctgtttggggtcatggagccttgcttaaagggctgtggtttggtgagaagggctcgagctttttgggaatgcttaagtggaagcatctgggcttggctctgccaaaggaggctggtggtggagcagggacatgtgacaggacttgggctgtgtcttcagtggaaggaccagaaagcaaaaggaatccttccagtgggttcagcagaactaggctccagcacaaatgttcttaaggatatcctggacctcgcctgacagggagtggctgggaatacccggtgcataaaactcactaacctggtatagcgggaaaaagacgctaagcaagaaatattgcattcatcccctgccaccacccagcactgccagcctgtgtctagattcagggccctttctgcagttctgatagatctcagcccccactggcctgagcttaactgactaatcagaacagcctgatctaggatgtttaggttgaaacaaggaaccttgtatgcgccaaatatttttgttgctgtaaagctttgaacaaatgtttgctcttaggagttactgatactatgattagatggggaccagttaagcatgcttgttcaccttcagtggcattcttctattttctcctcttcagcttcttttaggctacttaagcttctattcattgacaaaacaaaacaaagctctgcctcttcacttttattagactccgatattcactgaaggcattcagcaactctgatagcaacgttctcagcagcctggcccctctgtcctgctatggctcctctttgtcctgacaggatatctcgctgtgttgggctcctctgtcctgagggaaatttagcacaatggccttgtccctcattgtgatataaagccagtgtctgtgggctctgccattgctctgaggagctgtcttcgcaggccaggtgtgcggcttctcctctccactgtcagatctgatcctgtgggggtcgtgacctctggatgttataggacctgtggaggacaggtacagcttgtggccctgggcagaaggtggggacaacttgaactgctacgctgagagccttgccagtgtagaccggtgacctctttatttcctttcattttctcccttttagaatgggagctgagctccggggtcagagatatggccctgcctgtgagggccttaccacttagacaaaagtgccctggagaagtctgtcctgggagtggcgagggggacccagtcagaagtagtcacttccatctgggggatggatgggagaggatccttggagataatgatgatggaatttggcctcaaaacaggagtgggagttgagcaggtagaacgaaggacttcagctaaaacactgaagaagccccaaaagcagaagcaagctggggacaatagcttggctgttgctcagggcaggagccagatatggccaggagaattaaaactgctggggttgtgaactcccacccagttttgaatctctacagtcccacaatgtgtctcttttcacctgaattttataaataggtaaaatgaggttcattaatgttaaagagcttgtcggggcacagctcatgaaggaaagaacttggatctacatgcaggtctgactacagaacccactctcctaactgctctgtgggtccttaacttcgtctccaggtccccaagcacccctttgttgcctgagtgatagaaagctggtgaagcgttgtgaatgctgggaagccttggtaagatttgtgaaatagacccaccctcctggcagcagtgtggaggatgaggggtgtgggggggcggtgaggctggaggcagagaaactggttaggaagccagtgcagccactctgatgggagatgacggcagggcaggtgaagatgaggggacagatctgaaagagagggaggagattttaccggatctggtgcccagttggatgtgggtaacaaaagggaaggtccaaggctgactcccaggtttttatcttggtgaccatgggggcatcaccaaggtgggatgggaagcatttgggtcccacccattgtgagaatatagagagggaggtgggtgctcaggatgggaagagtttggggctgttgtaggggaacatgctgcaacctcactccagtccccactatctcccaggctttagcttcccatggacaatgaattggttattttatcaataaatctgtaaacacttatccagtgcttacagaatgggggaccccacagggacccagacacgtggcacagttttcagggagatggctgtgcacagctgctgtcattcctttccttcaggatgaaaaaagatgatcagggagatcccatttaggtagtcagaattaagtatgattacctggaagagctggcttgatgggaatttagcagggacagctgtaggcatgggcataaaagctggaaagcagtgcagacagccaattaactaacaattaggatcagatgccttagtgataaggcatctggtgaggatggggcagaggtctgccaaaaggtatgtatggtaaaagttaaagccgtgaccaagtaggttgagtccatatgatgatagaccatgatttctactgtgtggctggtggccagcccctgaggctgtctaagcaaaagggtgcctggtgcagggctgtgtttgcattccatcagttcctcaactttggtcagaatcagaatcacccgaatggctagatcagccataaaggtcaggctctctacttacaggaggctgggcctcttgcttgattagttctcagggtggttctgattaacagcaaagtttgaggaccacgagataggtgaatcttcagtgcagagtgaatggggagggctgttcggaggagggtaaccggttaggaggctattgtagtcatctagggtgaggtaatacagggacaggtgaggctgtgtgagcagatgagatcaccagtagcgtgagtttggagagaagtgctctggtcttattcagcagcatttggtgcacctgactgcgccctctatccagaaaccctttggttcgcttatgggtgccactctcacttctggctgctcctcctgtctcctttgtccattcctcttctccccggtggctgcatggtggagtgtttcagggagtcctggggcttcctctgtttttataccacttcttaagtcacttcatgcaattgcttaaatacatctttatgaagatgcctcccaaattgacatctccatcccagacttctctgtaaacatcagactcctatttccaaatggctactcagcgtaacttcctaggtgtctataggcctcttaagctgaacatttctaaaaccaatctcctgatttcacccccagacaccccacattgttgctcctgcaggcctccacattctctaggtactcagggcaaaaaccgtgtaggcacacttgactctgctctctcatgcccatgtccagtttatcagtaaatcttatgggctttgtccccaaggtatatcaggaattagaacatctaattcattacggtctgagtcacttcatctcttgccgggtttcctgtgttcactgctgcgtcccctgcagtctattttccaagaagcagccagagtaatccttttaaaaggttaagtcagatcatgtcaactctatcctcagaaccctccaaatgggtttctgtctcaggaaagtggaagaacaggaggaaaaatggtgtgcatcctcaggcaaattgcctaatctgttttctcatctgtaacagggggagaataattcctaactggtatggggattaagtgagataatgttggataaacccttagcaaatagctaacagttatctgcccaatatatggtaactaaagaggagacagatgccgcattaatttaatcttggcactgtgcctgccatgccacatgtattatttcttttaatcttttttatttcttttaatcttaatcaccactatatatccacacaatttaaagactcaaataattgtatgtaatttgttaaaacagccacctcttcacctccccaccccattgttcttcctcagatgcagctgcttaatttttttagtcatgtatttttatccgtatctctagaaaaatgcttgttctgctgctttattattttccccccatttgtcattatctgttcttattgaattaaacaaagtcttcaccaattatgtaagtctgttaagatgttcagatgcaccaggtgttctgtcaatttcatatgactgaggaagtctctcccagagcttttgaactggctgaccttgcaggcttgctacagaactgtaccctagcatctcccttatggccatgaccttgtgtccttttgagtttatgtctctcttgttaaatgagcagttaaattaaatgtttaggttcagcctgcaatgtttacctgagttctgtcttgtttacatttgcccaaaacaatgaaattgattttatactgattttacagatgagacaattgaggctaaaagaggttaaaagactcacagccattatgcagcagagcccatgttttcactcaagtctgtctgtatataaaagctgtactctctctcctttgccctttaggaagaaagtagttgttggttaatatgggatgtgattgagaatttagcgctgccatcaaattccttcatatctgtctttgtcctttttatttttggatgctccaaatggcttcttgctccactctaccaaagaggtttcttagatcctttaaagaggctttctcttaagcttagggatagcaaaaggtatttcttaaaataaccatttaagagcagctatggcttatgggaggcctgtaaattattgggaaaagactccaatttcttgtaatatagtgacacttctttatcatctgtttgccacttggggaagggagaggtaggaaaggagttaggttctgtggttgtggtggggttcttggctgaggcctccttccccaggccttgatttccaggcagagacactggcccctgtctagtggcagctgctaaggagtcaggtcttggctctggctcaactgtgtccaaggctcagaatatcctggaggcacagggaatagcagtgacttccagatctgttcctagttcatttcagcatccagggctatgtgagcctgctccaaacatcaattacaacctaaccatttttattgagagaaaagaagcttagaaatggaattcagcgtgggtggagtaaacaaaggtttacttgcttccgacttaccttcatcagtggttgctgcctacttcaaattttcttttgccaaacatgaaaggagttaacacagtatataaatcactgtttgcctcagaacataccagatgatggggttcaattgtgactcactttctaaattttagaacacatacagatcttgctccctaatcaacttccaggtgccaaactggcctttgtgtggtgcagttcatgtggctgtggcatgtcatcataccttgccattctaaaacatggcttttcctcactggctgcatttacagctaaggggtgtgggatcgttttctccctcactggtagcgaagagaagggttaagtcctgtaatgagcaggacccccagcctcagatgctgtcccagataggaagatgacagcacacacataggcctgtgagtgaaggaaggatgaattgtggatggactgcattttttcttaaacaacataccctgccttatctttatggccagggatgagacagtgtctcagtatcagaagccagcctgctcattagggtcaaaatgccagctatgttaagtgtccagagagaatgaaaagtgctttggtcccatgtaacaactgtctctgtattgtgtgtgctaagagcaatatccttctctgtgtccacttctttctttcctgggcggttgggtgcccctcgtacagtccccatggcacattgttgattcctctgttgtccatgctgtgtaaggcccttgggtagctgctgtagctctcctctcattgctggggagcatgatttaaattctacatcccggttcacgcctgtattcccagcactttgggaggccaaggtgggtggatcacgaggtcaggagatcgagaccatcctggctaacacggtgaaaccccatctctactaaaaatacagaaaattagccaggcgtggtggcgggcacctgtagtcctagctactcgggaggctgagtgaggagaatggcatgaacccgggaggcggaggttgcagtgagctgagattgcaccactgcactccagcctgggcaacagggtgagactccatctaaaaaaaaaaaaaaaaaaaaaaaaaatctacttcccaccatctgcttagctgtcaccctgatttttcacatgtcgcttgggattttggcttgggttctggctctctctgtcttctccctggtgtgttgcttctggagcttggtgcacttaagccccatatccctgaggagccctggctccctaggagatgctgtgtccctgtgggaggaaccgatgtggaagacactgaacgcactgcatgtcatcagacagcatgtttacctctgagacctgtgatactatgatatacagtagccccctcttacccatggttttgctttcctgggattcagttacccaaggtaccgtccagtaaggtattttgaaagagacagggccaggcatggtggctcacgcctgtaatcccagcactttgggaggccgaggtgggtagatcacttgaggccaggagttcaagaccagcctggccaacatggtgaaatcctgtcttctacccaaaatacaaaaattagctgggcgtggtggtacacacccataatcccagctgcttaggaggatgaggcacaagaatcgcttgagcctggaaggtgcaggttgcagtgagccgagatcatgccactgtactctagcctaggtgacagagtgagaccctgtctcaaacaaaaacaaaaacaaaacaaaacaaaaaatcacattcacataatgtttttacagtgtattataattgttctatgttattactaattattgttaatctcttactgtgccgtgcctaatttataaattaaacttcatcagaggtctgtagatacaggaaacatcgtattctatatatagggcttggtaccatccactgtttcaggcattcactggggctcttggagcgtgtcctccaaggataaggggggactactataataaaaaaagtatatatttggtctccttccagtttgctagcacagaaaaggggcaacttttgttattcataataagcgcctttcaaccttactcagctttatgctaatgaggccactcctgcaggatgggctggttaccagagaaaccaacctggtgattagagggttagaactttcagccccactcccaatcctcccgactcctaccttggggaggagagtggggctgaagcttgagttcaatcaccaaggactgagcgacccatgattggattaatcatatctatggaatggaacttctataagaaaccctaaatgaaggaaggggtttggagaacttccaggttggtgaacgcgtggaagtgctgctgggtagcagccctggagaggctatggaagctccatgcatccctccccactcctcagtcccttgccctatgtatctcttccatttggctgcttctgtgttgtcagaaactacacatcagctcctaggattcttatgaaagcacattgtatgataatggatttaagtggttttgtggtcttgtatgcatatgtggaaccctctgtaatgtttccttgttttgtatttgaattttcaggaagaggaaaataggctggcaaaaagagtcatggcttctgatgctagtcatgcactgtgaataggatacaccttgaatcatgtttcacttcaggccagctcccacaggtccacccagcttgctgtttgccaagtacaaactcatcgctgggcagagggcccatgggtcttgttttatggcccttctgttgcgggggcacatagcctgggccctctgggtttgacaccctgtcatgtttacatctgaggccacctgatttgttaggcattggcatccaggcccctgatgctgtgggtgtgattcccaggctcctctcatgcattgcccttgtactgcatatgtgaattccatggaaggctttgactcatcttgagcagctgggtgctcctgcgtaatctcatcaaccattttggcctttgccaactacatcctgcccttacatgcttccctggctttcctgtgcaccacactctctgcctggaacagcattctcctcctcatcttctgagaaagcttctatcatccttcaagacccagggaacttgcacacctgcctctatcaacataccttgcactgtgtcataattatttgttcatacttccgtctcttccactagattgtgtggttcatgggggcagatactaggtctgatttatcagtatccttctagggcctagcacaatgctggctgcatggatctgtccatttattcataagtatctatctgttacacagtgggaacctgggagtaaacaaggcagacagggtccctctgcctctgtgggaaggtggccagttagcaaggaaacaaatacatagaacaagatactgtggatttgttgtgctttgaaggggctgctttacgtggtgccggggggcggtgtggggaagccctctctgatactttggatctgagacctgaaggatgagaataaatcagctgtgcagacaactaggaagtgagctcagggtagggggatggcaggcgtattgcagaggagggaaggtcttggagggctcgggagcagacaggagaccagtgctgctgaagcatgagccatgtggggagagatgtgagcatggcctggcctgatcctgaaacctgcttcataggccacagtaaggagtttggaattttccccttagagaaagagcagtgggaaggatttggagggattatttcaaacttttaatatcccttatgctgaacaggtgagagtctgcagattgtttccttcctcctgcttccccccttttccctgctacctcttcttttatcctggccaaagctggcctccattcaggccccaggatttccacaccgtattcgctctgtagcggcctggctgctcctctcacctcggagcagctctgttccttgttgcagccttttctggctcctgccagggccctgaggtgccactgaagttccccgacaccctgtgagctcccattctcattccctctaagctaactgtgcagtggttcttgacccccgaggctgaatgcctgcttctgaaccttccttggccttagcacctgtaaatccctgccctctccccctccacaagcatggttgcttatcttccttccccatgcctgccgcctccaaacgaaccagcctcctgagtttatctggttctccctccctgcacctacctatttttgtttaaagtttcctctgagctggcaaaaatatgtcctgatgttatatcctcacttaaaaaaaaagctaacatattgaacactttgtgcaaaggaatgtgcttagtgctctctacataattttaatcatgacatctatgagttagatgctgttatccccattttacagatgaggaaactgaggctcagagatcacacagtacatagcagagctgggtctgaactcaagctatctgactttggagcctgtggatttaactattatttcctagtgcagtccggtgtggttccttggtcttgagatccttatccacaccatctctgaagccattcctgggtggtgcccattttcctgtcttcactctaaatgtcccacttcacaggaaaaactggcggagagcctcagaaccacctgtttcctctgctgcaccatgcttgagtgtggaagccgtgcccctgttctccacagcgtgtatggccattcggcacatgtgtagatttgctgaatgagcaaacagcaactcctccagtttacagacgtgagctaattctcttgggattacaagtgctattgtaaatccctccttgctacccagggagagggtggggaacaagaaaaatgagaggaggctgcaggaagagggtttaaactaaagaccttccttgaggtagagttgtccagagatggaagcaattgcctgagggacaggggaggggcattgggcagttcccctttgctatagctaggggatacagcattaaggtagtggccggactgtgtatccttggaggtgttcatctgccctgaaaagatgggattctgaacctcaaatcgtgctgggtagagtggatctaagatggtcagttatggtgctcctgggtgctgtctctacatccttgtggcctgtagacttcctaggcagtgcaccctttcccaattggaggagtggaagtggcatttgagccctctcagcctggctcacacccacccaaggaaagcactgcaggcctagggcaaatgcagatgtaagacagttaaatgcctgcagggattgtcccaggccctgcccttgtgctgcattgccttgtacgccctgacagtgtccctgttaggtgtgctgctctcctacgccacttagtggcgcctttcacagtggggtcggagcttctggaacctgggactccaattgttacacctggtgaggtgttaacaattgccgtcttgctgccacaggtgactctggagagccctggtggtttttcattacagaagtgaatgggattgtgtgctaaagattcatggaaaaagcactcatgccaagagggaaaaggccatggagatgcagaaactacatgtcggctactatgattcttatgaaaacacgttgtgtgatgatggaatgaaagatttttgcgatcttgtgtgcgtaacatggaactctctgtaatttttcctttgttctgtatttgaattttcagtaagaagaggaggaggccaggcaggcaaaaggagtcatggcttctgatgctagtcatgcgctggaagctgccctggagcaaatggacgggatcattgcaggtacgcccagggaaccccagcaaccaaggtctcatcctccacattccaggaactgcttctctccttttacttttttttttttttttggcatagagaaaatccccttttgttatatttatttttcagtggtgttattgtgtatgtaatctcttttttttctttgatacgaacttatacaactctctgatgtctggtgtgatcgttctggtctctgctgagacagtgtggatgtacctaccatctaccgtctcagtttggattctggctgtgaggcagtttgggttcagtgagactgattctaatgtaaaattttcagagcttttcatggcttattatagctgatctgaaacttgaaatctagcagactttgccacctaatgcaggtgtcagcgtcctcagatggtctccagtgtgtttcagagatgaaaggcagttttgtattgattcaattaatgattcaaattttctttatgccatattgttttttatccctctcaactgtttggttttaatatttgcattagccagtaggggactttttcttagaaaagatctagcaaagctgtggttaatttgaaaggactatcaattagctgttccagctgattcctttcttcatgggagcaaccagaagcctatattgattagaccaaacgttttgttggaaatctttccagaaggtcctaagtcttctgactttacctgatacacttcagtggcctcattggtagattggatgtgcttctttggaactttgctcttcattgtttgagctgtggctggaagagagcgtggaggaaggtattgggccaagtgtggctagaccccaggaagtacacagagtacctgacactgccctttctcaggcatttgcttttccttcccattggagggtttcatctgacttacagagggctcttggtgtttgagcctgaagtgggagagtatgcctgtgtcttgcagcttcttcaggttattgttggtaatgtgatgtattctagctatcatctgtctgcttctcaatttctcagttgatagagggcccttgagaagccatgactaatgtcctgcttttcagagaatccatagactgggatgtcgtgatgtttaatactgagtgtcaacttgattgaattgaaggatgcagcaaagtattgatcccgggtgtgtctgtgagagtgttgccaaaggagattaacatttgagtcagtggactggggaaggcagactcacccttaatctgggtaggcaccatctaataagctgccaactaatataaaacaggcagaaaaacatgaaaagtctagactagcttagcctcccagcctacatccttctcccgtgctggatgcttcctgcccccaaacatcagacttcaagttcttcagctttaggactcagactggcttccctgctcctcagtttgcagacggcctattgtgggaccttgtggtcgtgtgagttaatagtacttaataaactcccctttatatctatatctatagatatagatatctatagatatctatctcctattagttctgtccctctggaatacagatgtcctgttctaggttagggtctctgatgccttattgaggagaaagagtcaagaaagtggatttcctagcaatccttttagagatactgacctgtgagctcctcggggtctcacgtgcattgggataatagctacaggatcattccctgagaatgcctgaggcagtcatcacttcagagccttcagccaaagagcaaaggggagactgagcgagtccctggcagacctctttgatggttgtcagggagggatgaaaatactatcttttctctacgtattatctctgctgctttgtcaaaggtcatttgattatatttttgtgatatatattcaggtctatttctgaactctgtattctgtttcatggatttattttttctttcaccaataccacactgtgttgattactgtagctttagtaagtcttgaagttgggtactgtcagtcctccaactttgttcttcagtgttgtgttggctaccttttgcctcttcgtataaaatttagagtcagttttttgatcacaaagtaactttctgggattttgattgcaattgcatttaacttagatcatgttgggaagaactgacactttcacaatattgaatttttgagagatgaatcagacttctaaagaaaagtagccttgtgtggggtcagtacctctttctgactcctgatttctccatacaggcattcctgaaatgacagagcctctggcaaaattcattttgtctctgagagacattatgtggctggatccttaaggccttgccttgacccaggatctgcagttgagaatctgggatgtgtgtggagagaggggccctaagtgtgggttgtgtgaaacccaggagacctaatcttctgatcttccagtacaaactgctctatccttccatttccttagtcctccatcttggaaggttctatctagaagggctcctgggcttttctgtctggaacaggtatgagagttttgtagagagaaggcattctttgcaaattggttctttgcagattggtagggaggaatacctgtagccagactacttgtttgaaaacctagctctacaacaagttacttacatggtctgtgcctcagtttcctcatattagaaatgagaatagtaatacccatcttagagagttgcctgtgttgacatgcgtaaggtgcttagaacagtgcctggcacatagtaagcactataaaatgttagctcttgatagattaatgagggactaaaaataatcttcatcatgttgaatcttttctggggacggggtagtattctatttattaaagctcttatttctcccatctgagttttgtggttttcattgtataaggcttgtgcatccattgctggatttgcccagggtctgcagatttaatacgtggtcttctgattgctctctgcatctgttcttgctcccttatagactgtttcccacagagctgtagagtaaacctgaaaatgtaaattaagtcatatcactcctctctccaaaactcctcaatggcttcccatctcaggataaagtttaaagcccttaccacggccagcaaggtcttagcatggcttggctttcgtggccctttatgcatcccttttacgttcccagggtgtatctcactttaaccatgagcttgcccccccctctcctggaatgccctcctccagatctaggcttatgctgaaatgttaccgtaccggaaggccttccctgactgtgtctatcatgcattcccacataactctgttcttgtatcttgtttatacttctttatagcacttatcacctgacctatcacattcatatttgcctctttgtttattgtctgcctcctgcaccagcatgtaagtttcttaaggacagaggctctgccactgtatctccagtgccataattggtggttttaggcattttagttaataagcatttaatacatgctagatgtttttttttcatttgcttttgtgactaggatctccttttcattggttaggaggtatacatataggtttctgtatacatcttctatctggctgcatactgaacttcatttattttctctattttcacccttgtttcactgattcttttggaataacaaattattattattttttttgaagactagtagtttgtatgtcccatgaaccatccctgaagtagtaactggctcacacagatatttgacaggagctatttgacagattattcaacactgaggttactagtgagtatctggagggcatgttttctatgctattcttgataaaaagaatgatcattcttttgaatgccttgttcaggttactttttctcaagattgctgaggacacttttcctcatttttatgatggcattaggatggctgaaccaaattgggccaaagaggttaagaatttttgtggttattaacatggactacagagttggactgtaggggtttgaatcccagctcagccatttagtgctggctgtgggatctttggacaaattgcttaattcttctgagcctcaatttacttatcgataaaatagcagtaataatagtacctgtctcatattattgtgagggttgaattaatgcagataaggcacctagaaagtgcttaattgatgtaagttatttgttttattgatattagtattaaattatttttaccccccaagatcatagtgctgagatttgattccagggccatctgagtctcttccaggctccttttattcctgggctggtttttatgttgatgcatggggctgtctgtaggagaaaagaattaactgagggaaggatacttttctgctcttgctcacaatccctaagccagagtggttttgttcttgtctctcttacgttatttcttctaagcaagggttcctttgcttaagggtggcacagctaaagaagtttgaaaactggcaccacaccacagatcttgcagaaatgacatttttgtgtgaacatttaaatcttcctctctttatttatgttctcttattaattttagattgcatgatgtcaagtagtgccaccaccactgccaaaacacaactgcttttccatcaaagtactcaagtacccaaagaatgtattttctcacagttaccacgtatttcaacggaaaaaacctttatgggcttcctggacctcccaaatagtaaccacttacacagaaacaacacagattcctactaaaatggatgtactgtattcagtgatcactagtaatcatatactatgtaacaaggaattgcctcttactaattacagtaggctgggttactgtttactttccaaaactccttctaaaaagagtgcactttgggcatgtgatatcaatgtttatgtaattaagcttttagtgcaaaaaaaagtctgtctcctcctgcatcaactaaaacagtgcaaacagtgcgggatgattatcactcctgtaaacaatcagaccaggagtactctgagaggacatcctaatgcgcaagtggtaaatatgcccctccagagccacggtgcgatggcctttgtctcaggtggtcaatgttgggaggtgtgagagagagaaattggttcttgtaaatgcaaaaagaaatgccttgtaagcaggactattaaatgaaactccttgtaaagttgaattcttgaaatctgaatggctgaatcccaggtgactagactagactagactagactagactagattgggtctatactagattgggacctcagtattttatatcagaaagttgggaaagggtggctgttaaagactctaggatctttgtcaataatgacttggttctaatatgaaagaccattattatagtttccagtaggatgttaacctttgatctagtcttcctcctgattagtccctgtgattctgcttgcaaattcactgtaattgaattacactgttgacaattgaaattgaactctatattgcttaattacctccctctggatggcctagagcaactgccacagacactaattttgcatggagcttaatttgtgaactgacaggttcagtggctactttgtcaggccacttctggcaggggaccagagagccacgtggtcaggacacagaaggccacttactcctcttggctctgcatgaggttactcatgcagttatgtacaagcagtactcactgaggaggaatagttaagaggagtctgttttatgacagttaaagaagttgccctgtcagctggggcctttctgccaactctgattagcgtctgggtttgtaaaaagaaaacaacaaaagattgtgcaggggcagagaaagttctgatcaagaccgagattgttcacgttggcttgtgaatgaagtcagctgtggtgctgaggactgttgagtccatactctgaacagtccttgactgatcttgtccccggcttctctgaggtgcagcagcatatagcattcatcagtatcggactcgctgtttcccattgcaggttgtgagagccctgctaggactttgttcagaagagttggagtgggggtcttaggagtgtctaaggggcagagctatcaaagactgccctttgtatgaagaggtcaaaacagctactggggcacccgctgtttgacagccctcattccatttttccctcactggtagaccccatctcccagtcctttatggaactgtgcctcgttttccattctctgaaagagtttggataaggctggaactatgtgttccttaaatatttactatagttgtaggtataggaactgagctgcaaaactgtgtgggcctcgtgtattcttgtttgaagatttttttcttttaatggtgtggacaggttttaattttttaattgagtcttggcaagttaagtttttctagaaatgtgtccattttactgaggctttccattttgttatcatcaagttggccattatattttatctaaagtactttgttagattagaattattctttaatgtttgatagaattaacatataaaagcatttggcctggtgtgttctgtgtggaaaaaaatttaaactacgattaaatttctttataagacggccaggtgcagtggctaacgcttgtaatcccagcactttgggaggccgaggcgggcgaatcacgaggtcaggagattgagaccatcctggctaacacagtgaaaccccgtctctactaaaagtacaaaaaattagccgggtgtggtggcgggcacttgtagtcccagctactcgggaggctgaggcaggagaatggcatgaacccaggaggtggagcttgcaatgatcgtgccactgcactccagcctgggtgacagagccagactctgtctcaaaaaataaaataaataatacttgactcttagaatgctttaattctcatcactgccccatcttccacattattttcgttcagtattctagtatctttgtattctccaaattattgttttttcagttgatagcattttgtttaacagttttaacaacctctccagtcatagttgattctttcatcctgctttttttgcatgatagttttcttccttaaaatttgatagtctgtcagtaatagattgtattagtcgtcatttgaaaaatgtccttaaatgttcataatcttgaatgatagtttatcttgtacaggcttgtaggttggtcactatccataggtattattttgtggtcacagggatttattgctaatgagaagtctggcaatctgtatctgtcttctgtctctggttgtttttaaacttcttatttatctttggtgttcttcagtttcactgtgttgtttcttgggtggatttgttttgatgtatcattcttgggactcagtgagtgtctttaagctgagaggactcaagttttccattctgaaaaattcatagccattttctttgttgtctctgcttcatcctctgtattcttctggaattcctgaagaattgtgttggaccttgtcctccttttttaattccatgcttcctaactcctcttttatatttttcacttgtgtctctgtttgcagcattcttcaaatctatcttcctctccaataattctctcatctgctatttaacctgttcacttaattaatttgcttggctgcattctttattttggtttgtattttttttttcagattttcctattttttaaaatcatgctttccttttctttaaggtttttatttcttccttttctcctttaattatgtaaaacatatgacatatgcccaaatattcccaaatagacaaaatatttactcatattagtgtattgatttagttacgtgtttaagcactaagtaaaaggctttcaataattcaaaataatatgttaatttatgaacttcttgtctcattggcacttttttttttttttttttttgagacagagtcttgctctgttgcccaggctggagtacagtggcataatcttggctcactgaaacctccatctcctgggttcaagcaattctcagcctcctgagtaattgggattacaggtgcccaccaccattcccatcactggcacatctgatgaaataattttattcaagctttttatatttatctttgtttctatcattttgagcgctctttttgaataatcctagcattctagagcagttgtagagcatttggggatgcagattcatatttgtaggtctgggatgggatccgagactgtatttctaatgaactctcaggttttgctattgctactcctgtggacccctcttttaagtggcaaggttttagaacatgccatccttacttggaatttgttttaaatacaacactttaaaaattcacatatgatgctgtcatcagctatttcatctcatgccaaagaactccatttacgtggtaaaaggttagactttaaaagtttatcttgtctatatgtcttaattgtacaaaatatatattttgcatgaatgaagataggctaagttatattgcagtgagaaactactcaaatgtcagtagtttgaaacacaaaggtttatttcttgtacacattgcaagttccctgagatctgccaagagctctggtccttgtcatcttcacttgaacacagactgattgagtctccactattgccagaagtcagggcaggtggaagagatatgaggaattgtgtactggctcttagactttctcccacagtgatacacatggtttctgtttattggccaaaggaagttatgtgaccatgagtgacttcaagggacagaactgtgagcctactatgaatgcaagtagaggagaacaaaatatctgaacaaccccagtcactaccacagacatccctatgtgctttcgaaagcgatcattaaaaggctttcagctggctgcggtggctcacgcctatatcccagcactttgggaggctgaggcaggcagatcacgaggtcaggagttcgagaccagcctgggcaatatggcaaaaccccgtctctactaaaaaaatacaaaaattagccaggcgtggtggcgcgtgcctgtactcccacctactcgggaggctgaggcaggagaattgctggaacctgggaggcggaggttgcagtgagctgagatcacgccactgcactccagcctgggtaacagagcaactctgtctcaaaaaaaaaaaaagaaagaaaaaaaggctttcaatgaaatcctataacacttgcattgtatgtggtcttatcctcaaaaataattattaaatcttcattaaattttggttttgctccttaaaataaaaattctcaggtgacctctataaccatcaaagctagacttcattgaggtgatctgctagtgccatggtttcagcttaagcatcattttagtatcacctgggaaactttttattaccccaggtcacacctcagaccaattaaattagaatccctggaggagggcccaggcatctggagtttgtaaaaccgctcaggtgacttcaatgtgcattgaaagttgaaaatatttgtgctactctaaatactgctttgttgctcaaaatgaaataaatagaattccccaaagagaaactttaggcttgactgtaagttgaattacccttttctgagaaatctggggggcaaatcttgccttatatttaggcatatccagcattagtggtttatggtgtcttctaaattttcctgttaattccaggttttagggcacacattttttttatttgttttctattttgatttgtttcccactgtggttgtaatttttttacaggaggtaattgtgggaaatgtgtgtggagtgtggaaatgagcctcctgggagattttgcaattgctaatgctgggctttaggtgttgcactattctggaccattttgtgtgcatgtgtgttgatttctggtttgggatttcggtagtcagtgcatagtagaaatttggcactataccagtggtatgcagaggcctgtaggcttgatgtctcactggggggtgagggagggtgtatatgtgtggtattataaacacctagggggttacttagcatactgcaagcttccctgccgttgggtgaattttctcagatccatttatgaaataggcaatactttggggtactttctttctataggggtctcactttcaacttactgctttcactggaggcattaaaacctcaagccccaatctcggttcctccctatatctgggtattttgcccctgggctactctagagtcagcttgaattaatttcactgttgagttcactctttgtttctggtacccaaggtttttactgtctttcaagcttggctccatgttaaaaaataaaataaaataagagtgttatctttttcagcttttctgtttgttcattgtgggtaagggggactcctggcagttgagtatgtcctgtttccagaaggttcccccttaagcagcacatggctagcttaccaagaggcctgctctgagattttctgaaatgattgttctgtgaaaatactaccaggtttttccccctttcactaatgcaattatagagcgagggaaagctaatcaacagcacaaggaagaaacctgtctgggtttactcacttaatttcctgcccaaataaaggcctgaattcttccatattgtctagcatcctgtggggactttgaaagaacaagagaacctagagtccctgtgcaaactaaatgtcaaacttgaatctctcacttagagtcaacaaatttaaagtttaaaacaaattgttataaaagtaatgaaaattaatattgtcaacatttgggtatttctctgtatatatatataccatatacatataattgttttactgaataaggcaagtatttccccatgttactgagtctttagataattgttttttatacagctatatgaatcatattctttctttcagaagttatttaaacattcaccaatttggggggatttttcccctactttttgaaaattaagatgctgctgagattattcttatatattaatctttgactacgtgtctggttatatttccttagcttaactttctagaattggacttgctaggtcaaaaggcatgaatatttttcctgtatcttgccaaattgcttttcagaaagattaggccagtctttgtgtctattaacagtgtatgagggtacccttatgaacagcatatgagcttgccaacattaattatcattgcatttgcattttcaacaatttacgtaggtgaaaattgaatatcatttttaaatgttctatttaccaatgcaaaaacattttctttccatatttttaaattttacttctgttttttaattccagaactgcccatataagaaccttgtgcctattttgtgtgtgagaagtggcttggggactttttcttattgatagataaggtctctttttgtatgaaggctatactgagcttttgttgtaattgatacgagtaggtttgtttgtttgttttgagacagagttttgttcttgttgcccaggctggagtgcaatggcacaatctcagctcactgcaacctctgcctcccaggttcaagcgatttttctgcctcagccttaagtagctggggttacaggggcctgccaccatgcttggctaatttttgtatttttagtagagaaggggttttgccatgttggccaggccggtctcgaactcctgacctcgggtggtctgcctgcctcggcctcccaaagtactaggattacaggcgtgagccaccatgcctggcctacaagtaggtttttcaggctataatttgtcttttaattttgtttttaatattccagaagttaattttatgtagtcaggtttattgttcttttatgtcttgctcaattgctcttgtgcctataaaatcttcctctcactcagttttgacctatcttctctttgtatttctagttcagttttttaagtgtgtaatctttgtctgtctaaattttatttttgtgtatggtgtataataaagatcttatttttttctgtgagggtaattctagccacatattttagcagtgtatggcaagtgcctcttgattgtacttctcagaatattctcagctatttttattggttagttattttactgtgtaacataaattaccccaaacataacatcatacaataataaacatttatcatctgtttctatctgccaggaattcaggagcggtttagttgggtggttctggcttaggtctcttaaagagttatagttaagatattagctggggctacagtcatctgaaggcttttctggggctggagcagcagtccctaacctttttggcaccagggaacagttttgtcgaagacagtttttccatggacctggggagtcgggggaaagtttcaggatgaaactgttctacctcagatcaccaggcatttgttagattctgataaggagtgagcaacctagatccctcgcatgcacagttcacaatagggttcacacacctatgagaatctaacgccaccagtgatctgacaggaggcggagctcaggcgtaatgctcattggcccactgctcacctcctgctgtgcagcccagttcctaacaggccatggactggtaccagtctgtggctagggctgggaacacctgggctggaggatcccttccacagtggctcactcatatggccattggtagaagggcttagttccttgatgtctgctgacaggtagccatatttcctcactatatggacttttccatagggatgattgagtgtccttataacatggcagcagccttcccccagagtgagtggcctgatacaataaagcagaaggagtcacagtgctctttataacctagccttggaagtgacattcctgtcatatcctatcatttctgtcatattctactggtgacacagagcaaccgtgatataatatccacaaattacgaatattaagaggaatgggtcactgacggcttcttggaggctggttatcaaactcttcctctgagaggaaatttagaattgtatctccctttgtatagatgtttattcaatatcattttgtcatttacatcccaaagccccatggtggcatctggaagtttcttcttcccttagttttctgccctgtaaccttatctgattcttaaatttaaagtcaagtggcgtttgtcatctgaggcttttctgtcactgtcattacaactagctcagggacaaaatatttatcttttcacttccctcatctagtatttattgactattggttttgttaaagtaataaaagaaatataagtttcaaagaaatagaaattaaagttttatatatatatatatatatatatatatatatatatatatatatatatacacgcacacacacatatgcctgtaaaacttggcacagatatacatgtactcacatacatgtacacacgcatactctgaatagtaggaaagaatcccaaagctttagggcagagagggtcacagagaaaggaagagacttttccaaggccacacagtgatataaagttaatgaaaacccagatcttccatccaccttttagcctgactcactcttcccacatttatgaaatacttaaactggatggctacgtgtttaaaattcatgtgtacagaatggagagggattacttagcaatggtttggagattggaggtcttgctctgcttctgtccgttttcttccctgaagtttggctgtggctgttctaagtccactcttaattggatttgtaggagccagaaagtgctgagcacacatcacagtggtgggtaattgggcagtttcctggctccccagagcctctgacttgtttgtggatggtgatccatgattccctgtatcatgcattttcagaaagcaaactggcaatcaaatggtaattgtttccatctgtgtggatttctgcctggcaaggaggaggttggctctgagaagagtaaagggacctggaattggatgtcaggcctgcagcataccatggatgcggtggccccaagctcacattttccagtagagtcctaatttcaaatctttcatctggttggccttataaataatgcaaatgccctagaaattccaccacctaaaccatattttctaaagtgtttcttactgctgaaaggagcacagacttcctttgttagactgttgccccagttttgatttgaaaaatgtatcactgaacttacggaaaggagacttttgctgctgctgctgttgttaaataggtgtaagaatggtggaacaggccaggcgcagtggctcacgcctgtaatcccagcactttggtaggccaatttgggtggatcatgaggtcaggagattgagaccatcctggctaacacagtgaaaccccatctctactaaaaaatacaaaaaattagccaggcgtggtggcgggcacctgcagtcccagctactcgggaggctgaggcaggagaatggcatgaacctgggaggcggagcttgcagtgagccgagattgcaccactgcactccagcctgggtgacagagcaagactccgtctcaaaaaaaaaaaaagaatagtggaacagttgaatttggggcatatcaaattagaaagagctgacccaatataccagatctctgaggacattgaagcactctctctctagatactcattcaggtatatgtgcgggcattttgtcagattccttttcagtgtctactgggtagagtgcatgatgctgggaactcagttaaatgtaatatggactctctctcagactccacagcccacaataaggagatgaggtatggatatacataataataatgcaaatttaagagcatatagagatatataggggatataaagatcttctaactgggaagatccagaaagattccagttcactaaaccctcaccaaaatgaatacagtaattgtcatctagtgctgtgggataagccaacccaaacatagtggcttaaaactaccatcgtttctttgtaatttcatgatttgagtagcactctgcaggtgtgtctcctccctgttccacttggtgtcagtcggggtggctcatgggggcttggaagatcccagatggcttcattcacatgtctgtcaccacagctgggagggccaagaaaggtggggctgtctttctagccaggtaactgggctttgttacatggcagtttagggtcaaagagagaaagagtggaacctgttagacctcttaaggcccaggcccagagctggtacagagtcacttccactgctttctgttgatcagagaaagtcaccaggccagcccagagtcaagatccatccctttatcagaggagtggaatgcacacacaggaatggaagaatctctggtggccaactgtgtaatctatgactttaatataaagaaaaaaattctaaaagctgaagaatgagatcttactgtctaaacgtagtttatggtccctagtgaggactggctgtgctttcccagttgtctaagtgtgtgagcttcatacatcagtcccaaagggtacagtcatccacctctgtatgcctatttttacactgtccagcccgagattagataaagatgatttctggaaagtttacattgtgagtgattcagctggggtccaggtggccttccaggtttctttatttaaagatggggtctcactctgttgcccaggctggagagtagtgactattcgcaagccagatattgtgcactacagcctggaactcctagactcaagtgatcctcccgcttcagcctcccaagtagctgagactacaggcgtgcaccgccatgcccagctcacccccagcttcttatctgtccctttcaccgtttcttcaccacctttgctctttactagtaccttgctcagggtgtccacccttcttactgagttttcacctctctctcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttggtgagtagtcccgtggcctgattgggaaccactggggaatgtaatggtgcagcccatggagtgccactgctgactggggctgttgagtcatctgtataccttccagccttttcttccatcccactttggccaacgctgcagggtggcccttcttatcaaggagtatagagcccagtcaagcgacttaagctatgccctctgcccttccatggtccacagttggcctctcctgaggaaatccagggccagagaagggcaaacatttaagatttcacacacacacacacacaccctcgaattacatgtactgcttattgagttctaatccctggctggtgtctctaccctcggctagatcccactaccccttgtttcttaccacaaacaaaagactggttacctcattgatttaaaaaaaagcttgacaaatttcttaggaggcaatgttttcttatttttgcatttctttggtaaaaaggctaaacttttgaaaattagtttattcgtattcctctgtatggtctctaaacttttgattctatatcctgtatctggacaaagaatgcatttcccatatacatattcacatgcagcattttatttttgagacagggtcttgctctgtcacccaggctggagtgcagtgtggcttgatcatggctcactgcagcctcgacctcccaggctcaagggaattctcccaactcttgctcccagaagtgtaccacctctgcagaagtgcgagccacacctggctaattaaaaaaaaaattttgtgtgtgtggagatggggtttccctatgttgtccaggttggtcttgaaatcttggctcaaacaatccacccacctcggcctcccaaaagtgctaggattataagcgtgagccactgcacctggccagtatttcactaatatacctaaattataaaaataccacaaaacagaattttaaagttttttatttgtacaaattgtggggtacatgtgaaatttccttacatgtatataacacatagtgatcaagtcagtcagggtatttagggtatccactgttcaccaaaatagagttttaaaggataggttaaaaaatagttcccatatttttccctgtacacccagaaatcaccttgagcctcttggatgcacctctcccactctagtctattcgtagtctatgctgttgttttctattaggattttagtgtttttcttatctatttgaatgaccttttattagccgtttgctttatttgtagcatatattttcctcactctgtttttaaataacgtttaggtgctttctgagacacagaattttaaacaactgtacttgactctatcagtctttcctattttggtttcttgttttccttttggccctagcaacgcctttcccaacctcagaacagataactgttcacctgtatcttcctctagtaagtttatggtttgatttttattttatggttaactccaatccatcaacaatattttttagcatttggtataaacaatgaatctaacttttaaaacagtttttggaaatttattaaaaatatttttgatccaaaggcagttgacattgttgttggttttttcaagatgcattggtagaaaacagcttgcattcagatttgcagttttgtcttggggttatttacaatggtttagggaatgccttcctttgaagagatttccctaaaagtgattgcattcataaatcttctagagtaattatggccatcactaacctatgcatggcgaagcaagtacttttagggggtcagaagttcatataaacattccaagttgtaagggctgcatgttaaggtttttattctggacagagatagcctgtctgtgttttagatcttgcagacctaaagtcattttatgatcagcacatccacattccacacaaggtcttaatctgtatgggaatagaattcagactggtgagcaaactcatcaagtgctttagattgacacttttagttagaagttgttgctgctcaaattttggtctgtggctcagcagctttcttatcccctcgtagcttgtgaaaaatgcagactatgggctcccatctcacacttgctgaaccatctccaggtgactcgtaagcacattaaagtttaagaagcgctgcgttcaaccctggagactcagttgaattatttttttaaagtcccatgtgggttaggattggagttggaactagtaagatggtttgaaggattaggcagcactgcccagcgccttctcatgcatgatgtctgtgcatcccttgcatatttgctcccttctcctctgtagacacattggcattgttcacacctagaattcctgcttggccatgacactggcctgacatggtccaactctgcctcgtgacacctatatcagttgggatactttttccagtaaaatgatgtaaacaataacaagatagaccactaacaagatgtccagaagacagacagtcccagggttaaataagtggctctgagtgacctcatgggtactggttcttcccatcttttttctttgccatcctcaaggggtggtttttgctcaggcacatcccataacagttgcaagatggccactagaactgcaggcaacatgtccttacaagacacaactatacaactgtgtgcagaggtagagaatcatttctttagtatgtttttgttgtttttaatcaggagggaaactctctgcaaccccctagcagacttcccatttagctgcagtggccagaatttgttcacctgtgcataccctagctgcaagggaggctgggaaagcaagtattggcacttccacctgccatagagggaggtggcctctgtcagaaaagaatgatgatagagtgggggaaagtggccctcaggaagacagctcagagtgactgccacagacttctgttaggtttgagtttactcttgttggctgacaaattctttccatgttttctcaatatgttttctttttaaactcaagtttctaaggaaaaggatctgattgacccagttaattatttttgagcgaagtcctccagatcaatgaagaagcgttaagtgtaaaagaaatagacattaaagacttttaatttattcacaagctatggatgcacaccttaggtccagtgtctaccccagagtgaatcaactgttagcagaggggagggattacatagtgggaaatgtatcttgtactgctgctgctcatctgggactgcagatcttctggcactggagcatctgtggtccatcagaagaatgggctgctgagaagcaggggtagatgtggaggagtggtccatagttagaataggacaaatagcagactagtcctgggctctctatgtcttacatgaaaagggcactcctagtcctagtgcctcctattgggtagctgtttctttgtggtagggctggttcctcttcttctgggtcctggcagagctaaagcacagctgggccagcacagttggcagaagtaggagtgctgttggccaggactttgcctggagatgggtataaaacagaggcgactagttctaaagcccaagtggagcagacctgcccaggagtcagtggcactgggttaagtgagtttcccatgctctggagtctaaactagcatcctgctccttggtaagtataatgaggagaagtgggctctgggcctagaagggcatgtgcaaggctttcttaatggggataccctctggggcctcagtggggcaaggaacaaagggcttggattcccttggtctaggagcagtatttcctctggaaagttggtgaatgaggaccttgtatagagggtgtcttggggtctaagatgggctgggacctggcctgcagaggaagcatcagggaggctgtcctgcctgtggtgcagcagagcagtgttaccctcaggagatgggaaggtagtcctttacaactggaagacacagccaagctcagggtcagtgctcatggaggatgaagctgaggccctggctggaaggctgaggcagctcttttgtgatgggaacagagctgagttctagaaaaggggcagcctcctccttctctgtttactatggtgaaatgtaggatgatgccctcgggagggtgtggttatttcagttcaggagccccagaaccccacaggtggtcctgaagcccagaaagggaagcagtgctcatcagtggccctggcatatgctggcatgtaatcatcagtggccctggcatgtggtacctggcccaggcaagaaggacccggtacaactgtgaccacttccaggattttggctgtgccttgagtggggctttcccatggtctgaaaggggtgtctctacccctccacacctgcttggcttggctggtggttagtggcatagatctttggctaggttgggtggtggaaaccttagacaggatagccagtcagattcagatgggctctacagggctggggatagccagttagctgggaggagtagacctaggctgatacacagtgttgattcgtgtcccaggtctttgggtgacgcccagaagataccagagccagcagagtctccatatgaagtagccatgggtgcttctctaacagtatgttatgtacacccttcatctcctaccagccagccagtctgttctgctgtttaatacattgggtatgggccaaggagattcttggtgaagtttcaagatgaagccagagaaagggcaggcaaacccagcagcaaagtgaaggcaagtcaaggaagagctcaggctccagggtgaggggtggtgcttggcagagaacccacagaagggctgtatgtactctaggccctgtttggaactggggtacatggagtaggcttggccatccaataggaacccaggcttttctttgcaaggtctcaagagtcctggtcagtgtgcttgagcaggtgaaagcagattgaaccagggtgagggagtatggaaggtaggaaggagttaaaaggccagggttctaccctggctctaccactcatgagcctcttcttcacttctgtgggactcagtttccctactggaaatgacagctgagtttgaaagtgtctgcaagatctggccaagcattccaattctgcagtttgttctgggggctatatggagtggtctctttgtaagcaccagcctttgcctccctcagtcttgacctcttgggttccaaagtgtggagacaggttaggaacctctcagtttactgctgcccttatgttagagcttgatggaggcccacatctcaacagtggagaggcaaatctgtttaccatattgaaaaacctgaagagttgctctcctgaatgagcagcctctgctggccccagctgggataagtgctcacctctgatagcccagcagtcagttcaggtgccctcagttacctttttaactagtttcccaagaaacaaagaaacccagacccaggctggggagcacagccacccccccttctcagctccaaaccaccttgtcacagatggcggtttcttcagctcccagctcctcaaacaaagcccatacattcctgccagattcagcttgcaatctttcattctgtccaagaagcaaatctgtttaccatattgaaaagctagaggagttgcaaaaaaaaaagtggagagaaaaagctgttttatgaattataaaatgtgagcttgaatttttttaccatgggattcatttctgtatctccagaatggaaaacaaaagatagtcaggatacgtgtgtgttgaacatttcaattttgaaaagttacagaaggagttttgtaggtaaaccttttcctctggatcttagaggagggaaaatttggtgcttatttttcaagaaaaaaagtagagcctgtgtgagccgatttccagcatgttttcttacctcccctgtgacaggtgtgaacttgagtgagagatgagaaaggagtaggtgtgtccgtgctttctttctgcgctcagctcccaaggggctcctgggccgggctcaggtggcatcagtggtggttctttgtccctgtgcagtgctggaagaagccactaggtgggagtcagggacaaatgctgggaagtgaaatcccaaagaatgaggtcagcatgggcttcatatgagaaaacagcttttaatttttctttttcagacaaagataacataagcacctctcattattgaaactgcttaactgcacctgggtcagctggcaaagataattctttgccattttccttagaaacagtggacaaagggcagtcaagagagggctccactgtttagggtgggggagaagagacagggctggtcctgggatcatagacctgaccttcccctgtggatgtggggagacctctccagacttcttgactgcagtgccttctgctggggtgctagtaggttggccccttccattcctgcaggcatttcctagcccacagtttatgtcacgccctgccctagagaagcttcctgtcccctgggggattttgaatgcccttttcctgacacagcagccaagactgggggccttcagccactgcaaatttagcagtttcaattttcctggatcttgatccctgccccccaaagtaaatttaccctactaaattctagcaatccggctcctttcagacctgacctaaagagactatttcagcctctaagaaccaatgtttataaatgaccaagaatgtgcaaacactggtgaaagagcaaataaatccttccccactatatttcctgcttcaggcccaggggccgtggtggacagtgttgccaggttagcataacttgaggtctgagcacgtagacacccacttaccctccacctacaaaagaaaatcctgccagagatacactaccaagagccttctgccctttcagatacctgctagtgggcaggcaggctccagggaatttatgcttctaggcaagtttgtttagtaatctatgtttcgaagaatgttttgtttgttttgttttgttttgttttttgagacggagttttactcttattgcccaggctggagtgcaatagtgtgatattggctcactgcaatctccacctcccaggttcaagcaattctcctgccccagcctcccgattagctgggattgcagttgtgcaccaccacacccggctaatttttgtatttttcgtagagacggtgtttcaccaggttgacgaggctgatcttgaactcctgacctcaggtgatctgcccacctcagcctccgaaagtgctgggaatacaggcatgagccaccatacctggccttgaggaacttttgaaagcggtttcctaacttcttactcctccaagtgttgtcctgggaccagtagtacgagcatcacctgggagcttgtcagcagtgcacaacagcaggccccatacccaatctactgaaccagaatctgcatttttactagaaccccctcaggtccaggcagttcattctggatggggaagcactgtcctaacccagggattagcaaaccatggcccacagttagcccactgcatatttcttacactcatcagctaagaatgatttttacatttttcaagactgaagaaaaatcacaagaatgttttgagatgggaaaataatataaaattcacattttggtgtccataaataaagttttactagtacacagccacacactggtttaggtattggctgtggctgcttttgcactgcaaataggagagttgagtatgagatagactacatggcccaccaaacccaaatatttgccatctggcgctttacaggaaaagtctgccgacctttgtactgatctattttggaggtgcattctccatgcatgtgttctgtggaggcttgagctgcagtggccaggacttcctccacagcactcttcactcccttcccccgcctccccttctcagcgggcccactgtgcaccatgtctgttgaaggacacaagtttacatctgacttatgaggatttatgagggagtgtcctggcagctgccacctatggcccagaggtgaaggctcagggctgagcggagcccaggatgcctgtaggtgataggtcagtggaacagcacgtgaccatgagattcctctcagtttacagttctgcctgataagatgctgctgatttctggtaggcagcaggagtaacacctcagggggcctcagctcctttttcagccattccctcaagtacttggaattccagccaggtaggtggcaatcctggggttctcttctagaccctaggacaggggtggagcaagctacagtgactttccccggcaaacctgaccaccctggcctcttagctgtgtttttactcccagaatgctcagcctcacagtctcctgcccttttcccacagctggctgctgcatgttgcaggcagtaatgaatctgtttgtagatgagcaaagtacttccaggaaggccttcgggactgttaggtcactgtagtgacccgtatttgtgtaccctttgtgcttcctgaggacttctgtcttcagagaggggtccagtgagtctgagacaccacctcacaggagcagtataatgggagcagcaagcccaggcccccgagctcccaataacaaggggagcctagacctttgggagtaactacctcggccaattaaaagctgggcttctagccttttgggagtcatggactgttctgataatctgacaactctttttcagataaagatttatgaatacaaatagtagtactttctatatatttgacgaacatatttaggggctcatctgatccctggaatcccatctgtaaatcaagtgaggtgccctggacaggatggacttctagggcagtggtgcagccatgggtttgccttgccaggccagtgtgatgagggagccacgacagggacccagctgcccctgggggtggggtgagtgagcgaggaggtgccttagcttctgaatccatcccatttcactcagcccttcccctttccctcctgccaacctgctcctaggtcttttggggtgttaatttgtgatttttgagttgaattacaacgtaagtaaaatgtacttggtgtttaaggaaaaacaaggctgagataagacttgctacttgagaatgccataaaaatgtcaagaatttagctgcagtttatctggattcttccctcccttcctcccttttctgtccctttctctcccctaccctgcaccccccacctttgttcatcacacattgagttgagctaacagaggaaatgggccccgtcttttcctttttgtgtcgaacatctttaccctggagaaacggaccttcaagtctctttccttcacatagaattttagtcttactttaccagtcttatcatttgagccttattctttcatccaaaaaatgtttaaattcgtactgtgtgctaagaattgtaggcatggaagtaggagaagtgagttggaaatcagacacacttctgacagtctggtgcaataggagtggtccagtgtgacaaggtcagtgatgaagtagagaggggaatttaggtgctcaggaagggatagaagagggacacctgagccacagctctatgtaagctgggagtgagcaaggctgatgagagcagccacattggccacctttctcttttctcttttctcctctcttgtaccagaacctaaggaagagcactgcactcctcccaggagaggggagaattttccaccatcctgtagaggctggaaccttgcgccacctctccctgtccagctcccaaatcagcttgtctacctcctcttccttggagtcccagatatacctttattgcataccatatgataattcttaacccagggcatgaagtttttcatttgccttggatgcggggaaaatgtgtattgactggatgaatttcttcatttgacttgttcaggcttttagacagagaaaaaccaacctactgacccctgtacctttagagatgttcttccttggcaacatcctgccatagcacgggcagggaacctgggctgggtgggtcacactgtgctgtggagcagggccagaggtgaggagcaaggggctagagctcagcgcatgggcagcaaagcctgcttttcctttctggcctctgtctgggtgtgtctccaggaatttactcctccccttatgccagctgctggctagagctctcctccttgccgcctctgtgatctctgtgggctggcccagcctgccggggactgtgctgccaggcattgtttctccccttttgggccctgcttctggccctggtggacattgaagccatgctgaggggcatgcggcatgaggggcatgaaggactgctcttcagactgggagttccaggaaaccccggaggtgacccccaagggaactgggaaggcccaggcagtcacaagctgtgcatctgcaagtcctttgccacagcagagctcggggccttgcgtgtaaccacagttcccaccgtgtaaccacagttcccaccgcacccacatcaaaggtcactttgataatcagccatagccaaaggccacacattaagggctggggaagggagaaaagctgtttttagtggggagctctcaaaggagatgggaataggaggaggtggggggtggcatctagggagtgctggaggggccacctggagagcctgcatgtgacctgccctgaaaggaggaaaacagctgcagctccaggtctccgccagcctttccaaggcccctgtctacccagcactgctccctgagtctcatggaaatgcacgtgaagcagcctcaacctttccacctccttggtttgtaaagcaggtagcccagagtgggggacagccagagaggcaggaccctccagccctggcccctgttcagaatgtggcccccagggtgccctggctggtggccaacagtccagggccagactcccctgagtttgcggcagttggtctctaatggatggtaccaccagtgccaaggacagcaaacgctctgtgctgggcccgtcgcacagcaggaccaagaacccagactggagctgcttttttttggaaacaacaggctttcctcagggcacagcccgtcactcgcctggaaaatgggtgggcgtgggcttcagggcgggggtcaggctgtgtgtgggaaccagtgagctcctccaagagcagcacttatttttagtcttctccccagtcccaaataaactgagagcagctgggagccctgggtaaatgcagagtgaagcagagacaggaaatcggggctctcagtaatgagttccagccactccagaagggggaagccagacaaggaattttcttcaggactgtttccctctggcaggctccggtattatcactgagaatggtcccgtgtgtgtgtgcgtgtgtgtcatgtttacaacttctgtccaagtcttctttcttttttctctacctttgtgtgacatttgatttctccgcagggctctgaatcccagtcctggtgcgtgtgcgtgcatgtatgtgcgtgtgtgtgtgtgtgtgtgtgtgtgtgtgtgtttgttggggtggtcggggaggacactgaagcagcacggtctgctctgtgtcgctgtgtgtctgaaactgtctagggagaggctgaaggacgcaggccagggaagtggggaaatttgaacacagcttggagttcttgaggggggagggggcagaggcaaggaagaggagagaactggtctccagccaggaaaagggctttttccaccaaggcatctaactgctgacatgggtgcccagcatggatggggacattgatgtttacaagcatttctcgtggctgaagagggtaagtgactggctgctttgtctgggtctccgtggagataagtgagggggagacgctttggggtgttttggggtgtgtgtgcctgtgtgtggtagggggaggtattgtccagcaaagccctgctgtggccaagttcttcatgagaatctaattatagacaccagggagaaaacagtcagctgtctttgtttctccactgacattctagtgaatgagcctctgtacagaaaggcaagaatggagtgaggaaagttggttattttaactttggcacctaaacagtcagaggctccaaacaccgtgaccagaagaatgtgcccaccgcttttcagtttgaggacacagggaggaagctgctgcctttttaaatgcattggattcggaagttgtttaactcgttctcactctgatgttatccggtggagcacacatctgctgtcagcagaatgagcttctgcatttccggaggaaagctttcagggagttctctttgaatgctctgaagctgagggtttatgttgcaagttgttcatgccctttctttagaggataaacctgagtgtgtggtatgagcaaggaatgaacggacgttgggggctggagtagcatcatactcctagaattcaggctgtttcctcttttgtggctgcctttaaattggctaagataggtatgaatttattttcacacgaagggattttaggctgagtgtttttcagaggcaggaagggcaaaagcagctgacaggttagagatttgacattgtaactgcagaaggacagaagaaccaggaagtgtccagcttggaaggggcatgcagatgcccggaccccgactcccggacactgagctggctggcttttgtgtgagtgcagcagcactcattcagcaaatctgtactgagtttgggtactgggtgtatagtagtgagcaaaatagaaccagcctcttgtggatcttctacctaatactggagatgtaggtgaaacagtcccaggaaataaacctcagattacaaacaataagtgtgcctggaggaagaacagaagacacgggactgctgttttgatggagaagggggttggggcggtcagggagtttgaggaaattatacttcgctgaaaactgaaagagcagtaagaatgagtcaggtgaagaatggggtgaagaacattccaggcaaatggggcataggggatgatgtatatacaaaggtcctaaagcaagatggagtctgctgattgtccagattgagagagagcccatgtggctgagcacagtgatggcagacagaggcgggcagaggctgggatcacgcaggacagtgaaggccacggtaaggcttttgggcaacctggtttgtgtgctgggggacttgtagcagggaagtgacatgggatacattggggggggtctagtttgtattttaagaaaattactctagctgtgatgtggtatatggtaagctatgttgggaaaagtgaggcaactgaacacaattatagggctggagggcttggagggatgggatagtacaaacccctcatttaacaaagcccaagaggggctaagaacctcatggtattagtgtcatagctattagtggtgcagcctggtcttgaaccctgttctctatctcccagtctagttctctttattcattttctctgccaaatatgtataaaattattgctttagaacccagcagaaatcctgtctgtgcccagcccctagggcatcacagtcaccagaaagcatgctgagatgaccagacgttttggcaaaggtttgcatcatcttaggttttttttttaagccccactggggagatactgaaaggaaatatgtaagaaatgcactgaccatcacttggtccttctttccctgtatcccaaatgaagcttttaatcaagaaatcctttcagccaacatgtgcctgggattgtcagagccttgtcccagcccctggggcagatactgtaactctgcctgctacaggagaagttatgtgtgtggaggaactaattttgcatgtgatgcaatgtaagaaggcccttcttgtcccaagacccagggtatgctggctcctgtggacagttggaagtttgcttagggaaactttaagcaaggagactttagaaacccccaggatgactcatagcaaaacagatatttttcttctacttttagaattttaaagagcattttacaaaagcaaaactcaaagtgtagacatgtcattggcagtgtgataagagtattttcactattctctaccctaaacactactgccagatttttaaaatcttcttaaaaaaaaaaacaaaaaaaacaaattccctttcgtcctgtgaccccagtgatgagcccccctggactcacccttaatctggaagaaaaatcaggcccttcggcttgcttggcctttgagaccattagcagcccaacctcaacttacctttttagttttatcttttatatctaccctgatgagctcccaagtgtatttcttcccttttctgagcttttaccacagatgaccacctcctctctaactctcatccacttcaactgactccatccaggctgtcttttcccaggaaacctctgctggccctccctccccacctcctgtagcccaggtctgcagcacttcccatctgcatggctcacccaccctttctcctgtgcttcagctgaggtggtgtggagagctggtttctctgaactcatgcttttgaaggtagaaacactatcgtcttcattctcctttacagagggcatagattctggaagaagaggttcctggtgccagagcaggagcccttgccctttgagcagtccaaggtggtggtgtctcagggcaaaggggagatacttatgttcagagaggcatggagctggaggggaaatatttgctcagaaaagaaatcttgctccagggcctgtgtgggatgggatagtatatactattaatattacagttaagaacatggagtctggagtgaggcctgaattagaatcctggcattgccacgtttaccagctgtgtgatccaaggtaaattatctcaaaagtctggatttctttaactataaaataagggagataatagtacctaccacatacaggctttatgaggactcagtaagatagtacgattagtgcagtatcatgcatgtaggaaatactcaataacatgcttgctattaactgctattggtgattatcaggaagggagaagttgaaagaggaacagatggaaccaggttctctcctagaattgcctctcaggccattcagtgcttcagctttatgacccttcccatactccagatcaaggtctcaaaccaagcatattgaagacctagaaaaggcagctgcaacctgggccaccataggtgaccagaggcctcattggctgctggatctggccagcttggctgtggttgctgagtgaaggctgatcagggctgatgctctagttcattctcctaacagacaaagcctagggataaggtagtctcttgccacaagtatccagagggactcagtcacaaacagctcacacctgttctacattgagtccagtggatccaacccacacaaccatgaacacacctctaaaaatagctccgagcagggtctgtgggacccacccactgctctttcggcaagagttcattttcccaggaacagaaatcccagactgtcagcatcttcacactgcttcctggcttccagcactctcagtgcttaagcaaattccaactgtaggtcacaaagaaaatggaatcactacaggtcccccatgcagttggctcaggttctgcagtaaaaagtggaattaactcaagctgctaatgtgagactttattctgtgtcatctggtgctcaaatggttgatctagtagcctggccacttgggccagaagagctgcaaaggcagacacggaggtctcctcactccagacactgacttgccttgcattcatgttggactgcagtgaaagttacagaaataggcagcagcttctgtgaaggctgttcctactagttaagagcatggatcctggatctagattccttgggctcatatctcacctctgtgtagacttgggcaatttatttaaccttcctagaattcaatttccttgattatatatatggataaacaattctatagatagatagatagatagatttttttttttttgagacagagtctaggtctgtcacccaggctggagtgcagtggcacaatcttggctcacttcaacctccttctcctagcttcaagcgattctcctgcctcagcctcccgagtagctgggattacaggcatacaccgccatgcccagctaattttttgtatttttagtagagatggggttttgccatgttagccagtctggtctcgaactcctgatctcagatgatgcgcccgcctcagcctcccaaagtgctgggattacaggcgtgagccaccgtgcccagccaattcaatgtatgttaagtgcttaggaagcactttataagtgttagagttatggggaggatgacatcgatcagaactgacaacctctggttactcgggagccaggtacccaaccttgattctgaaaagagaggtttttcaatcctatgggaaaggcaacagtggatatggtcacccaagggcactagcttcctcaatttcctatgatacctcctatttctggccaacacacccgagatgcctgtacattatgtttcctggtataatttagaagctagaattctgccatctctgacatccagcacctgtaactcctgccagctccttgaagagaggcctcttttacccagtgggatttaacaaactggcatcacaccagggtcatttgctgaacaacttgtgggcactacagagcagcacagccattgttggttttgtggactggcagcagcacttagggatcctttgactcatccctgcttttctctgtcccttcctccatagcagctctttcacacttttccattagtcttcaaccttatactcccctttcaactgatgtcactaccaatgtcataggaaaaaaaaaaaaaaaccagccaaactgagatgagtctcttcaccctccctccctttcaccgcaaaatgtaactgtatttcagcatcctgtttcatgggccaggagtcccttctctcagccaaggctatcccagtatcctgtccttgacccaatcctgttccagctcctcttgttgctctgattgtttcttctctcagctcctccctgcctatctgtcccttgcccttggtggaaaatgcttctcctcaattctcagggaaaaaacaaatcaaaactatctttgaccctgtgcttgtctcttcatgctgccttataacttaccttcctttcactgttaagattcttggtgagttgttagcctgctcgttcatctctactccctcctggtcactcctgaagccagtgagcactaactttgttcctatagtcatcttttaaattccttctgtaatgttatttttgctgcctctagttcccaggcaatcttccccatacattttcctttgtattcatttccatttggaaatcttgtaggattaatggcattcttgtgacccgaggagcagctccttactttggctcttgcctaattctgtgttctcaaactttggatctttcatgccgaagagacaccaggctctaaagcctccaggggagctaagacagtcacagcgcccactccaccctaactgtagcacccagtcctgctgcactgtctctgaaggtgttttcagtaataatgactcagtgcatctattggagttggcaaggtgaggacagtcttcaaagagtcttctctttttactctcctcctggctttcacatcctctcattacaggataccagcacacatacaaatgctatttctgcagcccagtgctgtaagctttttatgtgtccagctaccagataaagagaatttagcagtgaccaagctcagccaaggttataattttggggaaaaaaaaaatcttggtaaatgtgtttctctacaaatctagctccccaggaagatcagttaggagcttcatcccagccccttggttggagagctgatggccagtttatcttcagggtgtcctgtgtttgctatgttagttctggaagaccagaatatctgaagggtagtgattgtcatagcttcatgggtagcatgtctgtattgggaaggctatttccaaagctgctgttctcacattctcctaggggtattcctttaaagccttcagactcaatcattcaaatggtgcctccactgtaaagcctcttctctcttttgaaggtgaaatgtttttgtctctcctctatgcccctgccattcatgtgcatacaactctttatgatagtacttattacatcctgctgcaaaggttgatttcttttttccttctgtccttattccctgtaatactacagagctttttaagggcagggactaaatcattgtttagcacagaaagtggcacctagtgggtgctcaggattattcaagtcatttcataaatacattcatgacgtgtgatgatgtgaacattggtcaaccaagaagctatttatttgctgtttatgaactctgctttgttcttccttaaaagaggacatttagatcattggatgatagcctcatcagcaatacttaacctccccttatatataattgaggggaggagggaataagggtcaaggtcaggataggctttctcttgttggactcctggtagccgaggatctgactgcactctattcacattgcatttggaagaaatttctttaacactgtgacaaagatggtagattggcttgaccgttcttcacctagaaaaagcagaactggtcctgggaatactcaggtttataataaatgccagaaagccctaaaactccttaataaaaaaatctaggggaagttttcttttttataagaacctgcctacactcatactactgggttcccttggtgttgggtaaccagagtcctgtaacaggaattgactgtagcttttgtgatccaatcatttttgtttatttatttattttggtccccttacttttaaggtttatgtcttctaagtttctaaaaggggttgcatgtgagtggtgcttctgagcttaagatatagccttagtaactttgatatctcccctgatgccctgtgcctggcagctatggttcacttgtaactagttttctggattttgataagatcctcttgactaggcagcctggaaacactacacattttcttttgttttcttattcagctaaaaatacatgtcatctaaatggctaaataaggaagaaccattttaaggcttatccaggacaaggcttacccaacgtgctgtgttcaaaatctcagcgtatttacaggcaaagagccatcatataatttaacatgctctgaccagttgggacagtgtatgtactgtggccaagatcctgaaggcactggaatttatagcttattagaagcactgaaggaaatgtaactctttacctggccaagatgacaactattgatatcaaaaaaaggaaggcagatgcattttgaggatcccaaggcaagagctctgagaagcaactgttggcttcaaaaaccaacatgatgctagagctgtcacactggggagccgactgttttaggttttcccacactccttacttgtataccaatgacacccctgttgtgatctagcccttgccccatttgactactctggaaccaactccttcccctagttcaatgaagtacagtgccagcaggaagtctcctgggtcatgccagttggggagtgctacagaactgccctcatccagcatccctgaggtgtaccagagcacatgtgaagagtgtgttctccttgcaaatggccagccaggccataaagcagtcatgctgcccaccacaaatctgcaggaccccagccatggcatcaagcactcaccctgtctagagctccaaggagagactaacatggctatcccttggccaagctacagtggaagggctaggccaggagagagcattgtcatagatctgaacagccactgcagtcagagggtgatgtctttgaggaggccgctgggggttaacttggctgaaaagttcatgtttaacccaaatttgaactaacctctagattggaacagaaataaaaacccaagtgtttatgattggttattactagctataaaaattcccagtgtactcattataaacatgtatgtagcacataatacttagagtacacaataaaacacttgtacgaaagaaaaatatgtggccatgaatgtatgactcaaaaatgtgagcacttgttcagggatagtggagaagtgaactcatctttggcaatgtggcccaaagacatgatcccagggctattagctaatggtgggttctgcgttgtcactgtcacagaggctttctttttgttttgttttttcatttcaagcctgaaagtattttggttattgttcccttgggttgtttgtacagatcttcatagatatttcttaggcatcctgatcagaaatattgcccctgttgttctcttacacaaaaagagtgaattaattaaaactttttgtagaaggcattaaatgatgccttctaactcatgcttctaactgaatgttggtcttttagattaaacaaagctaaatcatttataagttagctaaattcatttgttaaattataatttaaaaatcatttccatattcctatgattattcaaaaactgtttatatcacacaggaatttttagagcaccctactataaagagcactctgtagttttagtgccacacgttttcaggtatgctgacctaacttgaccctttctgttgctccgtgaagcatgattttttctattgaaaggatggaaagcctgagatgaggtaacctacttgagattacacatggttaggtgcagccccagcctcctaattattcttggtttgtcctctttctgcagagaaggtggtcccttggggaggaggatgcaataggaattctgtaaatgaatatggaagcaccacaagaaagtccccagggatcccctgacttgaagttcagctgggccaaatgaggggaacagggaacccagagctctcagcctcccagcgcccagacctggcatttgtacagctgtgtctgacatgtaattctttcgacataacttcttaaacagttgttagatctatttctgttatttacccttcatttattcattttctgattcattttctgataatatcttttagactttagctcctgtttatttcttgttttgtttgaacttactttttcatatcacacatcctgctccccacctccaccaaccccggttgatgcccatgggcctgttgcatcttgtattcattccctgtcttaacctttttgctctacatgggaaataagaatggaagcaaacaggtggtggatagaaagccatctattccacacacaaaggacactgagtgccctttttatcctagtacatcccacacagacactccctgtgccacaaagtagatctcaattagcccctgatgataatcctggtttgaactatagttggcttaggactgacagccctgtcttaaaaattgccactttaagcaaatcaagcaatagtggcagaattcctttgcaattcagaactatatccaaatagcaggaattctttcctacaagtctgtttccaaaggagtaaattttagtcagttgatcaccttttgagacaaatgtattaaccagaacttttggttgcaaataacagaaactcagtttgaactaggccaagagggaaccaacaggaagggctggaatatatctctgcctttaggcagcgtgcaccggggatgagaatgcctccagtctttttcttggcttttgtttgcttttctgtgcacactgggttcatagctgtctcttgctgcaaaccagctttttccacgtggagcaggacatggccactgacaacctcagaactgtggcaccaccactaccatgctctgttcccaagtttaaaaattcagaggaaggatttcaacaagtcaagcctggatcaagtggcagggagatgaggatctttctaagaagatggcagccctcatttataccacataattacagtaaaggcgatgatctcagcctagtctacacaaacaatagattccattaaagcagggtgctgattctctgccaagactgatacaagtcttctctgtttcttttccttagcaagaaaacaaggggaacaatttggctgatctagggttcgccacaattcatggtgaagtttcttttttggacctgacatatcccctgaaaaatctcatccctaaaatgcaatgttctccaaggtgcagaaatcttgatttctttgagtatgccagcaaccagctctctgtgcatgaggaacttatcaagagtaaatttcttactcagtgaccaaggggagggatgggagaggtagggacaggacctggtttaggttaggctagtatcattgtacggtccaaactgccccttatgtggggacttaactatccctgctggaatcttgctggtcagtcagtcctctccctcctggctactcacagttctctctctgtcctctccctgctgaggctgattgactatcatgatcaactccaggatcccaaccatagaataccctgcacagctgatacattttcctgaggcccctctcagttagggatggcttagaaaatacccacaccttaggctgttaattgctcaagctgcacattaggcttgcccagccacggcagtggtagcagtttgggtcttacagaaacagaccctaggataacctgtaagaatcaaggaggtgtgttgtcactgtttctgaagacactctggaatattactcccaaggcctagggaagaccttgatatgacaactctgtgctgtgttttatatttgcctccgcgaggtctgaattttagaggatgaattccttgtgtccaagacttttttcagcctcttgagagcaacacttgatagacacaaaggtggcttggcttcaatgatcttgactaagggtgctgagttcttaaaaatatccattcgagaagcccttgtcttgattcagttccgtgatataggagaggtagtatgtttcactgtggcattctttagtcaaaattgaagaggatgtggaaatgtctggagttaacagttctccacagggcacacagatcacatggttctcactatatttttaggtaactaacctgaattacagtatcagaaatagctctgaccatttgaatgaatggtctgaaaatttgaatgagaagattgacttttccctgtcacatttgtagcaataaccatcagaacagagggggaggaagtttgatcaaatatatgtaacacagcttaccattggcaggtctagcctagtggctaatgtcattggttgagtaaaaattagctctttcttatattcatctgtggattgagcatccttaacaagtataacgggggtggatgatactctcctttatagtcacttgccatcccacagtggggaacaatagaaaattagcatgtaggccaggcacggtggctcatgcctgtaatctcagcactttgggaggccaaggtgggcagatcacaaggtcaagagattgagactatcctggccaacgtggtgaaaccccatctctaccaaaaatacaaaaaattagctgggcatggtggtgcatgcctgtagacccagctactcaagaggctgaggcaggaggatcgcttgaacccaggaggcagaggttgcagtgagcctagatcgcaccactgcactccagcctggtgacagaacaagactctgtctcaaaaagaacaaccccctcccaaaaaaaaaaaaacctcagaaaattagcacgtagcatccttcagaatttgattggactttcttctctgtgaaatgtgggcatggtttttgcaacctgacttcatgcgtggagagctgggcaactgctctatcgctgacttacctaatcaggaacatggacaagacttttcagagacacctcaaacctggaatcatgcagggatccactatccatccaagccttctatttgcaattccactattaaagaagcaggtatacttgttgaccaagcaagctgtctttaaagtagagcaaaacagagatgtgtcctaactcagtcttttaaaatatttttctcaataaattggaatcccattttgataaccacaaagcttattatgccttgatgatgtagtcattttataatgcaagaatgataccagaacgtgattgaacctgttgccaggttataagaatacagaatatacagattcacccaaaggcaaatccttaccttaggctgatgagtattagcattcagcaagacaatcctcttcttggccctgttctcagatgctttccaagtttttctccaggcagaggtggcatttgatcctggcctatgcccttctgaagaacgcagttttttttaacatcctagtcctatatagatcatgaaaacacatggctctgacttcatcaaaagcaaaggatagtgatactgtgggtttccatctggaacattatctttcactgctgtttacctttaaaaagcttgctggagaacggtgattttgaaggacctgtagaagaggaagatgcactgttcctctagaacagtgattggggtgggggagggacctgtctgccatgcacaccactgctgtatggaccagtatgcctgctaggaaaggagttggctcctcgaatctgttataggaggggcaaatatgaggaaccactgttctaggtcctctaacagtgcttctagattttcaaatatattttaattactcaatagaaacattttgtaagaaactcaaacattatgtcaaagtgctctgaacagtgcctggcacatgttgagcacaaggtgcttgctgtgtatttacagcactgtgcctggaccatattatattagtctccatggaattgctttcacctttggcccatattgtccactagcctctgaactattctgagaacatcacacaaaagtaatgagttctactgggctctgtttactataagggtgtcatggatattgctgatcccatcacacaaaatctgtctatgaaaacgtgaagtttctcccttgctccggaataattatgcttctcctaggcaattgatttgattttaccatactgatctgcggatcctgttaactgattgtgcctctctttttttactggctgctagcgtggatctagatttttgatcccccttctagcatgtgctatagaatctaggtcatacattttattaactgaatttatgatttcaactttcttactcttttttttgtcaactagtaaaaatagttacctctctgggtgattgtatgggtagaccttttattataatgaagaatatactgcacaccatttgaataaggcatagttggtacagtggcttgctggagtctctggaagaagtcttgcctttggtcttctctccttcatttcctgccagagaatgggcggctgccagtgctaggtggctccgtgtccatgtggacttcggcactggggttctacctgcagagcttcacttggacacctgggtcctgtttaattctctgtccactggaaatcaccatcatgtgagttctttgacagagaagaagttgacctgctattaagaattattctcctaccttttcttctctggttctgagaaaatatagattataatatattcttggattctagtcagagaatttgatcatgtgagaaccggaatattaatttaacaacaataaactgccattaacaaagaagtcagttgtgattgttaaggttctttgtctgtggcatgaaagagcttccataacaatgaacaagacataggctccagaggggctggagcagaagacagtggtgtggcagcaggtgctgcctggcacagctggcctggggagtggcccctgggcctgtcctctggctgcaccttcaacaaacaatcaatgaatctttcactagtgcgcatccagggtttgaatgcggtatgcttggtccacatttctgttctaggactgggcatggctctgttgcctccctcacctatgcagtgcattgggaaggggtgggatgaggggaggaaggaggtgccttttctcatggagggtggtgggagagcccatgctaaaagttgaaatgtggggaaatggcctaggacaaggtggcccaactctgggtctctcacatctgcctctttgcacaattaagactttcctctagggtggtagacacctccctcgtgaatattgaagtgctgatttcactggaccagctcagattgtataatactcagttccacatttagcaatcagatctactttttcaaactgccaagcctctgggtggcctattgcagaccagtctgatttcagtcttccatttgcatggaggaaggaggtgttggggccagcttggtgacattagctccttctctcctgtctgcccacaaccaggtcagacacacccaagaaagtgacacctcctttctctgcttgggacatttgtaagattctgcctctcctctgacatttcacatcctctccctttcctctcttttctatagtttctggctacctgtaatttccttagcttttgctctggcatccctctggctattatttaagttcttctcaagatgttttgtcttagcttgcttctctcagctctagcactggggaaatgtgatctgccagcctggctaccaaagctcttattggagggtgggattggggtgggaagggacgtgtgaatgaagggccttgtagttgacatcctccatccttcatgctcactgtgatgttcaggatgggcctccatgcagcaaggtgtgccttggcttcaggggaccctggcatgagaattaggagataccaagatctgtgcagaagctgttcccatgtagtcccttggagaacggtgccagctctccaatctcctcaaagagcagaccctcattgtcgccatgcctctggaggctgtgcctctggctaacccagacccagcatgtcaagtcaagcactgctgggcctagagtttcacagaggccctcctggccaggagtgaggtcatccaggaggtggttgtgccaacttccagggcgcacttttcagtggcatgtgatctggttctcctcatggtagttttgaaatcttgtggtttcctgttttgatgattggttttgtacatataatcagtgaaactatcctcacaaattacatgcatcccttatttcatttagaagttggtaagatgtttttccaaccttttaagtgtattcttttttttctgtcctctttagtcccaggtaaaccaccacagtgctgctagtaatgaaacctaccaggaacgcttggcacgtctagaaggggataaggagtccctcatattgcaggtgggtactttttggtgagaatcggcttatcctgttacctcctactatgtagcttcccctaagtggaagggaagcccaagagattttctctgttggaatttttctccttccaatgcctatgtttttagaaaagacttttcctgaaataaaacattaagtaactgaggggacaatttaactctagacttggcttaggggggctgtgaattcagtcattcatttatcatgcactcccaagcacccgcttctatacactggcagccccatgaccaggctgatttccaggtgctaagaatgaacaaaatgggccctgtcccccagaagctcctgagtcttgcgagggaggggagatatatcctcatgccactaataaaacagagctgtgggtgatacaggcctaagggtgaatgctaatgaatcaagtccaaattgtctgaagctggatctagactgatccctttaatgccaaatcccctggagctggtaacaggggctaagcctttgatagctgtcttgcttgaaagagaggagctccaaaaccttttacggagaaagatcatcaagggagctttttcgctgttgaaagtttgtgtgccttggtaggacatagagttaggtattctcataagaaggctgttgaagaagcaggcccagcactttgctgtgttagctcttgaaaatataaattgattaagcaagcatttactcaaggtctggtatgcatcagatattaattagtgatttggaaaatataaaggctagtatcctaatcccagctccttaaaagcttaaagggtgatgagttagactggtggtagaatgaagggaggggttgagcggggcctggaacccaccccaggctatgggctttagcttggagcactaaggttatgaggtggcagtgtgtttgttttttctctttttaccttacttattttactctttcattgtattttatgaacataagggtaatgaatgattttaaaaacctttaaaattctaaaaatgtgaagaagcaggttaacacttcggccttttttccagtgttgttggttttttttcttttgcctctattgtaaataactgagctcataccaaatatatagttttacattccagttttgtatttttcttcacttcattgatttcttcattataaaataattgggtatctacaacttgtgagatgctggttttagatgctgggataaagcagtgaaagaagcagactaaattcccattcttgtggatcttccatttgaaagagagagagtgggccaggtgcagtggctcatgcctgtaatcccagcactttgggaggctgaggcaggtgaatcacctgaggttaggagttggagaccagcttgaccagcatggtgaaaccctgtctctactgaaaatacaaaaataagccaggcatggtgatgggtgcctgtaatcccagcactttgggaggctgaggcaggtgaatcacctgaggttaggagttggagaccagcttgaccagcatggtgaaaccctgtctctactgaaaatacaaaaataagccaggcatggtgatgggtgcctgtaatcccagctactcggaaggctgacgtaggagaattgattgaacccaggaggtggaggttgcagtgagccaacatcgcatcactgtgctccagcctgggcaacagagcgagactccatctcaaaaaaaaaaaaaaaaaaaaagaaaaaggagagtgtgaattgacaataagccaatacattaactatttcaggtgctggtaagaacgctggaaaaaagtaaagcaggatgaggattgtgtagtaaaaggaagatctcctttacaggaggaagccaaggagggagccatgcagatacctggagaagtgcattccaggcagagcaggcagtcagtccagcccacacactgaggcaagagtgtgcttggggtgtgggaagaacagcaagtggccattgtgcctgcagtctgtgctcaaaagggtggtgcgagctgcctttagaaaggtagcaagggccagattgaatagcacattgtagcacagatgtttgagggatgtgtaatttgaaactcttatcccaatgacatgattaatgaaagagtatccaatgtaagattttgcagcaaacagtatgaaattgcaaacttttgaaccaggacccttcatgattgaaatagcacattcctatttacagaggattacaatttaatttttcaaagtcctgtgtaataatgctccctttcacattcatagttttctaaaattccaaattcttgaataatccccatttaaataatcctaacacaattgggaagctgcttgccagtaaagtcagaagttgaccctagtagtttctactctactgggagcttatgggcagactccaggagtgtctgttaagtgatcactgctgttctgcagtggagctggttaggcagattctcagcagggtagagcctcttgcttaatgcacacagcagcttagccagactgaattaatttagagtccttggcccagaaagttttcctggttctactcatagaacaaggcaaatcacacataacaaaatactttgtttctaggattagttaaaaacaaaaccagaatctcttgtatcttcattataatgtaactccttaggaaaaggatttttatcctttttttttttttttaacttctgtatcctccagtacctaaaattatgcctagcatctattagggtctcaaaaatagttgtttttagtgaacaaaggtcacattttatgacctttatgtattttgtctggatttcctacatcccttcatttgtaatacttagaatcagcgttgaggttcagaaagcccctggagctgaacaattagctatagaatgctagagatcctatgattccttgagtatcaccaacacatggcctcaaggcatggtatagaccatagaaatgtttaaccctcataataagattaaccagaaaacatccttcacaaacagaaactctggattccagtgagcaaagcccacccccagagtcctgcccttttgaaagtagagttagttcaggatggctgagagtgttgggccacagggattaataaacacccacccacaaaggtttgcgtgtaaggtggaccaagttgatagaaagagcccgttcttgtttttttttttttttttaacattttttttggttaaaagtggaatgttaaccatgtgtcaactccaggaatatgtttcaataattcattaatcatttgggaaaataaaaatggagatcttaaagtaggcatattaatttagattagttcctttttaaacaggcgctttataattcagaaagtttatctaaacactcataaatgaattcacatcaactcatgcaccatctattattccatttcagactgagaaataattctggataatctatatgtaaatggcaacaactctaaccaaaaaggtctaaaggatctcagtttatcaactgctaatttcttcactttggggaggacactcattctctctcttcttgctttgaaccatctcttaataaagaaaaaggatcctggggccgtttgctaatagagaaggctatgaaaaccattgttaatatatagttagtgcataatttgaatgacttcctgtaaatgagtttttactaattaatatttttaatagggattctcagcgttcttcagaaagatgactttttttctgccaccgtatgtgtaatgtggcttctctatatttatgacttagagtcatgttttggcctgtgaagcacaataacctttctggagccaagttttgtcagtgctaatacatgccctttacagcccacattccttaattgcatcaaaacactcacctgataggtgagcagtcctcacacccttatgagagaggtaaggtcattggttagtttccatgaagtttggaccgctcttccacacgaggttgcagaagtgctggcaagccagctgagatgtgccttgaggtcggggctgttctggaagaggaataaggagcaggagtccagcccagaggcagctcctgtggctgttgggtgttttactcttgagtctatcaagagcagtaaacgtgacccatgtcatcagagcagtggccgagactccctggtaaggtaagaatctaactgcagctgccttcgttcaggacacttcctccacctgccactcagcaaaaatcaaaatcgttcactgtgtgtaagagtcagtggtgagatttaacggctcccctgaggtggggaggctttcctgcaccatgtcaaatccctggtcctccaccattgctttatttcctggaacaggtgagtgtcctcacagaccaagtagaagcccagggagaaaagattcgagacctggaagtgtgtctggaaggacaccaggtgaaactcaatgctgctgaagagatgcttcaacaggtaagggcgggtgcactgaaggcccttgggtgccgaagcagctcatgtgctgaagcccctttgtgtgcccaggctacagccctcgctgtctgctttcccatcctgcctgggggcgggattggctgctcagttgtacggtgtttatacagcaggtgaaaccaacctgaacgttgagagtggcagagggggtagggaagggaagggctgccctgagatgaataacctgctgagctggttagacagattcccagacagcactttctccagacctggtgcagtgagggagcgctcggctgggggcctcaccctcatcctgtgggtgccatctggagttttagaaagtcaattctcagctgattctatgcccctttcccatctcgctctgcctcttcctactgtatatagtttttaaaataaaaatattatataaataaccttttagtataatttaatagatatcaaaatggaaaaagatatttaactgttccctaccattcaaataatgtcttctccttgttttctttttgtccttgttatgtgtacatgtactttccaaatctgtaatcacaagagatatgcaatttagtcctcagattttgtatgcttaatattatatttttcccatttaaaatttttgctgtattgtcatctttactatcacctataatagattttcttagtaaaagtatcagaattgacttaactttttttcaattcctaaatatttttactgtattataaataatgagctacaattttttaggaaggggtgttgaatttttattgtatcaaaacttcagaatttgttgagaagcgaattaggtttttaaatgaaatgtattaatatatctaatcttaaattttccttaagtcattcttacattttaagttatcttgaaaattaaacaatgactgaagtttatgtgtgtatgccttataactcctggcatagtacttggcacataaaaggtactcacaattacttaaagaacaaaagtttgttccttaaaatgagtggattcaattagaggactacttataatctttcctccaaaagcgctagcattttttttttaattgtcatgatcagcataagactcagattgtttcttgacagcatactggtgaacacaggctttgcattttacctttggtctcatgacaaatgtcatgagaattaatctggtgtttgttagttttgtttgagtgcctttgaagaactttatacaaatgtaagtcagtgtttttatatatatgtcttcataaaaacccgtttcaatgattcaggaacttttgtttgttatcttttcattgctgattaataaattaccacattcttggcgccatttgattttctacttaggttgtgtgccatttctcttgttcataatatttcctaaaaatctgactagcaaaaggaattgaggctttttttttttaattgaatctttcttttgaagacccaggaaagaaaatagcctgatggaaaaaaatctcaaatgatgaaagtattttcacaaagagtgcagaaaacaacctactagattgtgttttcaagtctgcacaaggtgtgtttttgaggtgagaaggataagggaagaagatgatggaatggtgtaaacaatccagaaagagagcaagaacatttgaatacggaagggaacgtgtcagaaggttgatgtttcaggaaggctatgctgggagagtaaccacataatcagaggtcaacagaatgctgcattgtagtgcctgagttatctgactgcctgtgctggcttctctgagccttctctacatagctctctatgacagtgtttctgctccattgtcaaagtctctgtgtcaaggagtctgattgtgatgcccagcaccacctggggagaggctgtctagttcctctaaacatcatcccatggatggcattttagacttttttaaagtcataaactcaattactttttttttttttttttttgagacggagtctttctcagttgcccaggctggagtgcggtggcgcgatctcggctcactgcaacctccgcctcctgggttcacgccattctcctgccttagcctcccaagtagctgggactacaggtgcctgccaccacgcccggctaattttttttttttttttttttgtagttttagtagagacggggtttcaccatgttagccaggatggtctcaatctcctgacctcatgatccacccgccttggcctcccaaagtgctgggattacaggtgtgagccactgcgcccggcctcaattaccttttttagcccgtttattctaaaccctctttcctgtgtgctgtgggtttggtattgggcgtgtggtaccatgtgccatagagggtagatgtcttaacctggcatattttggagtatggtagccacttctgagtttcaaagattcctgaacttgaccaagttatttttctgcccataagctttcattgtattctctcaaactgtcaagggtcaaatgatagcagtgtgcagtgctcctttcttaacaaattgagttcaagccataggacacatctgagcctcatcttccactcatgtgttcgctgggctgggtggcaccagagcttgagatcttttgagttcccagatctaaatccaaagttgaatgttcggccgcacatgctattgctttcctgaagtctgtttgatgctgtttgtgaagacacttgattcttgcaccacagtgctgatgcaatatctctggcttggagtatgtgtgtattctctgagctagggacaggcaaacacttgcctgatttgactgagatatcctgggctgcagggcccttggcttctggtggtaggagcaagaatgactcatggcctagaggcagagaatggaggcaaacaattgcctctttctgccagcctcagaaaccattcctgcctggagccaaggcgagcctgctgctcaaagcctctgaaggaaatcctttcactgtctcagtgtgcgcccttctaactgcctgtagataaggtgcttcctcggggtttgctgctcctgataaccctgcatgctggagacatcctgtctgaaggcagcagctgctgttctactccagttgactgcccatgtaggcctggtaatgctagatattctcatttttcacaagagactcaaaatccagatctaaagagttaaggatctctgcttttaaaatattagcagctaatttaagttttttaaaatgctgtgtgaatcatacagtacatacctataggtcaagcctggcctgcaggcctccaatctgcaacctctgctctagacttggccccttctacaggctggaataactccagggggacttggggaaagccaaatcaatgaggatagcccaaaccttgtgcttaaaggggctccaagaaccccattgagctgtctctctccatgctgctctcctgaccaatgtcaaccttcctccaggagcacaagaggtgaggagttagttccttacctagttcatgaacaatatactcactgtatccccaaccacaacatcctcagtctgtcgctgctcagggctgacctcccaactcccatctgtttttgtctacacatgaactcatccagcctccagaaagagcaagaagacctctcttggggttagacaggcaaatcagaaccaaccagagccagcaaaggggcaggtccacatgagcccacctagattatgaacacttttcagggcaaaataatgtttctgttttgcagcccacggcaggatgtgggatgggaagggaacatgatagctacaagcatctctcaggactgctacaagcagacagctacaagcatctcatagctgtcgacatacacatatagacataccttgtagctgtctacatagacagctacaagcatctctcaggactgcctatggaagcacctagtcagatgtggtcttagactcactgagcatgtctggattgcccaggaaactttccccattaagaagagttatttctcggccaggcgctgtggctcatgcctgtaatcccagcactttgggaggccgaggtggacggataacctgaggtcaggagttcgagaacagcctgaccaacatggtgaaaccccgtctctactaaaaatacaaaattagacaggtgtggtggtacataactgtaatcccagcactttgggaggccgaggtggatggataacccgaggtcaggagttcgagaacagcctgaccaacatggtgaaaccccgtctctactaaaaatacaaaattagacaggtgtggtggtacatacctgtaatcccagctacttgggaggctgagtcaggagaatcgctggaacccgagagacggaggttgcagtgagccaagatcacgccattgcactccagcctgggcaacaagaatgaaactcaaaaaaaaaaaaaaaaaaaaaaaagaagagtcatttctcaaaaggatctttaagggagggacagtctgagtcagttttcactggtctggtattgtctgagcctgaaaatagaactcacagtgctgggctctgcctctttggtccttaagcagatcaaggcattgctcagctgcacagtgaggctatcagaggccagggcccagaattgtacactagggtttccggcatggaccagcgatgttcttgtgactgcctcaaactatgctggcaacaaaaatctctgtatcatggggagggtttccctggtctgtgatataatcgaggcctgtggtggcattttctaaagtagccactgtgagctcactggggtctagtaggttcctgcacaataagctcctctgcctctgatcactgacccttctctagaggaggaagaagctgatgctactcggtggataagaggttttacatggagctggtggtcaaatggagcattttccagagactggccatttacagatataatcaatgtaaacagaaacaatgttcaatgtcaaaacaacacagggaaagggaggactgtggggagcaagtaagggcataatcctgcttttgggaaaccttggacaacaccagcctctatttctatcctccctaccgacccagagcttcagggtttaggcaacttcattttttttacttttaggtgaggttggggagtgacaaatataggggattaagagttcatggatatgggtttctatagatttgctatttgctattgatctgggaaagtcagtgtacctgtttccttattagtagagaatgaggatgacaatatggactctgtattgcctacctcttacttctcagagttatagtaaagttattccactgttattaagcatgagctatcacacagtgagtcaagacactgagcctaagacacaggcctagtagatggctggtaaacttcccaggagagcctttaagcaggtatttctatctcaaagagaatattaaacagagctgtgtacatgttccggtgggaacacaaatctgtctgaggtgggtaagacagtgattcagaagtgaagaaaacaggaatttttcaaatattccccaaaattccctctggggatctatgagctaatgagtttcttcatgcttatcccatgtgatgttgggaatccagactacagggcaaagtagatactttaactccattttacagataagagtgaggttcagagagatgattgagttagtgaggactgagcctggcctcaaactcgagttgactacaagcacctcttctctgcacagtgttactcatgaaagagacttccctgcaagacctgggccttttacttcaaagggcaaagagacttatttttcctttcatgcctttccatggcccactctttcattctggtttcaggttgccagtctggctgcagtcctctgtcattggtcggtaacaccctgggtcatattccacacttaaagatggaggtaattgcttcaagatgtggccctttaaggagagaataggttgaaaggcaaattctttttttcagctttagtcagagcctgagttttggaaaaaggaaatgatgagttgctccgagatataaactttctttcatctcttagaagaagtatttgtccttctgaaaaggttagtggcagttttgtccattgattttttttctaaacctttattacccagtttcatggtccatcacagtaagtaaaacaaaccaccctcccccagaccacctccctccttatttgcacagggaaccttcaaacaattgggagcagaagcagaatgatgcctgtgaagcctttgccccttatcctcagctcgctgcctcccctcaactccctccccatatactgcggtagctgcatgactccagcaggattccaccatgaaggtcaggaagccttcagcagggggcaagcattgcctggcgaggatgtgggtgctccagacagcctggatcagagttgactccagtcttgggtgagaatgagattaagggctccaagaatgttttccttacaggattgacagaataaaggcagccagcaaagaaaatggagaagaaaaaagaaaggtcaggaaaaccgagagcaaggaagattggggtggctaggagtaccttacattgagtggataaagggcgagacagttaagatctgagaaatgcaagctgcatctcaaagtttgtacattggttccaggactatttctgtgccctagttggtgaaggcagaagccaggttcaggcaggcagaaatcttgttgaggagtgacacacacatacacacacatgcacccacacacacccacctactcacccacccatacacgcacacacacccccccatacctactcacccacccatacacacagacacaccctccacacacctactcacccagccatacacacacacaccccacacacacacctactcacccacccatccacacacacacacccccacacccatgcatttgtccagcaagaggacatgggagttgacggtgttagctttgagggcaaggtcaagacggaagtttctttagaatgtcagaaatttgatcatgtttatagcctgaggattgggagctgatggtgagggagagattaaatgcctgccagagtagatgattgatggccctaacctagagtagcacagagcttggtgggaacttactcaaaggcagtacagaagtgagggagagtccaggaccatgtgagcaggagccattctgagttaccagctggagggagaaacaggaccagaactcagagaacagagccaaaggctgctggttgaccaggaagttaccgtaaggtttatcaagttgtatgggaatgtatgaagagtcaggagactgagaaatagccagaaatgggaaggtcagtcaggggcaattcaggagcaaattctggaagcattgtatcctttgatgggtactttttatgtgcacctggaagtattctgaactagggaacagttttcaaaggtgaaagaaccctgcagaaaagatggcaatgtacaattgtcgcagtttatccttggaaaggaactatgggcttgctgtttctaagacagggatttaagatatatgaatgagagatgatgctaggaaactttgaaatagaacttacattcagtgaacagatgcattttatcttttcagcaaatacgaggagagattatttgaggagaagagggagacatggtaggggtttagggcttgagcagaacagaaaagacttggaacagttcctgaaaggagtcagccagagacaaacacaagttttgccaggcagtattggaagatcagctgtaattagatagcacaaatttgtacagaaaccaactggcatcattaattgcctttcactagcaatttttaagctgtggagagtggaatcacgacaaaagactaacaaatgcacatgaggcctgttacagggatgagatcccatgaggattttctgctgtggtatgaatacaattggaatgactcacctcaaggtacagagttgataaggagaacaatgttgcttcaaggaagttgataaaccaggaaaatagagttactaagtaactagtggccgcagaagaaattagaggttgagtgagcaagtgggacagatgaaaggtcagaagattgtggccagaggagagaatttcagagctgaagattttagaagcaaagcaaacacattctggatacacgtgagatccaagtggtgactgtgctactgagaagctgaacgaaatggaaagcaaagcctgttggagctgaggtcaaagaatgtgaagccagagtggatactgaatgggaaagttaataacaaggatgtggaagctattgaggagacggagtgcgcctaaagtaggtagaaaagctgttgatcaagtcaaaagcctgaaggaagtaggttggttccttcggtttggggagaatgtggtataagtgaagagcactgtcttagaatagcaggatagatgcagatggtcggggggcaaaatactggcttggaagcagccctggaatagggagcacagtgttctataagttgggttggtggaagctgagtggtctccaattgaaatgacggggaagaatgtgtaatattgttgaaaaaacatgattcactttatgttggaagtagaaggagcaattgaggatgtaggataagttaactcctattaaagcacacattttagagatcacagttcataatagtggctacgggccttgctggatctggagatggggaagtagagctggactgggataagtttgttgaaggctgattttgagtttagggaccaaaacagtaatcatgacaggggcaaggggaagatgatcatgaaaggtagaagcacatgctaatagatataagctagaagagaataagtaaatgttctgttattagtgaactatatgaaattaagcaacctcaggtttctaattaaaatgttagtgtgtccaattgtgaatgtctgtttggaatgttagtgtggctaattcaaacactggcatgaccaattggaatggctgttggaactagtgaaaatattgtcttcatcagctggaaccattggtatgactaatcacaacctggtagttaaaatagggattttggcaatgatggaagcagagtagactcttagctttcaaaagagatacattatgaaactttaaaaaatcacatcaaagcagtattttgaatgctgatcagaagacaaaactgcatgaattttttttttttttttttttttttttttttttttttttttttgagacagagtctcactgtgtcgcccaggctggagtgcagtggcacgatctcggctaactgcaagctctgcctcccaggttcacgccattctcctgcctcagcctccccagtagctgggactacaggtgcccaccaccacacctggctaattttttgtatttttagtagagacggggtttcaccatgttcgtcaggatggtctcaatctcctgacctcgtgatccgcccgcctcggcctcccaaagtgctgggattacaggcgtgagccaccgcgcccggccttttttttttttttttttaagacagggtctcactgtcgcctaggctggagcactgtggcatgatcacagctcactgcagcctcaacctcccaggttcaatcaatcctcccacctcagcctctcaagtagctggaactacttgaggcccatgccaccacgggtgctaattttttttttgcgtatgtattttttgtagaggcagggttccactatgttgtctaggctgatctcaaactcctggggctcaaatgatccacccacctcagcctcccaaagtgctaggcatgagccactgtgcccaggctgagcatcaccttaaggtgttcaagtactcaatagtggctttgttttattagtaattgtcatgtatctaggcactggcatctggtaggtatttaaaaacatatttgttgaataaaagaatgaagtctcttgggggatttttttttttccctgagatctcagtagtctgaagacattttcttgtggaccttgacctgtgcacttgttccttttcccctttgcattggcagctgggaagctcacatgtacattatagtccatctctagctgtttatagaagtttatggcatagattttctactaactctgactttaacttattttcctacctgctttaatttttatgatttattttttaatttgaaatatctattttgcaaactgcctaaacacattttgggaataaggtaggtaggcagaaggatggagaactagagaatgaggtaataaagaaagagagggaggtagggaaaggaaagaagggtaagagagtaggtggtgtgggggatgattacatcttaagatactcacgtactcaagactcagagactcagataacttattttatgtgccctcacactcagggaagaactgcttaaggccctttgtggcctgcatagccttagcactgggtcctgataggtagtatgtgctcaatgaaatcttggcaatttgagtgggcatttcctgggctcattgaatatttgttgattgcctattttagcatgtttttttaaatgtctcttaaaatgcttggacttctttctctgtttgggaaactgtgatacaatagactaaaatgagttctggagtcaaacagacttttgtttgaacactaactctgcttgctgggtgtggtggttgacgcctataatcccagcactttgggagactgaggtgggtgaattactggagatcaggagttcaagaccagcctggccaacatggtgaaaccccgtctctactaaaaatacaaaatccgctgggcgtggtggcatgcgcctgtaatcccggctactcgggaggctgaggcaggagaatcgcttgaacctgggaggtggaggttgtggtgagccgagatcgtgccattgcactccagcctgggcaaaaagagcgaaacgctgtctcaaaaaaacaaacaaacaaacaaacaaaaataactctgctgctgattggcttgtgtccttggccaaaagatttatgtactctctcttggcctgtttcctcatctgtcaaattgggataatatttattgccaactcatttggagggtttattaagaagatgtatacaaaagcaccagcagtctctggtacagaggaggcactcaacaaatttcagttctccattgcattggacgcactcatctggctgactcctagtggccaagtagcctgtgctctggctgcagtgctccacctctgccttgtgagccagcttccagtctggctggcccaggaagagctggcctccttaccccagagctcggggagctcattatgctgagttgctgggcttcaagagagatacccatcccctcagactagcagatgaacagtttgttgcctacctttcccaggtaggctgttgcccagcctgttggcctggggaatcatgtattccaagtcaaaaatttctgtcccgtgtggtttgattcataatctgaggacggttccaaatctgtgacctcatagtgtttgagtcagagtgttgagattgccattcttgtgctgagcttgggttgcccaagatgatacaaaatgttcagaccatggcaggatatcgtatattttccttctgttcatttggcccattgctttcctggttgctgtgtctattctccttgccacaacctttgtagccagtgtctaccatgtgccgggattttggacctcataggacattgccctttgccaatggaaaaatatgtttccctggactttaggaaatgctcctgatttttgaggtcctttataattcatattacttctaagtgggtgtcttgcctatcatctttattttttaccttgtttatgcttatgaagtgtttttattagtgacaggtttgttgtcaaagccctgggttatttggttatagtctgctactgttctagtgatggcaggactagtaataacctccctggtctgtcttcacaattgggaaagaacaatcttcttatttacattccagagtggccagattgtaattttggaacagcccaggaaagatccatctcacataagattcctatgtaatcattcaacactctttgcacatctactttgtgttctagctcctgtctaggttcattgcagtgaagtcttgtattggaacatgttgaaaactgggctgagcattggttgagcccagaaagtgatctagaaattttggctttgaaaaaaatatattgttaacttaagcgaggacctactgctttgtcttttaaaaaattgagaaatttcgttctttgaaagtatccattcacttttctctacatggaaataatgaataatggtctctatgggcaaacacatttgagaaatgtagctcaccttgtctatcaaagcacagtgggtggtattgggggtgcgctatccctgagtagcccagcatcagcccaggcccatccataataggcctgtgactctcatgtagcagtctcaattctgtgttgttgaacacacaacttaggtgttgccttatgtgctgtaaatgaagccagagctgttcttattgccatagtggtttctgatttcgagatctgtttttgcttgcaggagctgctaagccgcacatctcttgagacccagaagctcgatctgatgactgaagtgtctgagctgaagctcaagctggttggcatggagaaggagcagagagagcaggaggagaagcagagaaaagcagaggtaagggtgagtgtgtactgtcctaagctcagacctgggaaggctgtcataatgtgaatttaggccatctggtcaactcccagcctggaagctattgggtgccagaaatatctatacactagagatgcagtgatctgttaataccaagttatcaggttttgctgtggctgcaaatttcagcaatatccaaaccagccagttttggctctaaggctttatctgccctcaaactgctgacaaggatggaaagagaagcaatagttggggaagaataagacaaaatgtggagggacacaagatgtcttctgtgagaaccaaggaaatgacgacgtaccggaatgaagtcagcctcccaataggccattgacactggatccaaggagtctggaaacgtttcttgacgtgcgtttcactgacccagatggaacctcgggtgatgtgtttctcttttcctgatgggtcttatggagcatgccatgtgcaggccttctcttagagaatgttttcctaattttgtttttcagtctttgtatgccattggctggaacatgccagactcttttttaaataaatgtttagagaattttacactcagagctcctttgagagcaggcagcctgttttaaccttagataaccgtcttcctgtgcctctacctttaagttcttcttatattcacacctagcaatgagagatatgaaagaagataggttttaggtttagaaacacctcgctcatttactgacctaactgcttaatagttctatgaacttcaagctggctacttaatctttctgaacttcaatttctttatctggttaaaatggataactgtgtggtaaagtccaaataaaatcgtgaaagttaagtacctgtcatagtatttggcattttgtgagcacctggtatgtcttcatctccttccttcatttaggctaaagatggatattgttcccttctgataagtgccagcattagtgcatactgacatctgccatgtttgctgagtaaacacactggtgattagaatatttctaatgtgtgagcatgttccttgcattgcttttgagaacatgttcattaattagaagtacagttgccaaaagaagatatccccaataagctgagaacagtagcttgtattgactaagagtccaggctgatgaatcagatctcctggctttaaactgagctcagtggctttgtgaccttggtcacgtaatttaacttcccagacctgtttcttctgtaagatggaggtagtaatacttccaatttctttggttattctgaggagtgaatgagacaatgtatgtggaacccttagcatagtaatagttagcttttattgatcacttactgatagtattgttaagcatgttggaaatgaaaatgtagacatagatacattatttacatattgcaaagtttatacagcctgaaagctaatctgtgtgaagtgctagttgaattaaatgttgagggagaagtaactgaattttcttctggtttgaagtattttaccaatgtttcaacctgcacaattgtatgtgaacatacattaggactttgggggcagaattccataaactctgtgagaaggcttaaagtggcagacactcaactcaaagtcacttaagagaaaaagggaggagagagacctatgtcacataacttgaaaagtctagtgtttgaaagaatacaatatgactagatccgggtaatctcacagtgtcactagaaattagtctcagttgtatcacctggttctgctttagccttattctcaagaaggttctccccaggtggtgacagagatagccatcagtagctccggaatgatatcctgccagccaggcaacttctgcagtcaaagaggtgctttctcaaaggttccagcaaaagcctcaagattgcatctcattgggccactttgggtcatatacctggttctacaccagtcaccgcagggatctgtgcatgaggggtgggaggtgcgaatatgaaagtcagcccgtgtgtggaagtatacagagttagcaccaagctaggataatgcagtccctttacagggacatcagaaaggaaggagagctcccacttctgggacaagaagcactaatgcagtcattttactgtttgcttttttctttcttttctgaaggactatttttaaatctgaattttttgtttttgtttttcatcagtctgttcatacataaggcgacgtagaccctgagtgtctggcctcagtcctaccagataacagcccttcccagttgctagtacaaatattaggtttccacgtggaggaattctgtaggctgttcaaacctgtgataatcagtgagcagccacatggcctgaaacaaattcctcgttcttgtaattgcacataatctttgctggtatgcacagaacttctacctctatttgtgagtgtctggagcaaccaggggtttaaaaccacagggtactgcttaagctgcactattgtcatgtgcatggagatgtttattttgagtgagacattttgctaaggtcaccagaggttgtaattgcatgaataaagggaacgctgcttcccatactatactgctgctgttttttccagtgagtgtatttagcctaagggctcattgtgtgtggtttggaacaggcaggattcttttttttttccccctcaggtgtgagatagccagatctgaaatacagtttctcagcttagctcaggctttatcctcaaattctgttttatgttttaatgaaaagaagagaatgcttgtggcaagagcattgccaccacaatgtcactagaaattagtctcagttgtatcacttggttttagttctagttctaattttagttcacactgctccttctctgattctgatcatagcccaagccagcatcttgctgcttgttttaagttgtggaaatgattaccgacagtcattctgtaagacctagggacttgcaggcgcaggttccttgatggccagccttgctcaagagtgagtagtggcccagatgagatgtgggtgaatactaggtttcctgtttaccttttctcatcagccttttgcaatgattcagggtcatatgagggtactgaagattgggtgaattagacgtattcctgaaaagtaggactacagaagagtgattgacgtggaaagtaaataccaaaatcaagaggatgaagcatgaaagaaagagatccagaggtaaaggaaaacctctgtgtggacacagatcaaagcattgcaaaggcgtgttgctcagatgggccttccccaagaaagaaatctggcttctccatgctgtggaggtgccagcaacctgcagttggaccccactgtggcaactagagggttctgtgaatagctatcagagcagcctgttaagaagggagcagggaccccagatatgctaggaaggggagtcagcccaactgatcaggggtacacgtgagcaagaagagaacagggaagaatctttaggatttcctgcagaaaatggaaacatctcacagcacaagtgatgatgccatcatttcttcttccttgtggttaggaccctgggagaaagggattctgatttctgaactgaggcaacagagtgatggacttggaacacagagtgagatctgggaagattgtgtttgctcagagatgagctggcctaataggagagtttttttattcttgtttttattttctttatttactcatttgcatcagtgtaggaaatatactcccacaattcaaaaatcaagtgttcaaaagggtatatagcaaaaggtctctttcaacacctgtcctccagtcagcagtcaggaagcagtgccatcagtttgtatccgtccagagttatattatgtgtggacaagtacattcatgtggatacacacagacacacacactttccctcatttttatacaaatgtacactattctagacctttctttttaaatttagcagtcttggagttctttttacaccaagtatgttttttaaaacttcctcattcatatctatgtctgcatattgttctaccatccaacaatagcctaatttatttaatcagtcgtctctcagtggacatttaggtggtttccaagtttctgctattacaaataatgctgtagtgaataatcttgtatatatgtaaagatattgatgtggaatttatgggtcaaggagtacatgaacttgaaattttgacagatatttccaaattgccctctctagaacatagaggttatattcccatgagcaatgtaatgtatataaactgagcctgaaaaaagaaagaactaagtaaaattgtgtacaagattaacaggtaagatggaattggaaacaactgtgattatgggaggtgcccagtagtttcacatagaaaagaaccataaagaagaactttaatggttggcaaagtgtgattaaaaaacaaagtgagctgaggttaaaacacaggacagcaattataacctcataaatgccacctagacatcatgatgtggaacccagaatggaacagagctacaaaagggtctgctttatgggagggaaacagacctgttaggaggtgggccagccctggagataaagaattatgaagctaggccaggtgtggtggctcatgcctgtaatcccagtactttgggaggctgaggagactggatcacttgaggtcaggagtttgaggtcagcctggccaacatagtgaaaccccatctctactaaaacatacaaaaattagccaggcatggtggtacacacttgtagtccagctacttgggagactgagacatgagaattgcttgaacctgggaggtggaggttgcagtgagccgagatcgtgccactgcactccagcctgggagacagagtgagactccgtctcaaaaaaaaaaaaaaaaaagaattataaagctaagttgaaatgccaagcctgtggacagacataccagaaaacaatgacaacacatggctcaggagaattaaggcagagtagcccagaagttttgggtacaccacacactgagcagagggatgaaaatagatgtgttcctgatgcaggtctccaaactgactgatgcacacaaggggcagtaatggagggaggggagtagcaacctatttgttagctcctaaatatctcccagctgaattctgaagcatttgaatgtttacttgtttgtttttctcacttgctttcactctactcagagggtagaagacaaaactaggaaaactgcctttctagctccaacattgaagcaaaaggagaaactggtttatgaagtaaaagtgataggtaccttgagagaaagtggtcattgttatttgaatgttcacgagagtgagcatggaaaaactaggcataaacagacatgcactgtagacttgggtaaatcataactctgacaatttaaaaataaaatggatggggaactgtcgaatagaggaagacccaagaatattgaactacttaaatataattctgactgtgcaatctcacagataataccaataaaaaggaagagtttagaggtctcttgaaaggaagtagttttcagaggggcttctacaaaaggcagaaaggacatatgctaaagacaaaagtgcacctgcatgaccagtgtcaggaaggggacatccgaaactaaaggacaatgctgaggacaacacaaagccatacacacacatacacacgcacacacaaacacccacacacagttatgttcttaaaaagaaaaaatggacttgattccatggatgcctctgacagatacaaaaaatttaggacaatagtcccccaaagtgcttgctataagttaattttaaggaatcaggaaaatcaaatgagttgctagaaaactggaaatgaaccatttccttcttgattttcaaaatggcaaaagtttgatagattcagtaaattttagtctgttgagtttggggccaactctatgatggtttgcaagaagggaggagacaaagtagggatccgtgtcctcaaggagtgagtctcgtcagattggccttatcggtttggccgggaatgtgtcgtgtggtagaccaggtaaatccacatttcagtgaagtgttgcaaaaacgttgcttgagataatcttgtagacaggatggaggaatagaagatgaatatactgaaataggcatattgatgcctgagttcagggtttgggtacatattgtcatggataagtgtgatgtgtgccatatgtcccctgtgcataggtgctgacacgttgggtgtttgggtaaggggagtcggtgtgtgtatcatgcatatgtggagagaggacgtgtttgtgtgtgtgccccagtgtgcacccatctctgctattgcttctgcttggatgaagagtttcttctagactccatgcctcggtgttgacacaacaatatggcacaaaggagctgttggggatttgttcgaactgcaagacaggcatctggatggggcaggcctgaggaaaaatgccatgtcttttggttctgttgtggaaagtggagggccgtcgacagtgaccactgagtgccacctgctccctgccccatgcacacttcctctgtgctgttctcttaaggagttctgcgtctgagagctgtctgacctggagtgcttttctcttctttcttttccttcctacagtcggttctgaatgtgatcagtgagctgcaggagcagatgtgtaggctgcagctggacatccacaggcagattcaagagcgcctgttactcagtagggaccaccctgaggaggtggcggccagcgacggtgtggccgagccccagccctgcagccaggactgtgcctgttgggaggggtcacctgtaggaaccacacttaagtatatcagagcatgcgtgtgtggggcatttcactggtggaggggctggggtttctcctaaccagaacagagtgcagtggcttggcatggatctgttgttacctctgggcagagcttggactcactcaatcctcttgggatgtgaggtgagctcagtgaccctcactgagcagggtctgagcaggtgaggccaaccctcaaacaggtggcactcatctcctttagggctgggaatgaggtgcaccaggtgctccgagtgatggggcatttgtgccacaggaagcctcatgattccccttctcaggtatgtgactcagatactgattcctcttcccaggctgggagattaaacaaacttttgtttcacatgattttttttttaaggaaaagaagtattatgaaaaagaatcctttcaagtttatgttcaaagaggtttacccccagtgaaaaaataaaatacaagttttcatatgctgtgaataattaagtcatcatctgaatttccaggaaaaatcccccccacataatcacatcagggtgattttataacaacagggccatgtggggctctatctgactgggattctggacttggctctccacacgggggtaacctggtcctctgtgactttgctgatggcaggtgatggcagcttcagcagagataaccctatgcctcgaaggaggcctcctgttgaagaggacttggaagccccccaagaaaagaccgaggtcacagcagccatgagtactacagaggataccctggctctgtaggaagttactatggtccatactcaattagggagcctgttgaaaatctagacataggtgttgcgggaagggatttggttggaaagatttcctgctgcattaaaggacagcggggaaataggaaagtcaagatgtaaatgtagacttggatagagaagccttgagagggtgttggcgcatgacctatgttgagtaggttactccagcaagacttttaaaggaaggaaaaacgtgtgtgtactaatgttggtagtcaatgatggacaacaagtaacatagaaggaagaggatgttccagaggtcacggagcctggagaggatgatttctgtatacccacagtggcagcccctcaggcagtaggaacctgtacacttctgattctgatatcagctggcctgacaccctctccaacaaactgagtaacctggctaggatacaaggctgagcagaagaaccctcaacttgtgggcattggagcctctcaggcagggccaataatgtcctcagagaatgattctgggtctgctgcaagtcaaagcaggtatctgaggccttgacatccagtgatgcagatcatggatgcaataaccttagctgagaagttttctttttcttttttttttagctgggattacaggcacttgccaccacgcccggctaacttttgtatttttagtagagatagggtttcaccatgttagccaggctggtttcgaactcctcatctcaagtgatccacccacctcggcttcccaaagtgctgggattacaggcgtgagccaccatgccatccagaagtttttttttttttttttttgtcttgtttttaacgggcatcagcatatgctcacctcaactagaaggcaatcttaaaaaatgaccctacaaaattcaagggtaagcaatgtcaactttgtggtggattatctcagaaggccaagacctccaggccagttaaataatgacttaagtttcatgtgtgcattcattgacaaatagtatacacctactatgtgccaggcactgcaggataatcagaggttagcaaatacctcatggagtttacagtttagtaggagagctagctattagctgtcatacaaataaatatttaattgcaaattatgtaggaggtacacagagtacaacaagagaatatagcagaggggcctgatatagtagggaggtcaggatagctttactcagggagacctgaaggatgggcaggagttaacctggcagaaaattccagacagagggaatgttgtctgcgaagacctaagttggagagaggaactgaaaattatccatgtggctagagcataactagggagaaagagtgatccaagaggcaggcagggagctgtcaggtcacgggttgaagtttatgagctttgagaagcatgggagtgccatgatctgatgtatggtttgatcatatcactcccccagatgccatggggtcagttgctttgagaggagcaagacaacagaggagcaaccaatgaattgactgtccaggctgtcagtgctaattgctagaccagagtggtggtgcctgagtgggaaagaaatgagacattcaagttgttttcctggaagtagaattaataaagcttggggacgaattgcatacatagaggaggaaggacagggagatgcagaggatagatcctatgtttctggataggccgttagatagatggatatggcatttagtgagatgagagtaactaggaggggagttgagcattccacttggcacctgacagtccggaggtgcctatgcagcatccatgtgatgttaagtaggaagtttgttgtgtgagactgcagttcagaaagcctatggaagtaattatctttatgccagttcttctgatgggagctagtcagcaggaccaattgtctgttaaggaaatcttggttcaagataacagtgcttagtggagtcatctttatagaaggagtagtttcacaaacaagggtcctagagtcagaatatatgggcttgaattccagctccaccacttactagctaaatgagtaagagaaaattgtttgtgtcacttccccactcagcaaccttcagtgactccctactgcccaaagaatggcatcggaactcatcatgtgtattctcatcctcaagcctttaccttagggcctcaccttaacttcccagcctcatcttccactgtgtgcctacaccctcagctctagccgcatgagttatctccctttctgtctcctatctttactcctccctggatgccttctccctcccttctttcttcaaatcaatctcttcctctgaactggaacacccattttggcatctatatttggcccttaacatttgttcccttagggttcctctatgaggcctttcaggatcacaggccccctcttctatcttccttcactcccagcacagagagatgctcccaattagcctgctttctactactttgcatcacagggaagaagctgcctcatttcagcatctctattcttcccactccgaagcctcgcctgcctgcctatactcatgtgtgtgatgttggcataccccacagaggacatagatgtcagagaaaggggcaggcagaacaggttctaaaactaaaaggaaagttttcactttcttatgtctggaactccctggcctttgttttttaacggccatacagctttcctgaaacaagggacgtgtttaaagattaaagctgttatgtggagcttgatgtggttgctgcaccccatatgcatgagcttaaccaggttggtaaatcaagagcacatcttttaaccatcagaactttgtctttctccctcatcccctaggagttactgcaagagctcaggcacctcaaaatcaaagtggaagagttggaaaatgaaaggaatcagtatgaatggaagctaaaggccactaaggtaaacggcactcctgatgcttatggagagagtatgagggccttgtggggagggtctgcattccaacttgggggtttccagtagcctaagtttgaaaatgcaaatcaaccctccagtgtggacacacagcagtgcccagatggtgcagtagacagacttgatccaggaaagatcctcatggagaatgcccgtgagattatgaattggtcaattgtagtaacccagtctgcttcctctccctgcaccccatagcacctggctgaagctgggccaagaaggggctaggagtggggagagcaggtgagtggcaggcagtgaatcatgcgtcctaaagcagatcttggatgcatcattttaaattcagtagtcccttctagaatcagtttttcaaaaaaataggcatgctttatatttggcacaaaatatattcctaaaaatggcataaacttcgaattatttcttcaatcaaatcatgtttctcttaaactagggagcctgcaatttaaaggacaccaataataaattctattgtgaaataaatttcttccctgtcccctttgtttcttccttcttttcctatactaaagtgcagagatcaaaactagtgggttacattcagcccatgaatttttttggcctgcacattggattttaaaacgttaaattgttatttaaatttcaggaagtttacattaggctacagttaggtttcctttgggagtatggggaggtgggaggctcacacctgccttcccctactgtgtctgcagtgccacccaagggcattactggatgtttttattagagttttcttaacttctagtttgtatttttattttttgtgcaagttagttgctaattattataaaaacaataacacacactatagagaattttcaaaccataaaaaattaaaggaataaaaagcactcataccacccaggcactaccattgctaatatttccttccgtgtattattctcttctgttttaggtctgtgttaggccattcttgcattgctacaggtaaatagcttagactaggtaatttataaagaagaggtttaattggctcagggtactgcaggttttacaggaagcatggtggtcacatctgctcagcttctagtgaagcctcagggagttttcaatcatggcagaaggaaaaagcaggagcaagtgagagaaaggagaggaggtgccacaaacttttaaaccaccagatctcgtgagaactcactcacagttgcgaggacagcaccaagagggtggtgccaccattcatgagaaatctatccccatgatccattcacctcctaccagggcccacctccaatatcggggattacaattcaacatgagatttggcaggaacaaatattcaaacatcagggtctctctatctcagtgtctctgtctcttaatttttattgttgataatttacatgcaattttataacatgctgttacttaaaattttatgacttctcatgttatcaaaagaaagcactgaacatatataaatatttatgtaatctagtgtataaatataaaatcatttgattaaccattttacagataatgaaatggatgtacagagagattaactttcccaagattttacagctatttggtaccaagcctgggcagtcagacccatctgtgtcctggcctgtgtgtatctgagtgtagttttgtatgtgtatgcttcacaggcaccagctctaggggcactggttttgtccagtagctcagaaccttccatcacaacaccccactcaaacaagccctgtcttggggaaacctttgaagttgtacataccgccctctgtcataaaaccaaataacacttttctttttaacaccccagctctttgtcttggcatgtagacctttgagatgctaagggttatttaataactaccaggtgtggagcacttcctatgtgccagaatgtaccaagctatttgcacacattttatcatccataaaatcacccagtgaggtatatgtttttttattctcacttgactgggaaggaaacagaggctcagcgtggccaagctgaggttcacatctgggtctctgtcattcccgtgccttcatgctgtttccaacatcatcctgattccctgcagagaaaaccagcactgtttttggaagtttttcacttttctgcttcaggcctctcagtctctgaaggggattcatctcccagtgcaatggcagtagggcatggtccctgggtttaatgaggcacagcacttgcagggacccagagcatccgtctctgcccaactgcctgtctgcatagctatctcagaccttgtgccacacagccctagccatggtgactgtggccataggaacagtggcagtagcatacacagtcaagtagaaggtctctggactgttcttggccttcccaactgcggagacagagatcgctcaaaggataacagagcacctatagtttctggcctatttctgtggaaattggcacaaggcaggttgggcccagtcacttggtctgtagggtccatggtatatacctacaggacctcccatagaggcagggctcaggaaggagagccctcatagtgccacgtgctagattctctcttgatcggtccacattgctgaattcccaactgtggggccagcagacaagcatcaggtatccagatttctaacagagacgagtgcccatcctgtccacaaagaaagggagaaatgggcatggagaggtgcaagaaaagttaaaggaatatctttcaagaatcatctggcctttgtagaaatggaggttgagagtcccaaagctaatatcttcagaagccattgtcaccatgagtcataagcccatgggcatctttgccctgagtgagctctgataaactgctccatagctgcatgtctcagaaagtgggttacacagcaggacccagctcttggcctctgtgagtggagcccagagtggagggacagtgcttcattatgaactttggaataaggaaaccctaccccttgtcatctctttatatggtcatccctgtcccatttgggggatgttagggaaggttattcagaaacccttgcggtgggctgagggagcccaagcctggtaagagtggccttcatctgtcctgttaactcagaagcagacacacggtggtgggtggagccctgacattggagcaggcaggccagggtttgcatcctggcctggtcaccaagtagctctgtgactgacacagaatcttgtactactcccgttttctccctgatgacttacggagatattgtttcctcgggtggttgcttgtgaggatttgatgtaagaaagcagtgagcacgggggctgatcagggtgcgtgctcagtccatgcgctgaaactgaacacaaggcctgtccagcaacagagttgccaacagggccagtactcatttaattacttggggttggtcagatattaacttgggcctttgtggaattgaacagcccatactataaccttgaggaccaaagtgggacatgattgggccaacacatggggaaggggtggccagaggagaagcctttgctgtcttttattgaccggctccacggtcgatgctcatcccttttcttacctggtttgatgctgagagaattgaaccgattatccacaaagaaaagaataggatgagaggagcaaatagcagtagcatttattgagcacttagtatatactaaatattggactaggttgttgataaccattatcttaaacctaattgcagtcccatgaagtaggtgtagtttttcccattttatagatgagctgagactcagaaaggttaacttacttgctcaaggtcacccaactaggaaatgagagaatcaaggtttgtttgactccaaaatccaggtacctcttcggacaggacctatacaattctgatctcctgatgagtatgggaaagcatgaacaaccacacctagtgttgtgtgtggatttaacctgcactacttaatggcgacatgggaaccatctagtgcagctgcctgtttgtgtgcaaatatgaatgtatgtgtgtacttatgagctgtgtatacaatgtttttttttgcaaaagtatgtaaatgaagcactcctgaatgcttgtacatctgtatatgagtgagcgtgcacacatgcctggaggttgggcagaggcagtgactgtacccaaagggtaggagcgtgtggagggagggagcccttggcttaccttttcttcagcagtggtgatttggcttccgctgcattttctctgtgggttggaaagatgaaaactgcatgcacttgttatagtggtgtctctaaatgttactgtatgagtgagtatcttgggagaagaaagaccatgtccagaatatcctcctctgcaccaaggacagccctcccattgcacacaatcccagctcctcatcacaatcctaatcctcacagtgcaggggagagaaactggtcaggtaggaagatgcaggggaagaagcacattgatggccagagccgtggggagggccaggatggcctagaagagtgagttcactcagcagagttccacctgtggagagggcagtgagcccctgctcctgctcacctcttctcctaactcctgatgcaccctggtgcctgatggggtctggactctgacgggaggcacttcatcatgatttggcagtccttctgacctggtagggatcctctgttgctcttccaggctgaagtcgcccagctgcaagaacaggtggccctgaaagatgcagaaattgagcgtctgcacagccagctctcccggacagcagctctccacagtgagagtcacacagagagaggtgactagcttgactctgacaaaatgcagttgtctgggtccctgggtctactcttataagtgagcatgtgtttctataaatgagtgtgcatatgtgcttgtgtgtgtagccatgctaatggacatgcatgtatgtgtgcaagcgtggccaagtgaatggatgcaccagtttgtgtgtttgtgtgtgtccctataatgcagcgctcttgtggaatcattcccatggaaccctcccctaactagaaggtttttctcagatgcacagaagttctgtgcagccacctctggagcttttactgaaaatgtaggaaatacctaactctttcatttgactgaaaggccttacttttgtgtcatcaccaaaggggaggctttagaaatttactcagtcatttcatggatacctgcctgatgcctgtataaggccctgagactacagaaacaagtcagttctttttcattcttgagatttcaaatcttacttctcagaaagacctttcttggccaccctaactcaaataggtgctcccagtcctattattctctaattcatcatccttcctttttcctgcctagcacttattataacttaccagtgttgtgtgttatccccactcaggggtaaggactatatttttcttgtttaagagcatatctacaaagcccagcacaatatttggcccattgtaggatcctaagaaatacttcttgaataagtgaaaggatggtgaatggtccctgaggagttcaagtcttgctgatcaaaaatagaggataaatcctcaactactgtaatgaacacataaatctttatggctgtttgccatgtatacaaagtgatcatacacctttcaacttgtccactgactaccaggctgcagagcaatgccgaagatcatatagtcctacggattggtgccactacctagtcacatcctggcctcagcactgcaagcttagcttggatccccagctggggtgtggaagccatgcaacaatggcttaggctggagaaggaaattagtgatcaatgtgctcgtccctctccgagcttttctcagtgtccgcccaagccactgggtgtgttgcctacctgccaaggcctgcttgtagaggctgggttctactaagacaccctggactatctctgatgctaagcctggacagagagtgccccatgccacaacttctaggccaggcagccttcccagtctacccctcctcttcccacagtctaagcctcccaggccctaccccactccattactgggtactttctagagctggtccttgggtcatttgctgccgaaggtaggttctgaccagtggatcagggttggcagtcttcatctagagcttactgccctccccagcaaagtgagctgcagagctgatgttagctacctagagcctaaataatgagcaagcaattctccactttattctgaaaatgaatctccacaactatttacacaaagtccatagatctactgttgctattcttgttagatacaacaagcatcccaaaagaaaatgggaggcctatatatttgttcccttgtacttttttttttttatatagacatccctattcccatttaggaagaggcatagatccttctttgaacaatctagctatgtgccaattcctagagtatctggcaaatgacctccagcttccttaggctcttcaaaacagttaaggaatcaacagagtccctcttgggtccaaactgagagaaggccttggattttccaccacagaccaacagagatttctcagcccatagggaaattctggtttatgatgaaataagattgtttatcctcaacccagcatttgcatatatgtatatatcccaatacatctaaacatttgttagtcaattttgactatatcattttaaattaagccaagtaccaactcttttacataatttttatttcccagtcttcactcaactgtagatttttttaaatgttaaattctcctcttcctacaatttgtcagactgtatgattttcttcaaagccagtcagaagcccaggtgcatgcctactcaagttgtaaaggataaaaatgtctatattcttaggagatgttggttttgaaagatttttggcttcctctgtcctctcgagtacatgggcattttgattttgcccataaatgtctataaagagaagacagagtactagcttccttcatttagtagtctagcaaatatttaaggaggccgattctgtagcagacaccatcccggcctctttaaagaactaaaggagccatgttcacatggcaagtcttcatttgaacttgggggacatcatagcaagtgcggatagctgtctgtatttatataaataattatttctatacctgaattcttttagaccaagaaattcaacgtctgaaaatggggatggaaactttgctgcttgccaatgaagataaggtaagatggtcattgggtagccctgtcttttccatgcttacatccctggctgtgtttggtccctgctggtctctgatattctggacaggaccatgcttatcatgccattgacatagggatatgtcaggagaatgacttgtgccttctagagacttggcctcagccacctgtttttggctttgataactggaaagtttgtctaaatggaatctcctaaaggcagattatagccctgcctgttcctgctggtgtggggggaaaaaaatactgctgtgatcactgccaatatcatagctcctgctggaactcctagcacaacagcccaccagtctcccatgtgcatgacctgacaatagaaccatcatagagacacttggcagtatgcagtgcctcagtttaccctgccatcttatatccttcgcatctaatttcggcacagtcataaatagccacctctataaataaagagtgcctggctggtataaacatcatctctgaggatcacaaccctgcattttacagatgaggaaacagactcagagtgcttaagtaatttggcccaaggtcaggtaactagtaaatagcacagccagctttcacacccaagtttgtctatgacctgtgtggtctcccaagttcctttcaaggcctttgccttgaaagaaacgatcttctctgggaatttcctctgtagtatgaggtatctcagactcctagggaacaaatgagtatattgagataaatatgacagctttattttagtctttttttgtgtcgctccagagggcaacactaggaccagaaggcagatttcaatggccacttcaggaaggtagggagacagtgagtttcgtgcttctgaaaatgtttaagccctgtgaagggtgtctcagatgactcacagtcttcaggtagagcgtgaatgcctgcagatgcctatgaggcagaccactgaaatcccagctctgtggaatggggcctggacactcttttcctttggttccacgtgggatttcttctccttgtgccaagaacatagcgtgggttccaaaatgaaatcatctgagatgccagcatagcattaatctaaatctctacttgcactatggcaggaccgtcggatagaggagcttacggggctgttaaaccagtaccggaaggtaaaggagattgtgatggtcactcaaggtaagagcaagggcgatcctaccgttgtctctgaaagatattccatcagctgtgttaaagccaggggcagttctgctagcagctgtttcacctctgtttcagagaagactccctactggagaacagagctgtttagacttttctgcatgatgagaacttagcagttgttgatttccagaaatactaccaaatggaagtcagcttagggccttcagggactatccagatcaccaagaatataaagcttgtgaattccccacccttggaaggtctcttatgcatcttcccaggacacgccttagaggcagcaagtgcagttaaacctggatcaaaaatcaactcagtgccatcattggggattagagctcatccacctcctagaaaatctaaagttccgcagcagactcagagggccctctgggagccttcctcgagttgctgggcctgagttgctataggaagtcacaggacagagagagctgctgtgttttatatttgctgcccagactgaatgcaacatgcaagcagcatcagggttcttatgggcatagtggtgcatgtgccgggctgccttcattgttcatgccattgacctgggctcccatcatagatcctgaggaagcagctgtttcacagcacagggctgctttgaaggatattcaggaacctctgattctggctgagcttctgctgcttcttgggaagaagccaagcctctgccaggatgtgactgactggtcactggccagggcctctgccagccctcacacacagccctcttttttttctctttttgagatggagtgttactctgtcacccaggttggagtgcagtggcacaatctcagctcaccgtaacctctgcctcccaagtttaagcaattcttgtgcctcagcctcctgagtagccgggattacaggcactggccactatacctggctaatttttgtatttttagtggagatggggtttcaacatgttgaccaggctagactcgaactcctgaccttaagtgatccgcctgcctcagcctcccaaagtgctgagattacaggcgtgagccaaagcacctggcctcacagccatctttttaagatcatgggtcaagtcactctcagggccttgattgcctatagctaaggagtgagaggtttggaggcaggggtacattacctctgttctgcagataaactttgaccttgaaatgatcctgatgccagcccttgctcagatgccctgaagaatcttcagaatcacactcttactgtccctttatatatttcttagtccttcttaatgaaggagaaacaatgttagaattttgtggtacgattataggtttctgaacatgaattcaacaattcagtcttactaccttaatgcttgcagggccttcggagagaactctctcaatcaatgaagaagaaccggagggaggtttcagcaagtggaacgctacaaataaggaccctgaagaattatttaaacaagaggtactgtgtttccatccatgacgtagggtttcagcaggtcctccgagcttgccctgagcttgagggaggatctagtcagacacgtgtcaggtgcacatcttggcaggtgaatacttaaattaatatagtgcccctcaggctgtgatggggatgggcgagcaagaggctgaggctctggcctgtgctctggttggaggcagcatggtggatactggaactttcaaggataggagttctcctttttaatcaggctcctagtttatttttatcttttttttctctggaatgtaagcatagaccaaaggtgatgtttgatttatctaccaccctttctccaaggtctgcagtaatgcccgatacccagtagaattcaacaaatatttgttgaatgaacgaacatgtcttgctcatttagaggaattaactgcaacctctgaaatgccgcattcctgcttgacagatacgcccttcagcccctatagccaggacacagattttccttctcatctatttcgtttgtttaaaatctggtcctattgtatgaatctctctagacttaagctagatacaaataaacaaataaacaagacctcaggtgaaggaggggcttcagcctagggtccaaaagattcctgaaaacgtcacactatcaaattgaaaagaatcttagtgcttcagttcaacctttttaattaaggagcaaaagcatcatccagtgagccagttattgactcagaacaagcaccccagattgctggcaattacagaatagcggtgtccaagtcttaccaagtcttactggatacctccacgtggtcactgtgatgaacattgtatctggcagaatatggacttgaacccaggtctgaccacaatgcccaggtatttaaaactatactataatgccagcgttgttgttatagtagaccaagaggatgctaggatctagagaaaagaggcagtactggagacatgggactgtcttctttcataacctccattagctcaaggtggctccgcctgtgatgctaggtgcactgctgaaggcacagtgttgtggtaggtacaatactgaagacacgggactgtattatttcataccatcattagctcatggtctttccccctgtaatgttctttcctttcttgccttaaccagttctcatttctcaaaattcagctcagcttttctcctctctaaagctttctcagccttccctctggtgagagggagcccctctctcccactgttcccatattgtgttacaggtgttggagccataagagcattgcacattattctgttatcctagtgtacttgtctgtctcccagatgtggggagtgcttgctccagacctggcacagggcctggcagggagtagatgttgctgatgtttgtcgggtgaccatatcaaatgggattttctcattgaaagcaacaaaatttggctctggctaacctaagccaaaaagaatgtttttaaaagagtctgcagtggctcgctgaatgaaaggaaaagctgaagaaccaagatcagaaagggaaggagcagaaaaagcccaagaacccaggtctcaggactgtactactgggatatgaacatgatctaagctctagggtccaggaaggagaggcaagctggcccagatggactgataagcctaccacacccccttgcatcttgaaagagcaaggcatctataatgatgtatccaccatggctgcacccagggaggaaatgtctccctaaaaggaatcatgtgaagcagggggaaagatggtgggtggtccccaaacagactgtcctctaccgtgactcttctgtctctggtgcagatgcctccaagatgtagctctcctacagtggggccacctccattgccacagaaatcactggaaaccaggtaagaggcctgggcatttccccacagccactgtgctctcaggcttgccttggggctgccgaagtagatggtgatgaccgtgaatggtgagcatggccactgagtcctaggtgcacctgcccctctgttgttagggcagttacaaaccaggcctacctcttttggccacagaagggcttctcatccttcaggctgagggtgtggatcattgtcactgagaaaggatctggccaaggattagagcctcagaggagaggtggctgcaactcatctgtgtcttatagcagctcctcagagctgagagcatcccgtgatgtgtgttccttttgtcagcctctgcctcctgctcttagagtgaatttagccctttgacagtcgaagctttctagggaaggccatgtcttctcatagcaattggtctaattgctttaaggatgcttcacaacaatgaactaataatgggctcgcctctgaggtcatttgactgccatctgtcttgttccctctaaaataaacctaaatctagttccctatgtccgtacttcagcacacattttgaaattgagccccatgtaagggagacatggaggcttcactaccaaggtactggcaaccactaccaggctgcctttcagctaaggtgttggggcagatgaccacaagcatcacagaaactccccagaatggtgctgagtctccagagcctgcactctgagtccactttccagaaagcagttgttcccttgagcctttagcccagaggaaaatggtaatgttagagaagttgatcaggcagtccttagttttggagaataagaattgtggtttatgagttcactgagggaaaggtcaacaccaaggaactcggactgaccagatttacaagagactaatattttttaaaatgatgacttactcgtataatctgagaaatatgactgccaaggagacttggcacaggttacccttgtgaccactggtggcattgcctcttgacacatttggtgcctttctctgcaaaatagaccctgagagagccagatgagtctgagcagactagatgggcatgcagatccagagcagagtgtggcagggtcctagcaagtgatgttctggagccatggctggttaatgtgttcatctctactctaaggaggcccaggtccctcctccctggattactcttagactcagacaagcccagcatcagcacctttcccctcttttgacactgtagaccttggccttttatgaccgcacaattgtcacctcagtgcagcagaattgagtgtattctggctttttgtgcaatgccaagaacatttcatttggatttaagtgaccctgtcatgcccttactaacacattattggaccagtctgtcccccaaggtgggccagtctcattttgtatgtaaaggctattatgagagggtatttttttttcttgactttgaacctaagcccaagaccatcggttaagcatttgaaatgtcctctgcatgagtgataacatgtacctccttctcataactatttctttcttttgtgtttttttcagggctcagaaaaagctctcttgtagtctagaagacttgagaagtgaatctgtggataaggtcggctcatcaacctatccttaaagatgactgagttacttttttgggcctagcatagtactgggatatacaggcaggtcctggtccctaccttgtagaggattttataaagttgtagaggaagcaggaattacatgaacattttgagaaaattaactgggtgtggcccaaagcatcttagaggaaggacaattcaggaaatgttgcctggagttgatgagagaagatgttgagatcagcaaagcttggttagagtctgctgagcaatagcaggttttggaagatggtggagagtaggaggaggtaaggtcagagccatgagacagatcaagccagggaagatcttgactactagtcctatatccctggggcacttggggacatcgtatagatttttttaatgatgaattaatgtgaataaaggagatgatcccaaggaaagatgtgggatcgtcaggatgttggagagtgagctgttgtaagagtctggaaagatggaggagggtcttgtggctccttatataggagtagcccttgatcatgtgggtggacctcatgctgcaggggacagtagcaggctcttgagcttggtcattagagaccaagggagcctgccctgatagagacccttcagtgagcctgtgctgcataccatcccttggtctccaataatgttcatcagcctccttgttgatacagtggagaaccataaaggctgaagtctgcaggagccctgggatcattcagtggctctgctcccatggtcacgtgtctctcggttgccatggtcatgttgctggcagctgcccaggacatctgtccatggagttggacagggatctttcctgccctggatggtgattacttgacatgaagatgtggagggaggggatgcgcctttcagatttaagcaaacaggtagtcctgagttgttgctgtttgtgaataacacaagtctctttttctccacataaacgaaatcctcatgttactccatagtgtatggatgggaaccagcccttcccggtgttagaacccaaggtacattgacttcgtgccccgtcgtctatttgtggttacactgtttgctagtattttaatttagcaagtcatagttttcataaccttaaaatgtgccaactgtaaggagtaagagggcaagaggaaagacgcaacttttctctcccattttatttttatgtgcactcagctatttaatatgcttttgctatcattatctgtgggacaggatttattattatcacctccattttataggctcagagaaattaatctttaacaaagtaatctagatttaatcactgggaaggggattgctacgatctcagcacactgaagaacgtgacagctctcatcctttctgtgctgatatgtcatggttaaaaaaacacaagtgtacactcagtcccgctttgatgaacaagttatgttataaaaattccattaggactgatcttctccagggaagcctgttgtggaagaggattaagtttttaggccagtgcacaaaatgttgagcccataaagaaatgaagattcatataattagcatgatttcagccacacccaaccaccatttataacattatatggaaaatgtattgtgaggctgatggcatttcccttctctgtcccctgcctccatgtccatatgaaacatggagcttctcattgcttgctgacttctgcctgagagggtcattttatattttcacggtaaaatggggcatctctgctcctccacatctgcgtaagagaaagatcttttctgcacgtctgcatctatataaggggcttctctactcttccatatttgtagcagttggttcttcaagtgggcagccattccttgggccatctgaactgtatagcaaaagtcttctgcctgctcccctgcccaggtgctctgcaacacagtcccttgagcctggggttggtgtggtccctttgtgaactgaaaggcttcctatggcgtcagctgttaaatcgctcagcagtcccccctcccacctcagcgtcacagaggtcattcgcaggtgtttctaaagcacacctgtaagtgaccacctgctcctttggaaacacacccagctcacaggctcaaggtttaagacgccaatttgattaccaagaaatataagtaacgtagaactatttataaagaaaaaaatgctccagattaaaagattaattcttacatggttttggccataatcacaatcttatacaacctcagttattcaacatgaccaccctcccctctcacccacatacaccaccgtcctccccagaatagctacacaggtgcagaaccgctccacagtcatctttctgcagcatccctaactgtagtgtctggcccttgcttaaactggctcttgctttctgtgactgagagctcatttcattggaagacatcctttgtattcttttgcagctgtgtgagcttctctaaaatgtgcatctgctgatcctctccctccacatctagcccatggaaaaagtcaatctcccctactcctgacagctctggaatttaagtccctcatgccctctctgagtgctctgttctctgggctgaacatcaccttctcatgtgcatggatcacaagccttttaagctgctacttagtcttcttaggctcagcgctagtttctcaatgtattcttcaagttctgccctggaccagacttggagtgtgatattctagatgtagtctgaccagtgcctgccgtggtctaaggactcctcttctagattgctatttctttaggccctgggtatgtgatatttcctgtgcttctccttatccactgtccgctgtgtgctaggccctgtggatatgttatttcctggcaaacctgaggtaggaattgttattctccatttagaaatgaccagaggtcctgagaggtggaagagaaacagctctgtctgagttggtctgactcaaagcctaggccctttccactctggcatgctgcttctctgttgtaatttaaagcagctggataatcagttctacactactcccttggctggggcttctgttcccctacagccaggaggattgttctttttggagacaggagaaacagaactggagttgagcatccttgtttcctctgcgtcacgtcttgacattgcactgccttccacatcagtgagtcatttcttcccagcccttattcttggcctgagcagagctcagagagccctttccattgtccttgattcctttttgctgtctttcttacaggtcggggctgccttttaaaccccatccttgggttaggtatgtgttctccttgcatctcagctcctcagggagctccccgggtggcccacttgcttccttggctgtctctgccctgccttgagggagcatgcgtgatgatgcaaccagaaacacgtttttgagagctcttcccccctccatatgtcgtatataatagggagcttggagtcatgcccttcaggtctctaacatctttgaacactaccttctcacagtcagtggttcctgggtctgactgcattagtataatctgagataatctgagatccttgttaaaaatatagacatctggggtgtgcttccagagggactgaatcagggactgggcactgggaattcatgttgttttacaagtgctccaggtaattatgaagagcagccggcacatgaactaccacttggaaactgtgggtcttgaccgtatgtctgatcatgtctaatcttcacctcatgggtcatcacaaacttgaaaatctcatagccttcctctctgaaggttctagttacttctactccaccagccagttctttcagaattcagtttcctctcactgtatctctcctttctgaactatttatggggagttaatagtcaatgttcaatgaatgaactgaatctcaaacaatttctaggacatatgtttataagcaaattgaattggaaatatattggatatttggcctttagctaaatggaacttcataagatgtctcagtcacagcagccttccattactgttgtgacttgccagtttgaaatctgttttgttttttatattactttcttcaggatctaatcaggtgatccacagttgattcctttagtgacattgcttcaatttctcttttcttttattctcactttcacagcacattccactgtgtttctctcaggtttgcagattaagagaggccattgtatgcctctttaccaaataagtgctatcttcttcctcatttaatcaacttgtttctttgggacctttccatggccagggtccaagcatggagctggctgcactgaggctctacctcgtgcagactatgatcctaagttcccaaaggagctttgttggcatgtagtcctctggcccatttcttgttgtcagctcccccaagggtgtgtgtgtatcttcatgcttgccttaacatgatgttttttaagaagccatgatcacaatatagggattttttcttcttttgctccacatttaaactataatttcccttctgtaccatagccgctctcaggcaagatccatatcatttatgcagttggtcaggccctcacagagatctgcccttttctggtctgagtaagggttccaattagcagaagcacctctctcctcaccacaggaaagcaaatctgggggaaacagaggagcccagaccagactgagctcagtttcctctcttgcaggattgttattttacatatatatgtatgtatgtatgataaaacactaggcagcttttattagaatgccaattttcatatccaaagagcttacagagtaattcacggctgttaattcattgagtctctgagcactaggccagacagcaaaggccgctttgcaagacagcttcacttcctgttagagtcagtttcagtcagccccagatttgcacttgactctgtccctgtcttactgtgtggccttgggaaagtttcttccttccttggaactctggtcccctttctcggactagctaaataatctttgaggggtgttcaagtcaccatatgtgaaaaatggctcttgcaaaacagggagttgttctgtatccaaggatttcctaactgaggctgacagttaagtcggtatctctctctttctctcaccttccaataggacagccctttcttggcggagcacaaatatcccactttacctgggaagctttcaggagccacgcccaatggagaggctgccaaatctcctcccaccatctgccagcctgacgccacggggagcagcctgctgaggctgagtgagtgtccagccctggtgctggtggcctctgagcagtgtccttggcactttcaatgattgtataagatccctgcacctaccaccacaatccacaattggagaatggtggggtgggtggctggaacaagttgtaccttggggtggtcccacctccccagaggctccccctgggcgagctgttttctaaggtcagcactctacagtctcagcaaaccagggtgtgtgtatcccctacttcttttcggctgcagcttttcacccttatttcctctcttcttctcttcctcctctcgaactctttcctgtccttcctagcattgttttccctcctctcagacacccccttctacccttcctgcccctggtgcttccttcctctgtcattctgatcttctctctcctgtctccaccttcttctctgcagcttccctattccccgtaggagggtatcatgcactccaagtgggagcatttccttaggcaaatgaagtcagtggccaatgggcaagggtgtcggtctgcaggtatcctttcggtgcgtaagacctgaaaccacagaggcttttgctgcttttcattcaaaataagccatctttccccaccagcagcaaaagattcaatggccccggaagggaacattctggtcctggcagggttcttcctgaggctcctcagcctcagctcttccctgagctggcccatgcattggcctagtgaaggccagctctgccgttggctgcaggaacttcagataaacccttgaatgagtgtgttctagtgacactcaaactggactcactatggcttcagattgttctagtctgagctgagtgagcccaggcacctgcacaagagctgcctgtggcctggagtattcagcccctgctgctgtcccttcctttccctgggtgtggacacctcagcctgtcacaaaggggccccaggaacacttggtcccctcacatgaaacctcttctcagtgtcagtcaccactcaccccctccttctccatgggattatttttctttctgtttgagtttttctctcttgctcgatgacactcttttgtttatttctttgcttccccgtaactctgttgggctggactttggcctctcttgtttcttcatgtggcttctctgcttcttggttcactggagatcgtggccggagtgtcagtgcccccgtattaggtactgtacccattccaggtgaggtggagagtgagaatgcctttgtttccctaccctaaccctccccttcaccagcactcagccagggacccactactgcctgcgttcctgcatctccctctgaggaaaaagaagctgcttgttggaataatccacaagtactttggaccccaaatccttaaaattaaagacattagctcacctagatttgaaatattgagcacactaatttctcagcaaggaagcctggagtccccactagtctctgggatcttggtatggagttctgccctgaaggcagaactgggcagattctctggactcccactgaaggggagggcccaggcttggggaagaagggttccaggggtcacatccttacattcacattcattgccttcttccaatctcaggagacacagaaagtggctgggacgacactgctgtggtcaatgacctctcatccacatcatcgggcactgaatcaggtcctcagtctcctctgacaccagatggtaaacggaatcccaaaggcattaagaagttctggggaaagtaagttggtgccgttgatcctaattatattgcttagaatttttctttttgattgggcaaagagtctatgtaagcccctggtccaatagacactgaaacagcagtcaaaacagagtgttcatgttcaaagagaagaatctgagatattttccagggccaagagaaggagaagtatgaaagacacccattgaatatatccagttgcctttcatgtcatgcatcctaagcacccacccattccacacaccctgaacataatctctgcagcttatattacattggatctggcacagacacagatgagactgtattctcccttcttaggagtcagtctgttttaagaaatctttgaaaaacctttgaaagccaagtacttgctggcccaactgatccactttgtgacatgaggcagaaactggggcctcctacaaggcatcaaactttgctttgacttctatggcaagtgaccaaatcccagaggcaggatccgaattgaggcttgagtctggccaaggagctgcgacaggttgtgatccttgatctctgggaaggtacggagaagcagtgctgccgagagtccctgtgctggcctgcatggccttgcaaaagaggaagcacagtgactgtaggctttctgactattccatgaccgtctccatggattcttctccatgcagaatccgaagaactcagtcaggaaatttctacactgacacgctggggatggcagagtttcgacgaggtgggctccgggcaaccgcagggccaagactctctaggaccagggactccaagggacagaaaaggtaaggcttgacccactttcctttgatctccctgctctgaaaaagaagtatctcccttcaaacctgcatgggtgaatctttactcctgtgttttgcggaaacccctttccatattctcttccccagtcaagcagtccctacagtacgtcatttccagcacaatatctcctaagttctgagttactcagccaagatcagtactcctggaggtcttccacaggattggaatgtgacattttatatctaaccaaaaggcaaaaagtaagctgtaactctcttcagtttagtcacctcaagattgccatataccaatgcagagtacaggtaattactggttatgatatgtatcattcagatgtccgttctcagaaataatatagtctagattccaattaaggaagaaaagcatttccctaaatgcatcatattgtttgcagacctgcatcccctgcggaagggagtcttagcttattttgcacatggatatgatactgcacttccctggcttgccaaacaggtttctagtcttaccaggtcctcctcgtgcatgagacctgggacctttccagatccatttattcttcgatgagtatccccagactccaggaagcttgaaaagaagcatgagaatgtgtagaccattagcttttagaggctagagaatctaaggacatagtctaagtaagtcagagaccaattcagagcccttagaaagtgagccagggaaagctttacctgtatattcaataattagatattctaatttacttggcaattttctcaatgtagacattactgttgtttctgatttatctgagctgaaaaaaaatcaagctatagtaagcttgaatgattgatctttgttttaattctggctagttcttgaaggattgactctagaaggggaatcattgggtcagggtataaaaactttcctaagacccctcagcattgtccctagagtaggagagcatggttagggagctatctgtattctgacagtcactttagggtatggggtgaccagggtcagtagctttctttgccaaaggaaaaaactgcagttccagccacaggctgctttgttcaaatgtctttgtgctttatgaaccgtaacagtggatgagaaagggaagacgtatgaagaagtcctgatgagattgttatgtttatcgtaatggtgcaaaatgaatttgctcgtggaaaagaaaggccttgtgactcttaactagaaattgatatatgttaatgtcctctggtgatatttataatttctagatattaatatttaggtgtagctttaaaactgttgttgctagtattctttaggaaaagtactttgatactgaaagcctccagccccaacctttttttgttcaataaaacaattgatttttttttaaatatgatatttgataacattgtgtaggcactctctctcagattatggatgaacacattttattttctttcttctcccaggtaaagttttacagagttacattccagtcagcactgctggacagagtgcgcctattacacccacatccttgtcagcattgagtagttaaatttttctttttcaaagttttctacttttatgaacctccaaatttcctttttattggtaatttagttttcatgtttgtccttttaattcttttgtgaattatctgcatttttgttcattattattattgtatttcttatagatttctaactgttctctattaagatattaagtcatgtctagtaattgtgacaaagtatttttaggtttgtagcagaattttacttttgcttctgatactttgatacatggaatttttatgtttatatagaattaggttcatccactttgtgaattctttcatcattttgttttaaatttttttctgtgatttttaaaaactttgaataatccatttaggaattattatagtttgtgagtttattatgagttactatttttgagaaaaaggcagtaaagtataatgtttaaggcaaacaggctctagagccacatggctggatcccacctttgcggagtgtttttttcctgagttgatctactgactgtattgcccttcaggactccagctttaggagaggtccccaatcctactgctcccctaccctgggccccattttgtttccttttcctacacgcatggtgagtcagattcatcatgaatgtaaagatgcttaagcttcagggaccctcctttgtatggagcccttccagggtccagagaaagtctgatcatagtgttaacagggccaggtgttttgaaaattttgcctaaaaaaggtattttaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcccgccactgcactccagcctgggcgacagagcaagactccgtctcaaaaaaaaaaaaaaaaaaaaaaaaaaaaaaaaaggtattttaaacacaaccagttttaagactgctgactatttttactgcaactttcccttggtctatacttttccttgtaacagatggtgttagggcagctgtgggggttttggaggacttgctaaggggaagttgacctggggatccatgtagtttgggtttaggggggtatgtgtgtgcatgtggtttgcagtcactgcatgtttagttttgttaggtttaattcactagctttcctactgcacaaatggcttccaggatttcttctacttcccattgtgccgattcgctcagtgctctgtactcactaatgaactgtaaattataaatgtgccatgtgctctccccctactgtgagaagagcatatttgagaaatctcagctacatcatttgaactgcaatttgaaaggatgttttggaatgtgtcaacaaaacaaatggtttggctgtatatgaagggtatcttctctgtcatctccaaattatttcccagcgtgttcagtggtgccctggctgaggatatgggagatgctggcactgagaggagctgaggaggaggtgcagaagctgggtctgattctgtgtgaacacctcaaggcttaggagggaggagaggattcgcaaaacaaaaaatgggaagactactggagatgatgcccagagctctaggtggttttgaaaaggtcgatagcacagaggttttccaattatgatctcaaaaacacttatttcccctttagagctgaaatgttaggttcacaaagactaggcaaaaaataaaagttaaaaaatttaaaaaagaactgaaatgtccctcagatatgtttgtttttcccacttccaagaaacaaggaaacaaatgaaataaaaaccaaatataatataaaacaaaagtgataaaatgagcattgaaatttgagagaaattattctttcttacattaaaaaacaaattataaacaaaaaatccagatcacaccaaaagcagtaatttgctaagagcaagaggtaaggtttaaacaaaaggagtgagtagccctctagattgttgttcatataagatgaatgatatgaatccattgggaaaaggttgaaatttcttgctgagtttacatgatgtactgacagtgacaaagataacataaaactcatgtactgccgcaaggacatagacaacacatgagttaaatgaactttgtcaattcaaagaatgtttaagattagccatagcgttagaaaacttgaatgcgttatagttttacaactcacatataaaagacatttgatagaggcctttctaaatttaaatgattctaaaaatgtacgtgacaataccagttataaattgtgaagataaaacttcttaactattgtcatagaagataaatattgatcagtcatgctagaagaaagactaaatcaaccgtctgttgtcatagaatatattataaagttgtggacatacaaagaagcagtcaaagagtatccacccaaaatacaagagtaaagaagtactatagctggatacagtagctcagacctgtagtcccagctacttgggaggctgaggcaggaggattgcttgagcccaggagctcaaggctgtaataagctgtaattacatcactacactccagcctgggcagcaaagccagaccccatctctaaaaataattaattactaacaccctgtctctaaaataaataccccatctctgaaataacaaataccctgtctcaaaaaagaatcaaactatagaggtacatcaagattttatataatgaaatatttctagattttgtgatttttttttcagttttgcaaaacttgcaattttttgtggcttgttttctaattctaaatattccctttgtttctaattgtatattcaaattttatactattttgaagagaaagtttgtaagttccaggcctcgtaaaatattttcaggacccatgaaagcccaggttccagattatgattgatcagtccctgccccagggtatacattatctctaacatttgatctaaaatggggcattcttatcatgcttatcctttgaggaattccctcactttaacaacagctcaaccaggcatttaaaaaaatatgttttaatctaatatgttaggggtactttgaaggaatctttctggtctttgaaggaatatctacgatattctataaatcctcatttatgaacataaagttgctctgtcgaatcccccctaaaaaaatgactctattgggatttttagtgtgctattcacactttaaatgaaaaatggatgtctttaagaattgatggctttataaaacccagtcatcctgtctaggaacataatctagcttttcatttattcatgtccttttttatctagctcagttgactgctgcagtcaatacctctccccacccccgcaatccccacacataatcacacaaggccaaacatctcttgttaaggcaattcctagacgttttataatgttggttgctatgagtgggatttttaaattgttttaacagtagcattagtatctgtgcattgatggtattagaaaattattgatctttgtatgtaacatacgttacatatgtttatatgtgtatttcgtaagtggccacctcactgagctttcttgggttttctaaatgggcagtcctgacatctgtaaagaatggctttatttctgcctaatagctatacttcttgttcttatttatctctaatactggctatgactctcagaccagtgttgttagtactgatgaaaaatatattgtccttttattgactttaatgtgaatgttcctcctgttttgttaataagtaatgtgctagctgttgttgattggcaagtttttgcttttagttttgggtgttttgttttttttctttttaatgttaagagaactgaccctcttaaatgctaagaaaagtagttttctaagcattttcctaaaaagatgattccgcctaatgaggccacagctctggacttgtggcatgtatatgtgtgtatgcggacctaggacatgtgaacatgatctcaggagggccatacaggctgccccattctctaagtagcctgagatttgaaattcagatcttgtgttattaagaaaactctagggtctacctcctatgagtgtgttgtagtggaattttgttcagcagaatcccatgatggaggttgtttgttaaaaaacaggttttttgttttgttttttcttttcttttcttttgtttgtgagacatgattagattcagaacctcaggctctcccactaacaggaatatgctgttttcctgcttcccagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggtaagggctcagcttggggagaggaggctcccatttctccccaaagcatggggaggccagggtccgccactcctgtcacacatacacacaggaggatggatggaggaggctgagagttcctctgtagctgcaggttggcatcccagggcacggtgtggagatacactgccatactcagagcatctccacccagacacagctttctctgagggccaaattgcctgccaaaatttcacatgtggtcttcatcttttaatttcaggagctaggaattaagcacccactccacaggaagaagcttgttttagcagtgaaagccatcaacaccaaacaggaggagaagtctgcactgctagaccacatttgggtgacaagtaaggataggcatatatgtattaagaatgtctctggcagcaactaagagtagaaagaattttcctgttaaatgggtacctcaaggacagctgtctccttgtaaaaagcagaggaattactaaacttttgggggaataaaacgaacctcaaaatataatttgctcccctttttttggtgtctacattctctcattctcatgaatcctgacacatctggggtttttgtatttgtagggtggcttgatgatattggcttaccccagtacaaagaccagtttcatgaatctagagttgacagacgaatgctgcaatacctaactgtggtgaggactttttctttaaatatttcagttgtccctgtgagcactcagctcacgtgtacccatggtggttattttaaacttgattccatatattcttaaggccttgaaatagtatcatttgtcacaaaagaggtcccaagtagcagagtacaaaccactgtgataagctattggtgtctccacgtgcaccttcctgagatgtggttgacttgtctatgcttggtctggtgagggacatcaggggtcttttgtcactttggaaactctggtttataaaccaaactttcctctttcagaacgatttactcttcttaaaagtcaccagccaactacatcatctcagcatcaaatgtgccattcacgtgctgcatgtcaacaagttcaacccccactgcctgcaccggcggccagctgatgaggtgagaccacaaatagtatctctccaggtagccctgagccaggacccctgaaacatcgagcatgagcaaacaagaatgacatcataaaagcactgttttttgcaccatggtgcctgggattcttttgtttgcttgtgcttcctgttgccccaaacatccgttacctgcactttgtgtctcacagtagccatagacctctaagctcccaccctccactggggagacacatgctataaagtcatcatagtgattaaaggagatgaggagatggtgcaaaggagagggggagggaaagacaaaatggaaagatgggtgtcacagtagaagagaagagaagagacagaggagggggaagaggagcccgtagaagctagacatttcagaataggtatccctacttgtagatccaaaattaactgacttccaggcccaggtacaggggatccatgagtagtcttgctagagaagaaatagtatacgtaaataacagcaccccaagtcttgaagaaataactgattatgttccatgaacttcggagttcttggtggacccccaaactgaagattgtcagtcacatcctatctcctctgttcctgggaactaggtctaaccttgctgtaaaattaactcagcttcctgggctgctacctttgctgtctatctcctattttctccttattcaaccaacatgttttgaatgtcttgtatatgtcaggcacagcgctgtgcatttttaagaccacagtgctacgtgagagcacttaggaataagtaccttaaggtgtgctcccctaaaatcattggccacaccagggagatctttcatctataaaccacttggattgtaaaattgacagtcatctttaaagttctgttgaatcactgaaagaataactataatgtcctcatttatttgtctcaaagttagctggaaaatgatggagtaacagaattctggattcagatatctcagtgtggaagatcttcaaagattcagtgggagctctatttcctagaaactggggaggctggtgctctggcagatggggtgggtcactaagcttgagggccttctattgttgtgatgcgtctggggcagggttacttaccggggctgactccacagaggaccatggtgggacctattaagcctaacttcctcactctccttctccctctgacagagtaacctttctccttcagaagttgtacagtggtccaaccacagggtgatggagtggttacgatctgtggacctggcagagtatgcacccaatcttcgagggagtggagtccatggaggcctcattgtgagtggctctctggcctagcccacctgccttggtgcaaatgggatattcagaaacttatttattaaggacaaggcacaaaagctaacgaaaaaaaataggtacttcatctggaggtcttgcataatttgatgtctcaaagtattttgataacttgtccttgagaattaatatacctcatggaagcaagatgccttctggcagcacctccttggcatgagacttgaggattctaggtcgatgggttgcatggagaccaacgcttacaaggcgagggaacagcagggctgaggaagggacggggaagccgtaaaaatgcagcttcccacttgctgcaataggatccctatcactactcagatctgtcagtggcaaagccagaggggaaatgaggaagtgtggtggcttggatgtcatccagagaagatcctgagagacagcctcaccaaagaggtcccagttctctgctggtctgtgaaaacaaggtggtcagtcagcacatgtgctagtatgtgctcagagccaggccctgtgccagccagtgagtggagtgggactcagaacaagtgactgagctcctgtccctcctctggaggcacccccagccccaacaggccagtctctcagcatcctccccctcgagccatttgtatttgctcctggccaggcttgtctctggttccttcttagatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccgggtgagttgcagagcctttctgggtgggccctgggctgcctcctggccctcacgcagcacagcacctggcgcgatgcccacagccagagcagcatgcgcagcctggacaaagaggatctttcagcttctgctgtgggcttgtggtctgtgaggccagtctttgttaagccagttctccaccagtttggagtccaaggaagacagtgcaggtttctttacctagaaaatatgtgcaggaagcacctatcctcaggtggcttagagctcgtcctctaccccactgctgctgtgactcaccttgcagagcggaagcgctccgagtctggctttccttcggtcaggcctgcctgcgtgccgcaatgccgtgggatcttggtcaaagctgtcctgctgatataggaagtgcttccaatggaagctggttccatttgtcttgtttcgtgaagtggccagcacacagatacccagaggtccccaggtctttcaagcaccaacactactcactggggctcccagaatcccacaaagccctttagacctgcctgagccacagcatcctcagaccacattcttcccagactacagaccaacaggcaacctctggaggccaggctggtcctatccctggtagtgttgatgcttcatgcccagctacaactcaggcacagacctccttccccaggggagcaagacaggaagtatgtctgggggagtcaggcagaaacagtgctggatgacgctagggcagggagcaacctggggctatcctacgcgcctttagatggtgccaggtgctgagatgggaaagggttggggtgccagcagctgtgctgaggcaagttctctgtgcttcgcctcaaatgcagacctcaagtacattctaaaggaactcccagttcatctatggaaataagaaagtcactttggtggggcagccaggcatgagtttcaggcatagtattggaggggcagctcttattgttcaagattatttacctattggcctttctgcagcatagaaattgcttccaagagctctgttttgttcagagtctttctaggagcagtttacattattcctctccttgagtgcctgctcttaaattttaagtatattgtcagtcatacctgcacactgccttgattgccttctcataatcttgcattttctgtgttttagccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaagcagctcaccatatctttaactttgttggggaaaaagagctgagggtagctggaaatggagtcctacggattgcagagctgaagagccggtggcactgagcctagtcctcagccaggtgcatgctcaggattcaccaggggggtagagcaaggcgggaccccctcccatagccttcagaggaggtccgtggccgcactgcttcagaatttgcttccctctgtgaagccgagggggcttcaagtctcatgcacatcctgaccatagggtccatctgtcgtgcagacctcaaagctgagtgctttcagtggcatgagcccccccagtgaaggggatggtggggagacaagaaggcaccttgctggaaagactctctttcatgtgttttgctggcttctctattactgacttagctaggctcataaccatggtgggggctggtctgtctgctggcagaactgaaagagatctgtccccttgatttagaggctgactgactgataatgactgataatggctcctccagatgggccttgtctggctgggactgaggtagagatgtgccttgccagtctggactcctggtcagaagactctagtttgcccccaggcagtgcttggctcccctcaatcccctgggcctcatcgcagaagagtaacaccacgtcaccgctgtctgatggcctgggcacggcctgatgactccattccattgtagcactctgattctgtaccagatggaggctatgctaagatttgcttcttaaactaccagcagcctcaggcatggtctgttgccacaggccactgcctcctgggaggtgagagatgtggggacaagcttgccagctggcaatgctgctgatagatcctggtacccaggtccactggatgacaagtgctcattcaggctgatgcctggccactggagttgtagagccagtcagggcaggctttgtcccttgtttcttatgttgcggtacagggatctctgcatgtgcctgttttcaaaacctgcatggaactgttgtgccactgattctctgcaccctcaagtaagtcctgttccctttgtgggcttgttttcctacctataaaacaagggaggggttacacttggtgccctccaaatttacagaggatgtttccaaatctacagtgtctaagtaggtttagggaaggaggaagagaccagcattacctgagaaggaggggcaggagggaggctcttgagtagtgaggaaggatgcccacctatgtcagggcattggtgtctgagctcctgttgcctggtagcaggagtctagcatcctgaaggccttcattcctactgctctctgctcctggaaatagctggaacattgaacacgtgcagaagggctgcttctgacaagcttgtgtcttgcctctgtgtaccctgaatgccagttcccagtggggccccaggagaggtatgcatgcagtgtgggacattgatgcctttccccaggaaacaggagcagcatgtgctccacccacctgtcactcctcagggcctggcccactccttgcctgtccctccagagaagcatgccctggagaagccaggcttgagcacgacaggacttgcatgccatctctctgaatcacaagctgcatccatgtgtgctgaccaggctgctgcccattttacagatggcaccttcggaaggtaccgtgacgcagatagggctcctctcccaagacattcaccgccttacggtaggactctgaccctctccccacagtcagactggtgccagggaggcccagtgagtttggtgtggtgtggtgtggtatgcacaaggcctgggggacggcgaagaatggtgcttagtgctggggtcacagcctgagcctgagccagccacgaggcagaaagcagcccaggggccttctctgttggcctgttactggaccttgagcccctaagggcagtggggaggctcatcggctgttagccaaagccagctaaagcacactagatctcaggtcctcttcccaggcttagagatgaggaaaccaagatgctcagcaactctagatcacctgtctcatcagcctagagcccaggctgcatcctgtcctagtggacacttccaccctctgcccagagacatatgcatttcctatcgtgcctctgactttgtgggtatcacagagtgttgacaggcttgtgagcacatcctggcacgcccgaaaggacaaaccatatcatggggaagcagtttggcctcgaaaagcagctttggagtgaggctgaagtccctgctctgacttcactagctctgtgaccttggatgtcattctctcctgagctttggcttagttatctgtaaagcagggctaatgacatcctccttgccaggcttataggcagactagagctggcaggaaaaggccagccacagagcacaggatttgtttttgaggatccatcactcccaaggccttttagttcttggacattccatcactgagcctattggctatagtgtctgtccccatcgaggcccctgtccctgtactttgcttgcttgtctagcaaggcccattgggatgacaggacaaggacagggacacacgactctccttgttttcaaggacaaaacaggaaagtctccctgactccaaacaggatcagttttactcaacgtttttatttattggcccacccatgaaaggaatctgcccacacttgcccttatgatctaggcctttggtggcctgaaaatagaaaatttatttctaagatgaacaatttatttttatcttaatagtgttgtttattctgacccaatactcagggtttcttgggacactataaacttatagtgcacctgtgtcagatgcagccctcacccagtgccctctagttccggtgcagctgccgcagggcagcctggaccaaaactctattaaactgacccttcggctgtgtccttttcagacaatgctgagccaggaccagctgctgaatgactctcgcctgcctgcccccaactctgatgactggagatgactttcttcgtggctgagagcgtagggaggcatgtgtgggggccccggagcctttgcttctgtggggagcgggcacacagccccctctgcaagcccagtccgggctggcagggtgtctcagacaggctgctgacaggcatgaagcagagctgtgggacaggtgtccaggggtggccccagggtccatgtgtgtcttcaaccatgctgcgctcttcaccgcaggcttcataccttttgtacttttatacgtggactgcagaccactttgtgggagggcagtgacatatcagcacacagactcgatggctcgtgatattcctggtgacagcc

SEQ ID NO: 655 - DNA, 86869 bp, Homo sapiens
cagccccaagcccagcgccgccgccgcccgcggagccccgagcggagccggaggcggcgatggagggagtcagcagccaccggaccctgtcttacagccgctggagctatgacaggtagggcgcccgaagggtggccctgcgtgagcgcctgctgaccctcgatctcctgcgggagaagcgggcctccgggggctaggactggcgcgagcgcccgacccccagggtgggcttgggcacccggaccctcgggcatccgggacccagagcctcgggtacggcgcagcggagctccagcgagggtagtgtccccacacccacggggcagagctgtcggaggagggcacgcggccactgggactagcgagctggcacctctgcccccaccccagctgccccgccagggtcgctccgccgggggaccccgagaaagggcgcggagggggcgccgggaggggcggggcaggggccggggtgggcccctggcgggcggggcgaggagggggcgccttcggctctgggatgcgcccgccggcgtctgcgccccgccggccctccgcagggaccgaggctggccccgggcggagtgtcccgctggctgccggggacccgcgagtcgctgcctgttccgcggggcgagatggcagcctgggccggctgtctgggcgcaggagcggcgctctcgagttgccaggctccgcgcccgccccgcggggatggcgagcggctgccggcgtgggcggtttggagctgcgctccccacgcactcgtcctggaggaaggagtcatcctcccaggcgaaatgaaaaaaataagaacggagtgagttggtcataaagccgagtacatttattcctaggttatgcctgttctaccttttgttggtgtgttaaatgccacccttgtatttaaaatgaaaccatgatgatagtagatagtagtttgtttgtttgttgtttttaagtttcgtaaccccaagtccatctgcagaattctggagttaaatttcctgacccatgaccctagatggtgagggctggaagacaaacttcatttactgggctgctctcatctccgtgaagtcctgcttcctgtgctctccttcccttaactctgccaaaaacctccctgcatcttcgacagcccttgtttgcctagattcagaggaacaggtgtccctcctgcctaaggctagtttgcctaggacccctcctcaccttccctgagtctcgccccgtattaatcccatctgtctcctccatctgcaccttcgcctctttactagtgatctctcttcagcctgtaaacttattcacctgtgtcttgtttacctcctcgagatgggcgcaactgatccacgtctgtttttttcctttcattgccttctttggggaaatatatcgtctgaattggttaattctgtttcttcatcagcccttccttgcacagccccagcaaatctcctgtccacctcatgattccagtgcacctgcctttttgaaaagtggtgctctccacggagaagaactctattattggagtattaaacttaaaataacaaaacctacaaactttggttcagatcccaaattcacacattcattcatttattcaacaaacatgtattgagtgcgaactatatcctgggccctggaaataaggcgataaaaagatagaatttcctccgggagatgagctcacagtctagattatattagaaataagcagtgacatattctgggagaaaaacttaaagttgagctaattccatatagtaaataatttttccctgcaaaagcaaacctataaaagcagaaagactttggaattagataacctgcattcaaatcctgactccacctagctaactttggacaaattacttctccctgggccacagtttcttggggaagtgttgtgagtattaaatgaggtaataggcctggcgcagtggctcacacctgtaatcccagtactttgggaagctgaggtgggcagatcacttgagatcagtttgagaccagcctggccaacatggtgaaaccccgtctgtactacaaatacaaaaaacaaaaaccattagctgggcatggaggtgcacgcctgtaatcccagctacttgggaggctgaggctggaggattgcttgagccggggaggcggagcttgcagtgagccgagattgtgtcactgcactccagcctggacgacagagctagactctgtctcaaaaaataaaaataaataaatgaggtaataaatataaagggcctatcatattgcctgggacttagtaatcatgcaacaagtggtataaattgctgttttattaatgcatattgtaaacgtttctggaactctagtcttccacagaagcttggtttgaaaatcttggccaggcgtggtggctcacgcctgtaatcccaacactttgggaggctgaggcaagcagatcacgaggtcaggagatcgagatcctcctggctaacacggtgaaaccccgtctctaataaaaatacaaaaaaattagctgggcgtggtgtcgggcgcctgtagtcccagctactcaggaggctgaggcaggagaatggcgtgaacccggcaggtggagcttgcagtgagccgagatcacgccactggactctagcctgggcaacagagcgagactccagctcaaaaaaaaaaaaaaaaagaaaattatttttctgctttcagacccctacataaagacatttactgggtttctgtcttcagaactcttttcttctcaccctgacaatctcagtacctggggagctatgtgaagaaaacaactcacctggcccttgaccaaactaactgaatcagaatatccaggggtaggacctgggctcaatgtttgtttaaaacttcgcagttgattgtgctgcagctggtttgtctactctccaaaagcactagtccacaccacctcctctatgttctcatcagtacttgttttttaagacataaatattgaattattcaaaaattacacaatactcaatcaagctgttaaaaccattacacaagcaacacatacattgggtacatagcattaaaagtgaaaatctgtgttctgctgacctcatccccatcctaactctataaggaaccattgttaatagttaactttcactttccagcactgttctctggttgctgcccccatcacatctttgaacctggcaaacacctttccttcaagtcctcacccaagttgacctctcctccgtgtgtttatgtaagctgttgtccgccttgcttctgggccatgtgcatgtcagttatctattgccatgttaacaagtgactcctaaatttagtgacttaaaataacaactgttttggccaggcgcggtggctcaggcctgtaatcccagcactttatgaggccaaggcgggcggattacctgaagtcaggagttcaaaaccagcctggccaacatggtgaaaccctgtctctactaaaaatacaaaaattagccaggtgtggtggcacatacctgtaatcctagctactcgggaggctgaggcaggagaattgcttgaacccgggagacggaggttgcagtcagtgcagtggagatcgtgccactgcactccagcctggccgacagagcaagactgtgtctcaaaaacaaaacaaaacaaaacaaaaaacacacaaacaaaaacaaaacaacaacaacaaaacaactgtttgagttagcacaagattctgtggatcagcaatttgggctgggcttagctgggcagttttgtggtctgggccaggctcagcttttctgggttgggcttgctcacatatctggtgctccggctgggaaggctagagcagctgggccttctctccacgtgccttctcatcttgcagcagtctcactcaggttggcacacatggtggtggaagggattccagtgagacagcagaagctgcagggtctcttgaggcctaggtttagaacttgcacatcactctgctgccttgtattagtcaaagtcagtcaaaatgccagcccacatttcaggggtggggaaacaggccttacctcttggaggcaggagctgaaaatctatggccatttttccaacctaccaaaatatgatgcctacatttttacaatttctggctcctcttaggtccccactgtccacatctgagcacatgccaaagtgctcctcttttccagttcactctattccattctattctcaggctacaccctggtctcagttatcaacgcaatgcttctaacacagaaatctatatcttcaactccagcctttttgccaagacttagtcccacatctctaaatgcctgtagacgtctccatctagacattcagccaacagctttaacgcaataggtttaaaatcagacctttcactgataactgtattctctagtcagcatccacaagccaaacggactcctcaaaacttggacattgaccttgacctctccaaatctccttatctataccactgattgtgatgaagataaaaggaaaagatctatgtaaaatgactggcacaaagtgggtatcatgaagtccatttttttccacagcttggcaccccattaaccattttgtctccactcaagcttcagtcgttatcctcaaaggcttcagtgcccatatcagtgaccaaactagcactcttcactcccaatttctggaccttcccattctagacccttctcttcagttattcacaggataaattcctagatgatgacagctggaattgcttcacttctaatctcatacacatgaattgccagctctctgacctcaggcatgttccttatacattactcctgccataacacgaaggtgtctgccttcatggcctaccagccttttcccggcctctcttctcttcccagcttgtattacatggtagattatttcagtcactcactccagcactttttattccctcacgtatgctcagcacgactctagcccggcgtggatcaatgttaaaatctctatcccctttcttcttataacactagaatcctacaacaaaaatgacttgcctgtgcaggatgtcaccactttcatggtcttcatcttcggccgggccaccaatgccatctctcagtctttctgcttctccctgatgaacttcactcccattgcccacaacagcccttccaaaccttccgcactctcaagacccctctctgcttgacccttatctgcaccccgtgtgttatgtaaatggccctgcctcctgctccttggagaaaaattgatcacatcaggcatcatcttctgtcacgtcctgactccacttcatttccactctacttcaatcactcccttgtggggactttgttgttcttcccagttctttgctattataaataattttgtgttgaacatcttgtatatatgacattctcccctcatgtttgattattcaattaaaacaaacttctgaagaaggattgttagtttccaatgttggctactgtcagattgtcctccaggaggggtgaattgatttctttttccacaggcagtcactgactgcattgttttgcaattatgtttgtgtgtgtgagtgtgacctctcagactctgagacaaagtagcatcactgcgcagaacttggattttggggtcaaagtgacctggctttgcagcccaggtccttaaattattgcttatatggctttagacaagtgacttaacctccatcagcaaatagacaataataatggtagctacgtcttaaggtgggtccattcactcaatatgcatttactgaacaccttctaaatgccaggcaacattttaggcagtggagacagaatgaaacaaagtctgtggtctcgtagttcttaccatctagttgggggagatatggacaaatatatttaatgtatcagtgctaagaggcttatataatatgataaagtgcaaagcagaaaaagcagagtctggaggagagagtctgacagcatgggcatgctgggggtggtgtgtgtgctgtgtcatatagtgtggtcagggaaactctgaggagggggtatttcatccaagagctgaaagaggcgagggaatgagtcatgtggttaatgggaagaatgttccatggaaaggagcagcaagtgacaacgtcctgaggtaggagtgtgcctagtgtgtttgggaacagcatggaaacctgtgtgtcctctgcctctttgtaaaacttccttattgctcttctcccaactccccgcacccactccacccatcctcagggaaccactgatctgattcgtttcctagagttttgtataaatggaataatcagtatgaaccttttattgtttggccgttttcagacagtgtaattattgtgatattcttcaatactgttgcataaattagtagagcatttccttttattgctgagtagtattcatggatatatcacagtttgtttatcccatcacctgttgatgttcccactttttggctattacaaataaagcttttgtgaatattcatgtacaggtctttgtatggacgtatacttttgtttctcttaggcaaatacctagcaaagcagtggaatggctgaatcatataataggtctacatttaatcttttaagaaactgcccaacttttccaaagaggttggaccattttatattctcatgagcattgtatgagagttccaattcctctgcgtttttgtgacagttggcacagccagtctttttcatttaagcattctaacagttatgcagtggtatgccattgtggtttcattttgcattgccttgatgactaatgatgtcgagcatcttttcatgtgcttatttgctatccatatctcttctttggagaagtttctgttaaaatatttccccatctttaagttggattgttttctttttgagttttgagagttctttgtatgctgtggatgcatctcctttatcagatatatgacttgcaatattttctccaagtctgtggctttcttttcattttcttatgtattttcaagagaagtttttgcttttgatgaaatccagtttatcagtttttttatagattgttcttctgatgttgtatctaagaaatcattgcctactttgcggtgacaaaggtttttctaggaattttctaattttacattttaaatttagatctttgctacattttgagttaactttttgcatatggtatgagattcattaaaaaaaaaaatgggtatctaattgttccagcagcattcattgaaaaaaacctttcttttttctgctaaattgcctttgtacctttatggaaaatcagttgattattgtttgtaagtttatactctctactctgttatcttgatctatgtgtctttattgatgccaataacaaaaaatacttataagtattgaaatctggcagttcaggactttcagccttgtctttcttttacaaagttgttttgactattctagggccttttcaatttcacattaatttaacaatcagtttttcaagttctaacccccatccccccaaaaaacctgctggaattttgattgggattttgttgactttatagatcaatttggggagagttacatcttagtaacatcgggccttccaattcatgaacatggtatctatatatttatatctgttgaggggatagatcatcttaatttctctcagtcatatttgtagctttcagtgtataggtctttaacctcttttgtaagatgtatccctaaattctgcatatttttcaatgatattataaaagggtttataaaattcagtttctgatttttcattcctagtgtatagcctgtattgggattcttaattgtggtaaaatgtgtatgacataaaatgagctatttcaatgatttctgagtatacaagtccgtggcatcagttacattcacagtattgtgcaaccatcaccactatctattttcagagcctttttattatcctaaactgaaactctctacccattaagaaataatttctaattcatcaccatcctggcccctggtaacctctaatctactttctgtctctataaattgcctattttagatatttcgtataacgaaatcatacagtatttttccttttgtgtctggcttattttgcttagcataatgttttcaagattcattcatgttgtagcatatattttttggctgaataattccattgtttgcataaaccacattttgtttatttttaaaattttttaaatttaaattttattgatttatttatttttgagatggagtcttgctctgtctcccaggctggagggcagtggcgcgacctcagctcactgcaacctctgcctctcgggttcaagcaattctcctgcctcagcctccccagtagctgggattacaggtacccaccacaacgcctggctattttttgtatttttagtagagacggggtttctccatgttggccaggctggtcttgaactcctgacctcaagtgatccgcccatctcagcctccccaggtgctgggattacaggcgtgagccactgtgcacagccagcattttgtttatacattcatctgttgatggacacttggattgtttctaccttttggctattgtgaaaatgctccagtgaacattggtgcgcgcatatctatttgagtccgtcttagattcttttgggtagtataaacctaggagtagaattgctgtttggtaatgataattctatctttagctttttgagaaaccgtgaaactgttttctacaaagactgcaccattttacatttccaccagcaatgtacaagggttcccatttcttcaccttctcaccaataacctgttaatttctgggttgttattataattattattatagccatcctagtatagtctaggaagtggtatcttatcatggttttgatttgcatttcctcagtgacaaatgattagtattatttcttgtgcttatctgaccatttatgtcttagagaaatgtctaagttcttatcatttttaattaggttgtttgtctttttgttgttgagttataggagttctttacatattttcaatattaaattcttctcagatgtatgatttgcaaatgtttttccccattgttgtcttctcactttcttgataaggtcctttgaagcacaagctttaattttgatgaagtccaatttgtcttttttctgttggttatgcttatagtgtcatatctaagaatccattgccaaatccaggaccatgaagatttacctgttttcttcagtgttttgtagttttagagcttgtatctatgtcagtgatccattttgagttaatttctgtatatagtatgagttgtggtccaatttcattcttttgcatgaaagaaaatccagttgtctcagcactatttgtttctactttttctctcactgaatggacttggcaccctggtcaaaaatcaactggtgagtcgggcacagtggctcatgcctgtaatcccagcattttgggaggctcgggtaggaggattgcttggagtctaggagtttgagaccagcctggacaacgtagtgagaccctgtctccataaaatttattttttaattagctgggcgttgtggcacatgcctatagtaccagctgcttgggaggctgaggtgagaagatcacctgagcctggaaggttgaggttgcagtgaaccgtgatcacaccactgcatgccagcctgggcaacagaccaagacctgtctcaagaaacaaaaacaaaacaaaacaaaaaacaaaccccaaaattagccataaatgtatgggtttatttctggactcttgactcttgttttacactatatctgtgaccaaaggtggattctggcccacactggtctcttctgcaacatatcttcttgtggcttttttctggccccgggttcccaaacaaagcatgcagttgctggtgatattctctgcacagttaggtttttgttgagttgaagaagtagccaaattcttattgtaaaagtagcctttcgtactaagctgactttacctttcgaggagaacttaacaaaatatgtgcttcttccacttttaaagtttgggccctcaggttcttttctttttctttctttcttttttttttttttttttgagacagagtctcgctctttctcccaggctggagtgcagtggtgcgacctcggctcactgcaacctctgcctctcaggttcaggtaattctcctgcctcagcctcctgagtagctgggatgacaggtgcccaccacaatgcctggctaatctttgtatttttggtattgacgagttttcaccaatttggtcaggctggtctcaaactcctgacctcaggtgatctgcccgcctcagcctcccaaagtgctgggattacaggtatgagccaccacacccagcctgtctgagcactctctagttctgacattctgtgagtatatgacctatggcctcggtgtgtgttctgtgataggaaaggccagggtggagggatgagaacaggacagctgggattggaggtcctggccgtggcagtgccagcttaggggttgctggccagaggagtcgggtggctaccagaggcagggggctggaggctctgctttgttttagaactttttgagtgcagctacttctcttttgatggatttatagcagtacagtaccaagacagctggactggatggggcaaatgagggcagtgtacagagggtcgatgaggaatggcgttagagggcagtgagtggggggtggtctgtttcccatccagctggtgtaactggggctcagggtgatttatggtggagaggggagtcgggtatggaggtggggcatggacttttcagatcccttgggacttgcccgcgctgaagtttgacatcatcaggcactgtggttttccagatagggtcactggatgcagtccaacaaatgcaaaaagaccttgggcagggacattgtatctgtgaccaaaagtggaaggaagctccagctatgcctacagtctggagaacagttgccaagtaggggctcatgggtatctgttgatacttactgccttcactctggaaaatcctgagcctgagtctcagctgggagattctggcccagcatgtgcttgggggagattcacacctttgctgtctatcctaagccatgtagtttgtcctgaaggtgcagcagttagatctctgggctcaggtgtgtgttcctctgcagccttgggcaggtgtcctggtcttctgatctgaatatgaacaaagacaaccctagatatgtatgtgtgttggggagtggggttcagaagtcagcaggccttagggaacagcctgtccatgcttttgtcctggggagaggcagatttctgcaggtgaacaatgctagagaactgtgccagcagatgggaccctagtgtcagaatgaggagcacagagctgaggtccgggggaagcggtccctggatctggggaggctttggagtcagggagggctggcaccaggataacagcagcctaggattatctctttgcaaggtcacgttcctctacaaagattcaatcccagcctggctctgcctccatgcccccttagacactgcagaccaactaaataccatgccaggaacaccacagtgtcccgaaaggacactgtctcctgacaccagcccctctttccacagtctgacattttgggtgttatttcgtcctctccatcaccaagtgttcagacaacagaggcaatgacgggttgggctctgagagaaggcgtctgtgtgcacatctgagtgtgtgcatcagtaagagtgtatctgggtggggtgtgtgcacaggggtgtgcctgccaccaagggcagccatgtagatgtgtcccagttgtgtgtgcttctatggaagcaggtatgtatggtggaattgactgtgtgaacggggtgggactggggggatcctctcttttgccctgcatttggtggggtcaagaggtaggattgggaagtggaaggaggtcaggtacactggccctttcctgggcccaagattacacttaatggggggccacaggcctgctttcacaggcaccttgcctgggcagtttctgggaggctggtgagctctaaaagccctaaaagcactcaaggattaagcaggagcccctgtgcctagagctccgcttaggtcgctgagccaaagagaccctgtgtgaccctgggcagtgagctgtggtggggtagaggacccttccctccctgccaggcccaacccatgggagttgagagcggggacctcggtctgccgtgaggtgaggggctgtggggcaatccggggccgcatcaatgttggatgagcctgcacctcctcgataccatcttccttggtctcacttttagtgtaactggagagcccagggaccagtccgagctggccatgcgcgatctgctggcagtggccgcacctgcgaggggacaggagctggggtagggaggctggcgcaggcccacggcgtgtcctggaacagcttgggggccacagggccagtctcgcagggcaggggtcgattccagtctggcctctgctcgggccctgggtcccggtgcagggttactcccccgcccccctcgggccacttcgccttccgcggggtgtcatctgtctggcggcgtgtccttgggccagttcggtcccatccccctgcctagctctgggagtttcctgctcgggaaggggctggaggggcagcagctggacagagagagaccccctggggtaaggaaggggagcagccgcgactgcacagagcctcccactgcaggtgagtgtcccgcctggggaaaggccgggagcgcctggggaaaggcctggggaaaggccgggagcgcaggagtgagattgggggtccacagtggccaagcttctccccaccctggactttcctactccagtcctgaccctttatagccttgtgacaccacaagtgccgcccccacccccaactaccaccaagtatcgccctacaaggcagcagtgaagtaggctcgtagccggtgaacacctggtacttgttggcagatgttgggatgaagttattactgcactgtggcctccatgatcagcatggacggacactcctgtgggcagcaagtttggattggatcagtgagccatggcgagtgggcagcagcctgttttaaaaaactgtttattggaaaacagacacatctatcggcttaaatgttgtctatggctgctttcacactacaacctcagatctggcccttcaagaaaaaattttgccgatgcctgagatattctcccagggcatacttccctttaacctacacgtgttcattctcttcctctccctcacacctgggcacctatcctccctcctccctttgcacctcccgcacatctggctcacgccaggctctccacacctgggaacatttctttggggaccattcacctcacatctggtcactattccttcctctggcaagagaggaaatgactggggcaacaatttcagaatctaacaggacagccgagggctgagggaggacctttgcctgaccccaagttgtcagtgagcccctccctaggctacaggagcaaggcgagttaactgccgatgagcacagctgctctgggcccccaaatctgttttgtcacccgagagactaagcaggccagttctgggcatgggctttctgtcactccctctgttggctggtgacagtgctgaggtcccgatagagtggtagggagaccctgccgaacagataattagagggtgccaatatgatctgggggggaacctgggagacagggagctccagaggcaccgcccctcgcctgcccgcttccctgtcgcttccacaccctggggcccatcgtgccccacttcctccaagccccaagcctttgcaaacagaacaaaagccgtttccttggttcccttttgtacgtctgagttcaggggtccgtttcagggcctggactccgggagactccgggaaactccggcgcccgaagacagagctgcattcctgctgtgccgccacaagatggcactctctaggtgtccgccccagtttgagcactccgggagtttctgacacttgctggcctttcgcccagtttcagcctgaagattgtggtcagacacactctgaatcccaccaggcttgattagctttgcctgccccctgaggcagctcatggacttcttcagactctgtagttcaggacatattgaccccttctgaaggggccctcaggaactgcctgcagtgtaattacctgcctgcttatactcctccccaccaggcactcctgagagcgggaccgtcttattctcctcggggccacctgccccaacccagggcctggcacggcagagatggcagaggtgtttggtggggtgtaatgtgtaaacagcagagtgctgctgtcgtcattcatcccaccatagtttgtctggtgaatgcatttttagtgtcaagctgcctgaaggagaagccagggataaagacccaagctcagaatgtatcctggggagagggattggttcacagagagaagctgtcttgcagcctttccccctctggcctggttctggctgttgccagcattctaggagttctctagacgggctgaaacgcaccgcagggatacagggagggccggagaataggcgtttgtttccaggtagaattttggggcatacccggccttgtctgggagcaatcagggaccagaggcaagggctgcgatgggctctggggcctactgtggcctcatccctctcacctggccccagctcaggccattccaagagcctcccagcctaacagcaacgtgtggctatccaagggtcccagacagaggattggagggctgcacctgtgtttaggggacagccacccctccccctaagcacctgctctgacagcatgggatgatgtcaacaagggacttccatgaagcccaagggggaaggacagtgggagtggggtctgaggtctggactctgcttgaagattgacaatgatgggtgggagtccctcacccactgtaagctctaggaagagggtgagcattcctgttgatactgtggcccattgtgttggcagagtccaggccagtttgtgctcttggtgtgaccccaggagggagtcctttgctggatcatctacctcatgggctggtactgacatgcaggtgcgatttccctgcctaaaacaggctccagagtaagactggcatcgctcaccagggtaattattggtttgggttcaatttccattcaaaacagtaatcccagcctgagctgggtgtcagatctgaaggttgattattagtaacatttatcaacagcctctctcagcttcaggcaattacagctcatctgccattcctgctcccagtcatgcaaacttgccagcttcttccctgcccaccccctccattcccctctccccttcttctcccatctcctccccttagcagacaacctgacggagggcaggaggtgggtgccaccttatgactcactatcaccctgtatggagggggtccatgtgcatgctaggcacctgtgctccccagcagcaatattcatgttgcagtcttgtgaaatctgaatctgattctatcagaactgaggagaatctgtgaaggggacagatgggaacccatgtctcccggctccttgtcgcatgatgcgttttcaatggcactgtgctccttcctgctcctgactcagtctgtccctcccctccagggctgagactagggtgaggctagaaagacattgacctcaagtgcaacattcaaaggacctcgaacaagctcagtaattaagataaatgatatttcaatatagtatttttttaaatcaaaatgaatgcaaagcacatacaacaaaatcaaacctttaataaagacaagatacaacactggatttgcgggccttgtattggcctcacttgccttaccctaactccagtcttgtttatcatggacagttttgctttgatttgctggaagtattaaatttcttggctgctgagttttttggcaaatctttaaattctgcgcctcaggcgagagctttattcagcttaccctggtgctggccccactgctctcacttcccgctgggccctaacctcctgctcccttcagctcttactgcctactgcctcaggcagggtggctcagcttctctcttcgcaggtgcccagggcagcaggggacccaaagggcccctccatgggctgtcttccagggtgcccatccttcattccatcccactggaccctgcttcagccgtcagacacctcagggagggcctgcaggttgccagagtaactgctgtgataactggaggacagaacatgctggtcttgctctgctcgtagaatcacatccagccagggctggatgagtgcaagcaggcacgcctgacagcgtccctgacacgctgatccaaaacgtcactggacatgcatggaggtggagaacattccatgtacccacattcctctagggggaggacagcatgaggctggaggaaaactgtggtgatctgtttgtgacagggaggtgagacgctgaagtagacatggatgcttcctaaccagccttccgcagagggtaggtctcattcgctgaagggcttctgttctgctgagcagggtctgtcagtaggggggcacacctgtctccagagaataccctcctcctgtcctcccctggctgtgctccactagcctaaaaggtaaacagacattttagaaagatcagtgttgaaggggtacccaagatgccaaattatatctgggacttgagacactgttatgtcgaggtccaggcctaggccagctggtcacagtgtccagatgcctgtcacggtgggaggcctgagggtctcaggggacatgtatcagaagcacctctgccctgcctgttccactctgtaatctcccttctgagcccctactgcagcacagagccagctggtcatctagcctggcagtagtaagtcattctattttcctgcagataggaatacatggttcctgttcctcctatgcactctgccacttaaattcccctctctgagtcctaggttccccttttgtgaaatatcaatgatagcatccttcttagaaggctgtgctcaccattcagtgcactaatgcaaagcactgtgaccgactgaagagtcatgttctgtggggccatggaggacagaactaggactgaagggaggtgtgtttgagctttaggtgaagcagcaatggccaactacaaagatggagggaccgctctgggaagagcaaacaccctgatgctcagagtgtgcatgaggaggtttcataatcaccatccagcagcttagcctcaaaagggctgcctgccccagggagctatgacccttgagagatgcagtttatccagccctgaggttctgtttgaccatctttccccggttgtcctccagggggtcatggcacaagtctcagtagcacgggccccatggtccagccttaaggtaagaatggacctccctggaggaagctggcttcatctacagttgataagttcaccttttttcctggtccactttccttggtttaaccctgtgaccaaacctgagagctttggcaggaaggaaaccagggaggatgttgtgcttgagaaagtgctggcctgagcattggctttgagatgtccttttactctgactggagggtctcattccacctgtagcaagactaaagacacctgaaagagagtttctgggagatggaggatgaggtctccagttgcaggtgcatgcacacgtccacttccccacctggcaggtgccggcatgcaggatgtctgtgcgtgtgccccttgcactgactcccttgaggctggctgtgcagctttggggcatgtgtccaagcagagagaatggaagactccatattgggagccttggctttgacctttcctttctctgagcctgattttcccaacagtgttatgggaggggaaggatgagatgcgcttctcagctgatgtccgtgattcttctgttttctggaggccatgagtgttaacagaatgtgttcacttttgcacccttcttccatgaccacttacagtctgtctgcttagcagatgaggggtctgggtctccagcgtccatttggggtggggtcagcaatgtccagctttgcatctgggtatcacttttccttctgatacttgaaattggattctgaagattcctaattattgttccaagttctcattgaaaatctgggtgtaatttttacaagagcatggctgaggatggacatggaggggaagtagtggggctggagggagggaagggacagacagaaggtgatgttgtcattaggagttaaagccagggcctggtagtagataaggctggacagttggcaggatcatcgggcggactaaagtagcttagattctgtccagaggaagtgggggtcttctgaagggtttaagtaggctgggaggacatgatcttaggaagctcactctggtgtcagttgcaggatggatttgagaggagcaagttaggtgtagatgcccatgatgatgccaagatctgggcaacagacaggaaggccctagctcagaagtggctctagggaaggtgaggtgcatagaattgagagatgctcagtagatggcatgagcagtgcttgatgattgtctgggttggtggaggaaggtggacagggaaaagcagaaagctacgatggtgcctcaaggggctgagtgatgtcactcacagagacagaatgtatagagtgaatgttcagactcacaggaagtccaaaactacataccccaacgtgaggtgctgtgggacatccggggtgcagggtccagagagcaggtaggtagagtttagaagagggctgggtccacaatgcagccttggatgttctcaatgtaagagttgtgggagatgaagccttgtgagtggatgggaacacccaggtgcatttcaggtgaagcaaggggacaagaggctgaggacacagacaagcaaatcctagatcttccatcagtccctagaaggcacgatgtgtgcccctcccagcacacagcctgagccctagcacagagctggccgcagagagggcagcagtgaatgtgtcctcggtggttcctccagatggggcctttgtccgcagtgcacttgtctctgcctgggttgctatagtaacccacagatgcagagagacttggcctccgtgttgccatggaaaccagcaattgggtgtccctgtgtggcatggccactgagaccttgaggattcagtctggtcctgaagggtttggggggagactgcgaccagaagatgtttccatgtcctaattaatgggtgatggtggttgttagtctgactgttgccacggtgatgaagggagacatccaagtgctggtttcagtactgaggcgaatacagggaatttcaacaggctccaggtcttactatgcagcctgaagtgggaccatcccttaaacccactccatcctgtggccacgatgggggccaggacacctttgccttctttctgggtttctttctttgccgagacagggattttgttcccaggaggcactccctggcccatgggatctcagcattcaaagcagcacaggaaacctgggcccctgaaacggggccaccgaagagatcggtaagctttcaacatcctgcctttagcccatgggcccaaccattgcgtcagctccacccacccaccctcactgacctcaaccctttacagtcccaaggcctccccttcctgatggtgctgctcccctatcaccacgtggagccccacaggtatatccccgcaaacccctcttgctccagacaggtgatcagggaggcttcattactccaggagctgcccaggacctcagggaggtcccccaccatgggagtaagggcctctcccccagcctccagggctccggcagctccacactccggccctctgcctcttctggagggctcctccttccagcttctgcctgtctccccaccccccagtgcttcattcccatggctcaggtcatcactgccctcatctggactgcctgcctgcctgcctgccatccggggcccacagagtgagcactctatggaagtccctctaccctgatccatcacgtaactcacctactgaggcagctgagaccagggcactgaaggaggccttgagtgaccaggtgtggccaggcagcaggcagggatgatgaggtgaggctgcaaggatgtggagagtcaccccttcttttcctcctcaggagaacaaccaggaggaagtactggaaggaaggaagggagatcgctcggtgagctggaggggaggagggcgtgccggccctgggaaagggccaaccacaggagactgtgagggaggtgggcggaagacgtgggtggctcaggggccatgaaccccatatgcgcctgggagtgtgtgtgtgaaatggggtttaggggagggtgtgaccactggacaaagcctgctcttattgtgtgtgactattgtggccttgggtttgtccctcttggatcctcctgtggtctttttgccttgactctaaccgggtgatgctgatgagcaggtccagaggcctgggctctgttcactagcctgtgctgggactctcagccaagccttctcagaaaggaggtgtcctctacatgtggtcacaccatagcctaggaccacagagggaatcatggtggcagagcctccagcccccctgccctcccattgcccaaacacccagatgtggagatgccctgccccggggtgccgtcccaagcctgctttctaacatcaggaggtgggtcttgcctaaggctcctaaccaggacctcatttgttgtttacacatgttggggtcccaaggatatgtttcttggcccacagaatggtcataaacaactgccctgtgaaggagggggtgctgtcttgtgtacagatgaggcaaaatgacaggatcctgtccccagctgcagagtgtctgctgggcgtccccaacacctgggaagtctgtctgtccttccaagggaccaggccagagaaatggggggcacctggggctctgctttgcctcctcatggatgtcagtcccgggtttctgatggggtttgtgatgatggcgccctaaagggaagctctgtggagagccaggggtctcgagtatggccttcatggcagggaccccattgctctccttttttacacatggcctcaaaccaggttgactttttagcctaaagaaaatctcatgaagagaaagacagtggtgtgggggagggtgtatcacttgagcctacttcacaggctcttgggaaggagcagtaggaggaggaggggtgcaagtagtgaaccccagagggatgactctgctgtgatgactgttaatgaggcttgagacttcagctcatttgtcatgtgcagctggtgtattttgagtgatataagttgatgacagcctccttcctgaacccactgtcaaggctgcaagaaatttttgagatcccacatccaaccccttgtgtaacaggcaaaacaggcctcaggttctgaaccaaggtcacactgcaagtttgtggtagactcagaattagaacgcaggccacctgctcagggttctttctctgtactgcaggagagggaaccagcatcactgtgtgggagtcaaggggcttctcaggagtgagtagtcctttggccatgaccttgccttatgtgaatggaagttctgagcatagtgtgaactgtatgtctacagctgatggctgcctggcagggactcttggccatactgggtttctgggctggctcatttctggtgtttggtatctctctacttcacgttgaatggctcttccctgttgaaaggctctgccagtatcccttaatatcaggtaaaactgcacaattcaagatggtgccagcaagcatgatgtttcccccatggtgacacagggctgtaagtagggagatgaggagccaggcatctttggaattgagggctgacttatagggctgacttatctccgtaggtttggaatagtcataattaatggcaaagttaatggtccagccacttagggatatagcaaagcaagagaatcttggcttgttgtcttcaacttgttgaagaatatcatctccatttcatccacccattacttggcatcttgggatcatttgaaactgttccacctgtgaaaccttaatctttgtgtacctcgtatgcattctgcctcccatatctccaccatgtctgttcatagagacctcaggcccctgagccctagtttttctcctcactctgaatcaactcttgttcctattctatctgagctctgttgcttgtcacttcaactgcccaccattcaccacctggcctcttagtctcctacctcaaccttagagcagggtcactgcctgctttctctagtcctggtttaaaggtgtggggggaattccttcgtgaattgacattggtccaaattcatggcccgcagcctccagcgagcccccagcaatgcccagcagtcctgtgacctgggcctgctccaattcctccacaactatttcaaagctctcacattacccacttattgggatataattcatataccatacaagttgcctgtttatagtgtacagttcaatggttttaagttgtatgaccatcactacaatttattttagaacattttcattactccccccaatgaaaacccatacccatttgcagtctcccccttttcctacaccccccagccttaggcagccactaatctattttctatctttatagatttgcctattctggacatttcatgtaaatggaatcacataatatgtggtcttttgtaactggcttctttccttagtataatattttctaggttcatctgtgtcatagcatttatcaatacttcatttctttttattgctgaataatattcaattgtatggatataccacattttctttatctattcatcaattgatgaacatttgggtgtttccacattttagctattataaataatgctgatataaactcttgtgtccaggtttttatagggacatatgttttcactccttgggtatatgcctaggatctatgttcaaccttttgaggaactgtcagagtgttttcccaagtggttgctgcattttacatccccaccagtagtatatgagggtctcagttttttcatattcttgccaatacatgttattatctgcaattttaagtatagtcatcctagtaagtgtgaagtagtatctcattgtggtttggcttacatttccctgatcactaatgatgactaacaatgtgcttatggaccatttgtatatcttccttggaaaaatgtctattcatatctcttatccattttttaaattgggttgcctttttattattgagttgaagcattctttatatattctaggtaaaaacaagacccttatcagatatatggtttgcagatattttattctattctgtggttgtcttcactttcttgatggtgtcttttgcaacaccaatattttacatttttatgaagtctaatttatctagtttccttttgttgcttgtgcttttggtgtcacatgtaagaaactgtaggattttttacaaagatttttgcctatgttttcttctaagagctttatagttttggctctttcatttaggtctttgaatcattttgagttaattttgttattggtgtgaggtaggggtcccaactcattcatttgaatatggatattcagttgtcccagcaccatttggtgaaaaaaccattttacctccattgaatggtctcgctatcctgttgtaaatcagttgactgtaaatgtaagtttatttctgggctctcaattccactgctttgacctatatgtctatctttataccagtaccacattaccttgattactggagctttgtggtaagttttgagatcaggatgagttctccacctttgttctttttcaaggttgtttggctattctgtatcccttaattttttcttacaaattttagaatctgcttgtcaatttccacaaagaagccagccagtattctaatggagattggaccgaatctgtagatcagtttggagagtattgccatcttaatagtatatagtcttttgatccataaatacaggatgtcttcttgtttattatttaggtcttctttaatttctttcaaagaagtttatagttttcaatgtataatattgcacttatttttagcagtttattcctcagtgttttattcttcttgatgcttttgtaaattgaattgctttcttaatgcaagtgtatagaactatgtataactgattttgtgtaatgatcttgtatcctgcaaacttgctgaacttgtttattagttacaatcattttttagtggataacttagatttttattacacaagattatgtcttgtatgagtagagatagttttatttgttcctttctaatctggatgccttttgtttcattttcttgcctaatcatcttggctaaaacctccagtacaatgttgaatacatttgtctagaatgagcatctgccccaccccaccccccttcttctggctgctcttaagatttttctctttatcgttggctttcaacaattgattatgtgatgtcttggtatagttttcttcacgtttcttccactgaatgtcttttgagtttcttggatatatgggtatatggtgttcattaaatttgaagaaacattgggcattatttcttctaatattttttctgacttttcccctgaaactccaactatgtgtatgttagcttgcttaatattgttccagagtttttcatttttcagtatttttctgtgttttattttgaaatatttctacctatgcctttgaatttacgaatctttgctttgcagtgtctaattccatgaagtatatattttattttagatactatgtttttcatctcttgaagcttgacttgcatcttaattatgtatttcatttctctcctcatcatagtcatatttttctctatcttttttacgtggagtgagtttatcatagctcttttaacatttatgtctgctaattctgtcatctgtgtcttcctacttgtactgtttttacccacaacacttctaacactaaatgtgtggtttctttccacaccaacaaccaatttggcaactctctagatgccaactgagggtcctgcaatttaatttgattctggtactaattattataactgaagttaatgcagaccccacagtttaagggctcagtcccgcaagacttcccccatttcataagtcccaggttgtcacctatacttctggccaaccagctataaattgggggttcctaggacccctgctcaggtatgaacatttgctagaatggctaacagaactcaggaaagcactttatttactctttactgatttattataaaggatacaactcaggaacagccaaatggaagagacacctagggcaaggtatgcaatggcgtggagcttccatgacttctccaggtgtgccacctccccagcaccccgatatgtttacctgccaggaactctccaaactctgtcatttagggttttatggaggtcctgttacataggtacaactgattaaatcattgaccattggtgagtgaactcaatctctagcccttctcctttccccagtggcttaggggtgagctgcaagttctaatcctctaatcacatggttggttcctttggcagccagcctccatcattaagctatctaggagcccaccaagagtcacctcattagaataaactcaggtatggttgaaagtggcttattgagaataaaaaagatgttcctatcatgcaagaatttccaagggttttagaagctctgtgtcaagaactggggacaaagaccaaatatatatttcttcttgtgtgcactggtgattgatttttctcctagttatgcatcttctcctcctccttttttgaatgcctgggtaatttttgattagatgataaatgttttggattttacaatgttgggctttgttttatcctttaatagttaatggtgggctttgttctgacaaacaattaagttacaggttgagtatccggaatatccgaaacctgaaacgctccaaaatctgaaactttttgagagccaaatgacactcaaaggaagggctcattggagcatttcagattagggatgctgaaccagtaagtataatacaaatattccaaaacttgaaaaaatccaaaatctgaaacacttctggtctcaggcattttggataagggatattcatcctatacttggaatcagttggatccttctggggttttcttttaggctttgttagggcaggtccagagcagcccttggccgagggctaagttggcctcactactaaagagtgctcttctgaggaccctccctgatctgatgttctgtgtattaggaggtctttctgctcggactggtgggaacacagagtatttccacccttctgtgaatttctgagattgctctgcttacttctctctgtggttcattccccagccttgggtcgttttctcacaagcatgtgcagatcagtactcagccagagataagggaagccctctacaggcctccgaagcacatttgtgcgttatctccctcccctccctccatccctccttctctttctcagtctcttgctctctcactctctagctcttccttctggaaaccctttccagggaataatcagggcacttgcagggttcactttgtttgttctctttcctcaggatcattgccttgcaccaccttttgtccaatgtctgaactgtcgtttcatctatttcaccggtttttaaatgttaaggcagaaatgtaaatctaggccctgttactccattgtgactgaaggcagaagtctctccttagttttaggctcaccattttaagtgcttactctacattcccaactggatatcacacagacccctcaaactcaatgcatccaaactaacatcttctctcaccaacctgtccctcgtcttctatttcctatctcctgggggaaacccagccccaaatcttaaaggccactgtgacctctttttcaccattccctgatatttaattaaataaaatcctttcaatttcatattctttgttaggcccaaatctgtgcatctctttcttttctctctgaccaccagattacctaggtcctcacggtatttagtctaagtgactatatagcagcctgcaaactgcctctttgcctccagcctatcttactccaagccatgggccacactgaagccagagtcagttttccaaagcatagataggatcctatcatcccccacttaatgtatttcagtggattctctgaagcagggctgtccaattttttggcttccttgggccacattggaagaagaaaaattgtcttgggccacacataaaatacactagcactaacgacagctgcttcacttttttaaaattcgcaaaaaattttcataatattttaagaaagtttacaaatttatgttgggccacactcaaagccatcctgggctacgtgcagcctgcaggctgcagggtggacaagcttgctctaaagctttagcacagagcactgcattcttagtggagacaaaaggctgtttactatctggttcctgttatattctccagcatcgtctcctctcctgcctctccccactgccagctgcaccagccccccaaactcatgtactcttttccatttctgggcttcacctgtgactccttccatatgtagtgctcttccctgtcttcacctggtagacttctcaccagccttcaagacttggtatcacctcctccaggaagcctactcagatgtcctcaatcacatgcagtgctaaactctatcacaagtcttagtaaatttatatcaatcatgattccatccaaatctactactgggctgtgatctctctgagggtaagaacgtatcttgcttagctcagtaccctcagtggaaagccatgcacagaataggtactcattataagtgcactggatgaaggaatggaggtgtggagccatggctggtggaaatgagatccaaggccagatgccctcgagtggcctggagtcccaatagcagaagggctctgtgcagcagggccttcctcctagattcaggcaatattgagcttgagggtttgtgctgcctccctgctctactgcacaggggctagacttaaggaacttgccattgctgcatttataccttttgtttcaaagggatccctgatgaatcatccaaacctgcacggagcctgagccccagggagggtccttggggtggctgggccatctcctgcatgtgacttagaaactgtgccacaaagagcctgatgcatcacaggacatttttcttgaaaagagattttagaataggatgtgatgaaggtctttgatgactgtgatgtgccaccatgcaatataactctgctagaaagggtcccatttgctcatccattttaataattatttatatccttcactgtcatttgattacaagcaccatgaaggcagggctgtatcttttttttttcattgttgtgtcctcagcctacagtgcatgtacacagtgagcactcagtaaataattttcaaatgaataataatagctaacatttgttgaggacttataccacacatgagtctaggccatttacacacattaactcatttcatagtcacagtaaccctatgaggtgagtactgttatcattctcattttgtggaagaaaaattagacacatagtggttaagtaaattgcctgaggtcacatagttaataactggtgaggaaagctttcaaagacttcatgaatgaatgaataagtgaatgaatgttttaatttagagtgtccacaaaaagggactacaatagatgaaggtgctttttgttttgtttgttttcttttttagatttttttaatgagatgaggtcttgttctgtcactcaggctggaacatggtgatgcgatcatggctcactgcagcccagaagtcctgggctcaagtgatcctcccacctcaatctactgaggacctggaactgtaggaatatgctgccagacccagctaaatctttgttttcttttttgtggagacagggcctcattatgttgcccaggccagtctggaactcctggtctcaagcaatcctcccaacttggcctcctaaagtgctgggattacaggcatgagccactatgcctggctgaaagctgtattttttaaaacaatcatcagagcatcagactttccataatttggactattcatactcaatatcaattaatatatttctctatataatatgtaatgttgtaatgttatgtaattatatgtaagattaaatatatgcaattaagtataatattacatatagcatatatcatttgacattactgcatgccagactctgtattgttttacataaattatcatatttaatattcgtaattctgtcaaagagatatgagaatccctatgaattcccatggtacagctaaagctcaaagtggttaacctcaaacatagagagcttactgcaaggcaggatttgaacccaagtctatttgactccatattcgtgctcttacctgctttgccatcctctctcttctgtagtcggcccaaagcatgggctaccttgtgctttccaaacccttgcccttctaggaagctaccaaaccctatggcatagtcttcatttcacagcctaacccaaggggactttcagtgccccaggcaggttttcccaacccccatccagtaggaagagctgaggcttccacagctcagaccccatggtgtgtcatcctgctattttagaacttgaagggtgccgtattggaggccatcctagaccaactaaatcagagtcattgagagtagggcccaagaatctgaattttaaatagatctccaggtgattctgatgtccaggcagatttgagaaccactggccgaggcccagcaaagagacaatgcatacccctcaggaaaagaagtagtggcttattgcccaggccaccttcacagcaccttttagaaccatggtggtattatgtggtatatatatatatatatatagatagatagatagatagatagatacacacacacatacatataaaataaaatcacattacttttattgtgtaattttattatgtaattttattatataaccataataacatatgtatgtaatcactacatattcattgtagtaaatttggaatacataaaacaatataaggaagaaaaataagatgacctatagttccaacacccagaggtaattcctactgacattttgattaattttcatctttaaatttttaattgaagtatatatagtaacatggaaatacacaaattataagtggacagcttatgatgaatttgcacagctgaacacagacagtcatgttaacactacccagaccaagaaacacaacatttgccagccccctagaagcccacgttgagcccttttctgataaatgcaccctcccaaagtagtgatcccgacttttaacatcatagattaattttgcctgtgtttgacatttatataagtgggataatttattatctactctttgaggctggtttattttgttcaatattaatttgcaagatgcatgtatgtcaggtatgtagttatacggtagttcatttattattgctgtatagtattcaattgtgtgactgttgtagtttgtatatgcattctaccgttcatggacatttggaaagtttaaagtatttggcagttacgaatagtgctgctataagcattcttgtacatatcttttggtgcatgcgtctgtgtttccatgaggtgcgtacctaggagtggaactgctgaatcttatgttccattctagtggatgctgccaaagttttccagaattgttgtaccagtacactttcaccagcaatatatgaatcccagctgtcccatatctccaccaacacttggtcttttctgtctttttattttagctgttctggtgagtgtgttgcatgtggtcttgtggttttactttacattttcctggtgaataatgaagttgagcatcttttcattcatgtatttctttttaatcttttacttattcacccactcctggtaatccttaattcattttttttaaaaaagtgaataaggccaaaaagctttccataaataaaacggcctggttaaagtactattttatttttcccttcagcgaagtctgtcatcttaaaaataagtgccatctaactagaagatattaaagaaaatgtgttttctgctcttctgtctcttagctcttttttcctatgctttcaataatcttttaacttttactggttccacaataaaattgcatccttttgagggatgtaatcttatgagacaattgcacacatattctccaaagaaagactagtaggaccattaaaacagaggaaaagcttaaagtcaaggtgagacaggaagctttcaagtagctaacggccaggaccagttgttccactgggaaccgtcaggaggggagcccggggagtggagtagtgagcatctcagagtggatgctgaaaatgaagttgtttcttttatttgctttgtgttttgctctttgttactgaaaaaaaaatgggcttaaattcttaggtgctactttgaaaatgatctcgggtgttacctgaaaaaaatgtgcagtatgagtttgttcacaagtggcaattacatatgtttgtgtgtgcctatatcctaatgacattgtgtaaactgttttgtcatctaaatttttcatgtaacatactttcccatattgttaaatattatcgggaaaatactgtttttaatggctatataatagctcttttatggatttgttgaaatttaatcattcctttattttggttatttccataatttctaaattctcaatgatgaatatatttgtacataaatctctgtactcttgtgatcactttcttagaatagcttcagagaaatgaaattaatggctcaaaaagaatgaatctctttaaagttctttgatacattcatattatcacatttctttccagaaaggctatcaatccactctctccgcacagtatctgaagggccaccctcactgcatattcgccagctttgcactcacttcaattacagtgtctcttgccatatagaagacggtgatttttacctaataaacttttatggcttctggatttaggaacatgcttagaaaagctcccccactccctgcacatgactagaagaatactctctaacatgttctacttaacagttttcttttttgtaataaacctttaatcctctgttatttgtttttgtatgtgatgtgaaatagggatatagctttatttgccccaaatggatagcaagttgatctctaagccacttactaaataatccaatgtttcttcagtattttgaaaggccatctttattgtaaaccaatttcctctatatacatggtactatttctgtactgcattggtccattggtcattctcacgtcgataccactgtttttggtacagtttcctagtacagatgatttattggagattcatagcacagtttgataactggcatggcaaatgcctcctcattcttttacggttacaaaattgtcttggctaacttggaaaactggcttatttctccagatgaattttggaataaatttgtccagttgaaaaaaaattctgctgcatttatgattagaatgggatcacacctgtcaatttatttgacaaaattgcagttccatacaggaacaggggatgcatctccttttatcaaggatgttaatataagtaaaattttatagtttgttttattattaatagaattgtagtttgttttcatgtatgtcgaaggcatttcttgtgaagcttccctagataggttattttttctattgcttgtgtgaataggaccttttttttttttttttttttttgagacggagtctcgctctgtctcccaggctggagtgcagtggtgcaatctcggctcactgcaagctctgcctcctgggttcatgccattctcctgcctcagcctctcatgtagccgggactacaggtgcccaccaccacgccctgctaattttttgtttttgtatttttagtagagatgaggtttcaccgtgttagccaggatgatctcgatctcctgacctcgtgatccggccaccttggcctcacaaagtgctgggattacaggcgtgagccactgtgcccggccggacctttttaattatatttttaaattggatgtttctgatatgtagaaaagccatttatttacaggtagttattctgtattaatcaatgccactgacttatttattaattctaatagtttttcagttaattttcttagattttgctaggtagacagttggatatgcaaataatgatcagtttatcttcttttctaataattatgtgaaaaaataaattattgcattggctagaacttataaaacaatgcttagttatattctttatcctgtcaactatacttctgttcctagtttactaataaatttcttttaaccaaaaatgagtgctgagttttatccaagacctctttggtatctgttaaaacttacgacatttatcattaggcttattaatgtgatgtattagattaatagggttactcatatataaaccatctttccatttccggaaatggaatgagctctatatggtgcatgttacatttttcattcaacttacttctaggtttgatttgttaatcttttattgagaatgctaaatatatttttaataagtaaggctattaagtattggagttttaggtttctggggagttagatttttatatcagggtttgattaaccttgcagaattagttggttgcatctcatctttttttatgtattgctgagtgattcctctaactcaataattgtctgtttttatttatttatctttatttattaatttatctatttattttgagacagagtctcgctctgtcgcccaggctggagtgcagttgcacgatctcggctcactgcaagctccgcctcctgagttcacgccattctcctgcctcagtctccggagtagctgggactaccggcgcccgccacgacgcccggcgaatttttttgtatttttaatagagacggggtttcaccgtgttagccaggatggtctcgatctcctgacctcgcgatccgcctgccttggcctcccaaagtgctgggattacaggcgtgagccaccgtgcccggccaataattgtcgtttttaaaagtttgaaatacttggccgggcgcagtggctcacgcctgtaatcccagcactttgggaggccaaggcaggcagatcaagaggtcaggagatcgagaccatcctggctaacacggtgaaaccccgtctctactaaaaatacaaaaatattagccagacgtggtggcgggccctgtagtcccagctactcgggaggctgaggcaggagaatggtgtgaacccgggaggcggagcttgcagtgagccgagatctcaccactgtactccagccggggcgacagagcgagactctgtctcaaaaagaaaaaaaagtttgaaatacttgtcccaaaattcatcttggtctggcacctttcttgtctggagctgtttagcaacatttccagtttcttctatggttattaatctaatcaacttttctacttctttttaagtttagagatttatattttctagaaagttcattgtgttgagatttttaatttattagtctagaaatatagtaagattcagatgtgtacagtctcatctgtatctttgattacagccctttcttaagggtttgattcttttatggtcctctgactttccacatgcccctccttgggcctggcaggggcaagggctggagagagagagagagagagagacagagagagagcacaagtgggagtagggaacagttgtgggcccatgtccatttccatcaattggaatggatatgtgtgagcctgtagacatgtcctcacctgcatgccatgtcatctcccagcccgaatgtctgttgtggcatatctatgcatacaccttgatgtgtgtcctggcatatgtatgtgtgtatgtgttcctccatatatgtgtcagcatgcatgcacacatggtctctgcagccatggagatttccactttgtgtgaatattgtgtacatgttcctgtgtgtactgtacctgtgttcatacatgtgcatgggtgtatgttcctgtgttactgtcactgggaggcacatggcacatctggctaaagggatggtagagtagctcagcacagccttggtgcttacatggcttattctctgccattttaaacaatctctcaaagggccagaaggtgaagaggaggtgggcttgggcaagatggggtgtggaggctggcccgtcctagagtcactctgtcatgactaacccaagtctggagcccaggcctagatgctcagcctgtgtcccctggaaaccccctcagctagacagagaggagagggtttactgtaactcatcagtcagggcagctgtctgctgttgccatggaaatctgaaggcagcatcttctgcaaggaccaggatgtagagtctagagaggacaggctgcatcagcctggtgggatcagtctggagtggcctgtgtgtgtgcgtgtgtgagagagagagaggtgggaggagaatgcaagatagtgagtgagctttctgaagtgggtggcgcatacctcaccattgctctctaaggcctcagccattactctggattatcgctgggtggcgctgtaagaaggggtgtacccctgagatggcttccctgtgcccatcaggacccggtctggcctgaggctgctcttagagtgtcctgggaccacctagacagatgtgctggcatctgcccatcatgggccccagagcccacccagcatctgctgcacactggctcctccttgctcagatgatggggtggtccaggaggcaggcccttaccctggccgcacagatgctgggtgatgggagcagacagacagaggcccctcaccccaggactcagctctgctgctgatgggctgggggtgggggcaaggacagggcaagagtacaggatgatgactgggggacaggatagagtccaaccttcaggtggagctgagggctgggacagccaatgacagtgtgtgcctctgccaccgcctcagtctggcaaggcataggaaaggagcacccccttggagtcctgacagcacctgtggagttggaagcaggagccctggcctccctgctcaccttcccactagccccttcgctcagggccctgtgacttctgatccctccctgtgacaggggagcctgggctcagcgttcactgcagcctgggcaaggcccttaagcccccaagagtcccgctctcacagggcatgggaggagcttccagaagcagatgggtgtccttgtttgggttgggggtgctggggagagcaggaaggagctggctgctggagccgcctgaggctggatctggaggacacagaggtgtttagccaacagttctgtcctatcccttctcagctctctgaagtcctccctgcacctcaagccagggcctgacctccagggaagcaagctgtcaccacgaggaagtgcaccctagctttcccacctcgtgctaccaggatgcccctcactctccttaatccagggcatgggctcagagggctggctggggtctcctgtcctggaatgtgcggccatatgggaatgccttgagtgtgtgagggccatatgggaatgcctgtgcgtgggggtggcatgagtgtgtgctgtgaggtgtgagtttggagagaagtataaataaatgatgggcacatgtgtgtggtgcgcatgcttgtgctgacaggggaaggcagggggacgtctggagtgtcagtgggttgtggtgggcagggtgaggcatccatttctgtgaaatgcctggggggagggaaaaggtatttggcacagtacatgtgggtacaaagcacacgaaggaattttgggtacatatgcgcatgggagcctttgtggggtgtggtttgggtatgcaggtaggctgtgtgtgaggtagagctggaggaaaatctatctgtggagtgtctgaggtgatgtgtgggaggcagctgtctacaggtgagcttgtctctgagtggtatatggggtgacatgttgttgtgtgtgatgtggtttgggagggtgaggggtgtgcaggcatgtccccaaaacaagcacatggtgtgtctcaagtaaggtgtgggggcagtgatgggaacgaactacagtatgtaggccaagtgtgtgggggaagggcaagtgggcgtttcattctctccacacgtcacgagttaggaggcaccattttccccctcaaagttgaggaaactgaggcccacagagtggaaacaagctggctggatcacacagcagggtctgttagactctcaggatcccagctctggcagctcacaagctaggctctggagggctggggaggggactggccctctgggtaatggcagtaatggagggtcccattcagttctttagggtgactctcctggaactggcccacagacagctcatgagaatcgattgcgcaataaaggaaaatgtttgtaagccctttgctcaacatagctgttattaagcatcaaactggccgggcacagttactcgcgcctgtaatcccagtgttcctggaccaaaccgagggtcagctgcttattctcaaggcccagtaacgagatgcagatgaactgggagagaggggagtttttatttctgtaaccggtcacagggagaaggcctggaaattattgccagaccaactcaaaattacaaagttttccagagcttatatatcttctaaactatatgtctatgtgtaagtgtgcattcgtctaaagacataagtgattaacttcttttaatctataactaagattcgagtcctgaagaccttcctctggggcctcagtaaatttacttaatctagatgggtccaggtgccaggggtaattaccctccttatcttgtcccctgcgaagtcacggaggtttggggagttccttcagccctccaataaaacttatttgtggaggcctggggagtttcttcagacccccaataaaacttgtttaaccttaaacgaggcctgttaagaattccttcattattttgtcatgctttaaggcccaggaaaggcctaggcaaaactcttggtgggcttttgttacatcccagcctttgtataagggcactggttctgtcagcttttaatatttgacttaaccactcagtcagtactgaaacagttgttatggaggcctgtgttagtgatgcctggcctgccgcaccagcactttgggaggccgaggcaggaggattgcttgaggccaggagttcgagaccagcctgggcaacatggtgagacccccatctctacaaaaaaatacaaaaattagccaggcatggtggtacatgcctgtagtcccagctactcaggaggctgaggtgggaggatcacttgagcctaggaggtcaaggccacagtgagccgagatcacaccactgcactccagcctgggctacagagcaagatcctctctctcaaaaattaaaaaaaaaaaaaaaaagaagcggtataaatttaacattaaacaagttatgtttacaaaggtaatatactgaaaactcaccacttcgtattcattttactgcctttccctgcgcttgtctgttgtgtctgcggggtggaactgccacgtgaccgtgcactgctgagcatctcctcgcacttcgatgctcagtcacatcacagattggccatggcgagggtggctagaccaggggagtcaacaggtgctgcacattaagacctggtttattgttttgttgattgtctagacctgagaaagtgatgggaaaaaatactactaatgcagattacattttaaagggtgtcatgtttatagttgctccatggtgaatagcagaaaacaaagatttttccagtattcagaaactattaacctattcagcaaagaagtcactccgaccaccagtgaaggagtgaagttctgacatgtctttgttgtttcactttcaacttacttgttaacataaatgaaaatatcaagcagcattaagctggaactacagtaatttgtcattgcaaccgtaggttggctacagataaagagttaggcgaaactcattgaatgggttgatttctgggacagtcatctggctatatggaatttacaataaagaatattggatatttcattagtatttgtaaattatgtgctatacatcctttgtgtcagtaaaatttataataaacttattgagtctacgcatgcagacattttctggagagcttgttgttaaatgtcactgttaacaccccgtaggccctccattacacatagtcccaacatgtctccttactgtgcagacggtgaggtagggtggggtggagggacagatgtaacttgcagagaccctgggagcagtgtcttaggtttccagacaagctgtggcttgtcactagatcagcctgacctcctcctggccgggggcactggggctcaggtgggggtcccgttcattggtcccttctctgtagcaggctcagggatttacaggtcagaggaagaagacgtggtcactgcctgtatggagctcacagcccagcagaggagacatccagtcgcagttagttacaccctggagagtacaggggcaaaaaaagaagaaattgcccagctgaggcaggagcgaggctgggacaagaggagctgctcagcggaacagtgcctctcgacatttagtgtgcagcatccacagatttgtgttaaaaatgcggagattctcttttggcaggtctgggcagggtggtgcccgggagtatgctaggggatggtgaagcaggtacccaagggcacactgggaaaagccttgatctgaggagacgagagggtgtgtgctgaggcaggagatgagaaagaagttctgcggggagatctgccgggagtttaggagtggctggagctaagccagcctggaggggagacagcagagcaaggcaggagaggggtcagggggcaggtcctgcagcctcgtaagcctcatggaagagcttggtttgtatcctttggaacgaggagcagtggaaagagccttgtcagcagacaagtgacatgctcgggttggcttttaaaagtgtaatgttcctggagcaggcagaactgcagtcaaggagaccagaaggaggctggggacatgtgaggcctcgatccgggcagaggcactggggacaggggaggggaccgataggagggcttcatgggtggagccacaggcgagatgaggagggttagggtggggcctgggtttctggggtgatgactgagcgaatggcaggactatgcacattgccagaaaacaggaggaagagcaggtctggagtaaggtgagttgctttgaacctggagacttagaggtatccctggaggggcccagaggcatttggggctcaggggagccatcaggaagtagatttgggagccccatggataggtgggaaagccaagagagtgaagaggtcacctgcggagaacacagtcacaagggtccagaactagtgctgaagggccaagaactcaggcctgcctggaccttgtttctggaaggggtgccagatgccaggtccctccgtacaggaaaaccagagagtgggcaggagaaggttggaggaggtcagaaccatgggtcgggttgctggccacctctgacttaggagttggaggccacagtggttaggagtcatggggcctcagttctagctccagccctggctctgctaccaacttgctgtgtgacctttggcagatctctacccactctgggcctcagcttcttcatctgaaaataagaaagctggaccataccagtgattttcaaatgacatttggagccccagggtcacccagaagcatctccaggaagcaggagttgagggtgatggggagggagagactgagagtgtggaaatctagtcccaccctgtccccagcttcatccagagccacttgcatttatgttttctgttagcctcttcatgaaaggatgttttccaactgataactactgggccagaggatcccttatactgttgtacgtatttggggtctgtgaatccttgccaacatagaagctgatggagtctgaggaatgacacacactgagaaaaccaagcatcatcattacagacactgtgtgaactccctgcctgccacccacacagcacagtcatggttatgtccatgcttatgtaggcctgggctctgcctagctgcgggtgatttcatcagtggatgccgctcagtttgcccctgcctgctggctggctcgtccccagccccaggcatcagggtgccccatggtggggcctgtgtggccctggcccttctctgctgccccagggctgtgaagccacaggtcggccccctcgttccttgatgctctctgtccattgtctctacaaatacaaagagagtctctgaacaggacaaagcacatttcctccttccttgggcctggcatcagcgacgatgccacctgtgtgggggaggactcagtgggtagtgtcctggcttcccttcagccccacagagcttccctcaaaccttgctgacagctgggcgctctcagtaaactgaggcaagcctgggcctagaccagtgtgtgggggcgtgtgctgtgggcagggaggatgagagagctggcctcaggatgggggtggaaacaccctgcggtgcctctacagggaaaaccaggtccttcaagtctgtgtgacctcagatcccaaataagtcaatgccggcctcccctccccgtccctcagagcagggcctaggagttggggaggggcagctttgcacaccccttgccctgggatcctggggtgcaagagtaggacgaggacagtcggctcagaggggacagagatcttgctagtttgctctgtgcccctttagcccacactcatgtccctgcatacactggaccctcctattgcctggaagttgtcctgcctcctgccgctgcccctacccgctaagagatccagatccccaaataaagccacactggaccccaggatcccaggcttggagacagtgcttttggggaactccaaggtcccccagctctcttgctacttcaggaacagtttggaggggggcccagtagaagtgaccccctccctgtcacctactcaacatcccagatagggctcagaaagttgctccaaaactcctgggaagagaccccacccctggagttccttcctgctcctcctcctctgttctcgctcccccaggactatggaggcttcagcccgttctcactcggcagggtggttggtggggcagggtgacgactctcggtgtttcctgacaacaggctgggggactcaagcgccaatgtgaagctgaagagcgtcctggagacagggggcggtgagacggagtctgcccaggccacaccagtggccggggtttggacctgggcctggggagggtcgctgtttgagaggaggacgcagctttataaaatgactccgtaagtatggcctgggcaggtgggggccgcgggcccccactgccccacctgggaccacgggcatggaccaagagctcctgcagcaggagaccctgccacaggacgtggggaaccagaaagcttgggaggttgcagtcctggggagatacacatgcttgggctgaggcggaggctggctcttggcctctagggatctagggagccaggcgctgtcaggggcctgtggagggctctcccagatgctctaggctactgggcagggccttcctctgaaggtttgtgtgcgtgtgtgtgtgtgtgtgtgtgtgtacacatgaggggttgcagtttctaccatggctgctggctcatgataagagccttttgaacccaagaccccaggaaggcaggctcacaaccttctttcttaggcatcaaaggctctagaacagtggtttgcatcatgagaagccctaggaatatttttaaaatgcacattcccaggctctgcccacagggactctagggcagggcccaggaatctttattttagaaagctccctgggtgattctgacaggctgcagctgggggaggaaaccactgctcttggcggacacctacccggggccaggaagcccaggctctgcctacagggccaccttagacactcagacgttgtctctggaaggtgttcaggtcatctgcactctcgtgggaaggagaggccgacatactcttcggtaaccttttcctgaggcacaggagaaagcatggagcacagagtgggccccagaggaaggaaggctcaggaaggggtgcgacagagcatcagggccagggactgccccatcacagtgtctgggcctgctgaggccggggaccctcacatctgtctcagggcccagcgcctccggtccacagcagcccctgtccagccacgtgtgtgagcccaggtcctcctgcatagacacgaggaaagagagatgagatgtcagaaaggactccctggagatgagcgcacacaaggacagttatgaaatctcctccacggagttccttgtgagcattttaaatgtcttcttaaaaaagaattcagttaattcaaaatgacctttagaaaaagaaagtaaaataaatgacctttaaaaccctcataattgacatgaagtttactgacttaactgaattaacatgaaggcagcatgaagtagccgactgcacgtttgcttccatggttgaagctggagtcaggccatctgattcggtttatttcccgtcttgccggcccaaggatgcacattcattttgccccagactgcacatgtccacacctcctggctgtaaagcatccgggagtgttcactcgacccagtttgctttagtcaatccccaagtgctgaacctttgggctccttccaatttcttgctattataaatatcatggctatgaatatctctgtacaaattactttcttagtattttactgggaggcattccccaagtggaactactaggttaaagggcatgaacaattttatagttcttgtcacatattactagatggttctccagaaatattgagcccgtttactgtgacaccaattatgtatagctgtccccacagccctccagtataaaggttcatcatttttatttatttatagctgttttatttactttcttttttctcattttgcgattttggtcaggagtggtgtggcgagttgttttaatgccgttgtttcaatgattggtgacattggacattctctgaaggactttgagaacctcataggcgtcatttgtcccacagggatatggcaggatcggttctgagtctaagagctggatcaggactggaaaatggatagctctgagttttcagacttactcagttctcagtctcccaccaataggccagaatgtacgtcagggccatagtttccaaagctctgaggctgaacgatgaatatggttttaaaacagcatcacttgccccagggagaagactgagatgaaggggagaaggagaacccgtggccccatgcttgtccccaccttgatggactgtgcctgagctccactggacaggctgcacagcctcttaccccagatgtgaccttctgggtacacagattaccatgttatgcttgtggctgtggccatagggataaaccaaatttggggcttgtagtacacttgcctgttgatcctaatgagcatccaggagctgcaccaagagtttacccagtacctgtaaaaccagggctctgatggtggctagagaggcctggctgggtaagatcagtaacatttgctggggtctgggccctcatgtcttggctgaggtctaagcatggggagttgtggaaaaggagactgttagggaactttgacgtaagtggggtcgaagactgtggccttcagataatgacaggggcctcctcagtgataccaggaactcaaggcagagacagtgagggtcaggggcatgaaacccagtgatagaaactaggtgccatggctgttgcagacagggccacagggcctcctgggatctcagagcaaagaggccagatgatgaggacagtaagtcagggcagacatggctggtggggcaggaggaactagcataggatttgaagtcagcaatttaaatcgtggtatcaaaggactccgcaaacttgggaacaaataagcagttatggatactcaaagatattgttggtaggagcagaagagtgatttgtgcaaccaaaggaggtcttggagtcccaggggcctctccatgttgaagcaggatgctaggggatgagaggacacagggccaatgtataatataggtagcaaggcccagcctcttggaggagaattggtggaagctggctgggggatcatcactccagactacacctggacttgggaaggaccctgtctacagaggccaagccaggatcatgaccatcaggctaaggaggaagtgtgcatgttgctggggtagcaggtgtcttgggcccactaaggtcctccaggctttgggaaggaagcagactccctttccctctcattcctggcctgctccccatggggccagggcattggtggtgctggagcgggtggtaatggacagaggagacatggtgtgtgccccaggttcaacaatgggagtgacacagagttaagaagtggtttcgtgtgagtcttagattcaggtagacctataccttactgtgtgacctcagttcttgagcctcactttcttttctctaaaatggggatagtcgtacctgccttatagggcagtcaagaagattgaatgagaaaataatacatgacagcactcagcaagaatagttgttaacaaatgtcagtttctttccatttgcctcttttagtacctagagcagagttgagtgtatctgtgggcccaaataggcctccactctagacgaggtggagggtaaaggaaggggcagcatgccctctggtaagcctaggagcagagctggaagagcagctctgcttcagggtttatctgacccaagggtaatgatgaatttggtgacgtggaatagttaaagtctggcaagtttctgagcctcgatttccttatctgaaaaataagttgtgtgtggccttgtgacagtgcatggaaagcccctagcaccactcctgcacatagtaggaggtccacacatacatgacagtgtggattctgtggttgcagacactcctcttgccctcagagtcatatcgcggtgaagcgtttctctctgtgagctcagagtccagcctgggattggtcagacatgaaataggttgtgcatggtggtcagtgcttgggcggtggctaatcatgtcaccccagagttggccgaggaggaaggggcccggggggaggctgccctgaggctgtgggggctccaagggtactgccaggggaagaatgggcactctgcagttctctcctctagcccagggtgttctgagagtgtccagaaccaacaggtctgctcagacgctggacatgaggttccacttggcacacagcatgacagccttttcccctgcaggagcgttaccagaggcaggcaggcagcatggaggtgaagggaattggaagggcctggcatgagtcaggaatgagtgaggatgggggcgaaagcaactccgtgcagtccagagggagctggctctgggttcagcccctgtacagctccacagcctgtgccctgacccggatcccagtcccagccagttactgtgcacaggggactaagtgatgaacctcgttctctggaggcagcagggctgtacagagggtccagacaacctggagagagagaggctgaagctgcctcagacttccctgggcagccaccctgcttggggcaacaccgctcagcagctagaggagttcagggttctgaatcccaatctgtcgcctgcgagctggagacctggggcaagcctagcctgtctgactcctcctgccctcttcagagctcacgtctaggagaggtgtaataactgcgggtgtttgacgacttcagcactggttatggaagcaggttgaagagttgtgacgagacctgcatgaacagcctaccaggcgtgcagcccctgcactttgcaaatgacctctagtccttgtcaccctgggacaaccctggatctttctggacctgcctgaatcctctggataacctttgcagcccattacctcccccaaatgcacacacattcacacacacagccatcaccgtgtacagatggagctccttcctctcagtaagtttctgacctccatcctgcccctcccgctccaggcagctccactcccggctcctgatctgctcccattcctccaccgtctggcctcaccaaatactggtctgtgaatggcctcactccgtaagtctgacgccaatgaggtccagcttctccagctcattcttctggctccccacctcctccagcaagatttaaaaatactgcgcatatgagagccggcacagggcattgttgctccccgtttcctttcttgctgagtcagggtctaggagagcacccacagggagtcctgcagccccaggtttggcccctggctctgctcctcatgaggtgtgtgaactcagccagttgttttaccttttgagacctgcttcctgatctataaactggaaataataatagtaccttccctccaggctgtcgtaaagattaaatgggaccctatatgctgttagcatggtgcctggcacagggtaagcatttaataaatgttagctactgttattattttgtgcctaacaaaatacttagagtgaatgacaggaaaaattctcctcatgtattcacccgacaaatatttattaaactcctgttttcttccaggcactgtactaggcactggggatacagcagggagcaaaacagtgaaaacccctgtcctcaaggagcttctatgctggattccacagccacacactcaagtctttgttgtcagccctcctctcccttagtctgcaccctcccctgagcctctgcctcagcctcctcccgggctcaggattccctgaatttccctctcctcacacatcctgtctctaagctccagatgcgcttttccagtcacttgcaatggggtgacctgcagacgctcaaacctggcacatctgaatagtaactcacaatgcccaaccccttctcaaacctgctattcccactgggttccctgaggagccactgtccagacccctcttcctccaacatgcagctcttctatcgccatcgccaccatgaatagagcacttagtgcaggcaccatgctaaaagcttttatttattaaatcatggaatcccctgacgtccctaaaaaccattccacttgtttgcagataagaaaaccgaggcggaaatcgttaaacagccttaggttacacagttaggcagagcccggacaaagagcccaggctgtctggcctcagttgtgcttttcctgccgctgtgctgtcctgcctcgggtcccatgggcttgcctcagctgtaccactgacctcaggcccctcctgggccgcatctagctctgccctgggctattgaagagcctgctcactggtatctctaattccctctggcttcaccacagaccctgctgccagggctgcctatgatcccctcccttacaggcgggatcacttccccagcaccaccacacccctgcacccctgcaattttccattgtttacaggcagcctggccctgttccagaccaacttccccagtcccatataacctctccaagacccttcttctccctactcattccccacgtgttacagccaggcaggccgtccaccccaatgctttcctaactcccgtggcttcctcaccccgtctacctttactgagctctgtatcctttaatacccagcctcaaaggccgtctctgctgcaaagccctgcctggttccctgtcagactcctctggctctctctgctgtgcccccacgggtcttcacctctggctgggttgacttcataccacctgggattattgtttgttatctgtgtccatctgtgtcctccagtaacccatgatcttcacaggccagtgccctgtgttagtcatctctgggtccccgtgactgacggggctgggtgcagtgcgagcctcagtactgaaatgaacagggccggcctacgaggtcactccgcgatttggggcaggaaagatctgagtttctttctgcactcccgtcgagtcctgctgtagaaaccacaaatggggaatgatcgttgaatcccagaagactgagcaggaagggccgctgcaggtcatctgtgttaattctttatctttgaaatgttggagtgaggcccagaaatgagaaagacctagcccacgatcactccacagggaggagttgtggttggaattcagacccctggcttctagcccagtgtgctttctgctttgctgaaccattccatctttgctttttctctacacaaaccacctactacaataacaacaattgcttatgctgaaaatcagcccagtctcatagctctggaacctctctttgtccccttccagataaccacaggacactttattttacacttttgtcataatgattttacactctcatttttaaatttagtattctttgtattctttcggggggggggggtaattaaccctaaattcttgtagagaaattaagttcttagagtagatttctgggttgcttgttttcttccattgacgtttcacatgacattcctgtccaccgtcacactgcttcagttgttgcagatgtgtattttcctatctaatgggattggtgctcctctcattagccgtcatcagaaatgtcttttattttcctatctaatgggattggcgctcctctcattagccgtcatcggaaatgtctttgcttttcttacctgttttgtttgtttttgttttttgctgttgtttttttttccttccagataatctatacctgggttatctagaggaattaggggcagacgagtagcttatcccagtctgccctaatcatgggcatccacacaggtcagctgaattggccactcttaattcatggctctgaaaatggtaaaaacggccattgattgagagaaacaggcaaaaaagagagtagtgggggcaccaatgccctgactaccccaaactctcactgctgcccactaatctgccatcctgggatgtggggcaggatggccgcaccgtgtgggcatgctctcacgggaaaatggaggtggtgttgctgatcgacactagccagcgaggcaacatggccacactggctttcttatcacagagcccacgttcacaaaccatcttggggctcgccctcctttccttaaatcatcaccacagggaagcataaaaaaatctctgtacattatcaagtttcagaatccccttggaattttgctttgaactaaatgaagtctcatttaggaagaatgactgtctttaaaacagtcttcctatcatatagaaatacattaggaatctccatttcttcaagttctttttataaatctcagttgcattttataatcttctttatatgaatcacaaatcagtctcattggtattattttaaaacttttcatatgtagtcttgtaccactgtaaatgagatctttttcattctcattttgcaaatgataatttttttatagaaatgttcttggctatttttccatctttttatctggcaactttactcaactttctgattctgggggttttcttgttgattcccttacattttctcaggtccagtacagtaatcatgtgcaataatataaaccatgagtcctttctaacatagtagactaataactgttcatcaatgcccccctcaggaactttaaagaaatacaagtagttgggccctcctcggtccccactgaaccataacttcagtctcagccatagggctttggcttgcggggcagggatgggaagtggattccagacccaaaagtctgcaaaggtggagaaagcctggcttctctaaaagcataccagtatagctacagaccagaaacttcattgctttgtaggaactttttaaaattttggtctgtgagcaagggaagtgagtgaaggatttgaagcagcaggtgcaaggatagatttgcattatgaaaaaatcactctcactgccatgtgagaacagactgcaggggggctggagggaaagggggtgcagatcattatgtaaccacagctaactcttaccgcctgttttaagtggtttatatatattaactattaagtccccaggacagcccaaggcatacaggtggttcatggcagagcacatttgaattgttcctaagcactcatcacctcgactctttttcacggagagggtgggagggacttcagacccacttacggagtgcatcctgcgctgccatctgtcttctgggtgtgtgactgggtgagggtgggtctgtactcaccgtgcctttttcataggggtaggtctagcctgagtgttctgtacactgctctcccagggaagtgggagcgggaggtgagaaatgtgtatccttttaacataaattatcagatggggcccatgatgatggagctctagtgatgttgggtgccttggaccttatctaatccaaccccctcatcttatacactgacacactaaggccaaggaaattgggaaggcacttctttatggtcatataggaggctggggacttaggcctaaacttgggattcctgacatccaagacactaatggtgtttttagatcaagtgagaacatgggcctacaacatcagcaaatgtctggtcacctgtaaggagcaagggaagttttatatgagattcatgtccttcaccaaaccgcttcagttgtctgtcagagccaggaggatggggtggaatacagttcagaataggcaggctgagatgcagatatggggagccacagcatgacagagagagctggggtgtgtgcggtgcagggccaggaggctggggccaagcagaggatgacctgagctagaggaacacacagtggcccgaggcccctcccactggggaagagagacctctgaagtccatctgagggccaacccaacttgcctgtctccagggagaccccagaaatcctcagaagtgtaagggctgggacagggccacctggcatgagatgcccagctcagaatcccagggcctcgtcctgctaagctgagcccccatcctcagagctcccacctgtgccttcctcaggatggaggtacaggaaggggccactctgcagcagcggagagggtggtgacagctcagcagacacagagacatggagagcaggtgggctgtgatcggaccaggagtcgggagagagacacagtgatgcaaaggacgcagagggggaaggaggcagaggcgggtactgccccacagccccaccacccctgggcgtgatctcacctgaggaagcctagaaggagtcttcacgcgtcgcctcctccaggccagagctcagcttggagatgcagagggggaagggaccctctcccttccttcccttcctccctcctagagcctaggcagggcagcagtggtgggaccacctgttctcaccctcatctgcggtgggcggcggaggccccatgccacaggcttggtgaggctgagtaaatccttgctgctgtgaccacccacagtgcttctgcttccttctgtataatagctcctcggggagctgccagcaatcaatgagacaatacaagcgagcacttagcacagtgctggccctgtgtgagggctcagtgagtgggagctctaagtactaaatgttgtcccatctccgtggtgctttggacttccagcacagcattcacagacacacgtcccttctcagttcatcctcacacactatgtgcagtaggcaaggaatacgttgtctccaatcaacagatgaggaaactgaggcgagcctggggaaagtggtctctggtcacccagtgagttagcagcagagaggataagaattcagctcccctcagtcttgtgtgttttcacagctgtgtttcttacataaaatacaagaatgctaacacaaaaaacaataaagcgagaattctcaccttatttcagagttgagtaaactataatcatcttcttttgtctcctaacagccctgctttaaagagtcaaagtatcagagaacgtttagtgctaaaaggagccttagagacagtcccactctctttcatgaagcacagagagaggacatcctcacttaaggtcacacagcacattagcaacttagccaggattggaacctggcactggtgttctttcctctatagctgctgcctccataggtcttggaacttttatccccacttcagagtctggaaaactcagctcacagcttgactccaatcccatagcaccaccttttttgggactctgcctcctcagtggtggctctagagtctgatatttagaatcagcagcagcaaaagggaagggccatggagcaaaaaggtggtgtgttgggagtaataaattttcaaagagtttaaattgcatttcagggactgattcctcttgttggagagattggtttgtgaattcagaataggattgtttaatatgcatttcacattttaaataatcatggttttcttagagcagggagaaaaacaggtcaaaaacacaaactcataggcttttctgaaaggttacaaaataaaatgttctttgctggaggatataaaggaaatggctcttgtttgacaaaggagagggctctgctagataaattctgcatttatgaataaatgaaagctctctcccgctcttcctgatcaccttaattccttgttgcctatctgcaaatccaataatgctggtgaaacaaacccctcctggaggctgagcacaggggcctgagcgctcagcctcagaaccactctttctatttataatctcagcctgtgctccccagagagctgggcttagatgccccctgggcaagtgggcaagaggacttgctgggaacagaaccttccccgggtcagagaccctgtactccagccctgggtctccctgcctaggaagcactcagcaaatgcctcagaataggtaaagagcaggtaaagagcagaaccgtagttcagcatcatccttcctgcacttcctctgctcccttccaagataaataaccaggctaagaattgcaggtgtttcttgcagccagttggctattgtcttagtgacacaccatattacactaggcaactgaggatatgtcaactcgtaaggcgttactatatatatgggtttttgtggtttttttttttaccaaatctattttgtaccaatagtgtgtgtttatcgtctgtcttctcttaacattgggggtggggatgttgtctgcactgttcagggatcactaggaggtcttaggggccaaagctggagctaagaggaggttcaaacacctggaagaaggggccacctggaatggaggatgtggcccctagggtggcaaagctgagacactggactgtgtctctcactctaggcatctttgtatgaaaccacatatgtgtcagctggtggggcttttttatagagcattatactcacctaaaatattgtattccatctgataaatccattactttgtcattaaaaattctctataaggctgggtgcgatggctcacacctgtaatcctaatgctgtgggaggctgaggcaggagggttgtttgactgaggagtccaagaccagcctgggagacatagcaatactcaatctctacaaaagattttttaaaattagccaggtgtggtggttcacacctgtagtcccagctactctggaggctgaggcaggaggatcacttgagcccaggagttcaaggctgcagtgagctacaatagcgccacttatactccagcctgggtgatagagtgagacctcgtgtctttttttttttttttttttttttttgagacggagtctcgctctgtcaccgagactggagtgcagtggcacaatcttggctcactacaacctccgcctcccgggttcaagtgattctcctgcctcagcctcccaagtagctgggattacaggtgcccaccaccacgcccagctaatttttgtaattttagtagagacgggtttgccatgttgcccaggctgctcttgaactcctggcctcatgtgatccacccacctcagcctcccaaagtgctggggttacaggcaggagccactgtgccaggccaaccctgtctcataaaaacaaaaattccccataaaggatgcttagtgatccatcctatgaacactgaattatttacttaaaggagtcctaattaatagacattttgtttatcttcccccagccaatttcccctattagcaataaagtttccatcagtatctttgtacataaacttttgacttcgttttcaatttcctttgactagttttctagaataggaattaatgagtcaaagggctaaggcgcccatcatctggttttctctggaggaaggtagttctctgggctctacaatgctcatctgcctgaatctgaatttgaactctatcacttcttatcagtgtgactttcagcagattatatataaccttttagttgcttcatttgtaaaatggggattataatagtacctaccttgaagtgttgctctgaggattaaatgggagaagtgatgtgtaattgttaagttgaataggcataggcatgactcatgagatgtaatcataaagcaaactttatttttgtctcccacagtctctttaaatttattctatagggctgttttcccttctaaaattatattaaatttagggtaagtcccatgacttttctgaccattttcaggtaaccagaggttgtcttgtcagtaattaatgcatcctgtctgctgtaataaaaaaaaaaatcttgaaacgtcagagttacaccatctctttcccagcacggtctgctgtaggccagctgcctgtggggaccttgcacatgacagtcctgaccctttccagggtccaaggtggaggggcaggtaggtaggagaggagatggttgggaaaggtcttcaacgactgtactctgatgagttgctgtcccgttgttctctgggccctttctctcactgggctgtttttgtgggttggtggagaccaccccatcgctggagtctcaccctgcacctcccttgatgagggtgatactttctccccgtagccgatcctatggtttctttctcaggctctgggaaacctggtctccctcagtgtcacctcctcccttggaggagccctcttgtcctggatctaagacagtcacatctggctctcttgctgggtgctacctctgtccacaagagacactcatgtgtgctttgccctgcaaaccagggagcacaggctggtcctgaagcagcagcactcttgctgctctttggatttctccactgtggcaccaagaccattttggccacatatcaactgacttaggggtctcctcaaggccccactgtctggctttgaggtgaaggtgatagcaccctgtacccctcccatttatttgggatcactggaccccaaaggctgtctctgaaattcattctaaacctccaacaaccttttttcaacctctctcccattttgtatgcattagagatgggtgtcagctaatggcatggacccaggttttcgccacctcttttccaagaggtgtatcccacttcactttggaatgtggtatctgttcatttggagccccaagtggatcctagactggaagcatcccatctcatcctcccattgccatatttgtctttatgaaacacacagaggagcacctggcatagagcatgcactcaacaaatgatagctgtgtatgatccaggctcacggactctctagttacattcacctcataaccattcgatctggttttattcctattactttgttttatgccctatgcattttatgtttcctgtagattatgcttttgtgtgtttgtgtgtgtggaaatgatttgctattattttcagcagtgatttggaaaatagacattgcttttaattttactagtggttgacctacattttttttcagacattgtaagcctatttatctcaatcatcaacagtggtgcaatggtctttgtatattctgcagttatttaaatgggaattacagagggctttatctggccacccatagttatgctaccatcttgccatgatgtctacccacagcttcaaaatggcacttgactctgttttagggctggctcatctttgtcctggactttactcatagctgtctagcagtttgccataccactagcctttctcccgcaatcctccattctgctcccaattatttctttctaaaggttacatctgggcagattattcttggcttaaaaccctctagtggtcccccactgggaaccacatccttagaacagagtctataggatatttccaaattataggataattgcaaacgccctagcttgatgttcaggatgacatatgacctggccctgccttaactttctaggcccatttcctgccacaccgaaccattcacctattggttgaatgctgccatgctggtttgcaccttggttttcaagtgcattgggcatgtactctcatgtctgcgtaactttgctcatgtcatcctctgtctgtatggccctttggtaaaagaccctagcacagtgcccggtcaattgtagaatctcagtaactgttacgtttccctcttcctttgttatcagcttatcaatatcctattcatctttcagggcccaacacaactatcatccttttccactcttgggaaggcttgtcctaaccttatctccccccttctagggacttccattgactgcctcttttctgtgtccccttgcccccagcacattgtacacttgtgttgtaacaccaacaccttaatgtagggtacagtcattatttcttcctatctcccttgccagaccgaaagctccctgagagcagccatgcacctgacccccactaaggccactgcagccctgcatcagcctttgaggggctagttgatgtttgattgatttgaattgccttcctcagactgcaaggtcacaatgccaagccaacagacagggcccaatttgaatggatatcatttatcattcatatccctttgcttccaaaattgactagagatggcccacactcaataaaaatgtcaccttaagtatagcacatataagactccatataggtggctaagtcccaaaatgctaaccttcttccctgggtgaactgattctgcttgggagagggggtggccctggggtcctcaagctcaggtggcagatgtgagggtctctgttgggctgcttcactccccatgcattccttcactccccctcacaaacatttcatcaccacgtttgaaaatgcctaaaatgcaaacaggatgatttaaattcatagcaaatatcttacccttgcaggatttgggcaggtggtgagggaggcatgttgggattgctgtgtggtggtgtttcagtccagataaccttgttcctggggctaaatttgaaaagcttatgcccttcttcgagggtcatggttatagtgcagttgtaaaaatataacttttgatcatggcctagtataatatacatcatatgactttctggagtagctttttgatggaagccaaggacgtaaacttaaaatgtcaaccacggaagtcatttgagtggaaaaagccatcatgcattctgagtagaatgttaacactcatgcactccatagaactcgaagaagcacacacgtcattctcctgcacgcgtaccatccaacaaatgttcttgtgcagtcctgttcagactgcagggccatctctcacacacatacacacattgctgcgtacactgaaacagtcctgctgcccccaacttcccatgcacacacacactcaaggcatacactggcacacagtcccttgtgtgccagtgtatgggactcacacaacccatgtgcatacacacatgtacacacatacacactcatattcatgcgtacactggcgctcagtcccactggctcccccacatgtacacacactcacactcatgcatacactggcgctcagtcccatggttcccccacatcccatgtacctatgtaacttctgcagaaagagacttggaaagccatcttacttctgcacctcactctgcctccagattttgctcccttaggacagagcctaaactgtctatttaatagattcaattactccaggctcctgagaccttccaactaaattctgattgctttaaggtgtcaggtaatttgggaataaagggaggaaaacagcttcaaattcttgaagggaaagtcttttagactctagctgtctctgacatggtagctactaattgcaactcaggaaggggtggcctggagggcgcggcctccaggggtcaaagcttctgatctctaggcaaggttctgccctgaaggacagaggcctctggggcaatgctttgctgctctgctgcggtctccagggtagggaccaatctctgctgcccttcctggaaggccagcagagtccaggccaagcatcccagcaggcaacaaaacagccctgctttctgccttctgcaccccactcccaggtgttttattttgtctgctctctgtccccagtgacagtgacagctcttggaggttgataaataatcagaggtcatagtgttcagagagcatcaatgttgtgcccgacagagatggatctgacctgtcctgagctccagaagcctggagagagaggccatgtgtgtgtgcatgcatgtgtgtaggtgtgtgtaggtgtgcgtgtgtgtgtgcatgtgtgtaggggtgtgtgtgtgtgcactacatgaactgtgattggccaaaaggaggctgagggtaagtgctgtagacccagaccttttgtgtgtgaatgctagcttcatcattgaccagctgtgtgactttgggcaagatccttgccttctctgtgactcagttcctctgctgtgaaatgggtatgctaatggtgcctaccttctagggtggctatgaggattaaacgaattataatatgtacgtagcacctaacacagctcctgacgcccagcaaataatccaaatattgtgggttattgtgttttataattaatgggcaagagaaggcaaggctgaagggctgggagagccctggggtgggggtctggctgtagccccagggcagcaggatgagccccctccctcagcccccttggctgttctcacactctctgcggggcagtcctgaccgcctatttatcatcagaagatccccgcacaacactcttctggcgcggttggcgcggcagaatccaggatgcacacgaggacgcccacggggcgtgtggggaccgtgcccctccgcagacctctcccggatcacctgctccacacgcaggccttggtgacccctcagcctgctgctccttgcttccgcccgccctgctgtgggtcccgcaccttctcagtgtgccatgccttgcattcaagctggtcctagtcacagccaggacctcctcagcgcgcagagactttcagatgatctttgtaggggtttttgcctccggtcaactgcgccccttaggaagggctttggaggacacagatcacagaacagtttcagctccaccacttcctagctttacggccttgggcatctcagcattcctattctctgggttatagggatatgatgtttgtctctcaaggctactgtggagattacatactagaaatttgcaagggctgggaatgcaatagaccgtaaatgttccccttcccttgacgctatagcttagatgggagggagccactgctgaggaaacacctccttaacccaaagacagagggttccccaggcgggggtgtgggaactcggaggtgggggtgagggaaggccaacctccacgcttcggcccggaggttcccccgcctcttcctgcacgactggattccttctccatccgcgcctccggcccggtccctgccccgccaaatccgcgcatcggtttcccatcccatagcgcagataggtagggcaggtacacagggaggtgttcgaatgatccccgtttcacagaagacgaaactgaggctgggaggcctggggactggcccggctgcagcgccgccgttagccgaaggtgggagccggcgcggtcacgcgcatggagcgtggatcgcgacgatttcgggggagggggcaagggcgctccgcaggccctgagccggccggggggtggggtctctgcggggcggggcggggcggggcgagggagaaggggcaggccgccgctgccacgcagtactcccgccttggcgccagaggggcgcgggacggtgcggtcggcctccccgcctccacgcgcgcgcacgacccgcgcactcccggagcttcgcccatctcgcctcgccgcgccgcgcaggcagccgctcgcagagccagcagccggggccctggcgtgcagcgcgggcctcggcggggcccagcgccccggcccgggaggatgcggcccggggcggcccgggagctgagcagggcccccgcgccggcccctccgggccccggcctccagagccgcagccaccgccccgcccccgagagacatgacttccaagccgcattccgactggattccctacaggtacgcgggcgccgggccggggcgcccaccactcccgactcgggacgtgagctggctggggatacgcggccggggcgcagggcaccgctgccctccccacctatcccagcactggggcgcgggttggagtcgctggtccttcctccctcaactttgagggcccctgcggactgctcccgcctgccccgctccacccccttatctgccagggttgctggaaggggcctgtgtgggccttgttgggtcaggcagcaccatgtggccgcctggggaaggagtccacactgctctgagccccctcctaggcccagaaccccagtcacacgcctgtgcagggtgcgcgcacacgctcatacatctgcacgcatgcacccacaggacgtccctgccttgggccaaagacgctcctgctggtcggttcacactctcaaagcatggatccgtgaagacagttattctgaaccaagagcacaccagtggtcatgtggacatgcacccgtatattctacacacaagaattcttgggctcacaaagacacatgcctgcatatctgtgcacgtccacctcctgtatctggagaataactgacacctgcttctcactcacaagtgctactcagtctctttcagacactgaataatctacttgctagcaggtctatacctagacacacaccagctcacagtacatagaactgccctcacatgcagaaaggcactcaagaatccaggcacactcagggaagccccccaccctctgctgccaggcactgtggtctatctcaaggatggctgggctttcccatttgcctgggaagggggcggggaggtggtctctggggggcccctcacaggtgcaggtctttccctatccactctactccattctattaccagggaagggagctcatcgccatggcagcgccagattcttggccacccattggctccttggttgccatgggctacggggctgtctctgtggaaaatgggtgctggactcctaaggcccactgtgttattgtcgacccaggtgcacgtgctagcggacggcaggatgagatcctcaggtcccgccttgtaacacagcttgctctctgttagagcctcataccagtcactgatagaaaatagttctgacagggctcttctctgagtctgtccagacagcgtcccaaatggaaaccagctgaaaccgcccaaggcttcttaaaagcagatccttctgaaaacaggcacgtggcctgggaactcagggtttctcttgagaattgttacctctaatctcagctcctgtgggggattcaggggtttccaggttattttgtgtctctccccacaaccaccagcaacaccctcacacgtgcgcacatacaggtcacccacaggctctcctgcagacacatgtagtcacacttcagtctcacatggattagggagctgtttccatcatggaaccagggactggggctgtgctgactgagaagagctgctgcgccagacagacgtccaggctggggcacaggtagtttctggaggatcctggcctttcttggcacatgtgggctgaggaccttctagaagacagtgcagccccatggagcgtcatcaaccttttctagccacgcggcagaggtgcctgggcggtgcttgtgggctgagtggactccggtgctgtggaagtacctgtgtgcgggggtccagatggcagggtggtggccatggaccgaggagggtgggaggggcagcacttacggctgtggagattatgacgtggttaggatctggcaaactggaggttgggccaggccaagacatggttctagaaagcttctcccagggagccagggactaaagccacttgtagagagtgtgcaggggtcttagagaaaatatgcctcaaacggaatggcttaagcctgttcctgggaaaggtggcccaggaaggtagaactgtctctaggaaatgatcctgttctagcaagtgcctagggccctggcatcctgcaaggagtgatttggcacttgcctcagcccaggtccaactactatctcccctccaccgccacccctccaattcctttcctgggccgcagactcagccctgaagcatagaatcctgcctccctggaagcctggccccgaggagcgtctcaacacccttatagccctgcactgcttgctttccccatgcctgtcactccacctcctcgttctgttgtagagaggggggtgtgtagctggaggcaggctatgtcagcagttgccaggatcccccctgccctgctggggtctttctgggcacgcactgagtgtggcaaagtactggaactggggtgcagacttccaaaatgggagacttgggctgagaggaggagattcaaattgcctcttgcattaactgggctgctgattgcagtcaaagccacatgctgtctgatcacagagaaaactggggcagaagacagacaaagcattttacttgcagatgggagtgggggcagggggtggcatgcacgtgctttgactggtgtgaggtttccctaatgtcacagcatgtcagagctggaatgtggcatttggtttgggagagaggggttggctggcttcttgctggttctgctggtgagggttttactccctctctaatggttacaccttgcattccctgggcccagcttattttctttagagaaatgatagttggtgataatcttcttatgggtaattttggctcagtgtataatgatcatggattaatctcacattctgagttcaaagggagccattgagtttataaagtttaacaattggaatgtttttgtcttttgtttctgttagtactaataatttctaattctgccagtttctctttacctgtgttcttgaggaatattaaatgcccttagtacatttacagccttttataagttgtaagtggagcagtgagagtcaggaaggactgcggcccacggcgtattggaggactatgctgggtgggattggggtggccccgtcctcagtgcccttgtcctcatggtcctgaggccattgcctggtgtttctctcacttggtcatgaactaattgagatcagggaacttatctggttcctggtcatgtccccagcacagacaagacgtccacttctttgaatcaaagtggcatcccgggatagcctctagggcttccttggctttcccagccccacacctgggttctaagcacacctgagggatacagtactctcacatcaccatgggacctcctggagcactgcttgaaaagcattctgtaggtcacagaaagagaatctcagactggaagagcctttacaggtcatctagttctccgtgtggatgctccctgtagcatccctgccacacggcctcccatcagatggctgtgatttctttcaagttcttccttaggttgaacctaagcaagtctccgggttccccctcctcctggcccttgttaggatcctcccaccacttcctttgttttgtagggagtagtgggactcctgacgccttccgttctgctgctaggttcggcctccgaggtgccctgggcacttggacccaccactttacttctggcagccttataacgactccctgattttcttgttgttctttagagatcaccagctgtggctcgtggtcgcatttgcatggctgagcattagaatcacccatggcacttgcttttacaaagagagagaggagtgggttgattctgggggatgttccccagcagttctgaatgaccaagtcagggcttagtcccgccagcagtttgaatgcacctgatacatttgggaactgctggctggaatggggacggcacatcctgggaggctggaactcctgtgagcagtgtggtcctctgccttctggagctgcactggttcccactgtgtcccagtaagctgccaggcgacagaagccacagatctggacttgccgggggtccagggttgcagccaggggcacagggttgcagccagatgccctggtggcctttcctctcctgacagcccacatctgtgatttcctgggtccagcaggggtagcttccactgtgactgaggggaaagaatgagggcaggaagaggagaaggtgaagtcaacatggaaagtgtggccagagggttgggtctgtccctagattccctgacccctgggcctctggttagcactgatggagtagctggagcatgtaaggtagagtctctgaagagagggagttcggaaacaggctagaggatgttggctgtgtgtgcttttccagggcacagaattgtccttgtgtccttgccccttgttgtcaatcgtggatgactgctctgatatctgtggggtgccttgggggaagtgagtggatgtagaggggcaggttccctgggaggtgaagctgccacctcgttggtgctggactgagcagatggattggtggacactgaagcctgggtttctctgccctcatgagccagtggctttcctgagcctccctgttcaggcccccagcaggaggtgcccgtgatgtaggagactccagggtcagctgaaagacctatccatcagcgccctgtctcttgtctgagtctcctggcggggctgcagctggcagcctgggcttggcagttattccataattggagctgaagtcattaaaaaaccattactgtctccttgtgtggttatcgtttaggtcagcctagaacagggcccatcagaaacaggcaggctggggaagcgtcggtgagaaaggaagatgccttaggaatggtgctggggtggagatgaggaggaagggccatctgggtgggggcggagaagggaactgggcctattgaggaagccaggggagcttttggtgctgctcttcctggagacagccatcgcagttgcccttggtctccacaacagctgctgttggctggggattctttgttattcaccagggagagttgttgcgcacttgtcgttagctaggaacacccacctggtacaagcttgtcactgctaggtaatcgtggtcccatctcgtccccttgcagctcttctagaacactgctttaccaggaatcgtgcccactctcagagcctccccattttagtagatttagtgtagaccctcctagctgggtcttgctcagccaggcacaggtggcttctccccggtggccgccccccagctgtgcatgctcctttccttctgtgtgcttgcacatgcccgctggtgggtgaggtggtaggtggctctctaggtactttggggatgtctgaggtttctggagcctcttcagtagcctagcccttgtgttcatccatatttctctgaaggccagtggttaagtcctttctccctgttatcttacctagtaatcagggtcaccgaagcctgtggctctttatcattctcccccatcaggaaatggaggtggaggcagaggaggagaaaggaatgttttcatggaaagcagcctcctgcctctggcataactgtgcatagtccatggcaagtgggatggtggcctctggtagggaaatgtgccccctgcatggatgagagcattaaaaggcactgggcagtgaggccactatggctggaaatacctttagtcagttgagcagctgctgtgacccagcatttccggaggtggcattgctgatgtgagtcttacctctcagctggatgtccccttttctaaatgactctagatgtgagcgtcagcaccatggaagtcatcttctttgtcttgctcagccaagcccagggctggggatggcccaggtgactgcccagtccctgccctctgaaagtgtgagtggcttgcgacaacctagaaaactgtggaatggcccctcctgctggcacaaagggaagccagcactgtcttgtggaggttgcacaggggccaggccactggcttatgacagtggggtttatagctgccctgtgcccaggcacagagcttggcaagcggagggagcacagttggattccagaccctgttgctcctgtcagccaggggccactgtacagagcttagactgcatttttcacgtgtgtcctgaaagttgtgatgtgtatgcactgtgcgtgtggctgaccacgggggacactggtgttcgggtctgaccctttcaagtccgtctgtgggcaaatgctttgactttgcttattcagtcaggctgttggcttgagctgtagagatgggagggttgtagcctctcaggcctggcagggccctcaggcattttgcgctctggtcctgaaccctttcttcagaagtcttcactgcagtcctccagcctgggtgtgtgccttccacaatgggatgcccagcctctcagccagctggaatatttagggacctggttgcatcctgtggtcctggcaatgccctcagggagccccaaatgcagctgtgccctcttaggcagatgggctgtttcaagaagaccaaggcctagaagtatggctcttgagcggtgttttctcctgtgctctggcagctgagggtttggtgaatgaggctgttgtgcacacagccccagatcacagctggggctcctctgacatgcagagcagctcgtgggtacaaggaaagaccttcccagatgtcaagtaggcaggacacctgctagttaaaaaacatgcatagtcctcatagatcgtggccaaggtggtgggcagtctgtgttatgggggcttccttctaccctctgactggctcccttggaggtgcaagtagttgaaggctcatgtaggtggtcaatgattgttccagctagaaagggctagccatcaggaggaggtgaaagtggcttcactttgtcctcagggtgatgtgacctcctgtttcccctttgcacgcacactgcgctcaccttcacacgagcacacccacttcttcacaggtgtctgcatgcacatgtgcacacacatgagatattcacacacttccttatggcctcacacaaacctaatgcactcgggcacgcctgtgcaggaacctggacacagtctggttcaggggcagcttcagaataactgggccagggccgcctggggcttccccagagctcagatcctcaggctccaacctcacctcatgcagctgtccacaccttggcctttatagcatttgggcctaggtctcatgcatgtgtctctggctagcaaaaagctaagtgatttgagttaccagttccctacttgtgccctgccttcctcagaggcatggccagtgcgggtgagatgaggctccctgtcccaagactggtggggctcaagaatttgatgtccccagggctgcctgtgccatgtctgcagcccgggaaggacctggtagctggttgctgggctgtacattgatgtgttgtgtccaccctgcagacacctctgtgtggcccaaaccctgtaggctgagggactggttggtctcttagcttcattctctcaaatgagaaggaggaccctctgccctctttaagtggggaaggggagtagacaaagtcaggactctactctgcccacctggaaagctaggagtttgctttcaacggatggggaaagggtctgccccagaggacgcagcctcctctagaatggtgggaaggaaggaaaaggctggggctggtgagatcccagtagggagctggagggagcagccccctgggtttgtttgaagcctggcctcgggcctggcttgttgctgggatgcctctggatagttctcttggatctcagtcaggcccggccctgctcagggatctgaggggagggtctcatccggtatttactggggagtccctggggaaacaggggtcctagcaggcttccaaagtggcagctcgagcccttttggttcaagctggtttcaagatggcaggctccacccttcctccttctaccatgtgggctcactgagtcccagcagccgtgatgggatgggtttaacgggcccagatatgctgggggtgggctctgggctgtatatcctggcacctcacgggcaagccctgaaaacccctctttcgctctgcagtgtcttagatgatgagggcagaaacctgaggcagcagaagcttgatcggcaggtgagtaggcctggggccgggtagaagggaagagtctgggctgggatctctgagggcagaggggcagggctgtccatcttccctggatgatcccgtctgattgggggatgggattcccatgtggaagaagagaggtgcactctctcccagctcagcactaaccctgccgcggcacatgggctcctgccttcaggcagctgggtgactgcagttggagggctggctgtgctgtgatcctgccagggcagccacctgggccctgttttgcctccctttcctggaccccaagtgttggggtgccaaggacatggggccttggcccaaggtgggctgtggaccccccgataactgggagcccgcccttcctggtggaggcagtgggtcagccaacctctgtgcctccatagcgggccctgctggagcagaagcagaagaagaagcgccaggagcccctgatggtgcaggccaatgcagatgggcggccccggagccggcgggcccggcagtcagaggaacaagcccccctggtggagtcctacctcagcagcagtggcagcaccagctaccaaggtataccttgcctgctgccccacatcccgtcactgcttcggggagcccgtcacttcctgcccacctaggcaggtgcggactggtcctgacgggggatgcccaggctgtgtatggcttccagcccaggcagacagctgagtagggagggcagagggaaggtggacctgtagccttgggcgcctgtgtatgctccagctgacacctcctgaatcaggcactgaggccagaagcctaaaccttttatgaggccaggagttcagaagtccaagttttgatctggagcatttcactgagtgcaggaggtagcttctaagagtagatgacctgctccccaccagtattctacattctgagaggaatccgtctcactgtcctgccccatatcaaccagtgtctcagtacaaacacctttttccttccctctctgcaccgtgtctgcctggcttctgacttgcagatccctctctctggctcacaactccttaagagctgtagtgacctggagcctgcagctcccatccttaaatgttccaggtctcggcagagcccagttgggagaaattctctgcagctcatcctggagagagcacatctccagagatggctgcagcacatctctgttctcaggaccctccttcctgcttgggttaggtgaagagtaggccaggccagactgaggggttgggggtctctgagcttgaaaggaggactcagactcagtctccactgccccctgctggtgctagtaatccaggctgctacttcatcaaatagtaattctaaaaaggttgcaggcatctggcttttgcggttaggaagaaccttagcagtcgtggtgctcccctccttctgtggcttcgttatgacctggagcctccagatacatcgaactactggtagttgcctcacctcagggctgagcttcttcatctaactgctggcccataccctgcctcgcagtattttaggttcttctctgggttccactgacccatagctccctgagccctttgtctgcacattggagggcagcaggtgggtctcacttgcctggtgcccagtttgtggctgggcacaccatacaggctcggtcccctgtgtgcatgtgtaccctccgaggaagcctactccgtttcttctaacaaaggctggctgtacatctgccagtggctaagtacagtgctagaggctttacctgcattatcttgtttcatcctcacaggaactcattatcctcacatcatcagtaaggatgtgggctctgaggggctcagtgacctgctcatagtactctgctagtgagcagcagggctagaatttgaacccagacctaacagacgccaaatggtctctcctccatattatgttgcctccctgatgaaaagctccttcatgctaattcccctgtgtgtgtgtcagttcagcaccctggccatacctggtatgcctgtactctacttgagaggccttcagaaaaggggaccagggacctcagcccagctgtctcacagaggcagccccagctgctcctcacagagctggccccagccccaccctttgctggcagccagctcctccacttcctttgtgagtgccatcccaagggtggtagtggtaccctgccaggaaggtggccaatgttctgggtcatatggcgtgtggcctgtggctgtgtggcatcacagccccagctctgccaagcctggcacctgggcgagtgaggctgcatacagaataggggcctgcacccaggattgtgggccctgccaatttgtgccagaggccaacatcgtgagaggtcattgacgtgcagtcgttttggaaggtatttcttggcagctgtgttccagatgatgtcaggacatcagaaagactgtggtacaactagcgcctctggcgtaagtgcaggactgaagtcaaaagacagtttctgtgctaggtggctcacacctgtaatcccaacactttgggaggccaaggcaggaggattgcttgagggcggaagttcaggactagcctgggtaacatagtgagaccccatctttaaaaaaagtgagcagggtgtggtgacacctgcctgtagtcccagctacgtaggaggatcacttgagcccaggagttcaagactgcagtgagctatgatcgtgccactgcaatccagcaagaaaaaaaaaagaaaaagatagtttctggtcgtgccactaccagttagttacctgctcgcttgtgactggggcaagccatttaccctctctggatctgtttcctccattataaaatggggaaacttctctgtcttagggctttggaactcgaaggagccacggtgtgttccaaggtccaaaatcagggaattgctattccctgacattccagagtgggctgggcctccacgacctttttcacagaggacatttgaacatgtgacatttgatttctgggaggtgcctactgcttctctaggggcccagtctttgtccaggttcaaatggtggacaaagctctggggaggctgctgcacacacgcgtggcctacccaggaactggtgtttccaggccactcccaccccgcctacagcattagttgcctccctgtctgccctctactggctacaggcgttaaattcaggggatcattccaagaggaaaaggagggagtctgatacacatcagacctcacagtttatcctggtttttgacctgctggctatactcattcatgttacacattcattcagttcttaaatatttattgaggtttgtgtcaggctctggattagaggctgtaggtcccaagtgagcacaaatgggtgtggtccctgctttcacggaccttacagtctaggtggagagacaatgttaaacagatggtcacggggttgctttgtggaaggaagccaaattctgtgagtagatgacaacacctgctctgacgagggaggcaggcacagcgtccctcgggaggtgacatccaagctgaaatctgcaggatgagtgggagttgatcactgaggggggcgagggggagggcagtgcaggcagcaggagcaagggccctgtggcaagagggagtgcagtgcatgtgaggcaacagaccagcctggtgtggctgcaactcttggtgccccagaggtggggagtatgtgtttattttagacctaggggaagggagagaatgttggtcttcagcttaagagcaatcagaaaccattcaaggattttgagcagattggggttctgcagtatggagaatttggaggccaccagctgggacccttctgagacctcactgttggtgcctgtagcttcttgtgtcccagagttgttgttctgagcactcctacaccccagcctcccatgggctcatccccgcagagccccctcgtaggctccctggagtgcttgccctggttgtggtctcttccagaagatgcagcctttgttctttcttccccgtcttcaatggccatatcctctcagacattctccctgcccctgttcaggctcagtatggtttggtggcccagaacttttgagtgcgcactttgttggctgatcacaggttttggtctggctgttgacttgattacactgggctgggggtgccgcctccttccagctgggcctgccctggaatctttgcctagtagagatgagtgggcctgatcctgtgggctgtagaagtggtacaggggccctggtgggactcggggtgcagtcaaaaatgctgtgctggggactgtgttcaggtgggagctctggtctcacccactgcctgtttctctctctccatctggggatgtttcctgagcagttcaagaggccgactcactcgccagtgtgcagctgggagccacgcgcccaacagcaccagcttcagccaagagaaccaaggcggcagctacagcagggggccagggtggcgccgctaggaaggagaagaagggaaagcacaaaggtcagctcacattctctacagccctccccagcaggcctggcctccactgtagggctggggaaggtttgtcctcctgacttggaggggagggataggatgaacagcctcagggaagacacagactgccactctgggcaccccctcaggtggctcacaggcctcatctagcttgggaggtgcctgggctgcctctgggtgtgggcatgcctaccacactgccaggaagtgaagtcctgctcagctgtggcccagaaccaccgtcccccacctcagctaccttggcctgagcaccctttatcatgacccctcaaggaggatctcacccagcctggactaggacactcactgcactgggggctgactgcttcccaggcagcttgccccatccttatgcagccctcgccgtcagctcttcgtataatgtggacttcccttgactccatattctagtccaggttccaccctctggaccacagaccagcctgttccctctgctcctctttctccagaaaagacccctaaagattaaggacagtgattggcggtacctgccccaggtcctgtctcttggctacacaccccgtttcctcaacttttgttcacggacagtggtttccaggccactgcgtcacggttggacagtgatgtgtcacaggccatgggcttctggagctggccgagcactctgggcatagctcagtaggcgggcagggtggctgccacctgtgtgggtcaggccttgcttctgttgctgaagctctgtggtaacgggcaggaaagctgacgtaggatgggagatgctccatttgggaaggcgagtgtatgccaattgcaatctttctcaaggggcccacgtttttaatgatgtatgtgagttactgcacgtgtgtatgttgtgtctgtttgtggaagaaaacaccagcattgatggcttgtagctggtcgtgtccatgaatgattgctggccttgcctatggtctggatcagtccttgttctccatcttgtttttccactgtgcagttggttttgtagatggctgccgtctgctttaaggacgtgaggtgttgtaaaccaaccctcggcaattaatttgggggaagagcagaagaaatgaagcccacatcccttactagcttaccagttgttaacaggctggtgcaatcattagttttataaaaatcacttttgcaaataaagttttgcagagggtttccccactcttccctcatccccttcatggacgtctgagaatccaggccctcctctcctcctcctggatgtaactcaggcgtgtccgtggcctgcaggcaccagcgggccagcagcactggcagaagacaagtctgaggcccaaggcccagtgcagattctgactgtgggccagtcagaccacgcccaggacgcaggggagacggcagctggtgggggcgaacggcccagcgggcaggatctccgtgccacgatgcagaggaagggtgagccccatggggacccagtgatacccccaaaactcagtcccaggttctcagatgcacctttctctgggagcatggccttcctgtgtccaaacccctccctggcaatggtgggtgagggtggggcacacttcggagacaaatgagaaactcttaggcagggcccctgctaaggccccagggaggccctgatttgggggcagatttccttttccttttgctccttagaaaaagctccttttgcaagaagtttcccatatgtttgctgagctactgggagcagggccaggataccaagagacggggtagatcctccgtggaaacctgctgttcagttttcccaccacaagccctgccctagggagcccctggtgcagggtggcagagggaagaagcctggcagtgccacacattgtgaggaatctaatcaaggatggcttcctgtacaaaggactttgagacaacttgaggatggggatggcattcccagggaatggcaggcgggaggacagctgagatagaagctcagggcaaagatgaggagtcagtgggtcccctccacattgggctgaggaaggagctgaggcctgtgccctggcagattccgtggtctatgccagccaaggcctctaataggcctgaggtcagaaatggagattcccagttcaaggtgagctcagtgcaggccttgatacacaagagacagtggtagggtggctgctaggtagtggggtaatgtagggactgagctgaaactgggtggtggggatatatcctgaggattgtggccagccccggctcatgtgtgtacctgagagaatatccttttatatctggacatgtgtgggaatatatgtgtgaatgggagtctatatgtgtagatatggctaagagtgtgtgcataagtttgtgggggtacaggtgagtcagtgtctgaacatgagtatgtgaccatgtgtatttcaggggcagcgtagacttctcctccttcatcccttcttcttctctccttggcccaggcatctccagcagcatgagctttgacgaggatgaggaggatgaggaggagaatagctccagctcctcccagctaaatagtaacacccgccccagctctgctactagcaggaagtccgtcagggtgagtgagtgagtctgcatccacagcagtttttggaggactgctcatccgttagaggtggactgcatgtgaagagatggactcgtatgcctttaggagcttctctgctggcctcttatgtccctctaccttgcctcctaacctcttcagctaggccagcagggtgatgtatggggggagatgcagttggacaggatgacctctgaggacctcccgtatctcccatctccacctctaggaactgttgagggcagggctgggaagatagcttctgaccccaggcccaggctggccaggccccaatcccaggatccttccctctctcccaccgccacgttaggaggcagatttggatcccagaccaccaatttgggctgcttagggtccttggggctcaggcacctattctgcatccccataggaggcagcctcagcccctagcccaacagctccagagcaaccagtggacgttgaggtccaggatcttgaggagtttgcactgaggccggccccccagggtatcaccatcaaatgccgcatcactcgggacaagaaagggatggaccggggcatgtaccccacctactttctgcacctggaccgtgaggatgggaagaaggtaaggttggtctgggcatgttatcatctaggctttacagccctttgaaatcctaggggctgaaatgtgactggaagtctcatatctaccactgacctctcagttcctcaaagaaactgccttcgtgtctggtctgtgcacatctttgtgttttccagtgcatttgtgtgtgtgcacatatgtgcgtttgggagctgacgcaacggagagagtctgtgtgagtggctctcatgactgtgtgcagaccagaggctgagtctggaatatgacctcattccactccccaaggtgttcctcctggcgggaaggaagagaaagaagagtaaaacttccaattacctcatctctgtggacccaacagacttgtctcgaggaggggacagctatatcgggaaactgcggtactagcattcccccaggaagcaggcgggagtgggagggaggggcaggggcaagctgtctgtagagggcctgaatcttcctgaaggagatctaggccagggatggatactctcccaggatcctctctgataatcacatccaactggaggcctatgtctatgccagcctagagccagacttggagatgggaatcacacacccgaccccaagctgttcccaggaggtgggtgcaggcccaccaagagtgatggatccaaccccagggtgtcactgataacgcaggccaccatggaagagttgccttggctccatggtcaatgccaagggacagggctgagagtgagctcttgagggaagagacacacagcaatcttgggggtggggggcagtggtgaaggggcaggaaggctctgagcctaggcctccaggtgggggcagtggggaggtagggtttgctgaggaactgagtaccagatttggggagcataaataaagatgagaggtcaggagctaaagctggagatggggctggactgagacttaggctggctgcgacagaggagatctcatcctctctccacgggtgctaagcctcttccactgtcttatcagatgccattctgtttgctcacctcccatgaggagaactcccatgttcccccagataaatcttctgaagaatcctgattgacctccctgaattgctctcactgaactgaaatgcactttgagtcaactcagagcaagtccaggccttctgcccacgaagtgtcttcaaagatgtggattcagtgagcagtatgcctccctgggcctgctcctgttccagcccagaatgttttgcaggctcctcataggacagacgatgagctgttccctgctctggggcagagggtgcatgactctatactgattgtgcctttatttcaggtccaacttgatgggcaccaagttcactgtttatgacaatggagtcaaccctcagaaggcctcatcctccactttggaaagtggaaccttacgtcaggagctggcagctgtgtgctacgtgagtcctaggttcgggggtctctgatttccaaggtagatatgaaatccaggacttgatgcctgatctaggggctatcccatccatcttagtgggtagacaaggctgtgtggagaggggctgtcctctgtggagtgttcctggcctaggacaggggctctggctctctcctcctgacttcagagctcacaccacagccggccatctgcttggggagctcagaaaaccaggcctggctctctgcagtccaggccaggagtctcttagacagaaggagacggtcgccctgggttcttgtctgtgcatttcccagatcatccctctggcatgccaggttctacatggattacacggcactttgtcatctcactgaacgttcaacctaagaggtagatcctattttctttatagatgaggaaactgaagctcagctgcagatgtcacacagctcaaaaacgaccaaactggaatataaatataggggattactctacccctttgaacctttttcttcatttttaaaatcaggggtgggtatctcatcaacctgggcatgggcacttcttggaggccatcagtaagtaatccacagctactttgtatgatcctgtggtgccacctgctgaccagttttggggaggcagcctgagtcttcaagttcttactgagctccaactaagcatattgtttgaggcactaaggatatagtaatgaacagacataaatgtatacctttatgggacttaaagccctagcagggcagacaagctatgaaacagatctatcagtgaagtaagtatgttctttataaacactaagaagaaaaagtaggggaggggagataagaaatgtcaaggtatgtgtgagaatttcagaatggcagggagggcgtcactgaggtagctcttgagtaaagaccagaaggaagtgaaaaacagcagtgtacgtgtctaggggacacagtgaggacaaaagtcctgaatgcctggcatgaagaaggaatggagtggataccaggcagtaaatggtgaggagaggaaggtcatggggccacgtgcaggtgaagtcacatctccagctttaacttggagtgagctggagagccactggagagttctgagcagaggagaaagatcatctgacttaatgtgcctgagcactggctgctgtgttgagaacagatggtgggaaggaggaataggagggccaacaacagaaaccaggagtccaggcaaaggctgttagaatgatcttggtgagagaagctagtggtgaaaagtggtggaagtctgggtataattggaaggtggagctgacagaaactgctgatggattagacgtaggatgtagaagagaggactcgagtgtgaccaagtagtttgccggagcgagtggaagaacagcattgccgtgagcagaagcaaggatgacgcataagaggagctagttctggcagggtagagacccaggggctcagttctggccgtgttaggtttagagggatgtgtgttagacttcggagtggagatggtgggaactagctcttcctctttattcccgtcccccccaccttctccagtaggtaaatagacgcctcaggtggccagtgttgcgttctctttcccaggagacaaacgtcttaggcttcaaggggcctcggaagatgagcgtgattgtcccaggcatgaacatggttcatgagagagtctctatccgcccccgcaacgtgagtgtctaccccttcctcccctctttccccatcatcctagtctctgcatgagcttctaagggcagaactccagctgatgtgtgtatgtggaggggtaccatgtgagaaagccctggaggtctagggaaatccaaggacccccattcccgggatagatccctttctggggtggtcatggtgccaaaggcctgggcctggctcaggtgaggctgccctcccaggagcatgagacactgctagcacgctggcagaataagaacacggagagtatcatcgagctgcaaaacaagacacctgtctggaatgatgacacacagtcctatgtactcaacttccatgggcgcgtcacacaggcctccgtgaagaacttccagatcatccatggcaatgaccgtgagtgtttctgtccctactcattatggtccgtaggatacccaaggcccttagcgtagggttcagcccacctagccctgcctacactggctagagtttaagaatgtgagctatacagctaaggttagatgtatggaactttctaaccctaatgactgggaggtcctggaagaaccttctttgcagccctggtcctagattctgtgtattcaacggagtctcaggcacgggaacaccctttaaaaggacttttcctcttttctgtcccctggtgttcacatgcatcttactttgtcctttgccatctgccacctctttcctgccacttctcccaattggcctttgttttacttccctttgtgattcccctggcatctctgcttctcacttgttcttccctcatgtggtttgggtgtctgtctatccttccctggctctaccattcctgtcctgtccttttctctgtctgtgcctgtgcttggccccagcggactacatcgtgatgcagtttggccgggtagcagaggatgtgttcaccatggattacaactacccgctgtgtgcactgcaggcctttgccattgccctgtccagcttcgacagcaagctggcgtgcgagtagaggcctcttcgtgccctttggggttgcccagcctggagcggagcttgcctgcctgcctgtggagacagccctgcctatcctctgtatataggccttccgccagatgaagctttggccctcagtgggctccctggcccagccagccaggaactggctcctttgcctctgctactgaggcaggggagtagtggagagcgggtgggtgggtgtgaagggatgagaataattctttccatgccacgagatcaacacacactcccacccttggggtagtagtgtgttgtagtcgtacttaccaagctgagcaacctcttcagctgggaaggccgcaagaggcatagagggagaggaagcacactgcagggctgctgtggcccagtcgtccgctcagccaaggagtcagatggcaatgggtactccagcaggtaggggcacagtgaatgtgtgtatgtatgaaggccacatcaactttatgtagcaaagggcttggtggccaagcctggcccttaaacaactgcagaaagcccttcaacttcagaaggcctcactcaagcctgagagaagttgggagggtggtggggacaggtaagtggcaggaccctgtcaggattgcaggtgcctggcttgctgtggctatgggaatcagctggtggctaggtttctagcgcatttgatttctccaggtttgctgtgtctcacagaggcagtaggaacccagctctcagggctgtcttggtggatgggccctgcaagacacaggctcagcatgcagaagtgcatgaacagggtccctggatcagggttgttctgggagtcctgtcagcttccccaggagctctctgctgagcagcccagcacaacccccaggaaacacaaatggggtccaggtcaccagcctgactgcacacagctaggcatgcctgggaatcctgctgccagagaaccattcccaagccatggcatgctccttgaagaatctctcctctctctctctctctggaaagacccaactttctcactgctgtcagccaagtcatggttggtaaccatgtaggttcttgggagggaatgggacagggtgaataaagcagggaatattttagaaccacaagagatcagcagtggcaggacccttaggaatctagtacaaccttgttgctttaggtgagtcacactcagaaaatggggcttgccctgggtcacctagctggttaatggcagcattcagaacttcaagttctcttgatttctttgttcccactgtcccccaagaaactagtatctctggcctcctgggggcccattctgcatgccctccccacttcccccgattcagagacttagaagcatcagagttgataaattagattgaaaccattccagtaggaaatcaggcagttccctgttgaaagttgtctggctttttgcacgtgagtatgatccaggattggcctgtgtctggcccctccgcgagggctactcagcagtaagcaggccttagtacggctgctgcacacttctcggtctaggtgggagagagtgcataaaggttctggggctgggcctgagcctaactccctccactaccgctatttctccttggatggcaccatccaccctgcaggcttgggaactgtaagctcaagcttttgctcatttgtcatttaccctggtggaggcttcttgcccagatagagatctgaaattggtgggaagcaagcaggggtcgtaccttgctttagagtagatgtttggaaaagctaagtagaaattttttaaaatagaagttgtattttaaacgtgttaggctttataggtgaaggacttgttttgacttaagtagaagtaatatgctctcatttctttgtaatctagattttcctatgttgaatgcttaaagcaaggcatacctgtcctagcaggatctgcccacacctcggccgtacatctctgtgagagaccccctccaacgattagcttttgcaacatggtccagtttctagagggcactagaactttgtgccagcgctggcgagataccatggtgccatcctcctttctatagttccagtttagcccttccctgcctttaaggagaagagatcttcatggtgacatttgagatgatggaaactagatcgtctctaatgttaggtcaagctatttctctggatctatgattttaagatagaacaggctggttctgagttctggtgagacggagaccccggtggcagtggaaaaatcagaagcacaaaggaaaactcttggcctctgctttctcctgtagcacaaagagggagttggctggatcttttggtggagtcaggaaagacaggctgagctttctagcctaagtgtggagaaggatagcctcagccacaaaactctgtcaggcattgaatgacaagcatcagtagctgagtgcactcctggtgatcctggttttccttgaccactggccctggggccatgggtgcatggactcgtaaagctgctagggcccctagaaaccacctgggttcagcctctcccacaataagagttcttgcccttcataccctctacctggatggatggtctttgggcagggaattaatgacagaatgagcagtccctaatggtattgggcagttgggagtgagtttaggcagcttctctgtaaccgcttctggggccacaccccaaaactctacaccctctgccccagaacaattctgcagagtggtgaagttcacttccccaactcttctccaagtctagctttcctttccttctggctccaaggtgctctgtgtccgtctgtgtatgtgtgtgtctgtgcgtctgtgtgtttatttggggaaaagggcaatcagcaatcaactgaggtttcttaattgtgattatattcctgagaatgaatgagtaggaaaggaataaggatgttgttatgatcgcctgtggattttgtccattcatctcatgctctctgaacagaaggtatacctgggaagataccagctttttctctcagggttctgagtcagaggacaccatccaagaatgttgttagcttttcagttcccgctctgcattgcctgaaaaaactggtatgttgcacgtatgcttttggttgaaattgaacatactctagtgaatgtgccttaaaaatcaagacactagttcagaggaagcacataatgtccagatctatggcgaacacaggtgttggaagccaggactgtgataatcagaagctataagagaactttcggagcctgcctccttcagtgacaagtagggcacaaaattctagaagcagaaggttgtttttttttttttttctccattctgaaaatagcaggacatttacctcttaaataaacttagcatttagaggtaattctaaatttaacaagtgacagggttggtttcaaagaaaaaggtccatgctttgcttacaatggagtctgcagtgaggggagatgctgggatagccatttccatggctctgttatgcaagcacaaatttcatctcctagatggacttcctggttttctcttactgcagtaacactggccttcccttctctaattccttaccccagctgcggcatccctgtgttaactcaggatgccaagtggccctcagattacacttctccagatagctgaatgagtctgctttcactgtgactgggacctgaatgacctgcagtcagggcccagagttgggactctatactaccctgggctctggtctgtaggtttgtagtagccaccggtaataagccaagggctaggctcttgtttgagtttatggccacctggaattttcagtcatctcatgatacaggcgggaggggcagaacagatagattacgacaggtttggtttttaaattttccaaccaagtggaaaggcaagttggtcttatagaaagcactactgcacttagtagctatgtgattttgagcaaaccacataatctctctaggtccattttcctaaccacaagataaagatgttacattgtcaaagcttgccgtaggatttggggtgaatgaaaattattccttgctttcatcactacctttatagctctcatcactacctttatagctcatcactgtgcctttttttctttcctaagaaagacatcacatccctctcctctcctcctctgtgctcctgtccctccctccccctagcaaggtccaggcaaagctggagatgaggctgagatccagagtttcctagaacgcaacttaggatggctaggaaagggaagcctgactgctcggtcaggagggtgcagtatctcttgctgggaacacagccagttttcacaatgcctagactgtgtatgtctatttgcacaagattgtcttttcctattttggagtggtcagacattttatttttgttcaagattatctggcgttttagacaaatttgcaaaactgtgcttttattgactttttgaataaactttggtattctggagcaaa

SEQ ID NO: 656 - DNA, 63006 bp, Homo sapiens
agcccgtgctccggttccggttccggttccggctggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggtaagagcaggccagctccctctgagcttcccggcgccgaagagtacggagaacgctgcttgagggaggggtgactctgagagtctgcagccttcaccgaaatatccaccaaactgactggagagggcgggcgagacggcgttgaagggccaatgcccacggttccgttgttatcagcgggtggcggcccagatggttctgctgctggaagggtcaggaacgtatgcatgcaggtctgtgcatcctctaggtggccttgcgtactcccgtttaggcgcagtcccttctctcttaccccgctggcttaactcatctcgtcaccatttgttcacgtgctttgagtcaagggttcccagttgggtttccctctttaggttttccgtgtactttctgacgcgccgcttggtacgaaatcaaggcaaatggaattggtacagcaaaccttaagtcgttatgttttttcaacttggtgctgggcgctcactgcttcaggctcttcttgtgcctttaaaaatatatcttgaagattttaataaccccagtttcagttactgaggtggttatgaacaaattattacgttccccttattgaaacagtatttatctgttaattcttcgttgttggcatgatgtatgtggtgtttaaaaattcatcctcttagctgcactggggccttttacagaatgagtgtaaaggcacggtgctgaaggctgggagaaggaaccagaacagttttctataggtcatgaagttctactggtaactttctcctgtaaattatccttgtaatatctttgagacatgattttacggtgtctgaacacttccagtaatgtttaaactgttgattgctggacagctccttttgaactgtaatccacttccgtctgctttatgcacattgactgtagttccattctcttgagcatcatacacactataaatgcaaagcaccaagctttaggggtggagggcaggttgaacacataattctgtttacagaatttgcctgataatctttatgcttgtaagactatccacttgggacggacttctaaaacatctttgcgtatttgttctttttttttcctttctgtcttattgcaataatcccaaagatttttacctgctttgtctaatgatattgtctactttgaagaagagtcaattcatgatgatcctgaacagtgaagattcttcgaaaacttttttttttttttttttactttccattatggtgaattatcttgaacaagtactattgactgtgagtgggagacactcttctgaacgttgtagaaaatgtagagtggagattagacatgggttgttcccttgagaactcaagtgttggtattcagtgttctcatgttaggatctttgtaccttcagttctctttattcctgaagtgctgtgcttttccctcagtgcccttctcatcattcaaatttctgctcaaatgaaacctcctcagagagacttcccctgatgacactaactaaaataactcttttctcccatcattctctattttatcatgttttatattcttcatgataggcatcactatatgatatggaatattcttaagtgtttacttgtttgtttttttgtcttcaccttctagaatgtaagtttgcaagggtagggactttgtcttgtttaccactgtttcttcagtacctggcatataatgggcagtcaataaatactttaagattattaagctaccaatactgtaaattctgtttttgacaaggagaagctactgaagtagtataacctaggaaaaaacttaccttgaatggtacattccagtaactgaaacttgcagcaaaaaatcttaaccattttggggttacatacaccattgagaatcttataaaagctatgtattttctttctttctctctccttcctccctctgtccctccctccctcctttcctctcttcctggccccctttccctttctctttccctttccctgggtctcactctgtcacccaggctggagtgcagagtcatgatcacagctcactgcagcctctacttctagggctcaactgatcctcccacctcagcctcccaagtaactgggactacaggcacatgccaccatgcctggctaattaaaaaaaattttttttgtttttggttgagatgggggtctcattgtattgtccaggctggtgtcgaactcgtgggttcaagtgatccttctgcctcagccttccaaagtgctgggattacaggcttgagcaactgcactcagcctaaaactgtatgttctctctagaaaaaggtacatactcttattgtactcagaatttcagtatcaattcagagaattctcagaacccagaaatccctgctttgaagaaaggaataaccctgagtatttgaaaattcttaaaaatacatgttgttatgtcttccatttttgcccattgatgtgcatgaaacaagcacagttccctttccacatgaaagcctttaagatagtcttttaacaaatatttatgatgtaccatatcacatactgtgcacatagtgtatagacactatgtattccaagaaaaaatgagcgaactccatgctttgaggcggccacagtttagtaaaggaaagtagacatgtcaacagataaatgcaaaacagacatgttagcagataaatgcaagagtgtcagtcacagttactcaagtctgcgcagggaacaatggagacatgtatgcaatggtcagtgttattgggacttaagaagggtttcataaaccaggtgtgacagctcatgcctgtaatcccagcattttgaaaggctgtggtggaaggattgcttgagcctgggagttcgagaccagcttgggccacataacaagacccccatctctacaaaataagtttgttttttttcaattagctgggcatggtggtgtgcacctgtagccccagctactctgtaggctgaggtgggaggatcgtttgaagtttggaggtcaaggctacagtgaggtgtgattgtgtaactgcactgcagcctgggcaacacagtgagactctgccaaaaaaaaaaacaaaacaaaacaaaaaaaaaaccccaaaaaacaggtttcatagaacatagaggagggaagtcttttttttttttgataacagctttcttgagatctaatttatatatcatacaattcacccacttaaagtgtacaatttattgggtttcagcatattcagagttgtacaaccatcactacaaccaattttagaatatttcttcagcccccaaagaaaccctgtactttttagctattactccacaaatcccccagcccacctccagccctaggcaaccactcatctactttatgtctctatagatttgcctgttctggacatttggtataaatgaaatcatataatatctgatcttttgtgactgacgtcttttaactagcataatgttttcaaggttcatccatgttgtagcatgtagcagtactttttttatggctgaataatatttcattgtgtggatataccacatttcatttattcattaatcaattgatggacattgaatttttgccttttagctattatgaataatgttgctactgatatctgtgtacaaatttttgtgtagacttaatgttttcatttctcttgagtgtatacatttggaaaatgtgagcattccagtgtggctggaactaagcgtggaatttctaggttgtatggttattacatgtttaaccttttgaggaactgccagaccattttccaaagcagctgtaccattttacatgaccaccagcagtgtaagagggcttctggtttcttgtcaatacttgtttgttatctgtcttcttgatgatagccatcctagtaggaatgaaatggtatctcattgtgattttatttgcatttccctgatgactaatgacattgagcattttttgtgtgtttattcactctttgtctatttgtatatcttgttttggagaaatgtctattcaggtccttttaaccctctttaaaagtcagattacttgtcttttttttttttttttttttttttttgagagagacagggtctcactctggtgcacaggctggaatacagtggtgccatcattgctcactgtagccccaaactcctgggctcaagtgattctcccaccttaccctcccaggtaactaggactacaggtgtgtgccaccatagctggctaatttttaaattttttggcagaaatgaggctctcactatatttcccaggctggtcttgaacttctggcctcaagtgatcctcccaccttggcctcctgaagcactggtattacaggtgtaagccaccacacttggcgtcttgtctttattgttgagttgtaagagttctttgtatattctaggtacaaatctattatcagatatatgatttgcaaatattttcttccattcagtggttgccttcacgttcttgatggtgccctttgaataagaaaagttttacattttctctgacaaagtccaatttatctacttttttcttttgtttctcctgcttttggtgtcatatctgagacaaattgccaaatccaaggtcatgaagatttatgcctatgttttcaagttttatagtttttgctcctgcagttaagtctttgatccctttgaattaatttgtgtatatgggtaaggtaggagtccaacttcatgtggatatatagttgccccagcaccatttgttgaaaagactcttcttttctcattaaattgttctggcacccatgtcaaatcagttgactctaaatgtaagagtttgtttctggactctcaattatattacattaatctgtatacttatccttagccagtaccatgctgtcttaattattgtagttttctaagttatgaaatcgtgaaatgtgtcctcaaactttgttcttctttttcaagattgttttgctattttgggtcctgtgacctagcatttccataggaattttggatcatcactttggtttctgccaaaaaaaaaaaaaaaaatgccagttgggattttgatagagtgaactgaagcaatttggagagtactgccatcttaccaatattaaatctttcaatctatgaacagaggatttcttttttatttatctaggtctttaatttattttaaaggagattgtagtttttagtgtgaaagtcttattttgttaaatatattcataagtattttattctttttgatgttgttataaattttgttttcagattgttccttagtgtatagacaattagtttttgtatattgatactgtatcttgtcacctcgctgaacttgtctgcatatagagatagttttacttttttttttaatctgaatgccttttatttttatttttactttttttggcctaactgccctagctggaacctttagtgcaatgttgaatagaagtggtaagaacaaacatcctttcttgtccttgatcttaagaagtatgctttactagcatatgtaatgttatctgggggcatttcgtagatgcctgttttcaggttgaggaagttcccttgtattcttagtttgctgagtgtttttcattatgaaggggtattgaattttatcaaatactttttttctatgtctgttgagatgattatgagatgattatgtgagttttgtcctttactgatgtggcatattacattaattgaaatttagatgttaacccagctttaccttccttggctaaattgaggaggcagttcttaaagtgttttggggggtgtgtgtgtgtgtgtatgtgtgtgtgtgtgtgtgtgtgtgtgtgtgtgtttaaataatccagatgaaaaagaagggcattctaggtagaagaaatactgagcaaagaaacacagaggcttagggccaggcacggtggctcatgtctataatcccagcacttggggagcccaaggcaggcagattgcttgaggccaggagttcgagaccagcctggccaacacggagaaaccccgtctctactaaaaatataaaaattagcccagtctgatggtgcacgcctgtaattccagctacttgggaggctgaagcaggagaattgcttgaacctgggagttggaggttgcagtgagctgagatcccaccactgcattccagcctgggcgacagagtgagactctgtctcaaaaaaagaaaaaaaaaaaaaaaaaaaaaaaaaagaagaagcatggagccttgaagtatcctcagagttgtgagagaagacaccagagaagttggcacgggccaaattgtgaaggtttttttctgtcattcttaaggagattgggttttattctaaaggcagatgaggcatcattgagtgtgtaaggagaagagaaacatttaacctggttttagaaaggacaccctggcagcagtgtagacactgcgttgtgaggatttcttcagggagaagattgttgtagtcatccagttgagacatcatgagcatcaccaagtcattgtcattgggttcaccagttagggtgcttgtgacaagtgacagaaaagtcagcttgactaagacagggaatttattgacttgtgtaaatgaaaagaccctgtgttagaaatgtcttgcagtatggtttgaaccagagactcacagttgtcacactggggctctagctcttattttctgtgtccttttcactctgggttcgttctcaagttggttctgtgctctggctgccctctcagggtggtagcaatggttgcaacagtttcggacattacctcctcacattccattgcccggagaaagtgagtgtctcatttatagcaacagtttcggacattacctcctcacattccattgcccggagaaagtgagtgtctcatttatagcaacagtttcggacattacctcctcacattccattgcccggagaaagtgagtgtctcatttatagcaacagtttcggacattacctcctcacattccattgcccggagaaagtgggagtgtctcatttatatacgtgtgtgtgtagagctggcctggaactcctggcctcaagtcattgtcccacctcagcctcctaacgtgctgggattacagcactttgctgggcacagctccaggcctcttttcttttaagtcctccatcactctcaccttccagcctcactcccaagattctttcccagaagttccagcaaacatatccgttcacgttaatggcttgaattaagttaacttgtggtgctgtgggtagaaagaatatactgatgaatccactctggagttgagaggagttcccaaaggaaaatatggatattagagcaagagaggttatcaatggatagattggagggaagagaataattttaagagacattttaaaatagaatgggaaagtgagggagagggagacatctggattattctcaggtttaggtgaagggatagatgttgatttcctttgccaaaataggaatggaggaaaagtagattaaaggtgtgtgaaaagaaaataaaaacttgggaccccagttcactatgccaaaaggaaaaaattaagctgaaagctgagtcgtgcaagaaactgcctttccttttgttcctaagcaggtagctacagataaaaaattaaatatctctacaggtagctactctatgttcaccgtatcttacgtgaagtgccgatttactgagcaccagatgaatacataattgactattcctctacctgctccttttctcttgcaacatatagattaccatacccttctttcccctccagctcacttttccccttgaaatattgaagccctcaaaatcatctttggagaaaggcacagacctctctcctgggcgtgtccttaacgttggcaaaataaacttctaaattgattgaggcctgtcccagatactttttggtttacaggtgtaagatgattaatccaggaattggaaaagtagtattatgtccctttcttcagtcttctttcctgtgttaacatccctagctccctcatccgttcctggtatgacctaggtgcaagtgtttgaacacagccctctcagaagaggctcttagaactgcaaataacagcatatctaagacagttcatgaaagagcaatctgttgtttccctgcactcttcttcttctatacttaatgctttctggggattgctctagtttttagcattttccttgctgactttgctgtatattagaattctgagcctttttttcttctttttaataggagctgctcatctaggttttgttcattttctactgttcacttgatgtttcggaatgaaatgtaggaatttgtagttttccttgttgcattttatttgtttaaatttggccaagaattctagctcttgaaattttttcagagcattcaatgtttcattcaatgtatctgcttaccatttcttagctgtgtgccattcttgatttttaaaaaactttttgttaaagacattttcaaacataagcaaaagttgagagagtagtaaaatgaatccatatcatcctgcttcagcagccatcaatacatggtcagtcttgtgtcatgggtatccccacccacttttccccccattcactggattattttgaagcaaatcctagacattggatcatttttcatccttaaatgcttcagtatgcatctctaaaaacagattcttattaaaatgtagccacaataccattgtcacacctaaaaagtcaatacttccttgatgtcattaaatatctagttggtgttcaaatttttcccaccatgttataatttttctttttttctttctttttttacaattttacctttgattatgatcagcatgttttctctttttgtttgttttttctcaggctggagtgtagtggcaggatctgagttcactgcaacctctgcctcccaagttcaagcaattgtcctgcctcatcctcctgagaagctgggattacaggcatccaccaccacgcctggctaattttttttgtatttttagtagagacggagtttcaccatgttggccaggctggtatcgaacccttgacctcagatgatctgcctgccttggcctcccagagtgctggagttacagacatgagccaccatgcccagcctcagcatgttttcttgataggtcaaattatttttttaaatgtcttagtcatttaaaactgcttttagagtcccaccactgtattcatggaaacgttttgtttagggtcattcaaccagttggttatttggttgctctattccatcttactctgtcaccctggtttgcctccttcctccttccccacttcagtctattctcaatatagctgccagatagtattatgttgaagcttaagtcaactcacatctctcccctcctcaaaactctacagtggcttcctggcttagatgaaaagatagtctatacatgacccaaaaggccctatgtaattctcttccccatttgcttctacttttctatctgtctcactttgttgtggccacactggcttcctcctcactgttccttgaatatgccaagcatgttcccacttcagtgcctttgcatttgctgtttcccttgtttgaaatgctcttcttttggatatccatgtgcctttcccttcgtcttcatgttttctctcaaactgcatttcctgatgccttctctggccattccagctaaaatcttaacttccaacacggtcctaccccttctccctgtcttattttttctccttagtatttatcattatcttgtttattgtctcttttcctacttagaaaggaggctctgtggccgagcgcggtggctcacgcctgtaatcccagcactttgggaggccaaggcgggtggatcacaaggtcaggatttcaagaccagcctggccaacatggtgaaacgccgtctctactaaaaatacaaaaattctctgggcatggtggcagatgcctgtaatcccagctattcgggaggctgaggcagagaattgcttgaacccaggaggcggaggttgcagtgagctgagatcgtgccactgaaatgcagcctgggtgacagagactccatctcaaaataaaacaaaaaacaaacaaaaaacttcttaactctggcttcctagagtttgtgctacacgattcctactttgttgtcagaaacactaagatctcattctcctgaggttctcctttcatttcatcagagcttcttctttgatcagagtagcagttcttctgctctccctgtgtacctgtggaacataaaaatgtcagcacacttggtcaagaacttgtcagttgttccattgtcagctgaatgagagtttgaataggttgcagggtagttgaagtactccaagatgacagtgtgccactctgtgttggaggtggcttcaagagagtcctatctactacttctacttggctgggaacctttggtgttcccacagtaacactgtatctgggcatctttcctgctgaccctgcctgaatgcttataaatagggttccttagtagcccctctccagtggccctgttcctgtggaatagcacagaccctttgtcacgatgttctccctaagtaagttgtgtcccactgagtcttaatctctctgagatgtgaaaatatacagatacatgtatatgtgtatataaatatacacatacaaacatatacacatatacatgtatgacatacatatacatacatagttctgtgttatcttaaactagcttcttatgtgttggtatgtaagtgcctgaagacaaatatattattttggttggttaccatttattttccctaatgaagcatcagagatctactctgaaggaatgtttgaaggacagagattaggaaatcattttgatttcagagggtcattttcctgttcatgtattatggaaatgaacagaaaacaacagacaatttgagagcccatgaatgcgtgtaaattaggcattttttcaagtttagaaacgtacaggtaagtgggtatggaataccttgcttgatcagtcatcctaattgccagtttctattctagaaactataaaattgaaaactggcaggataatgaagtaaaaaactatttttagccctacaaatgactgggcaggatcttgagattctaataaaggctaacactcccagtataattcatccaaatcaggtcagcaaagattgtagtaggcaagatccagagcctgccctgggaacccaaacaaataaaacactaggcctttattcaagaagttcttagtttgtcttccagccggagaccactaggaacacacctgtagttgaacaagttgagtgtattactcattgcagcaagggagaatgcacaccatggggaattgtggggcatctcaataaggcactgttagaaaaagtcattataggatttgggtttgtgttaggtgatctggaggatggtttaaggatgtggtactttactctgaattagatgctttcaggaagtaaggcaaattctaggactggtatcttaacagtttatctaaagggagggccaactagagaaaggctaaagctgtaattgataaagcagccccatcgttcacattactcagcactgggggatattaggtatttagtggcttggacagtgttcatgttttgtctgtgttcagacagattactgagtggtcttgttttttgtcttgatccgtcatgatcacagaatggccttgtctaatgttggtgttctgaaatagcttatgtgtaacaggagaacaccacaacttatctgtgagtaccaagccagctcatagcagtattaatgcctagttgataataccaggccaacttttagatgttagaggctgcttttctagttctcagatatgatatacaccaaataaaattggatagagatggtgtttagtggaaaatgttacctgtttttgtttcccggttcatttaagtacaggctataagacacattaataaaactcttgattaaggccaagtgtggtaagtgcaattaaagaggctcaagcagtgtgttttacaggcatggggaatagcatgagaaaatgcttcgggggcatgggggcagtatctggcctgggccttggaggattggctggatttagatatgtggagttggagaggaaagcaaagccactggaggataagcataggctcagaagcaagaaggtgaaagtcaggttcaaagcatggtgagaaccctagtttgactaaatgagtggtatgtaatgggaaagtagtgtgaagagcacttttgggttagattatggaattcagttgtttaggaattcagtttgtggggagggaaaatcagaatttgttaaatacctactatatgtgctaggtgctttgtatatatgatattatttaatctgtaattcttgtaaactctggaaagtagatatcatgcccattttacagatgatgaaaatgagccctagaaagattaatttaacctccactgaaatagtgggaggcacagccataatcttaaccagtaactgactgaaaaggtggcactcattccacttcactctgctacctccattctgctgtaatacagcctcttgtcatcagtggaaactattagaagcttttgatcagagaactggcaagaccagttagaattgtgctttaggaagattattctggtaacaaaacagtggtaattgatgtgtattgagtgtgtggatcgggccctgtgctaagcaacttagacacacaatgatctcttttagtaatatataggatggattgagaatggagaggttgataaaagatgaaagaaatctgattaaattagcagaaaatgtgaaagcagtagagaacaaagcagaatcaggtagaagggaaatgtaacaagatagggcccttggaggagaccggtgaggaagaaacagctattgtcttggcttctacttcaagtaatgctgaatcaaatatggcttctacagcttcctcaatatttagggaaaagcttggctatcttaagcaactggcccccttaagacctttcttgaaccgctgtttctattttttattaaaatagaaacatgtccagttctttatagatttatttgccccaagaatgaaatgctgcagatgagttaatgttgctttcagaaaactcttttgttaacagtgctgaagtttctgtttttgtttttagcaataggtatggttattaacaaaggaaagtagagcttcactttgtaaaatccattttcttttctttttttttgaaacggagtctcactgtcacctacgctggagtgcagtggcgcgattttggctcactgcaacctccgcctcccgggttcaagcgattctcctgccttagcttcccgagtagctgggattataggcatgtgccaccatgcccagctaatttttgtatttttagtagagacggagtttcaccgtgttggccaagctggtcttgaacccctgacctcaggtgatctgcccgccttggcctcccaaagtgctgggattacagacgtgagccacctcacctggccagaatccattgacattaagtttttagttaagcttaaatgataacttaagtgaattttttttttttttttttttttaagatggggtctcctgttgcccaggctgatcacgcggtggtgtgatcatagctcaccacagcctcaaactcctgggcttgagcagtccttttgcctcagcctcctgagtagctgggactacaggtgcatgccaccacacccggctgatttataaaagtttttcgtagagaggaggtcttgccatcttgcccagactggtcttgaactcctgggctcaagcagttttcccacctcagccttgctaaatgctgggattaaattttaataattaaggaaacctgaatatgggcaaagctttcaataaacaattaggatttagtcatgttcccttttacagaatacttaagtacctatagagatagtcacatagctgttttgttttctagattagaaaacctacagttttatgttctgatatctttattctgatctctttagctgtttttaataaagcaaacttaaaaaaacacaaatcttatttgtaatgtaactgtgaactagaacatttgtaatagagaaaaattgaaaataatctaaatgtttatcagcagaaaaaggggtaaataaattataatatggtcatacaatgtgatgctatattgcagtttaaatgaatcaactagagctatacatgtcaacatggatacatttgttggccaaagtgttcattccccacctggaaaaaaaggcagaaaaggaaagttggagaagcatgtgtccaatataatcccataatataaaggactttttaaaattgtggtaaccatttttaggtaaacagttcagtagcattaagtacattcacactgttgtgcaaccgtcaccactgcctatacacaatatgaagttttaaaacattcaaggcaatattatatgttgtttatagatgcttatatattgtttatagatgcatagttaatgcaataaaatctaaaagcacgcattctgataataagcaccaaaatcagaatggtgtttatctcagagagggtgtgggggaaaagtacacaagggacttcagttatatttgggcagtggatatacaaatgttcataaagtatgtatacttttatatacctggcatatttcatagtttcaaatttttcttttgtaaaaaaaaaattcccactagaaatttccaaatgttttataatcattgactttttatagattctgggctattcagttttaagaaacatggtggtaccaagatccaagaggtgaggttgctacctgtagaggcctgttaactttacgagaagagaaatctttgccaaatgcagcattgtcattgttgcctaccgtcttaagtgtcacaggtagcagaggttgtaggtctcaagcctgaagtttggagagaatgaatctacaaagaaaggaaatacaagaggagagcaggttttaggaggtgaaaatgagttcatttttaggcttgaggtggtagacatacaagaagacatatatactgattgtattaagaaataagagacaagagcttgggggaaaagtcagaactagaagtacacattttggaaattacagtgtattccttgaataaatgagtttgctgaaggaaagtataaagaaagaacaggctgagacaaagtattggggaaggggattaaagaagaaccagtgaaagagattgagaaggaataggttgaaggaccagtggaaaaagagaagagtaatgtgccatagagattaaggcaggaaaatttgacaaggatttattcagattaatccaatatttattgaatgaccactatgtgataattacttttttgtattgcagaaaactaagagtgagaactgacaaaaagccattggatttgacggttaaggtagagttaccatgtcattgtaactatgctccctgtctgtaaactctttttaaagacagagattctgttctatttgtcattctaatctcagagcctgacatagtgtctgtcacattgttaagtgctcagcagtaaatatgtgaacaataataccgcatgtaaagtactcagatttcttctaggatataaaacatattttttgctatctagtctatatgttccattgctctccaaatccctcttctgtctttgaaaatagtattttttactttttcaacatctctttgatgttatcaataaccttaattctaatacaggtttccttatcaattaacttctttaatcagttctaacataggtttctttggacctcatcatgttttattcagcattgctttttgaaaccctattttttgttttctttctttctcctgttactcactcatcaactctatataaagacagtcctatcagtcagagctgtgtagaggtaggatgagcttcctggagaaagcattgttttctatcctgaggtattcagcagaattaggaccacaatttgaagcatatgagagtatcaaacacaggtggttagactagctgtctttaaaaaaaaaaagctttattgagacgtaatttacatatgcaattcacctatttaagatgtacagtcactgtagtttttagtatattcgtagagttgtgcaactatcactacagtcaattttagaactttttaaatcacacacctccccaccaaaaacctcatacacattaggcagtcactttttccttcctctgcacccctccaaaccccagctctaggtaatcactagtctactttctgtcctatagacttgactatcctggatatttcttattaatggaaccatataatatgtggttttccatgactggctgtattcacttataatattttcggagttcatccatgttgtagtatggatcagtactttattcctttttatggctggataatactgtgttgtgtggatatactacattttgttgatctattcataagttgatggacatttagatactatgaataatgctgctgtgaacatttgtgtacaagtttttgtgtgagcatattcctggctgtatacctaagagtggaatttctgggtcacatggtcctctatgtttaaccttttgagaaactgccagactgttttccaaagcagctgcaccattttacattcccactagcagcgtatgagagttcctttttctttacatccctcaaacacttgctattatctttttcattatagccatcctagttagtgtgaagtggtatctcctcgtgagtttgatttgcatttccttggtggcgaatggtgttaagcatcctttcctgtgcttattggacatttgtttgtcttccttggagaaatgtctattcagatcccttgctcttttttttttttttttgagaccgagtctcacttctgtcccccaggctggagtgcagtggtgtgatctctgctcatcgcaacctttgtctcctgggttcaagcgattctcctgcctcagcctcccaagtagctggaattacaggcatgcaccaccacgcccatgtaatttttttgtatttttagtagagacgaggtttcaccatgttggccaggctggtcttgaactcctgacctcaaatgatctgcccacctcagcctcccaaagtgatgggattacaagcatgagcccccacacctggccacagttgtttatttttacttggtttatttgtcttttttttttttttgagacggagtttcactctgtcgcccaggctggagtgcagtggcgcgatctcgactcactgcaagctccgcctcccgggttcacgccattctcctgcctcagcctcccgtgtagctgggactacaggcacgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcctatttgtctttttaatgttgcgtggtaagaattctttatatattttggatactaacccttttcagatacatgattagcaaatattttctcccactcagtgggttgtcttcactttcttaatggtgtcatttgcagcaccagagtttaaaattttgatgacatcaactttgcctaccttttgttttgttgtttgtgcttttggtgtcctgtctaagaaactgtcacctaatccacagtcacaaggatttatgtctatgttttcctgtaagattttaaagtttcagctcttataattaggtctttcatccattttgagttaatttctgtatatggtatgagataggggtccaattttattcttttacatgtgaatatctacctgtccccacaccacttattaagactggatgacttttaaggccccctttgactctgaggctttgtagtactttggtttctgttattgtctaaacaggtggacagtcaggatttcatgttatggccatccatttctcaagaatatattgtgtctgaaaacaaggattgccattagtttatgtgtttccaggcttctcagttgccttcaatttcatcctcctctgacttttatggtattagtttgtttctagtcatctttggctagcgcatttttcttttctttctcttttttccacataaatacaatattcttccagccttttggtattgggaaccattcactcaattttaattagctttgtcatttaggtagcttagagtttcctcttaagcctaactgcagtctaataaaaaaaaaattctgtattccatcaacaactggaatataatgtgtgaaaaatgtatattcagttgttccctaacagtaagccttccaagtttcttcattatcttctctatcttaaactcttgatcttggagttttctgacaactcctccatgagctctatttttgttcagtgttaaatggcactgattacatggtaataaaccttggacatgttaacttaaaaaatatgatttataaattgagaagagaagaggagactttatttcttataaagggttacaaccttcagggtggccattctgacaggctgggaagtgtagcctccagccagaagcaaaaacatacacttggagggatgggcaaagggaacaggaattcatgctgagcagggtggccgtatatacatattcaataagctgtagggggagtcatgaatatttatgaaaggagaaacacgtccttcatgggtcttatacacacaaaatggcagtaatagcgtggtcagagagtggagttttcagccctctgacatcaaaaggtgaagcagaagacatgaaagcccttactgtacattctctgtagaccagccagaaccattctgtggttggtagtctcttatcaggcaaaaaaggagggacagtatcaggtggttggttgatagcagtggtggatttttttgaaatggctagtttctgtttggtagttagagaagaaaggctaatcgtggtttgcgagggaaggggtataatgaggtgggtttgaaccccccatcccgtcatagccaagaatttagttttcaaggttactttggggtcccgttggccaagagatgacccatcagtcagttggtgggcttagaattttatttttagtttatagacctatcctttcctttttatagctctagccaccacctcagtgatttgcatctcagtgctaagttactgtaatagcctttttgacgttttcccagaccctagtttctgtctatattagagcctatattctgctgctggattaatccccatcaagtacccttctcatcaaggtccactgtatcaaatttatatatcacacaagttagcattttaactcctccccatctttacttcttatctcttcttacttccctaaatggagccaaactaatttggtagtaagtcctacttaatggtttctttgttctcaatctcatatacacagtcttctttcctcctggtgtgcttttgcttctctcctattctttcattcccttcagtaattgactccatttgcctcctgttttttttattattttttattatattatttatttatttatttttgagacaagagtctcgctctgtcacccaggctggagtgcagtggtgcgatcttggcacactgcaagctccgcctcccggattcatgtcattctcctgcctcagcctcccgaatagctgggactacaggtgcccgccaccatacccggctaatttttttttttttttttttgtatttttagtagagacagggtgtcaccgtgttagccaggatggtcttgatctcctgacctcgtgatctgcccgcctaagcctcccaaagtgctgggattacaggtgtgagccactgcgcccagccaactcctcttttttttaaagaaagattttgcatcttttcaaaacttgaatatttagtttatctagtaaaaaggtccttgataccctgctgctgctgctgctgctgttatttatgtctttgttttagatattctggttttgaaggcattgttccatgtgggaactattgtttctattacctttatcgctctcttcttttcttgcatatggcagaatcttgaacataataggatcctaaaattttcctggctgacagatctataaaagttttgggggagatgtgtaatgtcattcttaaattttagagatgcaaaataatgcttttctgtaattacctgtttttaatttttaatttttttgttttatgccagatttgaagatagtattctcaacacagtaaggtgaagttccacaacataatactacaaatattagatccagtttattgaacattagccacctgatagattctctcaagagaaaagttagcttcctgaatgctggctaggcatgcttttgaaggtgcataatagccaaagccagtactcatcatttaatttactaagatccttgaaaatttaaaaggggcatagtcaccagcatccagaataaagggtggtgacatggtgatttccttttactgtctaaagctgtgcttctgttgctgacccagtctctaaaagaagcatttcttttcaaaattttccatatcatttaaagtcaatactgagaggaaaaggagtatcactggagtggagcttggctgagaaaggatacaaggcagaaggcaacttccaagcctacctgcccacctaccttctttcttacctcaggagcagagttgactttgagaactaaattctgattttttaagtcttacccaaattcggctcatgcctgtaatcccagcactttgggagaccaaggggggcagatcatgaggtcaggagataagaccatcctggccaacatggtgaaaccccatttctactaaaaacacaaaaattagttgggcgtggtggcacatgcctgtaatcccagctacttgggaggctgaggcaggagaatcacttgaaccagggagtcggaggttgcaatgagccgagatcgcgccactgcactccagcctggtgacagagcaagactccctctcaaaaaaaaaaaaaaaaaaaaaatcttacgcaagttctacctaacaggcctagggaggcacaccctacaaacagtgaagtctcatcagaggggttttatttcaccccatataatctagcctgctttcccacctgactctggcataacttcacataacaaataagaaaagaaataaaaatattttaactccaaatatatttctttgccgtatcttgaaattgccctgcaaggttgtctcttgtgggaaagatccacattctatagagaatctcctttccacccacttttttttttctttctttctttccagacccaggagacaatcaactaaggtacccttttaagtctgataagtgtgaacacccaaaatttgagacagatctcagttaatttagaacgtttattttgccaaggttcaggacatacgcccatgacacggcctcaagaagtcctgacgacatgtgcccagggtggtcagggcacagcttagttttatacattttagggagacatgagacatcaatcaatatgtgtaagaagtacattggtttggtctggaaaggcgggataacttaaagcaaaggcaggaagactcaaagtggtgaaggggcttccaggtcacagataggtgagagaggaatggttgcattcttttgaatttctgattagcctttccaaaggaggcaatcagatatgcatctgtctcagtgagcaggaagatgactttgaataaaaatgggaggcagatttgccaggaccaattccccaccttgaaggggcccatgatattttcctttcatgtaagaaacattttacaatctactccctcagaagtctgctatctgagagcttcctttacacagtaaaattgaaaaacctggtcgccaggaccctttatcttaatctaaacatttcctgtctgttgatcccaggtctttagataaactcaaccaattgtcaaccagaaaattttaaaatctacctgtaggctagaagcaccccgccccctgccaccccgccccgcctttcaaattatcctgcctttctggaccaaaccaatgtatttgattgaagtctcatgtctctctaaaatgtgtaaaaccaagctgcaccctaaccgccttgggtacgtgttctcaggacctcctgagggctgtgtcatgtgccatggtcacttatatttggctcagaataaatctcttgaaatgttttagtttgactcttcatcgacaacttaaaggcagttctcagttcatagcattttattaactttgttagtgcaagtttactttcttgttttattcttttagttctttatcctcaacccacattccagttccctttcctattcatatgcacctactctgatgtgtttatgtttatgtctttatatccacatatttgcttgaaagattaatatcgttatgtgtgtgttttcaacctgcataatgttatttgctttttcttaacctaacggtatgtttttaaagatgtattcatgttgctgtaggtatgtctaaagtgtggtttccaaagctatgtagaattccatattagtattcactccattttgattttccattcttccagttaaggaaatcagagttaacttcaaactccctactacactattgtcacagcaaacattcttacataggtctataaagtctgtagttcacatatatataaccttatttgagattttctgtgggatttattcaccagagtgggatcattggatcatagggtgtgtacatatgtaatatcacgaagtacagccagatcactaggcagaatatctgtatcacttacccacagtgcatgaggattcatgcctctccacatctttgtcaattttgttcaagtcaaatccaacaatttttttatttctatttttagagtgttatttatttagagtgttatttatgctctctagtattttctgttctataatgttatctcctggtggtttttcatacatgcctgtttatttggccatttgagattcctttctggtagttggtgttaacttttgactgctcttgatggagaaaaaaaaaatgcaagaaaattgatgtaacacctccccctgcctctgcccctccccacaagccctgctcttccactcacaagatcccctttttcaagagtccctttttcaccctgtttgtgctatatccatcctgtctgttcagctatagctgattggaaagagatgtatacctacccaagctgagtacttaaagtcctcctccaaggaatttgaaattaggatgtctcagctagcctgttgaagaacatgcaaattgaggggctggggcgaccatcttcccctgtgtgcacaaaggagctagagaaatggtctgcagagaaagaataaagaagatgtgcacagaaaaacaaagaaaaaaccttatggccccatagagaaggagagagattgagctagaatgtgaaagtacctgtcctggatcctgatggctttccagtttctagttctcttttctcctgagaccacattgtattttctttcttttttttttttaatttttttttaatttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcttcattttttatggctgcatagtattccatggtatatatgtgccacattttcttaatctagtctatcattgttggacatttgggttggttccaagtctttgctattgtgaataatgccgcaataaacatacgtgtgcatgtgtctttatagcagcataatttatagtcctttgggtatatacccagtaatgggatggctaggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcatcgtagattctggatattagccctttgtcagatgagtaggttgcgaaaattttctcccattttgtaggttgcctgttcactctgatggtagtttcttttgctgtgcagaagctctttagtttcattagatcccatttgacaattttgtcttttgttgccatcgcttttggtgttctggacatgaagtccttgcccatgcctgtgtcctgaatggtaatgcctaggttttcttctagggtttttatggttttaggtctaaggtttaaggctttaatccatcttgaattgatttttgtataaggtgtaaggaagggatccagtttcagctttctacatatggctagccagttatcccagcaccatttattaaatagggaatcctttccccattgcttgtttttctcaggtttgtcaaaggtctgatcgttgtagatatgcggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgccttggcgatgcgggctcttttttggttccatatgaactttaaagtagttttttccaattctgtgaagaaagtcattggtagctttatggggatggcattgaatctgtaaattaccttgggcagtatggccattttcacgatactgattcttcctacccatgagcatggaatgttcttccgtttgtttgtatcctcttttatttccttgagcagtggtttgtagttctccttgaagaggtccttcacatcccttgtaagttggattcctaggtattttattctctttgaagcaattgtgaatgggagttcactcatgatttgactctctgtttgtctgttattggtgtataagaatgcttgtgatttttgtacattgattttgtatcctgagactttgctgaagttgcttatcagcttaaggagattttgggctgagacaatggggttttctagatatacagtcatgtcgtctgcaaacagagacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctatgggtttgtcatagatagatcttattattttgaaatacgtcccatcaatacctaatttattgagagtttttagcatgaagggttgttgaattttgtcaaaggctttttctgcatctattgagataatcctgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggagtagtttcagaaggaatggtaccagttcctccttgtacctctgatagaattcggctgtgaatccatctggtcctggactctttttggttggtaaactattgattattgccacaatttcagctcctgttactggtctattcagagattcaacttcttcctggtttagtcttgggagagtgtatgtgttgaggaatttatccatttcttctagattttctagtttttttgcgtagaggtgtttgtagtattctctgatggtagtttgtatttctgtgggataggtggtgatatcccctttatcattttttattgtgtctatttgattcttctctctttttttctttattagtgttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcctgtgggcatttagtgctataaatttccctctacacactgctttgaatgcgtcccagagattctggtatgttgtgtctttgttctcgttggtttcaaagaacatctttatttctgccttcgtttcgttatgtatccagtagtcattcaggagcaggttgttcagtttccatgtagttgagcggttttgagtgagattcttaatcctgagttctagtttgattgcactgtggtctgagagagtttgttataatctctgttcttttacatttgctgaggagagctttacttccaagtatgtggtcaattttggaatagttgtggtgtggtgctgaaaaaaatgtatattctgttgatttggggtggagagttctgtaggtgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatcctttaccattatgtaatggccttctttgtctcttttgatcttgttggtttaaagtctgttttatcagaaactaggactgcaacccctgcctttttttattttccatttgcttggtagatcttcctccatccttttattttgagcctatgtgtgtctctgcacgtgagatgggtttcctgaatacagcacactgttgggtcttgactttatccaatttgccagtctgtgtattttaattggagcatttagtccatttacatttaaagttagtattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgtattttcttatctgtattagttaggggtggctaactgctgtaacaaatagattccacagtgtataatgaccctaacacaatagaagttgatttctcactcttacagacaggtccagatgactctaagttagtgaggtggcagcagtggagggctctgcactacataattatttaggaatcaggttgatggaggctttgctgtttctacccgtggcttccaaggtccccgtgggtgttagcatccatgctgcagaaaagaaatgatcacggagttgaataacaagggagattttatagaccaggccttgagctagcacagtcctagtcacattccttggttggaactcagtttatatggccacatttaactgtatgggagtctgaaaaatgtggtccagctaaggacccagagggaagagaaaatgggtttggtgaacagctagagatgatcacatcatatttaggatatgtgtgatacctctgtatccttttaattaagttgccatttttttcttctacttgtttgtgttggcctcttttataccttaatgatttggtgttttcatgatagccatctttaaaatagtagaagagataaaaagtgattattattttctcaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaaggtaagtagaatcatcctaatcatattacatcaatgaaaatctaatatggcaataaaaatcattgtctacattaaaacttcttatagttcataaaattatttcaaatccatcatctctttaaatcctgcctcctcttcatgaggtacttaggatagccattatttcagtttcacataagaaatgtttactcaatgtttaagtgttttgccccaaaattcacaactaacaaggcagaactaggacttgaacatggatcttttggttcttaatccagtgagtgatacaattcaatgcactcccctgccaaaaaaaaaaaaaaaaaaaaaaaaattaacatctttacaggccgaaaaggaataaagattttctaagaagagcttttattattgggattggcacagtgatttccaaatagccattgtaaggccaaataatgacaccactttatcctgcttgtttctccacaggaatttgagatgctgtttttaatattatctccaataattctcctgagacagaactgtccctcctgaaattaagcctgatatttcctagctctggggagacatgggtgtaggttctttaaagcagacccccagttgagttccacctccaggcaggcctttgcaggcccctggcccctgtactgtgaattagaggcagaagactcactttgccctcctgtctagagtaagcttaaataagatgagttctttctcgcccaggaattctgcaggcagtctgagttgagtctgtaagaatgcccatagggtgccacacatcccttttagatgagcatgagcaaggaagatgacctgtagggagattttttttcccttgtgttagaaatgcttgttctctggtgccataaagaagcagcacttggacgtacatttaatttcctcagcaaggccatttttactttctgcagaaagggtacactcaccagcggttttgccgtgagagtacaccgaacaaaggagacagggtcatttataacctgacgcatccaccttactgctgtgtccggtttccattggctggaacgggacctcacattctgtatttgtgctgattggctagcgacttagaactttttaaaagaggcaaaggcagaggagaacaaaggaaggaggaactaacttgtggaatgctgagaaaggtaaaaacaccttcatataaggaagaggaacaggctatgacctcatgcttgctttgacaagtataagcatgccagggcaaatatttaggctaaactgtgggagctaagaacagttgatttctttattatggctagcagatatctaagcatgttagcacaggttcttgaataaattttgcttctaagagaagttactattcctaattatatggggagtaaagtctctttgaagaggaatctctactttactttttacacttgtgctttgataattttttacttggaaacctcatcttttggcgtttttttttttgagctatttctctagtgttgctatttgatttaatttctgaccttcatttttgtttcccaaccttttttttttgtttgatatgaggggttccgtgactgaggttctgagctgctgttgatgtgctatacctccttcaattctcagctctcaaaggggaaaacaactgcagaggatgggaaatgctatactgccatgcctggaaacacccacaggaaaattagtaagtgccccttctcagtatattcacaggtattattgagtcaaacagttttatagccacagggacagtctgtgggtatgtcttaaaagcatttctcaaaagttgctccaaattaatctgatgccatttttgccttagttctgggaattctcaaaagtttttatattgatgtactacaaaaagtacaaaaccaccagttcactttttaatatattagcaaattaatatttcacgtttggaatgacttctcattttcagacttcaaaatattggtagcagagagcaaaatggaggcagagaaatcatatcattgccaaaatcagtttttagatctagggaaagagtttaacacttctgactgttgaaacatggccatcagatacttattatacaactagaatattctgtgttctctagggaaattaaatttatacaacatggctctttcctcaagaatttatagactagaatgtatgtcaggaaaaataacctatgaaaaatttaccacccgcaagtaagagacttggcaaaagcattgcaggaaatcatgtttatctgggctgtaactgctttttggatttacttctggattttctatggaactaaatatcccagtcacactttgcatcctttttggaaatcttaaatattcacagaatcctttaataaaactgcggtgttcttcaatgagatagtaatgggaagttagacagtacaatagctttttaaaaatttgtggtctctttaacaggtttagggagttgtctctgatggttcttagattgttgcttattttttagccagttttgagcttgctcaactgcaagaaaaactgaaggagacagaagcagccatggaaaaattaatcaacagagtgggacctaatggtgagaggtaggttttcatgtaacgggactcagactatttctcatttagaaaataaattcaggctgggtgcagtggccgaggcctctaatcccagcactttgggaggccgaggtgggtggatcatctgaggtcaggagtttgagaccatcctgaccaacatgatgaaaccctgtctctactaaaaatacaaaattagccaggtgtggtggtgcacacctgcaatcccagctactcgggaggctgaggcaggagaatcgcttgaacctgggaggcggaggttgcagtgagccaagattgtgcccttgcactccagcctgggcaatgagagcgaaattctatctcaaaaaaagaaaaggaaagaaaattcaaaattatgctttttttttgataaatagaccacttattttcattttatgtactgtcagtttttaaattgtaaatatgtcatttacgtattctttatcatttaacatttttcattcacatactgtcaagcaacctcagttttcaaaagtttaatgtgcaaattattgtgaaagtgaataaatttgtgagtaattcctacagggtgaaataactatgatttaagaaagaaaatttcctagctgtctaaaataggtataattttaagtaaaaccaggttattgaacatgatgctttctacttgagacaaaatgagagaagagagcaagtgtgatcagattaggcattcatgtttgtgtcgactgtgccagcacagaattacatgtaaattagatgttaagagccaaactggccgtttagaatgtcccaaagggaagacactcctcttgctaccaggctggctgaggatctgaaagggtggcttcaggaggttgatagaagtggacaacaaccaagaaaacgtggatatagaaaggccaagaaggaaaaaccagaatgtaagatggaggacaaagaagggttcagtttcagctaggtcttctggcaaggatggaggaagaatattagggggagtggcagaatcccatgcagaaggaagtgttgaaatgtccctcctgcatctttgtgagcacactgtagtttttgccccaggaaatcgttgctctaccttagcctctatttgccatcctttatagtactagtacgctgtgccctttgttcactggcttcggccttgcctgtctttggctggatatgagagagtgggtatcctcagattgcagcctcctgacctggcatttccctgcaacgtctgcagtgctgttgaaatgacatttgtgaggatgaaccttgcctgtgtgggcccaggagccttgaccttctttttgcctggaaagcagagttactatctggaatgttccccaaagttgtatagatacattaatatatctgtgtgagtgtacaataataattgatatttattgaacaattactaaggaccacactctgaactaaatgctttatatacattatctaacatatgactatttgtatgagtgtgactaaaccaatttgtgcaattatacttttctggccttttctgccctaaccctgtagctgccacctacagtctgggtggagaactacccaggctattatagacagttatgtctgaaaaaatatctttacactcacctgggccattggcaaccccaggccacacctaagggtcatgaaaaccaggaatccaacttacaagggatgtgaaggacctcttcaaggagaactacaaaccactgctcaatgaaataaaagaggatacaaacaaatggaagaacattccatgctcatggataggaagaatcaatatcgtgaaaatggccatactgcccaaggtaatttatagattcaacgccatccccatcaagctaccaatgactttcttcacagaattggaaaaaactactttaaagttcatatggaaccaaaaaggagcccacattgccaagtcagtcctaagccaaaagaacaaagctggaggcatcatgctacctgacttcaaactatactacaaggctacagtaaccaaaacagcatggtactggtaccaaaacagagatatagaccaatggaacagaacagagccctcagaagtaatatcacacatctacaactatctgatctttgacaaacctgacaaaaacaagaaatggggaaaggattccctatttaataaaaggctttgggaaaactggctagccatatgtagaaagctgaaactggatcccttccttacaccttatacaaaaattaattcaagatggtttaaagacttaaatgttagacctaaaaccataaaaaccctagaagaaaacctaggcaataccataggcgtggacaaggacttcatgtctaagacaccaaaagcaatggcaacaaaaccaaaattgacaaatgggatctaattaaactaaagagcttctgcacagcaaaagaaactaccgtcagagtgaacaggcaacctacagaatgggaaaaaattgttgcaatctactcatctgacaaagggctaatatccggaatctacgatgaactcaaacaaatttacaagaaaaaaacaaccccatcaacaagcgggcaaaggatataaacagacacttctcaaaagaagacatttatgcagccaaaagacacatgaaaaaatgctcatcatcactggccatcagagaaatgcaaatcaaaaccacagtgagataccacctcacaccagttagaatggcgatcattaaaaagtcaggaaataacaggtgctggagaggatgtggagaaataggaacacttttacactgttgatgggactataaactagttcaaccattgtggaagacagtgtgacgattcctcagggatccagaactagaaataccatttgacccagccatgccattactgggtatatacagaaaggattacaaatcatgctgctataaagacacatgcacacatatgtttactgaggcactattcacaatagcaaagacttggaaccaacccagatgtccatcaatgatagactggattaagaaaatgtggcacatatataccatggaatactatgcagccataaaaaatgatgagttcatgtcctttgtagggacatggatgaaactggaaaccatcattctcagcaaactattgcaaggataaaaaaccaaacaccgcatgttctcactcataggtgggaattgaacaatgagaacacttggacacaggaaggggaacatcacacactggggcctgttgtgggctgaggggagtggggagggatagcattaggagatatacctaatgtaaatgacgagttgatgggtgcagcacaccaacatggcacgtgtatacgtatgtaacaaaccagcacattgtgcacatgtaccctagaacttaaagtataataaaaaatatatatattaaaaaaaaaaagaaaaccatagatgaaacctctgtgggcagggcccctcacttgggagacccaactcctggagcttggggtaagagacaacatgaagatattttctcattattatttactgttgagtaacagactcccttaactcaaattactccaccattcagtccatgtacatcatctatctatagcccaagccagggatgcaatactataacctctaactactgtctgtcctcttcatcccagatttatgtctccttttttatgtgcaaaggcagagaagctgtcactgtactacatctggagttgtactgtctcatttcaggggccacaggttctagcccagaatgtttactttttataagatgctgagttgtggacttcttgggaacatattgattgaagcctgcagcatggcaaaggttgtgtaatactttttccaccctacctcttaggaactggggagcaactcttcccactgaagaaagagcatggctcctggctctttaccaaatctctcattttttagttctcagatgtgatttttctctctgacactccttaatccaacaccttttatccttacaggtaggccctatgggacttatgccctaaagactgtaagggctaggcagcccatatgttcgtatgttttctgttggtataactgaataccacagactgggtaatttataaagaacagaggtttatttagctcacagttctggaggctgtgaagtccaaggtttacaggcaggtatctgttgagggtcttcttgctgcatcatcatatggtggaaaggcggaagggcaagcaagcacatacaaaagagggaggcaccagaggccagcccactttataacagcccatcttgggataactaacccactgagataatggcattaatctgttcatgagggctctgctctcatgtcctaatcacttcataaaggtgccacctcttaatactgttgcaatgtcaattaagtttcaacatgagtataggaggagacaaatattcaaaccatagcaccatgtttctacatgttttcccttttatacttacagtttgtgtcctttaacctcattttctgtggcatttgttcttttacaagtctgtgctcctatgattattagaaaagcccaaaatattccagtatttgttctgtcagatcaaaattgtatcacatctctgggtttctgggggtaaagcaaaagatacattcatttacagcctcttaagtccttttatataatattccataactgcaggatgttggcttaaaattagaaaactctgcagtttctgaaactttaccttaatgcttaagtaagaacagaaatatggggaaagtttttgatattatctaatcaaacttttcagaaagcttttacttgtgagggatgtaggtctgtacacatatttaaataatgaaacctagaatgtcagtcttgtgccatgttctgtctgatattaagcacagtgtttaactcaaggacactgagactaaggaaagggtctaggaatcagaagtgaggtgtcctgatttctgtccttacgattttggtcctctcttcccccacaacacacacatattttgactctgaaggcttttgaggaggaatgtaacgatttgctgtgctttagaaaaataactcttatagtaatacatagagtgactacatgctagaagattattgaaaaggtttcagtaaatggtaataaataggccagtgagagtggaaaagtggggataaattaaggggacctaatggaagaaaaaaatcacaggctgtattcctttctggaatagcatgccaagttgtaacaatttacctgctagaagcatggtatggtcaagcagtccatgagaaaagcagggagggtgcaacctctggcagcaaagggccctggcaggcatgtcaactatgtatgtgggactacagatttttgccatgaattcctggaatgtaaactctttgaggctagacttagcctattttgttcactgtgtttgtatagtcggtactaaggaaatacttattgaattagaatacctattctttttttttttttttttttttttttttgagatggagtctctctctgtcacccaggctgcagtgctgtggtgcaatctcaggtcactgcaacctccacctcccaggttcaagtgattctcctgcctcagcctcctgagtagctgggactacaggcatgtgccaccacgcctggctaatttttgtatttttagtagagacaaggtttcaccatgttggccaggcttgactcgaactcctgacctcaggtgatctgcccaccttggcctcccaaagtgctgggattacagtcgtgagccaccgcacctggcccctattcacttttgattaagcatttgtatgtttttgtggtagaagaggaaatcatgaccattcctttacttcatttcctgacctctatatatagagcccactggacatatctcatagatacctacctttagcctcatcatataataaatatctgttgaatgaatgaatgtccaagatggcatttgtcatctatcccccaactgaacctattctacctttaatttccatctcagcaaatggctccaccatccacttggttgcccaaagcagaaattagatgttatccttgattgaccttttattttacttcccatatctcatcaatcaccatgtcttgtcatttctttttaattaataagtctgtcttgctgcaaaagactgtaggctccgtgaggtcagggattatccttcttagctgtagagcttagcacaggcacataaaaggctccaaaaaagtgttagatgaagtagaagagtgagtgagtgagtgagtgagtgagtgagtgagtgaatgaatgaatgcctatttttgatacaggtcataactatctcatgtgatttctctgattttgcctcctttcggttttctttctgttttccaaacagattatctcttttgttttaatccttcaacaggtcccttttgattttgaaaaagcacagaatctttaacgtagcttacgtggtcctgagtgacctggccttgtgtacctctcttgctttatctttcttcatcactctctctgtggtccagccacactgaccacttgctgttcctctaaaatacctgtacctttttgcctctggacttggcatatactttttcgtttgcctgggtcctctctcccccccacaacacacacttattttgactctgaaggcttttgaggagaaatgtcatgatttgctgtgctttagaaaaataactcttacagtaatatatagagtgactacatactagaaggctattgaaaaggtttcagcaaatggtaataggccagtgagagtggaaaagtgggggcaagttaaggggacctaatggaagaaaaaaaatcacaggctttatcagggttccttggttgcagacagccaactctggctagcaaaaaatttggagtacgaggaggcagaatttattggaagaatgtggggtagctcataatatcaaaggaacagctgaacatgcaggtttcaggaagggtggtaaccagagcagctttgggcatttagggagcaggaacaaagggaaagtctcctcatggactgttgcctggatgaatttaatgtcaaaagtattcagttcaggcttcactgtgttcaaggtccaaaagtacagttggcccaacttgggtcctatatctatccctgaatcaatccctgcagtcaaggggatggaatgtgataattagtagtgggtcacatggccacccttgaaggagaggtaggggatggatggctcacgttaatctttgcactatgaatggaagaggagttggttccccaaaagaaaactactaaccagataagagtaatggagaagaataaataaataaagatgcattggagatttacagccaaactggaaggaagattatggcattaactaagataaaatacaaaagaagggaaagtacataaggctttggagttgggatcataagttcagcactgagtgtgtctgagatgccatcagaacatccatgtataatatgaaacagcaataggaaatttggttcttgaggtcagagcaaagggctcaggtttggaagtcattggctgggagtgagagatggagaaaatctccatggagaaaggtgagatcaccaaatctttgaggcatatcagactctgctgcagtatcctgaaatcttttactggtctgagttctgttctaaccatgaatggtattaacatctatttaattctctgtacttaactcttgcatttggaacttgatgattctgctgggcttatagaattcaaaattctggtgagggtgtttcccaactgtgaccttttatttttctatcatcttagaatcttccatactcagcctcttctggtcttcctgttcatgcagttgctcacgatcctgagccaactgggacctggtttcaagaggtgaatttaaggttaactttaacatagttccaaggcctccaagtggaaatgcccaggaaataactggagttgtgagacaggaatttgtgtggaaagtcaagattaatagtagcattaggacatcttttctatagaggtgatggtctaatctgtaatactgggtcaacttcctgagggcatgattataagaatggagaaatgagagtcctaggattgagccttgggaaaattgttttgggaggtgggtggaaaaaagtgagtcaggatcatagataaaaggaatgtttaaagaagtgggagaatacaaatgtctcaatagctaagggaggaggaggtttcaagcagaggatggtctatggtatagagaagtcaagaagaatgaaatgtgagaaaaagacccttggacttagtaaagtgaaaaatcacttaggagtaaaagtttttggccgggcgctgtggctcacgcctgtaatcccagcactttgggaggccgaggcgggcggatcacgaggtcaggagattgagaccatcctggctaacacggtgaaaccccgtctctactaaaaatacaaaaaattagccaggcgaggtggctggcgcctgtagtcccagctatgcgggaggctgaggcaggagaatggcgtgaacccgggaggcggagcttgcagtgagctgaggtggcgccactgcactccagcctgggcgacagcgagactccatctcaaaaaaaaaaaaaaaaaaaaaaaagtttttgcaacttttcataaaatgatagaacggaatccagaattcagggaggtggaagaaaataatggatggtgaggaaatggggatcaatcaaactaacacgtaattattgagctcttaacagtgatcatggcattgtgtctatactgttgtcaacttaattattactgccctctaggagtatcaaaccaagttgagatgataaggaatccatgaaaatattcattgcaataaattcagaagatgtcataaggtagaccatgattaatgcataatgcatgatatggacaataaaagtatacttgttaagagtgaaatgaggatgctttggtttggagttctctgggaaagctcttgtctgttcctgcttcctgtagtctacccatcctcttttaggataagggcttctgatttcccatgacttaggaaacagaattaagactgtttcattcattgaagatcagaatgccctgcgtacagtctggaaaagtaacatgtgccgcctgaagagacaagagtttgtgataagcaggtaagctcttctagtctgccccagaagcctcacacaaagtgggttgttttaacagtaagaaataggggttatgtgggacacacgagcagttgtggagagtcaggactcctgtactgatgggaagaatagagctatcagaggccctgtaagtataggattttagctgaatgtggaacagacaggcatctttagtagttcatggctttgaagctgcttggtgtggaagaagtggagctcgtggtgttttccattttcctttcactgaggtctctggtaatgttcattttcctcagttactatcttcatgttgaaaggagaaatactcttttcattttccttattagtcattaaggctaaagttaggctgagcagagaaatgaatgcaggctcagaactggctgttagaaaaatagacgaccatctccacaggctagtacatagtacatcatttttcctttgtaagtgttgtattaacttgtgtctgggttttaagaagagaataagtagcctccattaaatcctgctgctagataaaactggtctcaaagcagatagttatcagtcttctaagtaggaccttgtttgcctgtcagtgtgatgcagtgctttcctctagaagaaaacaatcaaactgttatccttgagtctcatgttatttttgcagatatttgccagaaccacacaagtaagttgggattcaaaccaggttttccaaaatgtggaacttgagcactgtgcttcaagaattgcgcagaatgcaatcagaagcctgggtggttttagttatagtgcttcattaagtggcagtatgaatatataaacaatatttctcctctgtggaccccagtttcctcaatttctctagtctagatgattgaattttcaaaatcacccacctctgaaattttagaatatatccttatacctgcacacgtaaattaagcctggtgattctagtagcataaattttccccggttgatgctaatggcccagaacgttttcctttgatgaccttgcttcagagaaaagtggcttgtagtaaatggagtaatgtgagtagcagtgaaattgttaggcgattagagaatcagggcattgacataccctgaaaaaacactgaactaaaagctgagacatctggggtctggtcctagtattgacattaactaatttcgggaccttgggcaatcacttgatctattctgggctttaattttcccatttataaaatcaaagcattgaactaacatctctagttcccagctatgcagttggaggatcaattcctagaataattatctgctgcaattgcactttctattccagtacccagacagaccatagtgatgtttacgtccattgcctaggagtatttaccactaaatggttggattgtctgatatttctaagcagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggtaaacagtgtcttctcatttttttgttagctgtcagcccagaaaagagatgttacagatttttaaaaaatcagcttcattattgaggtataatatataaacagtaatattaaccagttttaaatgtacggttggatgagttttgacaaatatatagagtttgtgtaatcacaccgtaattttgataaagaacatttccattactccagaaagctccccctttgtagctaatgcccttctcctgcccctggaaacaactgaagtgctttctgtgcctttagttttgccttttctatgtaagtgatcatactgcatatactcattggcttctttgatttagcgtaatacttttgacattcatgtttgttattgagtgtatctgaaatttttttcttgctgagtagtagtcagttatatacttataccataatttgtttgtccattcaccagttgaggagcgtttgggttattcctagctttgcactcttatgactcaagcagctatgaacttttgcatatgagtctttgtttgaacatatatttgtatttcttttgagtctatacctaggagtgagatttttgggtttaaggtaattgtatatttaactttgtttttgtttttcaagacagtctcactttgtcgcccaggctggagtttgcagagcaatctcagctcgctgcaacctctacctcgtgggttcaagtgattctcctgcctcagcctcccaagtagctgagattacaggtgcctggcaccacacctgaataatttttgtatttttagtagagacggagtttcaccatgttggccaggctggtctcaaactcctgacctcaagtgatctgcctgcctcagcccctcaaagtgctgggattataggtgtgggcctgtgggccaccgcgcccggccacctgtttaactttattagaaactgtcaacctgctttcctaagtaggtctactttttcccttcccaccagcggtgtatggcaattaaagttcctccacatccttggtaacactttgtcttgtcagtctttttaattttatccattctagtgagtgtaaaatgataccttaattgtgactttaatttacctttctccagtgactaatgatgatgaacattttttcatgtgcttatttgccatctgcatatctttgaagtgtctgttcaagtagtttgccaatttttaaattgggttgattaggttcttgttgggttgcaagagttctgtatatattccgagtacaaattctttatcatttctgtattttgcaaatattttctgtagcttgcctttatattttcttaacagcatctttcaaagagtagaagttttaaattttgatgaagtccaacttaaccatttttttctttacgatttactttttttttttttttgagacagagtcttgctctgtcacccaggccggagtgcagtggtgccatctcggctcactgtaagctccacctcccaggttcatgccatcctcctgcctcagcctccctagtagctgggactacaggcgcctgccaccatgcctggctaatttttttgtatttttagtagagacggggtttcaccatgttagccaggatggtcttgatctcctgaccttgtgatccacccacttcggcatcccaaagtgctgggattacaggtgtgagccgccgtgcccagcccattttttatgttctgtttaagaaatatttggctaacccaaggtttcccaattcccatgttttctagaaattctacagttttagcttttacatttaggcctgtgatctattttgagttaacctttatagatgatctgaggtgtcaggactgaggtttatttttttccatatcaaatacccaattgttcagcttcttttgttacatttaattagcttgacatttgcttgacaaaccagttgaccatgcgtgtgcttgtctcttctgggctctattctgttccattgatctgtatgtctctacttgtaccaatagcacacggtccttattactatgtctttatagtaagtctttattttgggtagttcaagttgttcagattttttttcccaagattattttggctatttccttcacaatttcagataaatttacaatcagtttgtcagtttttatgaaaaagcctgatgggattttgattggtactgctttgaatctttagatcaatttggaagaatcaatactgtaacgatattgaatcttctagttcatgaacgtcttatatctcaccatttatttagatcttttaaaagttctctcagcagtgtgttgtagtttccagtgtataggtcttgcatatgtgagggatattggtctgtgattttcttttcctgtaatttctttggttttgatttcagggtaatcctggcctcataaaatgcattgggatgtgttcctttttctattttctggaaaagtttcatagagttactgttatttattccataaaagttatgtggaattctccagtgatattatcttggtctggagttgcttgcttgcttgcttgcttgcttgcttgctttctctttttctttttctttttctttctttctttcttttttttttcagggtcttgccctgttgcccaggctggagtacagtggcacgtgatcatggctcactgtttgatctcctgggctcaagcaaccctcccacctcagcctcagtagctgagcctacaggcatgcactaccatgcctggctaattttttaatttttcaattttttaaatttaaaaaattagccaggcgtggtggtgcatgcctgtaggcccagctactcatgcctggtcttgaactcctgctcttaagcaatcttctggtcttggcctccaaaatgctgggattataggcatgagccactgtgcccagttggcctggagttttatttgtgggaagatgtctatgaatttaatgtattttatggatatagtgctattcgttcattcacttcttgagtgaacttttgatagtttgtatctttcaaggaatttacatagttcatccatattgtcaactttattgttagtataaagttgttcataatatagtctaattatccatttaatatacgtaagatctgtagggtgcaccctcttctattcttgatcctggtaatttgtttcttttcctgatcaagctgcccagaggtttatcatccttgttgatcttttcagagaactgtaatttggtttctttttgtttgtttgtttcttatttcattgacttgtgtttctttctttctggtacttttggtttaatttgcctttctctagtttctcaaggtggaagcttagacccatgatctatatttttggccattattttattaatgatctgtgtctttttgtctctcttttatttccttctggctctccagttgcatatatgtttgatattgccccacaggtcatgtgagttctgttcacttttttttttcttaccatgcttagttttgaatagtttttcttgctatgtcttcaggtttattgatgtcttcttctactgtatctaacccactgttaatcttattcagtgttttttaatttcagacattatcatctctagaagtttcatttgggtcttttttatgtctcatttattcatattttactctcttaaacgtatgattcatatctgtaatagctttcttgactgttttaattgctaatttcatcatccatgccatttctgggaatgtttctgttgactaatttttctcctggtaatgggtcctaatttcccttttttttttttttttttttttgcatacctggtaggttttgattggatgatggatattacaaattttgcattgttaggtgctggattttgttttagtactttaaatagtgttggatttattaggttagcatttaggttagtagaaaatagttgaatcctttaaagctttaacattttttagtttgggtccagaacagcctttattctagggctaattatttagttatatgcttataccataatttgtccattcaccagttgaggaacatttgggttgttcctagctttgcactcttatgactcaagtagctatgaacttttgcatatgagtctttgtgaatatttatagcagcttaatttcaatagccaagaactggaaacaacccatatgtcttttaggaggtgaataaactgtggtacatatatatatacacactgtggtatacacttagcaataaaaaggaatgaactatatatacaacaacctagatgaatttccagagaattatgctgagtagggggaaaaaactaattcccaaaggttacatactatatgattccatttataattgacgtggcaatattatagaaatagaggactgattagttgttgctaggagttaagaggggaataggagtagggaagagtgagtgtgccatgaaagggcaacataaggggtccttgtggtgatggaaaatgttctgtatactgactatatcaatattaatatcctggttgttatattgtagtacagttttgctagatgttgcctttgggagaaactggataaagggtacatgggatttctgtattactagtagtagtattttttaaagggatagagtcttaaccatgttgcccatgctgggactcaggcgatcctcccacctcagcctcctgagtagctgggactccaggtgcatgccactgtgcctggcttgtattatttcttatatgctgcctgtgaatctataattatctcaaaataaaaaaggttaatttttttaaaagcaacacaaattctaagggaaaagattgtgtagcttaaatacataaaacttttaccttctgcagatcagagaatatcacacagtttaaaagacaagaataaactggaaaaatatttataacaaatatgattgaaaaaagttattattattttttttgagacagaggcttgcttgcttttttgcccaagttggagtgctgtagcttgatatctgctccctgcaacctctgcctcctgggttcaagtgattctcgtgcctcagcctcccaaatagctgggactacagtcatgtgccaccatgcccagctaatttttttagttttagtagagacacggttttgccatgttgaccaggctggtcttgaactcctggcctcaagcgatctgcccaccacaacctcccaaagtgctgggattacagacgtgagccactgcgcctggtggatatatttaatatattaaaaagttctagaactaatttagaaaacactgatatccttacagataagcagttcacaaagagaaaaaaatgcaaccagctatgaaacatataaaaaagtattttaatctcacaagtaattaatgaaatgaaattcagtttttcctccaaattgcagttttcgttgttccccctctacctaccttttaggttttgttgaaattatatggaattttaactacaagtgatattaatttttaaagatattaaccttttctgttttaagtgtcatttcttaacggcagcattaaattcctaggccacattatcaatacttattttatgttgataattcttacagatttcattcttaaccactgtctcatatatagcatcatctttcttgaatttaaattttgactaatttttgtatttgtcaagaatacctttatatttttcccatatagtattgtgtactgaatacttggatatctgtacatatttttcacctgtacacaaattgtttggctgggtataaaatcgttgattatgccattttccctaaaaagtttgaaaatattgcttcattctctactttaatttgatattgaaaatgagaaatcttatcctggtctgcttctttttctcaataggttacctgtttttagttaggtagcttgtttgttttctgtctggaaatttgttttattttctttcttttttttttaaattatatttggggtattggtgtcttttttattattatactttaagttctagggtacatgtgtacaacgtgcaggtttgttacataggtatacatgtgccatgttggtttgctccacccatcaactcatcatttacattaggtatttctcctaatgctatccctctcctagccctccatcctccgacaggtcccggtgtatgatgttcctcaccctgtgtccaagtgatctcattgttcagttcccacctatgagtgtttggttttttgtccttgtcatagtttactgagaatgatggtttccagcttcatccatgtccctgcaagggacatgaactcatccttttttatggatgcatagtattccatggtgtatatatgccacattttcttaatccattctatcattgatggacatttgggttggttccaagtctttgctattgtgaatagtgctgcagtaaatgtacgtgtgcatgtgtctttatagtagcatgatttataatcctttgggtatatacccagtaatgggattgccaggtcaaatagtaattccagttctagatccttgaagaattgccacactgtcttccacaatggttgaactaatttgcactcccaccaacagtgtaaaagccttcctatttctccacatcctctctagcatctgttatttccttactttttaacgattgccattctaactggcgtgagatggtatctcattgtggttttgatttgcatttctctgatggccagtgatgagcattttttcatatgtctgttggctgcatacatgtcttcttttgagaagtgtctgttcataatcctttgcccacttttcgatggggttgtttgttcttttcttataaatttgagttttttgtagattctagatattagccctttgtcagatgggtagattgcaaaaattttctcccattctgtaggttgcctgttcactctgatggtagtttcttttgctgtgcagaagctctttagtttaattagatcctatttgtctgttttggcttttgttgtcattgcttttggtgtcttagtcatgaagtccttgcctatgcctatgtcctgaatggtattgcctaggttttcttctagggtttttatggttttaggtctaacatttaagtctttaatccatcttgaattaatttttgtataaggtgcaaggaagggatccagtttcagctttcttcatatggctagccagttttcccagcaccatttattaaatagggaatgctttccccgtttcttgtttttgtcaggtttgtcaaagatcagatagttgtagatgtgtggtgttatttctgaggcctctgttctgttccattggtctatatctctattttggtaccagtaccatgctgttttggttactgtagccttgtagtatagtttgaagtcaggtagcatgatgcctccagcttttaaaaatctgaatttggttggataatctgcatgtgtctgagcgtgtacgaatgtgtggatttttcatagtatttttgccaagcatttagcgagtccttcccatctgaagactcaaggctttcttcagctaaagggtattttcttttataatctctttgattattgttcccatttaccttattttgttctctcattctagaattccagtaattctgagattggatattgttgatagtttgccatgtagcttatcttttttcctcataatttccatttctttatcattttatctttgtgctgggagaattcctcaacttggacttttaatatactaatttggttttcagccatgtccatttcaatctgctattttttcttttttttttttgagatggagtctcactccgtctcccaggctagagtgcaatggtgtgatctcagctcactgcaaccttcgctgcctgggttcaagtgattctcatgcttcagcctcctaagtagctgggactacaggtgcccgccatcactcctggctaattttttttgtatttttagtagagacagggttttgccatgttggtcaggctggtctcgaactcttgacctcaggtgatccaactgcctaagcctcccaaactgttaggattacaggcgtgagccactgcgcccagcccaatctgctgttttcttgcctgagcattaattttttttttttttttttttttttttttacaattatggctttctattcaatagctcctttttatttcttgtttgctacctttttaaattgaagcctggctaggttttatcaatgcagtatcttcttgaatattattaggaatatcaatcataaattggttgatgttaacgcctttatctcctgcactaactattttattagagactattggcattgtttgttttggttagttttgttccctcattttgaactgctggtttcctcataggagcagtgaatttttgttgcttgcttatatttttaatgatggtctttttttttttttttttttgagatggaaccttgctctgtcatgcccaggcttgagtgcagtggcagggtcttggctcactacaagctccacttcccaggttcacgtcattctcctgcctcagcctcccaagtagctgggactacaggcgcctgccaccacgcctggctaattttttttaatttttagtagagatggggtttcaccgtgttagccaggatggtcttgatctcctgacctcgtgatctgcccgcctcggcctcccaaagtgctgggattacaggcgtgagcgaccgtgcccagccttaatgatgtttttgagtaaccagtaatgatggcttacataggctacctcagcagttttatgagttattatttgattttcctcagtgggcctcttcctcttttaaaaagaaaattatttattttaattaatacataaaattatatatattgatgttttgatatatgtatacactgtgaaatggctaaatcaagctatttaacatacacattacctcacatacttaaggatttttgtggtgagaacacttaaaatgtactctgttagcaattttcaaatatacaacatactgttattaactatagtctgtataatgtataatagatctcttgaacttatttattcctcctatccagctgaaattttatgtcctttgactagcatttccctgatccccctagcttctgataaccaccattttattttcttaatgagcttgacctttttacactccatatgtaagtgaaatcacgctgtatctgtctttctgtgcctggcttatttcagttaacataatgtcctccaagttcatctaggttgtcataaataacaggatttcctttttgaaagctcagtaggccaggtatggtggctcacgcctgtaatcccaacactttgggaggccgaggcaggtggattgcttgagcctaggagttcaagaccagcctgggcaacacggtgaaaccctgtctccacaaaatacaaaaatttgctaggcatggtggcatgtgtctagtcccagcaacttgggaggctgaggtgggaggctgagatgagtccaagaggtggagactgcagtgagctgagattgtgccactgcactccagcctgggtgacagtgtgagacctcgtctccaaaaacaaaaaaatgctaagtactattctgttgtgtatatgtgccacattttctttattcatccattcatggatgttcagattgatgctatagtgtggctattgtgaataatgctgcagtgaacatgggagtgcagatatctttttgacatactgatttcttatcttttggatatatatccagtagtgggattactggatcatatgatagttctatttttaatttgttgaggagccagtatactgttttccatagtgactgtactagtttacattcccagcaatagtatataagggttcccttttctctacatccttgctgacacttattattgccttttgtctttttgataatagccattctaacagatgtggtgatattgtggtttaaattttcatttcttgaatgtttaatgatgttgagcactttctcatatgcctgttgactatttttctgtcttctcttgagaagtgtctatttatatcctttgcccatttttaaattgggttttcttttgctgtggagttgagttccttatatattttgcatattaacccattatcaaatatatggtttgcaaatattttctcccattacatagattgtctctttactgttgtttcctttgctgtacagaaactttcagtaatcccatttgtctattttcacttttgttgcatgggcttttggtgtcatatccaaaaatatcattgtccagaccaatgtcatggagctttttccctaggttttcttctagtagttttacagcttcaggtcttatgtttaagtcttcagtgcattttgagttgatttttgtaaatgtgaggtgtgagatgagggtctaatttcactgttttgcatgtggatatctagtttccccacaccatttattgaagagattgtcctttgacctttttgtgtttgtcctttgacctgtgtgtgtgtgtgttttattttttggcatctttgtttaaaaaaattgaccataaatatgtggatttatttctgggcttttattctgttccatcagtctgtgtgtctgtttttatgccagtaacatactgttttgattactatagctttgtagtagatttgggaatcaggtactgtgatgcctctggctttgttctttttgttcacaattgctttggccatttggggtcttttgtggttccatatgaattttagaattgtttcttctatttctgtgaaaattgtcattgaaattttgatagggattgtattaaatctgtagattgctttgtatagtatggacattatagcagtatcaattcttccaatccataaacgggacatcttttcattttatttgtgtcttcttcaatttctttcatcaatgttttatagttttcatttcagcctcccaagtagctgggattacaggcatgcaccaccatgccgagctaattttgtatttttagtagaggtggagtttcaccatgttggtcaggctggtctcgaactcctgacctcaggtgatccacctgtcacagcctcccaaagtgctgggattacaggcgttagccaccgcacctagcctatactttcatatatatatatatgtatatttgtgttactgaatagtgtcccttgctctctacttgaagaacacccttgagcattttttataagatagatcttgtggggataagctccttcagcttttgtctggcagagtctttgttttttcctcatttctgaaggagagctttgccaactacaatattcttggttgaccttttttttttttgtttttgtttttgttttccgtaagcattttgaatatattatcccactcttttctggcctttaaggtttctgctgataaatctgttagaactcccttataatgtgatgtactttttttcttttgctgcttccagcatcctctctgtctttgatttttgatagtttgattataatacttcttgatatagtcttacttgagttcagtctgattggagacttttgaccttcttgtacccagatatttataactttccccagatttgtatagttttctgctattatttctttaagctttctatccctttgtgtccgtctcctccttcttgaactccagttcccataaatcccataagcttgctttcttttcattctttttttctcatccaactgtatattgtcaaataatctgtctttagattcaaaggttcattcttttgctcaatcagttctgctgttgatactctctattgcatttttcatttcaattctcgtatttttcagctgtagaatttctgtttgatttttttaatataatttcaatctctcgtaaattttttgttttagttatttattgttttcctggtttcctttaattgtttctctgtattttcttgaagttcgctgagtttccttaaaacagttatcttgaattctttgtcaggcagttcatgtgtcttctttttctttctttctttctttttttttttttgagatggagttttgttcttgttgcccaggctggagtgcaatggcttgatcttggctcactggaacctctgcctcctgggttcaagcgattcttctgcctcagcctcctgagtagctggaattacaggcgcctgccaccacgcccggctaattttttgtatttttagtagagataggattttaccatgttggccaggttggttttgaactcctaacctcaggtgatccatttgtcttggcctcctaaagtgtgtgagattacaagcgtgagccatcacgcccggccgtatcttcatttctttagagtctgttcctggtgctttattttgttcattggtggcaacatgtttccttgattgttcttgatcctcatggctatgcattggtatctgtgcatttgaagaagcagggacttttgctggtgaatggtttttgcattctggctttgtccggaaaagccattcaccagtcagcctgcccagagattctgggtaggccatttggtgtgatctgcaggtagacttgctggtagagtccttaggcagggtggcctggtgttgagtccgtggggttggggttgaagcctggatccactggggtgtacctgttgattggatcctcaggcatggacctggtgcttgtatcttgtgcagagaggctatcccaaagcctaggtccacaagggctgacctggggctggactgggccttgagcctgggtcttcagagattggccaggtgctaggatgaacctggtgcccgggtccactgaaatgggcctggaggctgagtctgatggatgtgtctgaaggctaggttcattagggctggcttgggtcctggggccacaggcctcagcctagaacctaggtccataggggcagtcctggggttctgagggccggcccaatgctggggtctactgggttgggctagacccagggtctgctggattgtgggaatgcaggggccaacctgaaggtgggggtggtcatagagactagcctggcactgggcaggcctggagcctgtgtctgcaggctccaatttgggtgccattggggtgccaatttggcactgggctatgtgggcagacctggctctggttttgtctggaacctagggtgggactggattctggggccatagttgctggcctgatgctgggtgggcccggagtctgtatctgcaggggccagcatggaggctgggtctgtgggtgcaggcattatgactagggatgcagagctggactgaggcctggtgttggggtaggctgagagcctgagtctgggtgaccttccctcttaaagcagatagtcatgaaaattcaaagataagctttgttctaagtgtgggaagacagggacatgccagcaaatggacttcttttaagcattcagtggctgggagctgactagcaagcagcttctccagatcctatccttgaccatggtggctgagggtcttgggttagctaagctccactttacctagcattccatccgcagtaagttaagccttggaataaagactgcattggcaaaattcttaacatactactgtgagtgctggtgagggtgtcataagatggacagtctttatatcactggtaggattgaaaatttataccactcttctggaaagtaatttggcacagtataaaaaaggcttttataatgtccattccctttggtctagttttcatatttatagaagtctatcttaaagaactagggaagtggacatagatttatattaagaaatcttaacttgtatactacttataataggggaaaattggaaagaatctaaatgccctagaaaagaggactagtaaatcatgtcagttatgtagctatatgatgagatattttgcaaccaactttcaaatgcctaatgacatggagagatgctcatgatataatgttgaattgaaaaacatcaggatataaccttttatacacaaatatgatccttctttttaaaaaaggggaataagaaaatacatgttggccgggcgcggtggctcatgcctgtaatcccaacaatttggaagaccgaggtgggtggatcacctgaggtcaggagtttgagaccagcctggccaacatagtgaaaccccgtctctgctaaaaatacaaaaaattagctaggtgtggtggcatgcacctgtaatcccagctactcaggaggctgaggcaggagaatcacttgaatcggggaggcagaggttgcagtgaaccgagattgcaccactgcactccagcctgggcaggcgacagagcgagactccgtctcaaaaaaaaaaaaagaaaagaaaagaaaagaaaagaaaatatatgtgtatatacggttaaaaaaagaccagaaaaaagcaaattattatgagtgaagatattatgggtgatttgtgttttcttttttaaactagcctgtatttttttcaaattttctacaaatgagtctgtatgatttttatagtcagaaaaagcagtaaatgtagaaatgtctccacacacaccctacattgcaccaaaaaagacttatttgtcacagttgtaggcaaaaaatggtttacgttagggttgaatttgccaattatcataatgggcaaatgggttctgaatcctccagctttctgcactgtatcgtgattacggccgctggtgccagtactggtgtgtgagctccagcacggcccatctgctgctcaggcttgcttggcggacacagatttatttcatttagtttggtaatttggcaacagtttctcttttctcattatcctagctgggattcagtaccagtgttactcattttgtttgccagtttgttgttttcttttgttccattttgtgaagatgaagaagccaacaacaggaattctgtcttccgaaaatgcagtgcttgtcctttcgggatcttgggcatgccttgctaaagtgctctctatttttgacacttgcaagccatttcaattgtttggataaatagaaagcttcatggtgtatttttcaaagagcttagcattcctttcctctccccactccaccaaggaagatttggaaattgttccaaatagaaattataaacattagcctggagctgtgctgtctctgtctggttttgatgctttttttgttttaactaaaggctcatgttgtttgtttaatcttcatcagtactgcaaaaacacatggtataagacttaactctgccccaagcaccctacacataagaagggattttcatctgaattagtttgtatttcaaagagcactgggatagccagattgctaagaatttgctcaagtaaaactttagaactattggaatcttagagatgtcttgaatggatttgttaggataggatggctgctgcctgagaatcctctttgaacctgacactattttttttttttttgaggagacattctttgtaatactttgtgctacttttctctctaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgcctttcctctatcagagaagttgatccattaagtaattatgtttggtctattgtaattacagatgggaccactcaggggcaaaggtctgactcttcctggtaggtgtaacagatagttcacctgtgaacgaacatcagcttacagatgatgaggacttaaggttgcaagaatgaagatttcagactccaagatcccttattctttgggccttgagcaggttagtagtcccctggtgagaagagaacattttgtttgtggggctaatgggcccagaggagggtaagactctgctgtctaagctgaagcctcttcctcgcagcgagggtcttcctaggaacattgatgctgcctcagacatcctcttttctccagagtagggaagactcccactgatctgagaatgagcccagaggcttgtttggggactgttttactctgatactacctggatatctagcttcctttacccctgttctgcttaacagaactgccaagcccagaagtacctttgcactcctggttttcagtggacagaggaagctttagatagagactttagaccctgccctgcagagtcaagacttgaggccattgaagctgcaggaagccctgcccagggatggtcctgccatgaggaggctgcaaccctataagagggctcaagattgtgaattctgctcctgccatgaggagctcagaaggccaggaagccagcaataggggagagaatctgtgtgcttatggacagtccttacctaaagctgtttctgaatgttgcaccctttgagaaatttcttctcagaaccataaattgaaacaaatgaggactgatcttgtatacaaagtgccaactcaagagggaagttggagtatgtctgttgcagagaaccaatatagcagtgcccaggggtagagaccatgtgttccatactcggatatttgggtctttttgagagagctggggaaagtagcagcaactagattaagactgggaggattttgaccaaactaaaggccttttctccttactgcatctgacgtgtgtcttcttgagacaagatagcacccatgaattacatcatgaggtatgcgtgaattcagtttacatgtaagacctgagagttcgaagagggcacattcccaaagacattcccagtcatgaaatgtagaagactggaaaattaagacattatgtaaaggtagatatggcttttagagttacattatgcttggcatgaataaggtgccaggaaaacagtttaaaattatacatcagcatacagactgctgttagaaggtatgggatcatattaagataatctgtcagctactactaggcatttattgttaattgagttacagaaagtcattcaagactgagtttatagaaagcatattgcatctatctctgtgtagaacatttgattcacattgtgaagaatgcagtttaaaatatactgaatgcaatctagatgtattgtacacgaaaggtgaaaaataacaggtgctctttactgtttagataaattgttttctgtgttatttcccttcgttcactgtgaggggttgattcatgaggagagccctgggttcctggctcaggtttacttttggccttaggataggattcccttattagagataaatactgctgttctcttctagctcattcattcatttagcagtcaattgctcagtgccaggtgctaggaacagaggctcaatctctaccctcagaaaactcagtgtgacgagagagagcctgacagataaaatgaactatgaccctgtaagagggctcaggatcgtgaatcctgcaggcagagaaacatgagccataatctgtccctgcattttctagctgtggaatcttgggtcagctccttaactggtctgagctttggcttcagggtagtaaagggaggggtattaaaggtcctggttaaatgaaatcatcagtgtgtgtaaaacagcattggttctagctcatacatgataaccactcattaagtggtaattatgtttttattataagggctatgctgtaattcagacatgggcccaaaactacaggaaagataaattgtttttgctaaagtattgccaagaaacttcacagtttcttgggaggtgggccttgaggcatgcaaagaacttcttcaggtaggcaaagaagagaggacactcttggcagaaagagttgttgaaaaaagcagtagggtgtgaaaatacatggatgttcaagtattttggtgaggctgttatgtaaagtgttgttggtctttggggaaaattggcttatggaaattcctgccagaagtactaagcccttatggtggttcttcctgccctagctcttggttggtttatatataaggaatatatttgtgtatttatatatcagacatttggatgtacctttcagttatttaggatttagaaaattctttttggattttccagaattattttatccttcggggatgacagttatatgtgtatatacaacccaggatgacaaaatcatgggtccggtttttgttgccagggctgctgtctcttttcttgcggtcttcatttctcacgagggtgctgggaacttgatcagtcccctggccttttggcactgtggcagagtacacaagtcatacctttatggacagttagctcacaaaacaactgcataatctgggatcactcttggtaaatcaggtgggtggtgcagccaggagatcccctttcctggtcacaacaggagcacaaagaaaccattatctccatgactagctccagaagctgggcccagggagtcgtgatgaggagtggaggtgtatttggcctgtagaatcaacggcctttgagaaccatacaatgcaccttatatggcttgggtgatcaaataacttaaggtccaaattcaaacactttggaaaaagggagctttaatataattatgccaaggtgataggcataaactaagactgtcctggacgtagggtcacccctgtctatagccatttaagatttttgaacctgatgactaaacaaacaaaaccctctttcctttttagaatatcctgtatgcgctatttcccaccagaggcagaggccacaggagataggccatggttcaggtaggaaatgctcttggtcacatcagaactctagatctgggggaataaacaaacccgaattattaccacactctcaaagttctcttcaatctggactatttgtattccaaagaaaaatttagtgctttagctattcagcaatattgagaaaaaacatgaacacatttatgactttgccttgaccattgacttttctaaaatgtgcttccttttcctttatttccctttttttatacaaagaaaatagcccaaatttctcctcttaggtcattccttaacctctcagagaaccagtttccccatgaattgggaataatgctctatttacagggctgtttggattaaataagatgctgtttataaagtgtctgtgccagggcaaagcatgtggtaggtgcttggtgacagcatgatccctgtcaccactctgtcaagtccagtgttgctgagatgtcacacctgacaccctctaaggctaccctgattgccaggagtggcccagggcccttctgcagtctccgggtgcctttagttataacctcttgtctgggtcagaccattagctttcatgtctgcttctagctacaactgtagcctcccttccttttgccttcaaatctgccacagctgcccggcaacaaaaaaagattcctaagcatctcgaggtcctgtttaaatgggttagggtccaagcaagccctgagacatcaagtggttgggtcttttatacctttttcatctctacagccctgttctcttcctaaggccaggcccacaggggatactgaggaaccaccagccccttcaggcggcacagcagaccctgaagagaactgctctaacttaagtaccttctgacttcaccatttttccagcctctgggtgtggttctgatgaaccttaaacttgaaaggcacaggccagaggaaggacagtgttgacccacatgtcattggtgaggttatgatctctttgctattatcacctacttacccacctgaggctcctaggaaacaatgaatgaaaggtatagaaaaaaattaggaagtaaacagggcttttttcccctttatgaaaaaagtacacagaagtgttgaaacgattcaagtttaatttgttgatatatgtgtgtacttagacaaacactaaattctacaacatacataatgtcaacatgggaaaataccaagtttgtcattgcacataccaataaataaatacatttgctccagaataccaaagtttattcaaaaagtcaataaaagcacagttttgcaaatttgtc

SEQ ID NO: 657 - DNA, 19777 bp, Homo sapiens
ctgagactggacctgaggagacctcagcctcggtgctcgggccgccccgcctctgccggaaagtccgcgccgccgctgccgccaccgtccgcagcccgagcgccccggagccgcaggccgccgccgcgcagagacgccgcggctgcgactaggcgcgcccagccgcacgtggcggacccgcccccaggcccgcagtgtcctggaccccgcaggcctccgctctcctgtcctcggccccgtccccagggccgcgatgagcttcctgagccgacagcagccgccgccaccccgccgcgccggggcggcctgcaccttgcggcagaagctgatcttctcgccctgcagcgactgtgaggaggaggaagaagaggaggaggaggagggcagcggccacagcaccggggaggactcggcctttcaagagcccgactcgccgctgccgcccgcgcggagccccacggagcccgggcccgagcgccgccgctcgcccgggccggcccccggcagccccggcgagctggaggaggacctgttgctgcccggcgcctgcccgggcgcggacgaggcgggcggtggggcggagggcgactcgtgggaggaggagggcttcggctcctcgtcgccggtcaagtcgccggcggccccctacttcctgggtagctctttctcgccggtgcgctgcggcggcccaggagatgcgtcgccgcggggttgcggggcgcgccgggcgggcgaaggccgccgctcgccgcggccggaccacccgggcaccccgccacacaagaccttccgcaagctgcgactcttcgacaccccgcacacgcccaaggtgagagcggcgggcgcgggcacccggcggccggggccgcggcgccggaggggccagcgccgctgcctgggttcggttacagaagcggccggccgctcccccctcgctttcctgcgccgccccccaaagttggcagcccttgtgtttggccctgccccgaggttgtccgttgagattatgtaactgaacaatgggcctcgtctggaacttcatcttacaaaggggccgatcggcccgtccgggtggccaaggatttgccgcccgttgagtccgggccgccccgagcgtgtcagccccgagtgcggcaccgataacgcggttcgcgaggatgctggagggtgccggcccggccacctgacactcccgagccataggatgccttttaaacgcggcgatcgggcctgtaatttgggcggcgcgggcagaaggagtttaaagaaaaataattgtcccgccctgatcgtgtcgtgtcgtgtggcgtggatgggggaaaggtctggggcatgcagggagactacgcttggacttgggagtaaaggctggccttccaagcatttacagtcctacagactcatcctaagtccaggcagtactgaggcctgtttctggacaaggtcttggcccagcatttgtttttatcgtgggtttgcggtgcccagagtttggccggcctccgtgtgattaggaacatcctaccgtagataaggtatcttaaagaaggaggtgttcagcacctgtgttttgaaaggccttcgagtactgcgcagatgaccacttttaaaactgcagattttaaagctgatacttccagagattaagacaagcctcgcatttgtaaggttaacagggaagatgcaccttttaaagtgagtttgttttgttttcaatgtactgtttgtcatcagcctaggcaatctgtgtgctttcgagctgtactgtttattggccgacttgctcaaggcaaaatccctctggaagtgaggggaggagtccagcggaggtggctatggaagccctatctagatgggggaggggagattttatggggctctcggactgctttctatttttggatgggttgaaagaatttgttaacttttagccactagaatgaacttagttttaggcagcatttatattctttttagggttagaggcagattttacttggctatttttttcaagaaaagatagttaatatccagcttcagtcttcctaaattagccacaatttattttgcttgaactctaacaaaggcttgtgtgttgctttcacctacgcattcagccctatgaaaggctcgttgaaggttaggttgagaaggctgactataggacttggatcctaaaaattgtatttgtatttttctttccctagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgagtaagtcgtttatttaacagtttggttctccaaataacctaagattggtttggtatacttatcaaaatttagttcctatttaatggcatggatgtatctgtcagatatattgatagaaaaataacattttttttagttcctgtggtgaagacatggaagccagtgattatgagcttgaagatgaaacaagacctgctaaggtaaatagctttttatttttatttttttgaaatttacttttctgccacttaaagcatgctatgaatatgttaataagcattaacacataaggtagaatggtttttaaatttcacacatagccctatcaccatagcaagaaataactgttttcgtatatttgtattacatatatggaaacactttttattacagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagtatgtattaaacattttgtcttttgctcttttgtcccctatggtgttactaacattaaggtttcagctggtcaaacactgaattccatctctaacttttgagaagctgtaatgatttaatcaggtccttttcacttaataccatcagttcttattggacttgttgaataatatgagtctgattttggaacctaacttaaatttcttatttctagtcagcatccatgaattcacagtaaaatggagtttattcttacctgagtcctagggcaagcaacatttcttctttctgataaatctttaatggaatctgcctttggaaaaatctcttacaagtctaaaccccttctctcttaagcaagttgctttttagcataacaatagataccaaaaatttattgtatgaagtttcagataaattaattcagtttaagcttgagtgaaaattatttaccattctattaatctcaaatttcttctaggcagaacgctttgagagaagtatatgctcatgcagtgcttggacagcattctcatgtagttcgatatttctctgcgtgggcagaagatgatcatatgcttatacagaatgaatattgtaatggtgagtgatgtaatggttttcttgtgagcttgagaaaatgaacatcgaggaaatatttatggttatctaaaatcttgctctatttctgtcacttttatcttttataaatttaaagatcagagacctaacataaatttcaagtacaaggttaaaaaccttgtcctttctgaagcaccttgtacatatctcagtagtagaacttcgcatactatttatgtgcttgtcgctccaactgagctttttgacaagactatggcctcgacacatatattttggtgtccgtagtacctagcgtagtgtgtgaagcatatagtattatgaagtgttaagttgaatagattcttcctgtgtctggtctttgatttccatttcatgtgaggtgctgctaaaactgatgtttgttagtcactgagtctctgttgatctaaattcagctgtttctttaagcattctgtagtccggccctactcccacgtatccaacctagtctaccctagaatccactaacgctttattatgttacattcttttagttctctagcttgtcgtctctccctcctctcccctaaggatgaaacaaaacaggcatgtatagattcaagtttggatgtcttgtatagctttcagtttcggtaagtccttcaagggccgacttatgtctctccttttctattaaaaacctttaccaaagtcttggtcagaattctggttcttatggacgtctgtcattattatataccaaatcttttatggattatttctcaacacttttgtagtttataagtgtgatgattgggttttcatactcaagtgtgaaatgtgcctccctcaaaccttgttacgacatcagcacattaccagtctgaaatgaaaaatatctgtagtttgtttctatttctgtatatcttctgtgaatatagacaatttagagtttagtgaacacttgagaggagataacaaaatttatttttgttgattcttattattccttaaataaacaagaccagttatctcataacttgtaaataaataagtggtgtaggtatggattcaggttccccatatttaaaaacagtgaacaaaacagaagtaaaagatccatttttcaaacctgattcctcattatttaataaagttctccacacttgaaagaacttgagtgtctagtatacagccttgctgctagtttttttcacacagctcttgaaatgtttctattcataccatcaaaatatttatgtaactatcacaaccttatggattattctatttcttaaccttcatttttcaggtattgcatttaacctagaacaacttgaccacaatgtcgtctccatttgatatttgttagacaccatctcttttcagtttccttctttctctttctcaccttcttgatgtgaataattctcttaacagaatagttcattagtagtccaggaatgtcaaatatgtagcaacctaccaatacatggttgtgtaaatcagatgattctgagaaaactcacgtgggcctgggagatagggaactgagtgagtagtcttgctaccctctcagattacaaaaaccttgtcctgtaatgttagattataaaataatctattgaaaataagtttttatttatttatttatttatttatttatttatttatttatttttgagacagagccttgctctgtcgcccaggctggagtgcagtggcgcaatctctgctcactgcaacctttgcctccagggttcaagcgattctcctgcctcagccttttgagtagctgggattacagatgcgcgccaccactcccagctaatttttgtatttttagtagagatggggtttcaccatgttggccaggctggtcttgaaccctgacctcgtgatccacctgcctcggcctcttaaagcaatataaaactcttgaagaaaataaatagtcctgcatgaaacaggactgcctctttgtgtggctatttgtcctacttagataaaagaaaatacgactatctggatgcatttgtgatctcttttgtttcctgtgtccaccgttcctctctccacataaagctttgaatataccaatagggctcatcttcacatcttttccacagtttcactggaaaaggattctgatatttatttgtacatgagtaactgattccctttattgtgatttaatttccttattatcttattcatttgcattataagccttttatcttggtttggtgatagattggaattaacctgtataaacaagtgtagaaaaatattgatggatagggaaagagaacctgaaatgtcagaacctgttttgctctcatcacctttcttgcccttctagcaataagagaagaaatgggcacagctatggttgctggacctgctaaaaaagagaattagccatattctttcttagcacatttgatctaggacttagcctatcttgtctgacagcgttattggtttgctcccttctagagcactctttcccctccctcagttcaagatttgtacaagtaaggagaacatacttaagactaagataccgagatgtataatttattttaaaaacacatttgacgttatgttattttcttatttaaattataggacctccttttctgactaatacatcattgaccttcctaattttagtacccagctctgatttttttattcctaagccttaaacaggagatatttaaaacaattcctcattgcctttgagatgaaatacaaactttaaaagtttgaaaaaatataaacaaattaactgattgatttaactaattctataaaagcaggttatggtctcattcatagtaagagtagtataaattataactatactaaaatactgtctttttacctataacatttatagacttgtcaagggtatggggaaacaggtatgctcatgcattgacaatgggcatatatattggtacagccttctctgtggagaagagtgtgtgtgtgtgtgtgtgtgtgtgtgtaaaacacaccatctccatatattacaaatgtgcataccctttaacccagcaatttggcttctaggtgatatactaaatgtacgtgaaattaccaatgtacaaggttatttattaggccatagtatgtaatagcaaaggcttggaaataattttaaaatgtccatcaaatgagggactgataaatgcatttctttctttctttctttttttttttttttttcgggggactgagtctcactctgccaccaggctggagtgcaatggcccgatatcggctcactgcaacctccgcctcccaggttcaagcaattctcctgccttctgagtagctgggattacaggtgcacgccaccacacccagctaatttttgtatttttagtagaaacggggtttcgccatgttggcctgcatggtctcgaactcctgacctcgtgatctacctgcctcggcctcccatagtgctgggattacaggcgtgagccactgtgcccagccaataaatgcatttctactcaattatacaatggaattctataaagacaagaagaaatgggttgtctttgtatattggtatagagtgatctttaagataatgaacatatgctgttatttatgcaaaaagttgaaaagaatacatagacctgagctgggcgtggtggcagtgcctgtagtcccagctgcttgggagtctgaagcagggaatttgaatttgggtttgggaattctaggctgtagtgccgatctatgttgagcatctatgccgatctatgccgatctaagttgagcatcagtatggtgacctctgtggagtggggcaccaccaggttgcctaaagaggggtaaactggcctaagttggaaacagcacaagtcaaaactcctatgctgataagtagtgggatcaagcctgtgaatagccactggattccagctgggcaacatagatagaccctgtctcttataaattaaaaacaaaaacaaacaaaaaaaaagccaacctgataatactggtttactctgagaaagaaacaggtggattgctgaggtgtatgattgagagagagactttacattttattttgtacccatgcaaatgtattacctattgaaaaaacaataaaattttgatttcacaagcaggttgaagggagaaggtcctataaaataacactttcttggttgagattggttggttgagactcatttggtaaagatggaagaaagaaaatatttcagaaagaagaaaatgctaatattttctatctttgttaggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaagtattgcagatcttctgacctgtgttctttggggttatagagaataaattacttcattatgacaacattgaaaaaatatatatcttctgttttctcattgttagttttaaaaggccttagatccacttaccaatattgttttatgatttctattcatctcttcccttgttaatccccaaaatttgagataaacttttttgagacagtgtctcattctgtggcccaggccggaatgcagtggcaccatctccgctcactgcaacttccccatcccgtgctcaagcagtcatcccacctcagtcttccgagtagccgggactataggcatgtgccaccatgcccagataaattcatttttattaaaagccagaaatttttgctgcatcttacaggaactacaggtgggatactaatgagggcactaaaaatctgtgtttaaagccccactcttccactaggccagaccatattaaaatttccccagttgactcaagtccttaatagttgatttgttcaaattagtatctacttaaggatcatgcattgcatctggttatatcagtttttctttttcagaacccatcctctgctttgtaaaaataatatacacttatcttgcaagctatccctttttctggatttgactagttgcttcttgtatcatttagcttgttcctttttctcctatatttcctataaattggaagttataactaaggattatggattcaagttaagcatcttaggctagatgaatttagtgaggttttattaatctttggaaacctgttgatttgtgagaatttcagtcattttgtacaactttatgagttatatgctagaatttcatatgcgtatgttaacaagtcactaaagtttcttctttctttttttctttttttgagatggagtctcgctctgttgcccaggctggagtgcagtggcacagtctcagctctctgtaacctctgcctcccacgttcaagcgattctcctgcctccgcctcccgagtagctgggattacaggcatacaccaccatgcccggctaattttttgtatttttagtagagacgggtttcaccatgttggctaagctggtcttgaactattgaccttgtgatctgcccaccatggcctcccaaagtgctgagattacaggcgtaagccaccgtgcccagcatgttttttattttcaaaagacaaaaatatatttggatttaaggcagtaaatgtgaattcttaaggaatagctgtactcatataaagtgttagacaaatataatagacccttataaggtataaaagttgaaaatattaagggatgtgaagtttaaaaatcttcaaatttagaccaggtgcagtggctgacgcctgtaatcccagcactctggcaggccaaggcaggcagatcacgaggcaggagttcgagaccagcctggccaatatgatgaaaccccgtctctactaaaattacaaaaattagccaggtgtagtggtgcgcacctatagtcctagttactcgggaggctgaggcagaagaattgcttgaacccgggaggcggaggttgcagtgagccgagattgcaccattgcactccatcctaggcaacaaagtgagactccgtctcaaaaaaagaaaaaaaaaattcgccgggcgtggtgcctcacgcctgtaatcccagcactttgggaggctgaggcgggtggattgcctaagcttgggagttcaccaccagcctggacaacacggtgaaacctcgtctctactaaaatacaaaaaattagctgggtgtggtggcaggcacctgtagtcccagctactctggaggctgaggcaggagaattgcttgaacccgggaggaggaagttgaagtgagctgagatcgcaccactgcactccagcctgggcgacagagcgagactgtctcaaaaaaaaaaaaaaaaaaccttccaatttacaaataccatcacaaaataagttgtcctataaagaaagtaaaacgtatagatgactccagtaaatgtaacataaatttaatactaaatatttgtgcgtgtgtgtgcgtgcacgcgcgcgcacacacacacacacacacacacacacacacacacacacacatatatatatatatatatatatatatatatatatatatatatatacttttttttttcttttgagacagggtcttgctctgttgcccaggctggagtgcagtagtgcgatctcggctcactgcaacctctgcctcctgggttcaagcgattctcctgcctcagcctccctagtggctggtattacaggcgtgcaccaccatgcctagttaatttttgtatttttagtagagatggggttttgtcatgctggccatgctggtcttgaacttctgacctcaagtgatccgcccaccttggcctcccaaagtgctgggattacaggtgtgagccaccactcccggccttattttttagagatagtctcactctgttgcccaggctagaatgcagtggtgcaattatagctcactgcagctttgaattcctgggctcaaatgaacctcctgcctcagactcacaagtagctgggactacaggcatgcaccaccattcccagctattttaatttttttctttttctttttgtagagacagggtctcactatcttgcccaggctggtctcgaattccaagtcttaggtaatcctcctacctcagcctttcaaagcactgggattacaggcttgagccaccatacctggccaatactatactgataaaactattaaaatagaatctgccactaaaagctcatgttaattatgatcttacctgaatttgaagaaaaaaggtaatgtgtatacaataggaaatagtgaatcacaaagccatattgcaaggtagatgctatatggtcagccagactcactggctaaatgactcattctgctcacaccagccttatagcgctacattaaaacttgtgctttcacagaatttcacaaattactgatactaccttttttgctgaagggtaatgtgctagaagacaagggcctcatccagtttaaagtgtttaggatcagtgctaggctggaaaatatattcccagaggcccagagtggtggctcatgcctgtaatcccagcactttgggaggctgaagctggaggatcacttgaggccaggagtttgatcagcctggccaacatagtgaaaccccgtctctactaaaaatataaaagttagctagatgtggcatgtgcctgtagtcccagctactcaggaggttgaatgaagcatgagaattgcttgaaccttgttgcagtgagccaagatcatgccactgcactccagcttgggtgacagagcacactgtctcaaaaaaaaacaaaaaaaattcccagcaactataaccctggtttctgtcccctgagatgcttattccatgggtttgggctagaacttgagaatcggcattttaaaaagcattatggatgattctggtatatgatcttgtttatgaactctggttttattattattagtttggcttacataattaactgtttgacaggtaatattttcatatctcgaacctcaatcccaaatgctgcctctgaagaaggagacgaagatgattgggcatccaacaaagttatgtttaaaataggtaagaaaggtaatcagattattaccttcagataaagagaaggctgttttgtttttgctcttcactgtaagtttttcaatacttctaggtgatcttgggcatgtaacaaggatctccagtccacaagttgaagagggcgatagtcgttttcttgcaaatgaagttttacaggaggtaatttttcttctcccttaatcatagtttgctttgtaacacttagcagttgatagaagaatataaattcagatatattaaactttgaagttaactaatagaatggaaataaaatctaaaccgtcatctgagggcatttaataagcaaaaagtcatgaaggcaaagatttataatggagttgtcgtaaaaaatatgttctcatacaccactggtggaactttataatggcatatcctttttggagatcagagtattagtattgcattaatatttaaaaatcatgtacccattgactcataattttcacttctaggagtttttcctatagaactattcatatacaaatacaagttgagaacagtgtaaataagtgtttactaataagagaatgattaagtaaattatggcacatagttattagtatggcctatagtttcaaaagagtgtgacagtatttcttgataaaaattttgaatgaaaatagaataagtagaaaaatataaagtgtaattgtctgatcccattgctctttgtaaatatgtgtatatatatgtttgctttatcacgtatatgtgtatttgtaacttgtcagtgtgtttctacgtgttttgtgtttgcatatgaatgcctagaggtagagggatttcttttgagagttgaattgggctgttgataaagaagaggcatttactcttatctatgtgtttgcatttttcccccaagagtgtgtattactttgtaatttaaaaaataaacatcctcaaatttagcagtttattctctgaataggtcccaaacttaaatgtggtattagacactttgattaagtcctatttttcacctaagtcatctttgaggtgtaatcttgttttattttgaccatgtttacattcctttaaaaaattgttttaattttacagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagtgagcattttatatatgaagccctttattgacatggttctatattttattaaatgcatgtctttaccttcattttacttttctttttaaggttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaagtaagtgagggttttatgttttctttttgctttttcattcactttaattctcaaattttaatgagagatgatttaagctttctgtcaacaaaggatgtagtggttttttgtgttttttgttttttgagacagggtctcactgtcatcaggctggagtgcactggtgctatcatgactcattgcaacctccacctcctgggctcaagctatcctcccgtgtcagcctcctgagtagctgagccacagatgcatgccacaacacccagctaatttttatattttttgtagagatggggtttttgccatgttgcccaggctggtcttgaactcctgggctcaaaccatccacctgtcttggcctcccaaagtgctgggattataggagtgagccacctcacccggctccagtagttcgatatgttgttatacggtgaaagcttggggacttctgccatgaattagtatttggcctattaaatttgtgttgtttctaaactttcaaattacgaactttaaaaatgttgagactaacatatatttgcaagtggtgatagtccccaagccataaatggtagtaaaagctaagcgagcctataccaatcttttcttcccagactctcaccaaaagttaacgttgtccttgaaacattctgttcttattttatgaaaggatgaaattaatgtcaatttggttaggagatgattctcatatatatgtttttaatttctggctaaatctttatatactgaatgaagattctcatattggacttaatgacttgatattttcaaaaagctggttgcaatggtaaaggttattaaaaagagaatattggagaatattaagttaccacagatcacatttctaattcttttgatttattgcagccattttgcttttaacctaataaaactgacttgaaaaggttatgttaacaattaatattaacatttaatatttaaattataagaattgtatattaagaggtttacttgccactagtttgatatccatcatagttcatacaaataggaaataaagtgttcctttcatctctcttatgtaaggatagattcgcaatataaattggagtttttgaaattattatttatttttaattttttttttattggggataggtttgtctggaaattgtttattattatttatttaaaaagatggggtcttgctctgtcacccaggctggagtgcagtggcactatcatagctcactgcagcctcaaactcctgggcccaagcgatcctccagcctcagcttcccgagtagctgagactacaggtgtgagtcaccacatccagctcaaattattttataagaaccaaagtcattactagcatctttactacttgttttcaagtatgtgtgatactgtaattcaaaaagcataaaataaaataatttcataaatttaagttgttttaatagaagcttcagtttcctgttttatttttcaattacatcttagaataatgatggcatgcaaatatctcccaatcgacaatatagtttgtgttagtttcttagaatctcttcctaggaataataccttgttttctatttttatgtcagagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgcctttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagcttaccttaattgtctaaatccttgtgatgcctgttttctaatattttatctctattattgctatactataaaatgtatagtgtgtataatgtactattataaaagcagagggcacattttgattgaatatgaatatcacattgcatgttatgcatgtgacttgctagaaatgtagcatgatgtaatttaaaatatcttcaaattattaagtgaatataatatgattcataactttctgatttgtactgagtcacagaaaactttaaagtggggaggttttgtttttgtttttaagatggagtcttgctctgttacccaggctggagtacagtggcgcgatctcggctcaatgcaacctccgccccctgggatcaagcgattctcctgcctcagcctcctgtgtagctgggactgcaggcatgcaccaccacacccagctaattttttgtatttttagtagagacggggtttcactaagttggccaggctggtctcgaactcctgacctcaggtgatctgcctgccttggcctcccaaagtgctgggattacaggcgcctggcccttaaagtggggaggattttaattctcactaaactaggctgggttttaagatttgaggccaggcgtcttggctcacgcctgtaatccccaccactttgggaggccaaggcaggaggattgcttggggccaggagtttgagaccaacctgggcaacacagtgagaccctatctctacaaaaaacaaaaaagaattgagtgcaaattgaagtgataatgttatttctatggcatcgttttctgatgttgattagaaccagagatggagtctcattgttgcttaggctggtcttgagcccctgagcccaagagatcctcttgcctctggagtaactgggactatgagtgtgtgtaatcatgtccaacctctgccataaatatttctaacaaacttgattatattagctttctagtctatggtatcttaaaatttagaggtgtgagatgaattggtgcagacaggagaattagatataaaagccggtgagtatgggtgataaaacctaaaaagccataggaactggagcatgcaactcacaccttttagtagctactgatgacaaagctataaaaagatcacaataattgggctgggtgctgtggcttgcaccgataatcccagtaacctacgatgccgccattgcattccagcctgggttacagagtaagagcctgtctcttaaaaaaaaaaaaaaagtatgtatgtatatatatatatatataatggtgttaatttatgatcattttaagtcactaaggtgcatttttccagtgcactagcttcaaagacacactcaggtgtttttcatcaatatttgcagtaaaattttcacataagaatattggattaagaaggaaaactgatatctggtgtttgaagagggaattcttaggccatctaaaagctgataggagagttagactcatttaactaaaggtacttttgttgagtgctatgtgctgactatgtagtagaccaaagaccagtaagaatttggttttgcccactaggaaatcaggataaaatagaggagacttttgtaaatatataatgacaataaaatgtaataaatgctaatgctggagggattgtgcaaggtagaatgaaggttcaaaagactatatgtaccttatgaagatactggtggtagattggagaatagatccagggaattatgttcagactagtttcaagattattgtataataatcaccgtacaagaaaggagggcctgaactaggaccttgctgtggatagaaaataagaggatagggattttctttgaacagtttgaaactttgaacagtttctgtttgttggtaagattgaagcattgaagatttttccagaaaacttaactaaaatgcaggggtatgttactatttgagacaggtattcgccatcgataaaagttttcttttttggaaagctgactttggtaaggtagaaaaattttaaatgttgactatgcggttgggtaggaggtattacatattgtgattgactgcaaattgaaacttttgccttaactttatcctgccaagaatacaagagcagtaggctttaattaatgaactaatgtattttgaagagtccattatcaagctttgattttcactccgctttgttccggaagtcaagaaactatggcatttttttgaggccaggcgcggtggctcgagcctgtaatcccagcactttgggaggctaaggtgggcggatcacgaggtcaggagttcaagactagcctggccaagatggcaaaaccccatctctactaaaactatgaaaattagccaggcgtggtggtgcatacctgtaattccagctacttgggaggctgaggcagagaattgcttgaactcgggaggtggatgttgcagtgagctgagaacacaccaccgcactccagcctgggcaacagagcgagactccttctcaaaaaaaaaaaaaaaaaaaaaatccgggcacggtggctcacacctgtaatcccagcactttgggaggccgaggcgggcggatcacctgagttcaggagtttgagaccagcctgaccaacatggagaaaccccgtctctactaaaaatacaaaactagctgggcatggtggcccatgcctgtaatcccagctactcgggaggctgaggcaggagaattgcttgaacccgtgagggggaggttgcagtgagccgagatcgtgccattgtactccagcctgggcaactcgagtgaaactctgtctcaataaaaaacaaaaaacaaacaaacaaaaaaactatggcatttttttaaaagttcataagagctaggtttaatgccaactgtcctgggatgctccaggctgtctcccagttcttaagcagcagcatcctgacaatagagtaattttccttcttccccaattcatctttacaaagcatctcactgacttttgaccaacagagcaaataaattgttgcatttttttttctgagtcggcttgctacagaatttgttgctttcttaaggtatctttatttgtgaaatttgcaaaggccaattaaagcaatcaacaaggaggatagatcaaaaaagaattttggaagtgttttggatattatgtaaatcttaagtgaagcctggaactaggaatctggaggcaactgcctcattcagtatttttgaaggtatttgtataactgtaaaaagcatcactgaaactgagagacactgcagagtaagtgaatctagaaatttctcttgcaaactgataatattgctagacatttctcggaagctcagcaaagtagatttttataaaaatggaagaataagacgtcattgcaactgtccctctcccaacatttagcattcaaaaacttttgagaggcattcatctgaacattactgaactttttttttcctttgtggcagatgaccctaattttcagtgcaaattcaaaggtctctggagtaaggaaaaatatctatgtatgccctaggaagattcaccaggaaaagatggcatgttgtgtccaaacttcattaaactaagagtcaaagaaacttcggccagtccagcccatgaagaaaaatacctcaaaggaacatttacatcacagttcacattgtttagttttatatggttaataaacattttgaagagc

SEQ ID NO: 658 - DNA, 7401 bp, Homo sapiens
gcacgcgtttaatataagtggaggcgtcgcgctggcgggcattcctgaagctgacagcattcgggccgagatgtctcgctccgtggccttagctgtgctcgcgctactctctctttctggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcgtcccaaaggcgcggcgctgaggtttgtgaacgcgtggaggggcgcttggggtctgggggaggcgtcgcccgggtaagcctgtctgctgcggctctgcttcccttagactggagagctgtggacttcgtctaggcgcccgctaagttcgcatgtcctagcacctctgggtctatgtggggccacaccgtggggaggaaacagcacgcgacgtttgtagaatgcttggctgtgatacaaagcggtttcgaataattaacttatttgttcccatcacatgtcacttttaaaaaattataagaactacccgttattgacatctttctgtgtgccaaggactttatgtgctttgcgtcatttaattttgaaaacagttatcttccgccatagataactactatggttatcttctgcctctcacagatgaagaaactaaggcaccgagattttaagaaacttaattacacaggggataaatggcagcaatcgagattgaagtcaagcctaaccagggcttttgcgggagcgcatgccttttggctgtaattcgtgcatttttttttaagaaaaacgcctgccttctgcgtgagattctccagagcaaactgggcggcatgggccctgtggtcttttcgtacagagggcttcctctttggctctttgcctggttgtttccaagatgtactgtgcctcttactttcggttttgaaaacatgagggggttgggcgtggtagcttacgcctgtaatcccagcacttagggaggccgaggcgggaggatggcttgaggtccgtagttgagaccagcctggccaacatggtgaagcctggtctctacaaaaaataataacaaaaattagccgggtgtggtggctcgtgcctgtggtcccagctgctccggtggctgaggcgggaggatctcttgagcttaggcttttgagctatcatggcgccagtgcactccagcgtgggcaacagagcgagaccctgtctctcaaaaaagaaaaaaaaaaaaaaagaaagagaaaagaaaagaaagaaagaagtgaaggtttgtcagtcaggggagctgtaaaaccattaataaagataatccaagatggttaccaagactgttgaggacgccagagatcttgagcactttctaagtacctggcaatacactaagcgcgctcaccttttcctctggcaaaacatgatcgaaagcagaatgttttgatcatgagaaaattgcatttaatttgaatacaatttatttacaacataaaggataatgtatatatcaccaccattactggtatttgctggttatgttagatgtcattttaaaaaataacaatctgatatttaaaaaaaaatcttattttgaaaatttccaaagtaatacatgccatgcatagaccatttctggaagataccacaagaaacatgtaatgatgattgcctctgaaggtctattttcctcctctgacctgtgtgtgggttttgtttttgttttactgtgggcataaattaatttttcagttaagttttggaagcttaaataactctccaaaagtcataaagccagtaactggttgagcccaaattcaaacccagcctgtctgatacttgtcctcttcttagaaaagattacagtgatgctctcacaaaatcttgccgccttccctcaaacagagagttccaggcaggatgaatctgtgctctgatccctgaggcatttaatatgttcttattattagaagctcagatgcaaagagctctcttagcttttaatgttatgaaaaaaatcaggtcttcattagattccccaatccacctcttgatggggctagtagcctttccttaatgatagggtgtttctagagagatatatctggtcaaggtggcctggtactcctccttctccccacagcctcccagacaaggaggagtagctgccttttagtgatcatgtaccctgaatataagtgtatttaaaagaattttatacacatatatttagtgtcaatctgtatatttagtagcactaacacttctcttcattttcaatgaaaaatatagagtttataatattttcttcccacttccccatggatggtctagtcatgcctctcattttggaaagtactgtttctgaaacattaggcaatatattcccaacctggctagtttacagcaatcacctgtggatgctaattaaaacgcaaatcccactgtcacatgcattactccatttgatcataatggaaagtatgttctgtcccatttgccatagtcctcacctatccctgttgtattttatcgggtccaactcaaccatttaaggtatttgccagctcttgtatgcatttaggttttgtttctttgttttttagctcatgaaattaggtacaaagtcagagaggggtctggcatataaaacctcagcagaaataaagaggttttgttgtttggtaagaacataccttgggttggttgggcacggtggctcgtgcctgtaatcccaacactttgggaggccaaggcaggctgatcacttgaagttgggagttcaagaccagcctggccaacatggtgaaatcccgtctctactgaaaatacaaaaattaaccaggcatggtggtgtgtgcctgtagtcccaggaatcacttgaacccaggaggcggaggttgcagtgagctgagatctcaccactgcacactgcactccagcctgggcaatggaatgagattccatcccaaaaaataaaaaaataaaaaaataaagaacataccttgggttgatccacttaggaacctcagataataacatctgccacgtatagagcaattgctatgtcccaggcactctactagacacttcatacagtttagaaaatcagatgggtgtagatcaaggcaggagcaggaaccaaaaagaaaggcataaacataagaaaaaaaatggaaggggtggaaacagagtacaataacatgagtaatttgatgggggctattatgaactgagaaatgaactttgaaaagtatcttggggccaaatcatgtagactcttgagtgatgtgttaaggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttgcacaaatacatatacactcttaacacttcttacctactggcttcctctagcttttgtggcagcttcaggtatatttagcactgaacgaacatctcaagaaggtataggcctttgtttgtaagtcctgctgtcctagcatcctataatcctggacttctccagtactttctggctggattggtatctgaggctagtaggaagggcttgttcctgctgggtagctctaaacaatgtattcatgggtaggaacagcagcctattctgccagccttatttctaaccattttagacatttgttagtacatggtattttaaaagtaaaacttaatgtcttccttttttttctccactgtctttttcatagatcgagacatgtaagcagcatcatggaggtaagtttttgaccttgagaaaatgtttttgtttcactgtcctgaggactatttatagacagctctaacatgataaccctcactatgtggagaacattgacagagtaacattttagcagggaaagaagaatcctacagggtcatgttcccttctcctgtggagtggcatgaagaaggtgtatggccccaggtatggccatattactgaccctctacagagagggcaaaggaactgccagtatggtattgcaggataaaggcaggtggttacccacattacctgcaaggctttgatctttcttctgccatttccacattggacatctctgctgaggagagaaaatgaaccactcttttcctttgtataatgttgttttattcttcagacagaagagaggagttatacagctctgcagacatcccattcctgtatggggactgtgtttgcctcttagaggttcccaggccactagaggagataaagggaaacagattgttataacttgatataatgatactataatagatgtaactacaaggagctccagaagcaagagagagggaggaacttggacttctctgcatctttagttggagtccaaaggcttttcaatgaaattctactgcccagggtacattgatgctgaaaccccattcaaatctcctgttatattctagaacagggaattgatttgggagagcatcaggaaggtggatgatctgcccagtcacactgttagtaaattgtagagccaggacctgaactctaatatagtcatgtgttacttaatgacggggacatgttctgagaaatgcttacacaaacctaggtgttgtagcctactacacgcataggctacatggtatagcctattgctcctagactacaaacctgtacagcctgttactgtactgaatactgtgggcagttgtaacacaatggtaagtatttgtgtatctaaacatagaagttgcagtaaaaatatgctattttaatcttatgagaccactgtcatatatacagtccatcattgaccaaaacatcatatcagcattttttcttctaagattttgggagcaccaaagggatacactaacaggatatactctttataatgggtttggagaactgtctgcagctacttcttttaaaaaggtgatctacacagtagaaattagacaagtttggtaatgagatctgcaatccaaataaaataaattcattgctaacctttttcttttcttttcaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctcttatatctcactcccactattacccctttattttcaaacagggaaacagtcttcaagttccacttggtaaaaaatgtgaaccccttgtatatagagtttggctcacagtgtaaagggcctcagtgattcacattttccagattaggaatctgatgctcaaagaagttaaatggcatagttggggtgacacagctgtctagtgggaggccagccttctatattttagccagcgttctttcctgcgggccaggtcatgaggagtatgcagactctaagagggagcaaaagtatctgaaggatttaatattttagcaaggaatagatatacaatcatcccttggtctccctgggggattggtttcaggaccccttcttggacaccaaatctatggatatttaagtcccttctataaaatggtatagtatttgcatataacctatccacatcctcctgtatactttaaatcatttctagattacttgtaatacctaatacaatgtaaatgctatgcaaatagttgttattgtttaaggaataatgacaagaaaaaaaagtctgtacatgctcagtaaagacacaaccatccctttttttccccagtgtttttgatccatggtttgctgaatccacagatgtggagcccctggatacggaaggcccgctgtactttgaatgacaaataacagatttaaaattttcaaggcatagttttatacctga

SEQ ID NO: 659 - DNA, 127030 bp, Homo sapiens
aaccgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggtaaggacgacccttttctcttcaaaccccatggtttcttttctccccggggtctggggcgggatgttaatccgctagctgttgtcttatgccttccagtatttcagtcctgaaggctcctttcacccccaacaaccctgtttctgtcagacttttcccagtttatcagtgccacgttctctggtccctgccagaaaaaaatgactgtaaattctggttctcaagagtggactgtgtgcagatgctgcctattctctaagctcagctggtgagttggcagtagtaatcatctggcctgtgtggcccccttaccttcaaagacacacaaatctggcgactgccaggtttggtgtggttattgtctcatttttattccgtgcacactgatcaatattaatttcgttatttaaagaacgaagccgcctctgactcctctacttatggtagtcatcatatattttttaagctgtgtgacttttaaaatctctatagggtgatgtattgaataactaaataatcagctatgactgcctttttgtgatcaaaatgttatgatagatgggccctcgagctatatgtgagacacacttgtgtcttggacatagttgatccatcattatctactcaatttgaattgttaatgaaatcagccaaaagattagaatctgaaaataaattttaagcagtggaatgtcatgtcagtgtcttcattgaaagaaaatagaatgaaattttgtatagctaagttgctattagggttggtgttttatgcagatggaaaactatacaaagttttaaatataaaaagtttaaaattgaactgtaatcatacttgctactaaataatccttgttttcattagctcattggtaactatattaatagtttatgacttagcaacttctgtaggtatagtagagttatgaaaatttctgggcaggatagtagatgcctttctatacacttctttggtaatcttcacatttttgtgtgtaaatgcccattataattacaagttttactttgcatatcaaaatcacttaagggtaagtcattatgaattaaactgtctgtgagcttctaactttcctgttgacagcctctacctggctttcttatttcatgaagattaaggccctcagctaagtgcttccctataaccccctcctcttcaccataacatagacatgctatgatagggtcaaggaatcagtacatttatatgtgcgctgcatgcttaactctaaagactgaaaaactctcgggcagagtaggtagaaatccatgaaagtttggagtattaaagtaaggtcttcctacttggcatggttgagcattacaattcacattcttctctctggtctcaaaggaaagtctcttgttgtaattaatactcttgattccattctttcatccattggactttttgttgttgtcgttgttgttgttgttgttgttttttgagacggagttttgtttttgttgcccaggcaggagtgcaatggcgtgatctcagctcactgcaacctccgcccccccggggttcaagcaattctcctgcttcagcctcctgagtagctgggattacaggcatgcaccaccacgcctggctaattttgtatttttagtagagaaggggtttctcaatgttggtcaggctggtcttgaactaccaacctcaggtgatccgcccgcctcagcctcccaaagtgctgggattacaggtgtgagccaccatgcccagcctctttttttttttttttttttaaagagacagggtctcattgtgttgcccaggctggagtgcagtagctgttacacaggcatgatgcactatagcattgaaatcctgagctcaagtgatcctcctgcttcagcctctgagtagctgggactgcaggtgtgcaccaccttgcccagctctactgaactgtctctttcagtttgtttcactttttaccttcaacagtatgtgggtgtcccctgttctcagtaaaggaaaaaaaatctgtatattcctttctcccaaccaacccatttgttttttcactttcattgctaaagtcaaattattgatggtctacaaatgttccatctacctattttttcataaccatcctaatcttaaaatgtctgccatctttctttcctccccttttttgaaactattctcttgaaggtcacaaatggcagtcttcctagtcaaaaccaaagaatatttttattcttactgtatttgacctcccagtagtttgatcctgttgattgtctctagctatttggaaactattttctttcttgcttctgttatactggactctccagtcttatcttcttcactatattctttgctggatttattttttctttccagtcacctagtaagggactctgttattgagcctttgctctcccataagagcagtattccccaaagtagtgttaaacagaatacccttcttgtaatatttcttaggtggtgaggagaaaaaaatgaaaaccttttttggagggaaatgttagtgtatcctcctcttggaattcataatgcctgctggaatataaaagctctgagaaatccattaataaagaaggctattcaattttgtttaactcagtcttgtttagtttatttgatcacaggttactattttcatggcctacctattatggcacagaataatatagcaaagcccactagtttgggaaatattgccctgggtatcttaactacttttaagtgtttggctaatattttatgcagctggctcacaagactgtatctcttattgaatgtcagttctgtgtgtgtatatgtgtatacatacatatatatatatatatatttttttttttttttagacagagtctcgctcggttaagcaggctggagtacagtggtgtgatctcggctcactgcaagctccgcctcctgggttcacgccattctctgcttcagcctcctgagtagctgggactacaggcgcccacctccatgcccggctaattttttgtatttttagtagagatggggtttcaccatgttagccaagatggtctcgatctcctgacctcgtgatccaccagccttggcctcccaaagtgctgagattacaggcgtgagccaccgcacccggctagttctgtatatttttaaaagttttttctttttttagttttgtagagatagggtgttgctatgttgcccaggctgctttcaaactcctggctccaagtgatcttgccttgggctcacaaagtgctgggattctaggtgtgtgccacagcacttggtgtgccacttctgtattttgagctggctataacaactttcttgggctgcttgtgaatgtctgttcttggggttaatgaggactctctgagctgcttagtagaaagggtagtcttggtctctgtattttaaacttaacagtttttcagggttttttttattgttattgttgtttgtttgttttgagacagggtcttgctctgtcacccaggctggagagcagtggtgcgatcatagtttactacagcctcaaactcctgggctcaagcgatcctcccacctcggcctcccaagtagctgggactataggtgcatgccaccatgatggtctaattttttattttttggtagagatgagggtcttattatcttgtccaggctggtctccagttcctggcctgaagtgatcctcctgccttggccttctaaagtgctgggtgtgagccaccatacttggccacttaacagttttagatctggaaaattattggaaaattagatctggaaaactaaacaagtgatcctcctgccttggccttctaaagtgccaggtgtgagctaccatacctggccacttaacagttttagatctggaaaattattgcaaagatagtacagggagtttttatataccccacacccagtcttccctattattaacatcttaacataagtatgatgcatttgtcacaattaatgaaccagtattgatatcttattatgaaagtccgtactttattcagatttcttcagttttcgcctgctgtccttttttaattccaggatctcatccagagttacgttacatttagacattatgtcttctgaagcttcttttcagcctttccttgttttttagaccttttcttgtttttgataatcttgacaattttaaggattactgattaggtgttttatatagaatgtccctcaattgggaattgtctgagtcttttctcaggattagactggagttgtgggttttcggacaaagaccacagaagtaaagtaccaatctcaacacatcataacatgggtatgtttttcaaaatgatttatcactacttatgttaacctctatcacctggcgtgagatagtgcttgtcaggtttctccactataatgtactcttaaaaaaaatctgtttccatactgtacactttggaagaaagtatgttcaccctcacttaatgagtgggtagttatgtttttcctccttaaggacagagtatcaacataaactatatggaattcttctgcaaaggagatttgtctcttctccctcatttattaacttaataatttacttgtatcggtatggactcatggatatttattttgtactttggcttataatccaatattagtttatttttttgttgctcaaattgttctggctctggctgttggagagctccttcattaactcctgtatccccttcttacttttatagtgccagaaagtacagagaatttccacataccctacacccagtttcattgtgacatacccctttcttactttttggtacttttagatgctctaggcctatctatacgtttcctactccagccctagagtcaaccatttctccaaggaaccttggttccttttattggagaatggcattagaaaccaaggtctgcagctgggcacggtggctcacgcctgtagtcccaacactttgggaggctgaggctagtggatttcttgaggtcaggagttcaagaccaccctgactaacatggtgaaaccccatctctacttaaaaatacaaaaattgggccagacacggtggctcacgcctgtaatcccagcactttgggaggccgaggtgggcagatcacaaggtcaggagttcgagaccagcctggctagcatggtgaaactccgtctctactaaaaatacaaaaaattagtcgggtatggtggtgcgcacctgtagtcccagctacttgggaggctgaggcaggagaattgcttgaacccggcaggcagaggttgcagtgagctgagatcacgccattgcactccagcctggaggacagcgagactccatctcaaaaaaaaaaaaaaaaacaccaccaccacaaaaaaaaacaaaaattaaccgggcatggtggggggcgcctgtaatcccagctacttgggaggagtatcgtttgaactgggaagcagaggttgcagtgagccaagattgtgccactgcactccagcctgggcaacagagtaagactctgtctcacaaaaaaaaaaaaagaaaccaaggtctgcttggcagatatgctcgttgctactataaggttatctttggaaatcaaggaatcctttctccagaggaatcagaaaggtgatatttggtttctttcacattattatgccattctgtcacttccagtctgttacctgggttactaaacacataaattcctttttttttttttttctgagatggagcctcactctgtcacccaggctggagcgcagtggcgcagtctcagctcacttcaacctccacccgccgggctgaagtgattctcctgcctcatcctcctgagtagctgagactacaggtgcatgccaccatgcctggctaatttttgattttttagtagagacagggtttcaccatgttggccaggctggtctttaactcctgacctcaagtgatctgcccaccttggcctcccaaagtgctggattacaggcatgacccaccacatccggccttgaacatggaaattctttaagggagctttaagttgctcctgtcttgtccaaagaagtgagaaacaacccccacttctctgagattccctcaaactttctgattttttaaacttccctctaaagggtttcagcctggaggggtgtattagtttgctagggctgccataacaaaatgccacagactaggtggcttaaacagcagaaatttattttctcacatttttgaaggttggaagtctaagaccaaggtgccagcagggttgtttttctctgaacttctctccttggcttgcagatggcaaccttcttgctgctttattgtgacatgatagtccctctgtatgcacacatccttggtgtcttttcctcttcttaaaaggatacgagtcatattggattagacccactgtaacttaagcactttaaagaccttgtctccaaatacagttacattctgagatcctggaggctgggacttcaacatgtgaatttgggggaaacacagttcatcttagaacaagggagatccaccacacatacacacacacacacacacacacacacacacagacacccttttatttcctcttttatcagaaaagtccttatttctctttcctcagtacagggcatgtctcttaactttgattattattctctctctctttgtcttttaaagagatggggtcttactacattgcccaggctagaatgcagtagctattcataggtgtgatcatagcacaccacagccaggaactcctggtctcaagtgaaggtcctcctgtttaagccttctgagtagctgaaactacaggtgtgcaccactgtgcttggctcctaaacttggattcttgcaaactgtagctcatactaaagctatgtggtccagctgtggcacgtcaagctcttgataaataaaaggagctgttagaatgtagaaaaagtcctcaaaattgtcgttttattacacacatacacacacatacacacacatcagttttgaggtttgaagctgaatagtaaatgaccttttttccctttaacaaccataattttccttgaggcagcctatgcctttagttgaatggggaaaaggtcatatgtcagaaaggaggatgagaagcgtattacaaaaaaatgctttttgggggaaaattttggaatataatagtagtctctcttattcttgagaggtttgagtaaattgattaaaattcttaaaacagtgcctactacattgttattctacagctacttccttatttcttttctgccttttttccaggatgggactctgtctgtgttcctgcccaagatctggtcccagccctagcctacctgcctcaccctttgctcctgaatgtctgactgtttttgttatttgcttgttttcagtttcctggttcatttccagttaggcttagttggctcctcccataggtgtcttagctgactccctagagcttgcctgttcttctgtaatttgagtatcaaccttctacagttctaatatgctgcacatgataattcctgcctttgcctctgcctcaccagccataatctggccaacttttaactgtaatttctacctcaaattattcataaaccaatcaaaactgataactcttccaaacgatatccctttcctaccttcttggttcctataaatgatgcccatgcaactgttatttaagactgaggttagaaatttggtgttgtctttgattccttcagtgtatcatattgagtgcttcaacatgcagaggagttacttgatcgaattaaaaaaaacgtcattctgactgcagaatagagaacttggcagatccctaactagtcccctttccttggtctccatttctttttgtcagttctcctgtgaagccagcctgaacttcctcaaaccttattttcagagtggctgtatgactcactgactacatcaggttagaattctgctgtctcatctttaaggtcttccatagaatggctctagctacctttgtctcccactatctcctgacccaaattgtatttcaggctgattgttttgcttacttttgccttcccacctgcctttctgtgtcatgttaattcctgtttctgtgcctttgttcctgctgtttgactcttagtttcttgcctcttttctgtatatttattataccaatttttttttgtttttttttttttaattgaggcagagtcttgctctgtcgcccaggctggagtgcagtggtgtgatcttggctcactgcaagctccgcctcccgggttcacaccattctcctgcctcagcctcctgagtagctaggactacaggcacccgccaccaggcccagctaaattttttgtattttgagtagagaaggggtttcaccatgttagtcaggatggtctccatcttgatctcctgacctcatgatccacccgccttggcctcccaaagtgttgggattacaggtgtgagccaccgcacctggccttttttttttttttttttgagatggagtcttgctctgttgcccaggctgcagtacagtgacgcaatcttggctcattgcaacctccgcctcccgggtttaagcgactctcctgcctcagcctcctgagtagctgggattacaggcacgcaccaccaggcctggctaaatttttttgtatttttaatagagatggggtttcaccatgttggccaagctggtctcgaactcctgaccttgtgaaccgtccaccttgacctcccaaagtgctgggattacaggcatgagccaccacacctggcctattctaccaatcttttatccagcttctgatccatgtccactatgaagccccctgggacttctgacctggaatatgcttttccttcttttctttttctttttttttttttttgagatggagttttgctcttgtcgcccaggttggagtgcaatggcgcgatctcagcttactgcaacctccgcctcccaggttcaagtgattctctagcctcagcctcccaagtagctgggattataggcacccaccaccatggccggctaatttttttttttttttttgtatttttagtaaagatggggttttaccacattggccaggctggtctcgaactcctaacctcaggtgatccacccacctgggcctcccaaagtgctgggattacaggtgtgagccactgctcccagccatgcttttccttctttatacaccatttacatttattgtttgagcttcattaacttattttgttcattttttactaatagcttattgtttgtgaacttcgttttctcaacgaaattttaagttccttgaggaaggactatgttttaaattttttcctgcgggaaaaattgttcttagtgctgttacaaaatgtacgaggttgatttgtatcccctaaaaggatatattgaagtctaaatcacctgtgaatgttatcttagtttgggaatagggtctttgcagatgtaatcaagttaaaatgaggtcatactggattagggtggcccctattccattataactggtatccttataagaaaaaaaaatagaattagggagaacaccaggtgcatgaatacacagagacacacagacacattgcagagaccgcatggcagataaaggcagagattggagttatgtttccacaaaccaaggaatgcccagggctaccagaagccagaagccaggagcctccccctagaggctccagtgggaacagggctttgccaacaccttgattttggacttctagcctctgaaaccatcctctagcactgtgagacaatacatttctgctttatgctattcagtttgtggcactttgttatatcagcctaggaaacaaatacacaaatgcatacttaaaagttaatttgattttttgactagataattgtttttgttttttttttttgagacagagtctcgctctgtcgcccaggctggagtgcagtggcgcgatctcagctcactgcaacctccacctcccgagttcaagtggttctcctgcttcttccttccgagtagctgggattacaggcacgcaccaccacacccagctaaattttgcatttttgatagagacagtgtttcaccatattggccaggctggtcttgaactcctgacctcaggtgatccgcccgcctcggcctcccaaattgactagataactactcttatataatatatactgtgtggcagtatggttcactggaaagaacaagggtttttggagtcaaacagacttgagtttataattctaccattatgttacctctccttaagcctgtttcttcactcataaaatgaagaggattcatgaagtaaaatatttagaggcctgtcccatacaaagcttgacatttaataatattggttcctttctttcatgggtgcattggtatagctaatcttgaagaaatttggggctaggtgtagtggctcatgcctataatcccagcactttgggtggctgaggcaggaggatcatgtgaggccaggaggttgaggctagcctgggcaacatagcaaaaaaaaaaaaaaaaaaaaaaaaaaagctgggcatggtgacacatgcccatagtcttaattgcttgggaggtttaagctggaggatcacttgagcccaggagtttgaagctgcagggagctatgattgtgccactgtgccctagcctgacaacagagcaagaccctgtctcaaaaaaagaaagaaaaggaaaaaagaaaagaagagaggagaggaggggaggggaggaggaaagagaaggaaggaaggaagggagggaaggaaggagggaaggagagaaagaggaagaaagagggagagggagagggaagaaagaaaagaaaggaagaagggagggaggaaggaaggaagaagtttagtcttgtattattctattgaaacccaagtatattaattcagttgacaaaaatttattaaatatattgggcacttactgtgctatacactaaaatgatctttgaaacaagttttcacttttctttgtctccctttcttatttttgtatttctctgttttttcttactctcctgataaaggactgagtaatctcaggaggttccatgaagatcataaaacaagctgctttttgaaaaatgatgactaggatttagttgtgcagaaaaaaggtaaaaggacattcaaggagctcccttttacttactccatagaggcaaacaaacagttcttatagtgtggcatgtaacatctgtctcctgaagtgacagggagtaccttttgacttatgacctcattaaacaggaggaactagtccttacaatttttggttgaagaccttaaagttccccatgttagcctcttcctcaaaagagagttaaagtttccttgaattcaaagtccaggcttttttctagggacagactgggcatgcagtaatttcagtttctcacagtgcttcaaggctctctttcttgttcttaattaactttatctaattttcttacactgtttctggccaggtagttcctcttttgaacaatgttgccacagagcttttgctcagatgcttttaatgtctgattctttctcttttccaaactacactttttccctgaggatgacttcaaaacttacatccacgaagctttttctatttaatataaaatgatttgctttccttttacaatttcaattttctatatccaatttaagttcaacttaggggaacattttttctcatttgatgattaacaaaggcctctcatagctcactgcagcctcagactcctggcctcaagtgatcctcccgcctcagcatctcaaagtgctgggattacaggcatgagccaccatgcctggctacattttcactcttaaacttgactctctatagcattttatactgatgatctctcctttctctcctttttgaaacttcttccctttagctttaataatacccatttatcttggttatcctatcattttcccactcaatgtttacatatgctgtgcttccatctttaaccccattttaatttctttattgaacaaatatgttcaagtttctattttggatcagttactatgctgcatgcatatcacatagtgaatgagtgaacaagacagatatggtatacattgactatggaacttacccttgagcaggggctatgaggggaagacctaacctattttagaggcttagggatgacattcttgagagttttagttgagtcctaaaaaaaagatcaggatttaatgaggcaaagattgagtgagaggtttgagataagaggctcaggagagatgaaaagagggttccagatgtagaatgttgcatattttattttattgcatattttaaagcacaggatatcagccgggtatggtgccacatgcctataatcccatttactcgggaggttgaggcaggagaattacttgaatccaggaggcagaggttgcagtgagccaagatcatgccaagtgcactccatcctgggctacagagggagaccctctctcaaaaaaaaaaaaaaacttaggagccaaggtcatggcaccactgtactccaggctgggcaacagagtgagatcctatctcaaaaaaaaaagttcaccatgtggaatgagggagctagaatgagtgtgataatatttgatgttgcactacaagactggattcagattgtgaaaagatttgtgagtcatgttaagggcaataggaagccattgattgactctcttttttacatttaattttttttttttttttgagatggagtcttactctgttgcccaggctggagtgcagtgtcacgatcttggctcactgcaacctctgtctcatgggttcaagcgattctcctgcctcagcctcccaagtagctgggactacatgcacatgccaccacacccagctaatttttgtatttttagtaaagacagggttttgccatgttgacgaggctggtctcaaactcctggcctcaagtgatctgttcacctcggcctcccaaagtgctgggattataggcatgagccaccacgcctagtggttctagtttttttcttgtcttccaatgatatattgtgaattttctttctttcctattttttttgagatggggtctcactctgttgcccaggctatagtgcagtgtcaccatctcagctcactgcaacctccacctcctagattcaatcgagcttcctgcctcagcctcccaggtagctgggactacaggtgcacagtaccacacccagctaatttttattttttttgtagagatggggtttcattgtgttgcccaggctggtcttgaactccaggacttaagtgatctgccggccttggcctcccaaagtgttgggattacaagcatgagccaccatatccagcctgtgaatttcttgactataaaaatatagtctaggctgggcgcagtggcttacacctgtaatcccagcgctttaggaagctgaggtgggcgtatcacgaggtccagaggtcaacaccatcctggccaacatggtgaaaccccgtctctactaaaaatacaaaaattagccgggcgtagtggcggacgcctgtagtcccagctacttgggaggctgaggcaggagaatcaattgaacctgggaggcagaggttgcagtgagtggagatcgcgccactgcactctagcctgggcgacagagcaatactccatctcaataaataaataaataaataaataaataaataaataaatagtctaaatctagtataaatctaacacttaatatttcatactattccctatgtctggactcagtaaatatttgatgattgatttagcaatttgtattgcttcttgaaccaacgggtgcataaatatgtactagggctaccacagatattatccacatatctgattgcactaccttttctggaagacataactaaaatattcagatgtaaaactactgcttgtcaactcatctttctagtatacatagaatatatcttttatttgaaacgtgttatagtagatctagaataatattttattcatttagaaactcaaaaatatttttctgattcaatttagtgtttaagtgaagagaacaaaaccttgggattagcttcatggggatataatgaaaaaaagtttgagttataagcatagcttggatttttgtttgttttttttggtgacagggtctcattctgtcacccaggctaaactgcagtggcatgatcatggctcactgcagccttgaccttctggactcaagcaatcctcctgcctcagcatctggagcagctaggactacaaacttgtgccatcacacctggctaattttttttttttttttttttttgagacagagtctcgccctgtcaccaggctggagtgcagtggtgtgatctcagctcaacgcaacttccacctcccaggttcaagcaattctcgtgccttagcctcctgagtagctgggattacagacatgcaccaccaggcctggctgatttttgtatttcagtagagacagggttttgttggccaagtaggtctcaaactcctgaccttaagtgatccgcctgactcggccttccaaagtgctaggattacaggtgtgaaccacggtgcctggccacacctggctaattttaaaattttgtagagatgtggtcttgctatgttccccagggctggtcttgaactcctggcctcaagtaatcctcccacctcaacctcccaaagtcctgggattacaggcataaaccaccatgcctggcctattcaagttttatcatgagattgcagtaattcagtcacgtcttcaggctccacttctttttttttttttttttttttttttttttgagacagagtttcactcttgtgtcaaggctggagtgcaatggcatgatctcggctcactgcagcctccgcctcacaggttcaagcaattctcttgtctcagcctcctgagtagctgggattacaggcgcccaccaccacacctggctaatttttgtacttttagtagagacagggtttcaccaggttggccaggctggtctcaaactcctgacctcaagtgatctgccctcctcagcctcccaaagtgctgggactacaggcataagccatcgctcccagccctccaggctctacttctatttctagttctctctctttctctcttactcagtcacttaggctgaatgcagtggtgcaatcacagctcactgtagcctcaacctcctggggtcaagcaattctcccacctcagcctcctgagtagctgggccacaggcctgagccatcactcctggctaatttttaaaaaatggtttgtagaccagggtcttgctatgttgcccaggctggtttcaaactcccatactcaagtgatcctcctgccctggcttcccaaagtactgggattacaggcataagccaccgtgcctagcctaattctaggtctcttgctatttgtaccacatctgcagttacttcctccactgaagtcttgaatcccctcaaaatcattcatgagagttggaatcaacttattccaaactcatgttcctgttaatattttagccttcttctatgaatcacaaatgttcttttttttgaggcacagtctctgttgcccaggctggagtacagtggcacaattcatggctcactgcagccttgacctccctggactcaggtgatcctcctatctcagccttccgagtagctgggactacaggcacatgccaccatacctggctaattttgtattttttgtagaggtggagttttgccatgttatccaggctggtctcaaaatcctaggcccaagcaatttgcctgccttggcctcccaaagtgatggaattaatggccactgtgcccagccacaaattattataattttttttttgagacagagtcttgatctgtcacttaggctggagtgcagtggtgcgatctcggctcactacaacctctaccccctgagctcaagtgatcctcccacttcagcctccgagtagctgggaccacaggtatgggcctctacacctggctaatttttctatttttagtagagacagggtctccccatgttgcccaggcccgtcttgaactcctgagcccaagtgtccacccgcctctgtctctcaaagtgctgagattatagacgtgagccactgcacccagcctctacaaatgttcttaatggcatctagattggtgaattctttctagaagactttcaatttattttgcccagatccatcagaggaattacatcatggtaggtatagccttatgaaaggtatttgttaaataataagatttgaaagtagaaattactccttgctccatgggttgctgttagcagacatgaaaagattaatgtccttgtaaatcttcatcagagatcttgggtgaccagggacattgtcagtgagcactagtattttgaaaggaatcttttttttaagtagtatatctcaacagtgaactgaaaatattcagtaaaccatgctgtaaacagatgtgctatcatacaggctttgttgttccatttatagagcgcagataaaacagatttagcacaattcttaaaagctaggattttaggaatggtaagtgagcgttggcttccacttaaagtcaccagctgtccctaacaggagaatcagcctgtcctttgaagctttgaaaccagatattgacttctctgcagctatgaaagttctagatggcatcttcttccaatagaaggctgtttcatttacatggaaaatgtgttgtttagtgtagccaccttcagtgatcttagctagattttctggataacttgctgcagctttttcatcagcacttgccacttccccttgcacctttatgttatggagattgctttttttttttaaacttcatgaaccaacctctgctggcttccgacttttcttgtacagcttctttacccttcacccttcatagaattgaagagagttaagtccttgctctggattaggctttggtttaagggaatattgtggttagtttgacctatctggaccatggaaactttctccatatcagcaacagtaaggctgttttgccttctcgttattcatgtgttcactaaagtaacactttgaatttccttaaagaatttttcctttgcattcacaatttggctgtttggcacaagaggcctagcttttggcctgtctatgttcttgacgtgcccttttcactaagcttaattatgtttagcttttgatttaaagtgagagacatacaactcttttacttgaacacttagaggtcattgtagtatcgttttgtctcaggaaatagggaagcctgaggagaggaagagagatgggggaatggttattccatggtaactcccgttatcgtctccccaacccttggcaacctctattctactttctgtttctataaagttgtttattctatttacacacacaacatttattgattaaactcactgtcctctatgagtgcagtttgtggtgcccccaattataataatattgaaggtcacagatcacagatcaccatgacagatgtaataaagaaaattttgaaatattttgagaattatcaaaatgtgacatagggacatgaagtgagcacatgttattggaaaaattgtgccaatacatttgctcgatgcagggttataagaaacgcataaagcaaggtacaataagacaaggtatgcctgtatccaagttatactgcttatcatcagggacttgtctcataagctggaaactaacatgatactaattcttttttttttttttttttgagacagagtctggctctgtggcccaggctgaagtgcagtggtacgatctccgctcactgtaagctctgcctcccaggttcacgccattctcctgcctcagcctcccgaatagctgggactacaggagcctaccaccacgcctggctaattttctgtatttttagtagagatggggtttcacagtgttagccaggatggtctctatctcctgacctcgtgatccgcccaccttggcctcccaaagtactgggattacaggcgtgagccaccgtgttcagcccacatgatactaattctcaatgggcagaatgaaataaaaccatttattgatatagtgctttatgattgttcaaagtttattatatgcataagtcatttatttgggaaagttgaataccatgtggtatgtgatagggatagaaagatagtaagattcccgttctttgaagaagtgagggaggcacacatagaaaaataatccataatgcatgattaaatgctatagtaaagctgcttacaaaggggtttgagaatacagaggaataactgattaacttcctcaggaagtcaagagcgaaataattcactgaaaaggtgatctttagtaatttaacaaaatgagaaagggataaggacaggaggaacataaatgaggccaggaaagctggaaagtatgttgtaccttcacagaaggtcaagcagtagaataggagagtgtaatataaggtacatggtattgagaagtaggggaaattatgtctgagttaaagctatttggggccagaataatgatgattattgttattactattttattgtggtaaaacatctataacaaaatttactatttttaccattttaagtgtataatttagtggcattaagtacattcacaatgttgtgtaaccatgattactaccatctatttctagaactttttcacgatcccaaaccaaacaaaacctctacccattaagcagtaattcccattgcccttccctccagcctgtggtaacctctattctagtttctgtgtctatgaatttgtctattctagatacctcatataggaggattatacaatatttgtccttttttatctggcttatttcacctagcataatgttttcaagattcatttatgttgtagcatgtatcagaacttcattcctctttatggctgataatattttattatgtgtatataccatgttttgcttttcattcatctgttgatgaacacttgagttcttcccctctttcagttattgtgagtaatgcctctataaacggtggtgtacaagtatctgtttgagtccctggtttcacttcttttatgtctagcagtggaaatgctgggccatattctatatttaacttttttttttagagacaaggtctctttctgtcacctaggctgggtacagtggcatgactgtggctcactgcagctttgacccacctcaagcgattctcccacctcagactcctgaatagccgggactgcaggtgtgtgcaccaaaagcacaggcaacaaaactaaaaattgacaaatgggattacatcaaattgaaaagctcctgtacagcaaaagaaaactatcaacagagtcaaaaggtacctacagagtaggagaagatatttggaaatcatatatctgataagggttaatatccaaaatatataaggaacttatacaatgtaataacaatgaacaacctgttttaaaaatgggcaaaggactggaatagacatttcttgaaagaagacatacaagtggccaacaggtacagtcatatggaaaaatgttcaacattattaatcatcagggaaatgcaaatcaaaactacagtgagatactatctcacacctgctagaatgattattgtcagaaaggtgaaagataacaaatgttggtgaggatgtggagaaaggggaacccttgaacattgttggtgggaatgtaaatagccatatggaaaacagtatgtagtttcctcagaagttaaaaatagaactatattatgatctggcaatcccacttctgagcatatatttaaaggaaggctaccagggactaggggaaggggcaaatgggatgttggtcaaggggtacatagtttcagttatgcaagatgagtaagttctggagatcaatgtatataagcatatcaaatcatcaaattgtgtaccttaaatatatacaatctttaattgtcaaatatcccttaataaaaaagtaattgagaaaaaagtaaataaaataaaaaaattctatgagattcccaatttattgttttagctaaaaaggctaaaagctaaagacttttttttcttttgtgttgtttttaagccagtcaaatttagcagtgggactttgtagaaatagtaaagaagacattctactcctttacatagtaatagctaatgtttattaagcccttaccatgtgccagccagtgttgttaacactttatctctggcataaactttttgacaatgctatgagtcagataatattttctcattttatagataaaagaactgaaacagagaaggtaaacagtatgtccaaggaaatagagctaacaagtagtgaattcagaattcagactcaggcaatctaattttagaggccccaccccctcaccagcttttggttttttttttgatacggagtttcactctgttgcccaggctggagtgcagtggcatgatcttggctcactgcaacctccgcctcctgggttcaagtgattctcatgcctcagcctcctgagtagctggaactacaggcaaatgccaccatgcctggctaatttttgtattttttgtagagactgggttttgcaatgttggccaagctggtctgaaactcctgacctcaagcgatctgcttgccgtggcctcccaaagtactgggattacgggcgtgagctgctgcacccagccagagccccttcttttaagcactatgctattgggtttctgcatagtcacagtcttaatttactttgtgcagcattaattacatgatgcaagtttaagaattatccagagaagagcaattaaaatcaccaagggatgaaagggtactcacaagagaaccaactaaaaagacttggaaaggctgggaggccaaggcgggaatctctctgagattaggagttcgagaccagcttgggcaacatagtgagagtctctctttctctctctctctctctatatatatatatatgtatatatatatatatatatacacacacacacccacacacacacacacacacacacatacatattcagatagccaggtgtggtgatgcacacctataatcccagctacctgagagattgaggtaggatcccaggagttgggatcaaactcctttgatcccaggaatttgaggctgcagtgagctatgattgtgccactgtactccagcctggatgacagtacaagaccctgtctcaatcaatcaatcagtcaattaaaaaatacataggccaggcacagtggctcacgcctgtaatcccagccctttgggaggccaaggcgggcggatcacgaggtcaggaatttgagaccagcctgaccaacgtggtgaaaccccatatctactaaaaatacaaaaattagctgggcatggtggcacacacctgtaatcccacttattcgggaggctgaggcaggagaatcgcttgaacccgggaggcggaggttgcagtgagccgagattgtgccacttcactccagcctgggcgacagagtgagacttcatttcaaacaacaacaacaacaaaacgaacaagcaaaaaacaaacatacatacatacctggaaaagttcttaaaagaacatatgactaaagaatatggatataaactttccataccaaatcctgcaaggtagttttatacttatacatgttctacttataaatgacccattcttatagattatgccactgccttgatgctacatgtggtatttcttaccttaactgaaaaagagaaaactattttagagcttagtggggaaagtttcttaacaggttttacttccctaaatggttcccctccctaagaggaaaaacatttttccccaaaaatgttggggaaatgcctccaattaaagaggcattccaggcaccataactttaatgtgaattaatggcatagtgcctgtatttttcaaatgaaattcaggacatgatgtctgaaaaagattgcttttctttttttttttattattgtggtaagtgtgtatgtggtaaaaaacacataccttcaaaggagtggggagagacagtccttcgaagggcctgggatgagaactagaaatatttgccaatgttaatgaactatcaaaagtcttgattattaattcattctaacataaacctaatataggattgcttttgtgtgtgtgtgtgtgtgatggagtctctccctgtcacccaggctggagtgcaatggcacgatcttggctcactgcaacctctgcctcccgggttcaagcgattctcctgcctcagcctcccaagtagctgggattacaggtgcccaccaccatgcctggctaatttttgtatttttagtatagatggggtttcaccatgttggccagagagatctcgaactcctgacctcaggtgatccacctgcctcggtctcccaaagtgctgggattacaggtttgagccaccatgccaagtcgttaacataggatttcaaatccttgaaatttaaagtttgtgaacttcaaacttgcatgttcttgggagaatgtaacaagaaagagattaaaaccgctgaataaaccataattgttctccaactttatctggacctctaatctattacctcttcctttctagcagccctatgtattctttactttcctccctatccagctgagattttgtttcaatttagtttcttgccattaccctctcttttacatgccaatttcaagcacagctgcagaaaatcatataaccagatttgcaggaatttatgatcagcaaactcaactgggttttcagtaacacgttacatattatatttctccaggcaacacaccctttccaacagctttcagatctttgccctccttaggcccatttaaactttttttctcctttctcaagcttagtaggtgatcttgtctcctgcttgaccaagaattggactgataaaactttaactaccaaatctgtaggaatacctacatctgtacccatctgtctttcctctttgttaaaataaaagaaggttcatccattctccagggccagcctctctacctgttctctggatccaatgtcttccatcttttcaaagactttgtagaattagtaatccagtcctcctcttatattcaccctctcagtctatgcttgctcctcagcatttaaaaaatagttgtctggcctggcgcggtggctcatgcctataatcccagcactttgggaggccaaagcaggcagatcacttgaggtcaggagttcgagaccagcctggccaacctggtgaaaccccgtctctactaaaaaatacaacaatggctgggtgcggtggctcacgcctgtaatcccagcactttgggaggccgaggcaggcggatcacgaggtcagcagatagagaccatcttggccaacatggtgaaaccccatctctactaaaatacaaaaaattagctgggcgtggtggcgtgctcctgtaatcccagctacttgggaggccgagacaggagaatcatttgaactcaggaggcggaggttgtagtgagctgagatcatgccattgcactccagcctgggcgacggagcaagactccatctcaaaaaaaaaaaaatacaaaaattagcctggtgtggtggtgggcacctgtaatcccagctacttgggaggctgaggcaggagaattgcttgaacccagtaggtggaggctgcagtgagccaaaattgtgccactcactgcactccagcctgggctacagagtgaaactccatatcaaaaataaaaaatatttgtcttacttcccctttccaggaaaatttcttgaaaagacattttatctctgcattttctgctttcatctgcattttctcctcctactcctgataatctcagcatcttttccccagcattctatgttcttggcttcttatctctcagtttacttcttagtctcctttgctgacttcacctgtattcattattaaatgttatagttcatagttttgtgtctgtaatcttctcattctactctcttactacgtcatcatactcacttataaaacttgttacactttatgtgctaatgactccaaatctgtatcctttatccagacttctctcttgtttcttatatattgctgtatctttaggctttacacagtgtctttcacttagcaggtgttcaataaatgtttctttgtgactggctgactgactaaataagtaaactttatagtaattctttgtgattcttcttaacagaccaagatcaaatcctttgtatccctaggtctagcacatagtgggtactcactaagtgctttataaatgactgattgaataaataatgaataagcaccacaataaaataaaatttcttaataagatgaatgagtgaatgaaaaaaaactttgtgctgttcattatagccagtcaagaccaaagaccttgtttattctctttgaaaatgtaactgggggccaggcgcagtggctcatgcctgtaatcccaacactttgggaggtcgaggtgggcagatcacaaggtcaggagattgagaccatcttggctaacacagtgaaaccccgtctctactaaaaatacaaaaaattagccgggtgttgtggcgggcgcctgtagtcccagctacttgggaggctgaggcaggagaatggcatgaacccaggaggcggagcttgcagtgagctgagatcgcgccactgcactgcagcctgggcaacagagcaaaactccgtctcaaaaaaaaaaaaagaaaagaaaagaaaatgtaactgggtaggccgggtgcggtggctcacacctgtaatcccagcattttgggaggccaaggcaggtggatcacctgaggtcaggagttcgagaccatcctggccaacatggtgaaaccccatctctactaaaaatacagaaattagctgggcatggtggtgtatgcctgtaatcccaccaactcagtaggctgaggtgggagaattgcttgaacctgggaggcggaggttgcagtgagccaagatcgcaccactgcattccactctgggcaataagagtgaaactccatctcaaaaaaaaaaaaaaaatgtaactgataactggatataaattatactaaaacttggtttaagaagacagtaattcattaacagataagtaaaagttgcagatgtgattggaatgttgactgcatactctgtgtgaactatgagtagtgagaataaaaaatgttaatcacctaccaggtctagtatatacacagtagtcacagacacagactctggacggggtctatttgagaaagtattcaaaacctcctgtaggtatatgactgaggacacagtttcctcatttgtgaaatggggaaaaataactatgcccactttcatagggaggttgtgagaattaaatgagataatgcttgtaaagcacttagcctaggacctggcacaaaaataatcatttaatacccgcttgttattattaatgctattccattttgatccagctggtataggtgttaaccatgctatagatgaataattgccaaacctggctgcttatcagaatcacgtaagatttttaaaattaaaattcctgggcctttcccagactactgaatcagactggaagtagaatatgtcttttttaaagctccccaggtgattctgagcatcagccaggtttggcagttatgttacagaagatagacttgtctctagaaatcatctgagtatgaaatataatcaagaaaaatatttctggtgtggagaaaaaggagtcaagaatgacatctgtagtaagccaattgtatataacctttggaataaatggtcatagttgtgctgattgcccaagaacagaccgtaatgaaaggaaagcaggcacagctgagccattttcaaggttcccccaaatggaaagagaagcagagcaactgagctgttaagagctgccaaaattaatttagagaagccacgtaggatggggaaacatgaaaagaacttcagaagagagctggtagaaaaataaaaatgaagtttttgatattgcaggaagaaagattaagggaaaataaatgaagtagctggggatgaacaagaagtactatagggaagtatcaggaaaaaagaattcttgctgaggaaaacaaataaagagcataaacaaagaacataaaactcaggagagaggtctcaggaaggacagtaaacacattttaagagattcacagggaaaaggccaaacagagcaaggataattggcctattatagatggactcaaaatcccaaagaaacaagtattacaaaaagagagggataaggtaaagcctaaaggcaatgacggcgataacaaggggaaataaatgaaggcgctcaaaagaaaccttgaagaataattaaaattgtgcaaatatggataaagtataacttaaggtaggagagtgtgtagtacaaagagtatgggacataaaagtctaggggatcattgagcaaacatttattcagtgtttatgggtatcaggaagtttatgtgctgttacctgtgtggaatatatttagaaaaaaagtgaaaatattctggaagcatgatcagttcaacagagaatatgtgtggcaaaatgaagataatctctttttctagtcatgtaatagtaagaactccaattaatttctcaacagcagggacgttttggcagtcatttagaagataagcatattcctaatgaccacaaggaaattaaaactgtgaggagagagctgggtgtggtggcctgagcctgttgtcacagctactgagttcgagttcagcctgggcaacacagtgagactccatctctaaaaaaaatgaaaaaacagtgaactatgagaaggaatagttagaagggaagttaagctttcttttgaaggtgaggggatggtggtggagatattaaatgaaggctctcagaggaagggttaaagccaaaggagttaaagagctggcccggcgcggtggctcacgcctgtaatcccagcactttgggaggccgaggcagccaaatcacgaggtcaggagttccagaccagcctggccaacagggtgaaaccccgtctctactaaaaatacaaaaacttagctgggcgtggtggcaggcgcctgtaatcccagctgcccaggaggctgaggcaggagaatggcatgaacccgggaggtggaggttgcagtgagccgagattgtgccactgcactccaggctgggcaacagagtgagactctgtctcaaaaaaaaaaaaaacaaaaaagagctaaaagaccagactgggcaacatggcaaaaccctgtctgtaccaaaaatacaaaaatttagccaggagtggtcatctgtgcctgtggtcccagctactcgggaggctaaggtgggaggatcacatgggcttgggaggcagaggttacaatgaactgagattgtgctactacactccaccctgggtgacagagggacccaggctgaatatatatattcaactatagattgaatttccccacctccattagaatttttttccaatgtataagaatatgaaagagacagttcagggaagctgaagccactcacagcctaatatttaagaagagcatacctctaccaatttcagaagcagatttaaaatggagtacagagaacctggcatagcatcataaaaattgatttaaaaaagtgagacccccccatctctacaaaagacaaaaaaaattatctgggcgtggtagcacatgcctgtggtcccagctacttgggaggctgaggtgggaggatcttttgggcctgagaaatcaaggttgcagtgagctgtggtcatgccactgcactctagcctgggcagtagggcaagaccctgtctcaaaaaaagtgtttttttaaataaaaaaccaaagtgttgaaaatgaatacaaaggaagatgatgttcttggaagggcaacaagtacaaaaagagattaggttctgcaaatgaaggaattgggaaacaaagtaaaatacaggctaattggaagttattacggagcagttctgagtgagcaaactgatcaaatactgtagttgttggtgtcaggttttttttgcttcccctgtagctttccctcagtgatctcattcctatgacctggattaccatttgaatgtgaatggctctctggtcgtcgcccgagctccatatgtccaactgcctactgaagatctcttcttggatatgtcacagatgcctcaaaatcaataggtcaaaatctcaaaaaatcatttccccaattctctccctgaccccaagtctgttcctcttcctgtgtttccctattacagaaaattatattcttactcatctagtcaccccgattagaaatctaagcatcatacttgatgtttctccttttacgcctgtatataatcaattccacaagactattcttcccctttaatatctcacatgtatttacctctcttttctgattctattagtttagaccagaaattgaaaagaccttttctgtaaaagtccagatagtaaatactttaggctttgcaggccatatagtctctgccacaaccactgtagctcaaaagcagccacatacaatatgtaaacaaattagtgtggctattttcccataaaactttatttgtagacactgaagtttcattttcatgtaattcatatatcataaaatcttcttttgattttttccttcagctatttaaaaaaaaatgtaacagtcatccttagcttccttccctacaaaaacaggctcacaggccatagtttgcccacctctgacttagaccaacattctcacctatgatatggcagtagtacttggtctccctccttctcatcttgcccactctggtctactcttcatgttgcagccagattgactttttaaaattgcaaattgggactgggtgtgcgtggcttacgcccataatcccagcactttgggaggccgaggtgggtggatcgcctgaagtcaggagtttgagaccagcctgatcaatgtggtgaaaccctgtctctactaaaaatacaaaaattagctgtgtgtggtggtatgtgcctgtagtccaagctacttgggaggctaaggcaggagaacgacttgaacctgggacgtggaggttgcagcgagcagagattgggtcgctgcactccagcctgggcaacagaccgacactctgtctcaaaaaaaaaaaaaaaaaattggaagttgaattttactaccttgttaaaagaactttaaagattgaccatagcttacaggatgaatccatgtttcttggaagacccttcataattgtgaaccttacttacctttctagccatatttcttaccagttctccctaattctctgttgcagctactgggaattgtttataattcctagaatgttaagtgtttttcatatctaagttttgacacgtgccttgaatgcctttcttccttatcttctccctacttatacctggttcctgcaggactcatatcagtcatcatcatcatctccagaagccttctctcactccatgaaggctgtattaaatccttctattaagttcgcccatcatgtctgtagaaccgaatgatagcatttattttacggtattatgattgcctatttacttgactcccctcctaaatagtaagctccttgagtacatagtgtttgtctgttgtgttatcctcagtttccatttttctttttttgagatggggtcttgctccgttgcccagactgaagtgcagtggcttgattatggctcattgcactcctgacttctgggctcaagtgatcttcccacctcagcctcccaagtagctgggactataggcatatgccaccatgctcgactaatctgtttatttatttattttttattagagatgagatctcactgtgtttccaggctggtcttgaattcctgagtttgaatgatcctcctgcctcagcctccaaaatgctgggattataggcatgagccaccacgcctggccttccagtttcctgtatgataccccatagtaatgtgtgagtggggtttttgtttgtttggttggttttgttttcatttttgtttttgagacagggtctcgctctgccacctagggtaggagtgccgtggtgcagtcacagctcactgcaacctcaacctttagggctcaatcagtcctcccacctcagcctctcaagtatccgggcctataggcatgcaccactgtgcctggctaagtttttgtattttttgtagagaggggattttgccatgttgcccagagtagtctcaaactcctggcctcaggtgatctgcctgcctcagcctcccaaagtgttgggattacaggcgtgagccactgcacctggccatttttgtttgttttacattttaaaaattgacgtataattcatgtaccataaaatttatcctgttcaagtgtacaatttagtgcattttactatatctaaaatgttgagcaactatcaccatggtctaattccagaacgttttcatcacccccaaaagaaaccttgtgctcaacaaaaagtcactcctcattccttcctgcccccagcccctggcagccactaatctactttctttctttatggctttacctattctgtacatttcatatcaatgctatcagataatatttgaacttttgtgactgtcttttttcatttagcatatgtaatgttttccaagctcatccatattttatcatgttctagtactttattccttttttcttactgaatatcaacattatatttcattatttatttattttttgagatagggtcttgctctgtctcccaggctggagtacactggtgcaatcctagctcactgcagcctcaaactcctgggctcaagtgatcctcctacctcagtcacctaagtagctaggactacagacatgttccaccatgcctggctaatttcattttttattttctttagtttttgtaggtctcactgtgttggccaggctggtcttgaactgctggcctcaagtgatcctcttgctttggccttccaaactactgggattctaggcataaaccactgtgtccgacctagctgtatattttaaacttcattcttcaaagcacccaggactcgggggggtgaaaaagagggaccccctagactccttctcttgcttcacctagaacatttatattttcatctatttatggacaaacttttattttaaatttgaaagtcgtgggctctcagattgaagaatacactctacctgggactgaaagatactccatggtctttttactccatctttctttccaactcttcttttcatgtgctccagtcagacagtatgttggtggagtcttgaggtatacctcatgctttcttgccactgtatcttttcttataccatctcctccatctgaaatgcccctttcccatctgtttaaatttttacctaactttcaatgcctaatacagatataatcaattccatgaagttttcccggatctctggattcttgtagtaattatactgctttagatggtgccttgtctaatttcttgagactactctcatgttttcttagttgttttatactttcccattgagtggctggacatgggatggtgggggactgggggttgggggtgactataacagattgcatgggccaggcattgtgcctcactcctgtaatcccagcactttgggagaccaaggcaagaggattgcttaagcccgggagttcaagaacagcctggacaacatagcaagacctcatctctactaaaaataaaaaaattaacctggcatggtggcaaatgcctgtagtcccagctatcaggaggctgaggtggaaggatcgcttgagccctgcagatggagactgcagggagctgttttgccactgcactccagcctggtctgcagagtgagaacatgtctcaaaaaaaaaaaaaaaaagggggggtggggggatagcatgagggagatctttgtgatgataaaagtattctgcatcttgattgtgatggtagttatacaaatctgcacatattttaaaatgacatagagctatacattcatattgtaccaatgtcagtttcctggttttgatgttgtactgtagttacataagatgcacccattgtgggaaattatgtgaattgtgtgaaggttacctgggacctctctttgctatctttgcaatttcctgtgaatctgtaattaattttaaaataaaaagtttaggttggccatggtggttcatgcatgtagtcccagcactttgggaggccagcaggagaatcacttgagtccaagagttcaagaccagcctgggcaacatagcaagaccccgtctctgcaaaaaaatatatttttaaaaattaactgggtattatgatacatacctgtagtctcagctacttgagagcctgagataggaggatagacttgggccctggaggtcaaggctgcagtgaaccgtgattgcatcactgtactccagcctggttgacaaagcaagactctgaaaaaaaaaagtttaaaaatatattcttcaggccaggcgtggtggctcatgcctgtaatcccagcactttgggaggcagaggccggcagaccacttgaagtcaggagttcgagaccagcctggccaacatggtaaaaccccatctctactaaaaatacaaagattagctgggtgtggtggtgcgcacctgcagtcccagctacttgggggctgaggcagcagaatatcttgaacctgggaggtggaggttgcagtgagctgagatcgcaccactgcaccgcagcctgggcgacagagtgagactcagtataaaaaaacaaatcatttttccatggtgctacttctgattaatgtgaatctgcctgtgccttccaaagtaaagttactttggggtagacaagagatgtatttttagtgatattttagttacattttacaattagaacaaacttgtctaaagcaataactgagacagagtggttagttccctgtctacgaggtcctggcttatccaaggtcttattttaatttttaagttgactggtaagcctttgagtcatgttttcgtatacttttaagttcttagtattcttatgtactggctcctagaagacagtgaccatagctctgagttttagaaaaaaatcattatgtgatgttcagttcaaactttaaaacttttaaagttgttacattgtttatcaattgaaatgaattttcttgtgcaaatttaaagtaagcattacaagatcagaattattgctgattttttttggaaagaggtagagtataaataaataaccagagttttttgtttgcatttatgatcaagctcaaagtgaatatgaaccaaaaaaatgaacaaaactacatattttttagtaaaatgagaacttaattttttttcaggttaaactacagaacaacatatcgtatcagatggcagacatacatcatttaaagggtaagaaccttaattccagattaaagataaaccaaggtcactaaatgcctaaaattgtgaagaattaagaaatagtaaattagcctagtgaaatacaattttctgaacaaactcctctgatggtaaaacatttatccttttgccttaagatataataaattatttaatgatgctttatatatgataaatccaagttaaaatttgagatctgtgtcttaaccttgagctacagacagggttatgcaatgaaatgttcttaagagaatactcaaaaaaaaattgagctgtagcttcagaagccatcaaatttctagggaaaaggtgagaagtgttccctctgtactgtgtccaatctgctaaattaattcattcaggtctagggatgctttggatagagcctccaagcttaaggttttagataccctgggaacagaaagaaacctggaaaatagataaatatataataaataaataataataaatataaaaatacacacacatatttttacttggatgaagtgataaagaggtactacagcttttatggagaaaaaaaaaaagccctgcaatctgcttatgttacttcatgccatagctgttagcctttgaagtttgggttctgaggaacaatcctcatctccctcacaccctttggttataatactgtattttaaaattttgcatgcattgtctctaggtttatgtatgtgggtagtacatgctctctagcttcaaaaatatcctttattctattatccttttgagcctctttggatatacttagataatctatttttattgtcctctcgaagtagccaaccttagctggctttgtaatgtagtaaaatttttctccttacctagcacaatcaataggaagtgtttttgtgtgttgtaaccctaaaataagttgttgatttcctattatccatgatttagaacagctttgattttctgttagaaatgctttctgggtcatcacatgggtttttgttgcatctgtgtccatgttctctttttgactcaccaaaatatattaggatgacacagaagatgccacagtgtcagtgctgcttccaacttgcaatttttacaaatgctttcacttgtcatcaaagtatacttcttattaaatgttaagaaatactattagggcttattaaagcagtaacttaatgcttattaactgtttattaaatagatcagttgaataagaagtcctgtggcttctgttagtatgtgtcaacaaaaatgacaacctgtgttactgagtaaaaatctttattgtaccatatgtgttggagtagatcttgagatattttgaaattgtgtatgatactcttcagcagagaaaaaggtcttgatttgtatgtatagctatacaacttttggttttgaagcttgggctcttaaatttgaatttaaaaatttaaaattgaaattcaataatgtgacttttgcaactggaatgatttctactgaaacaaacttcttgaaaacttgccttttataggcaagttttctttgaaattaatatctgctatagtagaattaatagacactaagacacttgagatggtttatattttcttggaaataaaggaaagttggttttttcaatcattgaggtaataaattgacattctactatcagatttattttgattagcttaccttgtttttatgcctgttactgaaagaaagttcaaagtcaaagttttctagaagtaattttctttttttttttaaagctggccccaggcaacccatttcttacctatccctaatcttttgaagttaaactaagggagtacagccatgtctttctataacataactggtgttgctttcaaagatagagcgtcctgtacaatcaacctgactcgtgttaacttactctaagagttctgctacggtgacctggagcagccacgctagacagaatatctctgggttcatataaagaaaacacatgccaatcagtcaaaagtaaaattgattttttttaacctttatttaagttcaggggtacatgtgcaggatgtgcaggtttgttacataggtaaacatgtgtcatggggcttcattatacagattatttcatctcccaggtattaagcctagtatccatcagttatttttcctgatcctctttcttctttgttttgctttctggtcttcttacttttccccttgcaaatctctgttttgacccactggaaatcaccaattacctccctgctttatgatctttctctgtattcaaataggaaataatcatattttacatgggctaaaactcatattaatgttttatttttctttgtcaattgtattttaagtcttttatcttcaattacaaaggaaaattttatttcctgatagatgaatttcaaataccatcaatgggaagctttgtggggggacagagaagccatccaagaatcttaaaatcatactaagcctcaggttcattctgaagctatttcaggtattttacagcatagcctgaatcagaagggactgtaatctttttgttccctttttcccgaggagaatgagtccgaaagatcaccaattgaagtctctttctggtagttgttaagttttgtttgttttttagttacagtttttaaatttagctttcagttctagaaactatccagcctgagcacaggtttactgaactagctagtttgatcccttagccacaaggctttttgctactgcttcctactgtgatctcattgtctctatagaatcagcattcatagctggggccagggtttctggtacctctggcctgctgtatcttaggagatggagacagggatcaggcaacaagctgaaagggttttttatggctacctggccaccacagatccatcacttttatttgagatggggggtaaatcaaccatgtttacatattggagaattaatattataaaaagagaaatttggctgggcacggtggctcacgcttgtaatcccagcactttgggaggctgaggcgggcagatcacaaggtcaggagttcgagaccagcctggccaacacagtgaaaccctgtctctactaaaaatacaaaaattagctgggcacggtggtgggtgcctgtaatcccagcaactcaggaggctgaggcaggagaatcgcttgaacctgggaggcagaggttacagtgagctgagatcgcaccactgcactccatcctgggcaacagagctagagactctgtctcaaaaaaaaaaaaaaaaagaaagaaatttaaaatgtggcttgaatatgcaaagataatgattaactacaaatattttatatgaatcattgattttttcatacttgattattatacaatagttattatgcatattgttaagcattatgtgtctcagcagatgtttatgtgacttaaatttttattcttcgttattgccacagttataattccacaataaaatttagaaagtgtagaaaaaaagtatatgttcaaaatcctactgtcagacacattcactgatagcactttgatatatttttattctagtctttttttttgcatggatgcaattatatgtttacatctgctgtttaaaaacatctgctttttatttttatttttttatttatagtttttttttttttttgagacggattctcgctctgttgtccaggctggagtgcagtggcatgatctcggtttgctgtaacctccgccactcgggttcaagtgagtctcctgcctcagcttcctgagtagctgggattacaggcatgcgccaccacacctggctaatttttgtatttttagtggagatgggatttcagcttgttggcgaggctggtctcgaactcctggcctcatgtgatccacccttctcggccccccaaagtgctggtattacaggtgtgagccaccgtgcccagccaacatctgcttttttttttttttgtctcgctctgtcactcaggctagagtgcacagtggcgtaatctcggctcactgtaagctccaccttctgagttcaagtgattctcttgcctcagcctcccaagtagctgggattacaggctcagaccaccatgcttagttaatttttgtatttttagtagagacatggttttaccatgttggccaggctggtctcgaactcctgacctcaggcgatccacccgcctccacctcccaaagtgttgggattacaggcatgagccaccacgcccagccccaacatctgctttttaaaaacagccaggcatggtggctcacgtctgtaatcccagcactttgggagatttaggcagaaggatcgcttgagctcaggagttcgagaccagcctgggcaaaatagtgagaccatctctataaatacacgtatatatctatatctccctttttactcaggaaagtggctgtatatatatctcccaagtatttttggagtgcttttagaggaataagactaattctgtaacccttctgtaaaaaatagatgttatagtattggtacattatggctagatgttatattttaatcttaatagctgttgcttatacagtataggcccctgttttcatttctaaaaattatcttaatactacttttgcttaactgctaaggctgttagctgtttttaaaatcacctatctgtgaaattaacattcactcttttccgcctgcatttcttttgtctgtaggcttagatcatgagggaatgaaatctagaacatgtgtggctggtgattatggattaaacatttacaaacaagtgtttggccaggttataatttactatccagtttggaatttcacatgattcatttccactaaaaaaattcagtcctagtccagaaattatgagctttgaaaatggaattttgggatatgtagagctaccatccatagccgaactagaaatgtatctaaagtgattggcacctatgttggtagtcgaatgtgatttaaaatgagaaagaaaacttaaaatttgtacccatagtacttttttcctactttaataaagcagatagatttgaagagataggtagttttttgtattgtctccacagcttagcatgtgtctatacaaagtgtaacaatgtgtaatttaaagaatattttgggttgatgtgaaagccactgaagctatattttttaaaaaataaatgttgccggtcaggcatggtggcttatgcctttaatcccagcactttgggaggctgtggtggccagattgcttgagcccacaagtttgagaccagcctgggcaacatggctaacccatatctactaaaaatacaaaaattagccggatgtggtgttgcacacctgtagtctcagctgtctgggaggttgaggtgagagaatcacttgagctcaggaggtgcaggttgcagtgagccaagattgcaccactgcactctaacctgagtgacagagcaagaccctatctcaaataaataaatgaataaattttattgaccatgaatgtgttacaaaaggatattaaatgtggtgtttgttatataatttaatttcctgggagtattactaaagaaattgagaattatgtataattaaaaaaacatcccatagcttctgaataggaagcattacaatgagtgaacttgattcctttggttcttaccttgggtggatagagcaacttgctgagcttcgtcaggaatttcttcgacaagaagaccagcttcaggactataggaagaacaatacttaccttgtgaagaggttagaatatgaaaggtaagatgttacatgcaacatatgtttatgaatctaaaatatttgtccagcttttggactcagttcatttctttctctctgacttttgtttccctttttttctcttctttcattttgttaagccttttaaattccttttctattatctttctttagctctttgaaatccagactcttttattttgataaattaaacagcatgaagtatctcttagagggcatgttgagtttgtgtatgttgtagaattcattgtgagagaaaatcttacaagctctgagttttattagatgtggcaaagatggaaagaagatttgtgattctttttgacggacatccagaagatgaaaccagcactgggagatgttcccagaagagctgagggactgagtgccggctgctcttcctgctctgcatgtcagccctcttgctgatacctctacacttggtgatgaggttggggatcctcttacaggcctttctagcaatcacgccttaaaacttttattatatttgtaatcaattttatggtaaaagatattttttagatttgtacaccaaaagttagaaagatttgccatattttaaagcattttgtgtccatttctgacttcttactcttgtaggttatcattgtacatttacttaaatatatgtattttaacgtaacagtattcagtatttttctgcatgtctataggattaaagatttaacgtatgtacaggtaatatattattctagcatattaatgtaccaaaacttctttagtctcttccaattgtgggaccacagtaggagttttccttttctcactttaagactatcacaggctaggttatggtggttcacacctgtaatcctaacactttgggaggctgagactggagaatcatctgagcccagaagttaaaagaccagcctaggcaacatagtgagacctctgtctctgaaaaaaatttttaaaaattagctgggcatgatggcgtatgcctgtagtcctagctgcttgggaggctgaggtgggaggattgcttgagtccaggagattgaggctgcagtgagccatgatgatgccactacactgtagtctgggcaacagggtgagaacttgtcttttttttttttttttttgagatggagtctctcacgtctctcgctctgtcgcccaggctggaatgcagtggcgcgatcttggctcactgcaagctctgcctcccgggttcacaccattctcctgcctcagcctcccgagtagctgggaccacaggtgcccgccaccacgcccggctaattttttgtatttttagtagagacgggctttcaccgtattagccaggatggtctcgatctcctgacctcgtgatccacccgcctcggcctcccaaagtgctgggattacaggtgtgaagaacttgtctctttaaaaaaaaaaaaaaaaaaaaaaagctgagtgcagtggctcacgcctgtaatcccaacactttgggaggctgaggcgggtggatcacctgaggtcgggagttcaagaccagcctgaccaacatggagaaaccccatttctactaaaaatagaaaaaattagctgggcctgatggtgcatgcctgtaatcccagctacttgggaggctgagcaggagaattgcttgaacctgggaggcagaggttgtagtgagccgagatcgcgccattgcactccagccagggtgacaagagcgaaactccatctggaaaaaaaaaaaaaaaaaaaagactatcacagctataaaaatgtctatgcaaaaaagatttcccaaaactagctgggtatgctggcatacacctgtggtcccagctacttgggaggcagaagtgggaggattgcttgagcccaggaggttgaggctacagtgaaccataatcatgcctgcactccagtctgggcaacagaatgaaaccttgtctcaaaaataaataaaaaaataaagatttcccctccccttgttatttcagtagtatattttctcaaatgtagaattcctctaaaagaatgatttaccagttttgttgcttttacagcatagatgaaaggttgctttctaaaatgattgtactcatttataatgtagacatttccccatagccctaccaaatttggttttaattctaatttaattttgttagtataggaataagatactactatatatatatacatataggaagttggtgggtttttttgttttgtgttttgtgtttttctttttttgagactgagtctgtttctgacgcccaggctgggagtgcagtggcacaatctcagctcactgcaacctccacctcctgggtttaagctattctcatgcctcagcctcctgagtagctgggaccacaggcacgtaccaccatgcctggctatattttttgtatctttagtagagacagggtgtcattgtgttggccagactgatctcaaactcctggcctccagtgatctgcttgcctcagcctcccaaagtgctgggattgcaggtgtgagccaccctgcctagccacatataagaagtttaatttgcattttataatggtgaaagttaacatttttctatatgtgtgttaactgtttctttttgcatgattggtgtatgtgtatcctttgactacttggctagcagaaagtcaccatctttatctgttttgctgctgttcactttctcctgatggcaccagtctatcttctttattagtttctttcgttcctagtattctatggtttagccttttattacagtgttaaactactattggatgaatcttctgctgccacttcttatcagctctcataattctagctttcctcatctgttactataaattggtctcacagttttctcttctatagtatttttctcttctgtgattgaagttggttttgaaagtttttttttaatagatgcaatttatggaaataataggaaaagaattgtttttatctttgtaatttctgttttctcaattagctttatcagtattatctacctcctattacaagttcaagtattttaaaagttttgattgtgagctatttgtatgctctgttttttccagcccactctcccctgctaactgagtgttttatctttcttatgtatgtgtcaacttctggacaactttgagaatccaatccaagataatataatctaaaagaatgactttgtaatttagttttcagtgtggacagcagatgaaggaattgagagcacagcatgaagaaaatattaaaaagttagcagaccagtttttagaggaacaaaaggtaaattttaaaaatatacttaaatccaaatatttttattataaatcatggtaatttagaaattaaaattataattttgtcacaaaacactatattttaagttttccagccagcctaattccaaaagtgatttacaatggctttatttctgagtaaattaaacatttgcaaaaatataatcttaattcttaaaactggtcgggcacggtggttcacgcctgtaatcccagcactttgggaggctgaggcgggcggctcactcgaggtcaggagttcaagatcaccctggccaacatggggaaaccccatctctactaaaaatacaaaatatagccaggcttggtggtgtatgcctgtaatctcagctactcaggaggctgaggcaggagaaccgcttgagcctgggagacggaggaggttacaatgagccaagatcacaccactgcactccagtctgggcaacagagtgagactccgtttcaaaaaaaaaaaaaatttaaattaattttgaaccaaaatatccatctttttaaaaaaataatttttgttgttaatatatttctcagattgtaaagtgggcaacttttttactgaaaatcaactacttccttttttatacatttgagaaatagaaaaaaaagaaacactttttcctttatcatcagtctctgttattctgacaccctttcctaaagcacagaaatgagacactagccactacaaccaatttgattcatactttttttggggggggcaaattcttttattaattcattttaagttaatatgtattatgaagattcttttagcaatagaggaaattgtctgaagattactaattattaaggacatgattcatttttttttgtgtgtgtgatggagtctcgctctgtcgcccagctagagtgcagtggcgtgatctcggctcactgccagccccgcctcctgggttcacgccattctcctgcctcagcctcccgagtagctcggactacaggcgcctgccaccacgcccggctaattttttgtatttttagtagagacagggtttcaccatgttagccaggatggtctcgatctcttgaccttgtgatccgcccacctcggccttccaaagtgctgagattacaggcatgagccaccgcgcacagccaattcatttttttataccttgtaatcttacctaaccaggcatgatttttatgaactcttgtgatttaaaggaaaaaaagatttaatagtgaaaagtatttgttttgctctttggtagcatctcaactaaaggactagaagttaaggatatcaggttttcattcttagctttttcacaattttatagtaggatatagagggtgtcatttctttctccatttcattttttgaatctacaaagtggaatacctgctgcctatctgcagtctactttgaagaggtgtttaaggatggattggtggacgaaggcaggcctgagtgagctaccatagtagaggcattgagggcaaccaaaaggtattattgagacactggagggtcaaaagaacataatggaacacaaaaggaaggggaagagaggtttgctgttgcaattgtgtcattataagcgtagtatataaataatgggataagtttgctctcttctattctctttttttttttgagatggcgtctcactctgtcacccaggctggagtgcagtggcgtgatctcagctcactgcaagttccgcctcccaggttcacacattctcctgcctcagccttccgagtagctgggactacaggcacctgccaccacgcccagctaattttttgtatttttagtagagacggggtttcaccatgttagccaggatggtctcgatctcccgacctcgtgatctgcccgcctcagcctcccaaagtgctgggattacaggcgtgaggcaccacgcccggccgctctcttctattctcttaaggaatacagatgagagctttccctttttttccaagccagtgtaattctctttctgttcttctatactaggctatttttatgttattaattaactaatgcttctccaattcttccttgccattatcctaccctaaatggaacaaggcatggcaggaattgaggtgcccagagaacttctcctttctgggtagcacatcagcccttaccctctagatcagctacctaattctactccccacccttcatttcctgtactttaactactatggcaagttggttctgtgcaatttgagttttcatagagacaaatccaatgttagctatatgaaataagcataaattgtattcagggatttatctttttgttttattaattttaaaattaattaaccagccacatgtctatcatagaaatgactctggaaaagaagtcagcaaactatagcccgcaggctgaattcagcttgctgcctgctttcgtactgtttagaggccaaaagtggttttcacattttcaaatggttgaaaaaaatcaagaaaaaattatcttagtacttgggaaaattataagaaatttatattttggtgttcatacataaaattttattgagacacagccatgcttatttgtttactgcgttcatgctgtaagggcagagaaactctcatagcccagagaagactaaggagactaaggacttaaatgcagtgtagtagctgggggcggtggctcacacctgtaatcccaccattttgggaggccaaggtgggtggatcatgaggtcaggagttcgagaccaacctggccaacatggtgaaaccccatctctactaaaaatacaaaaagttatccgggcatggtggctggcacctgtaatcccggctactcaggaggctgaggcaggagaatcctttgaactggggatatgggggttgcagtgagccagtactgcaccactgcactccagcctgacagcagaacgagactacatctcaaaaattaaaaaattaaaaaattaaaataaatgcagtgtagtatcctgaattggatcctgaaacagaaaaaggacttagtggaaaaactggtgaaatctaagtaagtctggagtttaggtagtaataatatactgattttcttttttagttttgcaaatgtatcatggtaattatggatggtaggttaacaggattttaacattagggaaaactgagtaaggggtgattacttttctgtaaatctagaattatttcagaataagaagtttattttaaaaacaatcaggaggcccactaaccaaatcacaaacattacatctagaaaagcatcttattttattaatattaatattgtccattcatagaaaggtactgtcaatagtacattaaagatacaacatctttgttaactattttcaatggaaaagtatttttgaacagtagcttgttgacttttaattttgttcaatatttttcttatccatatctggaaaagagtgaagagtactatagcaatagccttatgagatagcattatagtgaagatgcacagacatgcaagctggctgctcaggttgtacctcatggattttctcacccttggtgtttatattgacatgttcaaaaatttcagtttatcatttcattcatcaatgattaaactatcagaattgattatagcttaccaacttacaggaaatgtgggatttggagtcagaaagactgtggttagaattccttcttcacaattctctagttttgtgactttggacaaactgcttttttttttttttttttttctgagacagagtcttgctttgtcacccaggctggagtacagtggcccgatctcggctcactgcaacctctgcctcccgggttcaagcgattctcctgcctcagccttctgagtagctgggattacaagcatgcgccaccatgcccgactaatttttgtatttttagtagagacggggtttcgccatgttggtccggctgattttgaactcctgacttcatgatccacccgcctctgcctcccaaagtggtgggattacaggcatgaaccaccgtgcctggcccaaactacttaactttttctatttaatggagtgttgcactgttgcccaggctggagtgcagtggtgccatcttggctcactgcaagctccgcctcccgggtttacgccattctcctgcctcaggctcccaagtaactaggactacaggcacccgccaccacacccggctaattttttgtattttttagtagagtcggggttttactgtgttagccaggatggtctctatctcctgacctcgtgatccgcccacctcggcctcccgaagtgctgggattacaggcatgagccgccgtgcctggcccaaactgcttaagtttttaatacctcagttttgtttttctcaaaactattaattttatttctactagaggacagctatgaaggcaatttggaaactatgagacacgatgcaaatatttattgttgattttacttgccaggacactggaatacctacacctaattgtcagagtactctttctcctttattgtgacacactcttaagatttggctgttgtggccgggtacggtggctcacgcctgtaatcccagcactttgggaggccgaggttggcagatgacgaggtcaggagatcgagaccatcctggctaacacagtgaaaccccgtctctactaaaaatacaaaaaattagccgggtgtggtggtgggcacctgtagtcccagttactcgggaggctaaggcaggagaatggcatgaacctgggaggcggagcttggagtgagccgagatcgcgccactgcactccagcctgggcgacaaagcaagactccgtctcagaaataaataataataaaaaaaaatatttggctcttgtttttctagattccatatagatttttcgtactatttttataacattactaagaattatatttcatactgcattagagtttacaaagcatttatagatgcattaaatgttgactagaggaacctgtatatggcatcccaagcttgtgtacttgaatccttgctgctcccaattttccatggaggcaaacttaatactggtccaccaagagaattgagttaggcctaaccatgtacctgaagattcacatttccaagaagatgctaggttaggaacaggttagaggaagcactgacctgtttattgtcctgccactacttgctgtgtttcggtggccagcacacttaggaagaagattgcctgtttttcacccttgctcttgaagaggcacctgtgtaccagtctcctccttactgccatcctgcttggttctaacatatgcttacagagaacccaccctgcccatagcacccaggaagatgcccaattttaggccattagggtaacctagagtattcagcaggctgtcttgcagaatcacacacctcagcatagccaagcagagtcacctctgcctaccaaatcattcatttactgtagctagagattttcaaaagtgttattctttgactttttatcaggtataaaaatcacacagaaaataatgtatcctgcatctccaattgttcattatttgaacccatggtatatgttttacaagatgaactgtttcagaacatttaattaatagttgtgtcggtggtttaacaatttgaactgaaaaatattattaccaaattttgtctaacagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaaggtattattgttattattcttttgttttgtattaataggatattgactttttcttcccattttgaagtggatattttcaatcataaagaaaattgtttgattttagttcacacatgattaagtgtctgcattgtttcaaatttggattgtttgatagaagagaaaaaagagtaagttattttagagttacagctatgtccaaagcaagaggtaaagatgttcagttgatgtagcctattacttttagaaactgattgttacattccttcaaaacattttcaaattatgtaagaaaaacgatagaattctatctttttgttacttgggcagaacaaatcaaaagaggtggtgatgcagggatgcctggaatagaagagaatgacctagcaaaagttgatgatcttccccctggtaagtaaaaattgttagagaattcgactaaagtgatgataatacatttcatgtgaccccattctctttttcggtaacacttggaaaagtcacagatatctggatgatcgatatttctacttaattaagtacccattaattgccaggactttttttggatccaacttttataaaattttttgctaagatgtataaaatacttgtttttgccttgataagaatcacctatatttgaatcttttctttgcgactctgagtttttgcttatgacagttgtactatatagagtcatttatgtttactaaaagtatgcatggctcttttctttcccaccaaatgtgcccagattcctgtgttgttggtgtgctttaatatggcatagtaataccctaataagagttatttaattatttagttttgagggcttggcttgtccttttagtgaattaccccacacttttggatagtttgtttaacattttttttcttcttttctggccacttctgttcattgtatgtctctttcctccttaatgtgtctgctgcttatccattttcacttgaaggcctgctcccacttgctgctattctaatccccttcatttttttccttcatgtctcttctttgtttttcttgccatatctatgtttcttggctattaatggtactcctccctgctgactccaatttattagggtagaaaaataagaaattaacagcatgcctctactgcttttggctgattttatttcttctcagtctcagtaattacttctgtgattatagctagttgtacatgactgaaattgctgaatgtttagatcaaataaatgaaatatttgtcctttcatttatatagttttattgtcttctcaaattcttatgggtttccaattcatagtgatttcccctaaaataaaggtaaggacaaaagcaataacatgaatttgaaaataaagaatcagaattagcaagctttgtttgtaagacaatgaagtaatccagtgattttttaaaattaattaattaattaattttgagatacagtctctctctgttgcccaggctggagtgcggtggcgtgatcttgtttcactgcaacctcagcttcccaggttcaagcatttctcctgcctcatcctcctgagtagctgggattacaggtgtgtgccaccaagctcagctaatttttgtattttcagtagagacgaggtttcaccatgttggccagctggtctcgaactcctaacctcaagtgattctcccaccttggcttcccaaagtgctgggattacaagcatgagccaccaagcccggcctctttttaaaattttgagacagggtctcactctgtcacccatgctggagtgcagtggtgcagtcatggctcactgcagttttgatctcctgggcgcaagctatccatccacctcagcttcctgaataactgagactacaggtgtgtgccatcatgcccagctaattttattttttattttctttatttttttatttttgtgatatgggatctcgctctgtcacccaggccagagtgcagtggcatgatcacagctcactgcagcctcgatctcccgggcataagcgatcttcccacctcagcctcctgagtagcaggaactacaggcatgtgccaccacacctgactaatttttatagtttttttgtagagataagttttcaccgtgttgcccaagctggtctcgaactcctagccttaagcaatctgcctgccttggcctcccaaaatgcagggattacaagcatcagctaccatgcccagcctattttctttatttttttgtagagacaaggtctcaccatgttgcccaggctgatctcaaactcctgggcttacgtgatcctcccaaagtgctaggattacaaacatgggtcactgcacccagccaaaaaatatagagagagagagccaaaaattacatatatttttttcagagacagggtctcattctgttgcccaggctagagtgcagtgatcatagttgatggtggcctcaaactcctaggctcaagccatcctcccacctcagccttctaggactacaggcacacaccaccacacctggctaatatttttatttctgtagagacggtgcctcactgttgcccaggctactctttaactccagtcttcaagcgatagtcccgcctcagcctctcaaagcactgggattataggcgggagctgtggtgcctagctgtaattcggtgatttttaaagtgtggtctttggatcagcagtgtcagcattacccaggaacctgttagacatgcaaattcttaggtctcattccagacctacttaatcagaaattttggaatggagcccagcaatttgttttaaaaagctctcctagtgattttgatctatgctaaaatttgagaaccactgacttagatgttaatttaaagaaatgttcagagcaggaactctgtattcttccaaatttttgtagcacttactctagtcctaggcacagttgagttttaggttgattaatctattttacattgcggttgtgtattttaaaaactatacccaaagttttgtcaaggacatactgctggtttctgatacatagaagcactctattcagatatgagcaacagttggctacctgcatacattaatttttcatgtaatatacctgaaaaatgtattatttgtgtttaaatatatataatttttgacctctattatttatttccacatacttttctctttttttttttttttttttgagacagagtctcactctgtagcccaggctggagtgcagtgatgcgatcttggctcactgcaagctttgcctcccaggttcatgccattctcctgcctcagcctcccgagtagctgggactacagatgcccaccaccacgtccagctaattttttgtatttctagcagagacggggtttcaccatgttagccaggatggtctcgatctcccaaccttgtgatccgcctgcctcagcctcccaaagtgctgggattacaggcgtgagccaccacgcctggcatatttccacatacttttcaagttaaaattttatcattattactctaaatgtgtaatgtctccatttattttctcattggtcataatttattacccagccaccaggaaattccagtgtttagggtaaaatgaaatgggaatacaagagatcttagagatcttgtcttgaccattattaggtatattgtcctatcagacagtggttttcaaatgtctttcatatatgaaccactccagcaggatagaaatcttatcttgccgcttctgctttcttaataataatttttaaaaagtacacaacaattttattagatttttttttttttttttttttttgagaccgagtttcactctgtcgtccagcctggagtgcagtcgtgcgatcttggctcactgcatcctcggcctcccgggtttaagcagttctctgcctcagcctcctgagtagctgggattacagcgcccaccaccacgcccggctaattttttttgtatttttagtagagacggggtttcactatcttggtcaggctgatcctgaactcctgacctcgtgatccacctgcctcagcctcccaaagtgctgggattacaggcgtgagccaccgcgcctggccaattttattagattttataagaatgaatagcgctacttttgatgagatgccaacaaattcatatctgatttttacaatgtgaacttgccatatgcaacttacatggttgcagcactataatttggaactgggaaaaacaccacgtgtattaacattttgtgtaaattgatcgttaatgtaaaaaatgtcaccatatgcagacattttctacattgtcatggcatattaaaggccttcctctggattgtttttttttttacttttatttttatttatttatattttttgggacagggtcttgctctgtcacctaggctggagtgcagtggcatgatcatggctcactgcagccttgacctcctgggctcaagtggtactcccacatcggctcccgagtagctgggactacaggcatgtgccaccacatccagctaattttattgttgttgtttgtagagacagggtgtcgttatgttatccaggctggtctcaaactcctaggctcaagcagtcctcccaccttagcctcccaaagcactgcaactacaggtgtgagccaccatgcctggcctggattaatatttgaagctctttaaactattggtgctttgctttgataatcatttttcatagcaattatccttaattatttgaggaagtattttgagtgtaaagattattttgaaatggtaactggtagaaggaaactttgagctctgtgatcattcggatgcaaacacgaaggaaagccatttcatatctttgtatctggagctccctacatgctgccttgcatatagcagggtcccagtaaatgtgtatggttgaattatcaggctatctttaatggtgagacaatggtctctggagtcaaattgcctagattcaaacctttggctcttatcttttaacaattatgtgacaattttttgcccttatatgtaaaatagaataataacaattccagcctgacaggaatgttgtgaaatttaaatgtaaaacacttagaacagtgcctggcacatagcaagtgctatatatatcttagtttctattggccgggtgcagtggctcatgcctgtaatctcagcactttgggaggctgaggcaggcagatcacttgaggtcaggagttcaagaccccctggccaacatggtgaaaccccatctctgctaaaaatacaaaaattagctgggtgtggtggtgggcacctgtaatcccagctactcgggaggctgaggcaggagaatcgctagaatccagaaggcagaggttgcagtgagcgaagatcatgcctctgcactccaacctggaagacagaaaaaaaaaaaaaaaccaacttagttgttgttgttattattatttcatgtaattgtagccccatttttaatctctttgccactcctttttctcagttttgtcttttcttcctgaagtagagtatgccaaaattcttaatgtcaatgtaagttctggtgtatatgtggtgtcctattagctatagaggcagtaaccccaaagaggaagcagagaaaagaacatatcctggctgggcatagtggctcatacctgtaatcccagcactttaggaggctgaggcgggcggatcacttgaggccaggagtttgagaccagcctggccaacatggtgaaaccccgtctgtactaaaaatacaaaattagctgggcatggtggcacacacctgtaattccagctacttgggaggctgaggcaggagaatcccttgagcccaggaggcagagctgcagtgaactgagatcgcgccactacactccagcctgaacaacagagtgagactctgtctcaaaaaaaaaaaaaaagaaaaaaatatatatccttgtaatttaaaaatggactgttatatatactgacagttttgtttaagatagctaggaccatactagaaattatggtagagcaatgggaaactatctttaaatatacctctgaggccgggcacagtggctcacgtctgtaatcttagctgagattacagctggataggctgaggcgggagggtcgcttgaacccaggagtttgagaccagcctgagcaacatgatgaaaccctgtgtctacaagaaatagaaaaattagccagtcatggtggcacacgcctgtagtctcagctactcaggaggctaaagtgagagaactgcttgagcccaggaggcggaggcttcagtgagcagagatcacaccactgcactccagcctggtgtcagagcgagaccctgtctcaaaaaaaaaaaaaaatgtatatgtgtgtgtatatatatatatatatatatatacctctgaaatagtcaagggttatagagcatgtgcctagggttagcattttgtttcagcttctcagctcccaaagccatacagtgaacccttactgggttttgtttgtttttaatgcttgatttggaactaatcgccaagactttacaggaactttatgatttaatgaattaccttcttgacctggatacttacctatatgctgatttagataactgtaatgttaggcagttacatatttatatcagtagtttttaaacttttaaaatctttttgttatttattattttttatttttagagacaggatcttattctgtcatccaggctagagtacagtggcatggtcatagcttactgcagcctcaaactcctagacccaagcaatccttctgccttaccttctagaggggctgcgattacaggcttgtgccaccacatgcaaaacttatttatttatttatttaattaatttttttttttttttgagtcggagtctcgttctgtcgcccaggctggagtgcagtggcgcaatcttggctcactgcaagctctgcctcctgggttcgcgccattctcttgcctcagcctcctgagtagctgggactacaggcacccgccacaagtagctgggactacaggcacccgccaccatgcctggctaattttttcttttttttttttaatacagacggggtttcaccatgttagccaggatggtctcgatctcctgacctcgtgatccgcctgcctcggcctcccaaagtgctggaattacaggcgtgagccaccgcgcctggcctatttttttattttttgagatggagtttcgctcttgtagccaaggctggagtgcaatggtgcgatctcagctcactgcaactgccgcctcccaggttcaagcaattctcctgcctcagcctcctgagtagctgggattacaggtgcccgccaccacatccagctaattttttttttttttgagacagagtctcgctgtgtcgcccaggctggagtgcagtggcacgatctcggctcacggcaagctccgcctcccgggttcatgccagcctctgagtagctgggactacaggtgcccgccaccacgcccagctaattttttgtattttagtagagacggggtttcaactgtattgcccaggctggtctcgaactcctgagctcaggtaatccgtccgcctcggcctcccaaagtgctaggattacaggtgtaaggcactgtgcccagcctttcttcttgatatttaggagttctttaacagtatgcaatgcaaatatcttctctgtattatacctataaacaaagaggaaaatcgtatttctttcttggaaactcttttttagctttaaaaatccaatcagtcccagtaaaaatgtaaaaattacccctactgacttactttgggggaaaccctctataggtataaagatatttaagtacctgagcaattgaaagttattttcctaattaataacttggaaagaaaaaaattactcccttggttcttatttttctttatttttatttttattttctatcaacagcatccaggaaaagcttttaggttttgtgtgtgtgtgtgtgtgtgtgtgacagagtctcgctctgttgtccaggctgaagtatagtagcgtgatcttggctcactgcaacctgcgcctcctgggttcaagcaattcttctgtctcagcctcccaagtagctgagattacaggcgcctgccaccatgcctggctaattttttgtatttttagtagagatggggtttcaccatgttggccaggctggtcttgaactcctgacctcaggtgatccacccgcctcggcctcccaaagttctgggattacaggtgtgagccgcagcacctggccaggcttttagtttttaaatattaggtagaggtaatctatttgtaagataacagattttctagaacagaggcttcgaatggtggttgcatattggaatctctggggagcttgaaaaaaaaaaagatactgatgcctaaattccattccagagattttgttatatttgttctggggtttgacttgggcattgaaggtttaaatggtcactaggtgattacattatgtagctaaggcagaaaaacctttactctagacagattctctagatctatactgtattaatgcagtagccattggtcacatgtggctatttacatttaaattcattacatttaggtgaaattaaattcagtttcttagtcaaactagctacacttaaagtgcttacttagtagttacctgtggctaaaggcaactgtgttggacagcaccaatgcagaacattttcattattgtagaaagttctgttggacagtactgctctagattgaaaccagtaatagtggttttatggggaagaagattaggacagggatgaaaaggtgacttgcttttcattatataatcttctgaacttttaaatttttgtataatactaataaactacctattcaaaaaaatcattatttaaaaaaattaaagagaggctaggtgtagtggcttacgcctgtaatcccaacactttgggaagcctaggcaagaggattgcttgaggccaggagttcgaggcttgggcaacataacaagacctcatatcttaggaaaaaaaaaaatggctaggcatagtggcacacacctgtagtcctagctacttgggaagctgaggtgggaggatcacatgagcccaggagttcgagattgcagtgaactgtgattgcaccactgtactccagtctgggtgacagagagagaccctgtctaaacaaaaaagagagagagagagagagagaggaggcagagtgagataactgaatagaagcctccactgattgtcctccctgcagtagcaccaaatttgacaactgtctacacagaaaagtaccttcatgagagccaaaaatcaggtgagcaatcacagtacctggttttaacttaatattgttaaaaggggcatggaaggagtaggaaagacagtcttgaattgaagacaccaccccccaacccctgcagtggccttgtggcatggagagagaatctatacacttccaggagtgagagtgcagtaattgtgagactttgcactggaacttagtgctgccaacactgagcagaactcagccaatgcccacagaggaagcctgtggactaaccctagtcagaggggaaattttctctcccagcaggcagaacttgagtttggctagccttgccaccgcgagctagagtgctttggggtcttaaatgaactagaaaagcagtctaggctagaaggactgcaacccccaggcaagtactagagtagtgctgggatcagagccagtggtcttgcgggggcacacaacctagtgagacagcagccagggtgactaaggaagtgcttgtgtcaccccttccacacagtgccagccagtgcatcttgccagtacaaaagagaccccttccttctgtttgcggacaggaaagggaagagtaaagaggacttcattttgcaacttgaataccagctcagccacaggcatctagggtaccaagtagagttgtgagacccctattccaggccctagatgcctatagtgtctagacacagtcagcgccagaagggaacctcctgccttgaagggaaggacctagacctggcaagattcatcacctgctaactaaagagcccttgggccctgaataatcagcactggtaaccagataggagatgccatggccttgagtgagactctgagacatgctggcttcaggtatgacccagcagtagcgactgcaagtaaagactctgcttaacaaaaggagagggaagaataaaggagattaggtcttgcagtgtagatttgaacttggtcatagttgggaagagtaccaaatgggctcttagggtccctaattccaggccttagctcctggatggtagttctggacctacactatgctagaagggagcctgttgctctgaagggtgagtcccaggcctgagtgttcacaagatgactgaagagcccttgggccttaagtgaacactgtcgataccctggcctccccatgggaggccacagtactccccatgggcctgtggtagtggtggacacagggagagactgagactctgttttggtgccaaacttactgcagtagaaagaataccaggtagatttctgacatttccaattctaggccctggttcccagacatcatctctgaacctgctgggggaatttgccaccctgaaaggaaggacacaagcccagctggcttcatcatctgctgattgtggagctctagggccttgagcaaacatatgtggtagccaggtagtggttacagcaggccttggtaagacccagtgctgtattggcttcaggtctaacccagcacagttctaatggtggtgccacagtggtacatgcctatagtcccagctactccagaagctgaggtgggaagatcacttgagcctgggagattgaggctgcagtgagctgagatcatgccattgcactccagcttgggcaccagagcaagaccttgtctcaaaaaaagaaaaaaaaaaattaagacccaacaatctgttgcctacaagaaacacactcacctgtaaagacacacataggccgggtgcagtggctcacacctgtaatcccagcactttgggaggcaaaggcaggcggatcacctgaggtcgggagtttgagaccagcctgaccaacatggagaaaccccgtctctactaaaaatacaaaattagtgggacgtggtggtgcatgcctgtaatcccagctactcgggaggctgaggcaggagaatcgcttgaacccgggatgcagaggttgcggtgagctgagatcgcgccattgcactacagcctgggcaacaagagtgaaactccgtctcaaaaaaaaaaaaaaaaaccacacaaagactgaaaataaagggatgagaaaagatgttccatgcaagtagaaaccaaaaaaaagagcagaagtagctatgcttaaacaaaatggatttcaggacaaaaactaagagacaaagaaggtcattatatataaaagggtcaattcagcaatgggatataacagttatacatatatatgcacccagcattggaacaccctgatacataaagcaaatattagagctaaagagaaagataaatttcaatacaataatagctgaagacttcaacaccccactttcagcattggacagatcatccagacagaaaatcaacaaagaaacatcagacttcatctacactatagaccaaatggacctaatagatatttacagaacatttcatccagtggctgcagaatacacattcttctcctcagtacatgcatcattctcaagggtagaggccatatgttagaccaccaaacaagtcttaaaacattcaaaaaattgacgttatatcaagtatcttctctgaaccacaatggaataaaattataaatcaataacaagaggcattttgggaactatacaaacacatggaaattaaacaatatgctcctgagtcactagtgggtcgatgaagagattaagaaggaaattgaaaaatatcttgaaacaaacataatggaaacacaatataccaaatcctgtgggatacagcgaaagcagaactaagagggaagtttatagctataagctcctacatcaaaaaagaagaaaaacttcaaataaacaacctaacaatgcatcctaaagaactagaaaagcaagagtaaaccaaacctaatgttagtagaaggaaaaataaagatcagagcagacataaatgaaattgaaatgaagaaaacaatacaaaagatcaaggaaagaaaaagttggtgttttgaaaacataaaactgacaaacttttagccagactaagaaaaaaagaagacccaaataaagtcagaaatgaaaaaggagatattgcaatagatactgcagaaattcaaaggatcactagagggtactatgagcaactatatgccagtaatttggaaaacctagaagaaagggttaaattcctagacacatacagtctactaagatagaaccatgaggtaatataaaacttgaacagactgacaacaagtaacaagttgaagctgtaataaaaagtcttccagcaaagaaaagcccgggacccaatggcttcactgttgaactctaccaaacacttaaagaaaaactaaaaccaatcctattgagactattctgaaaaatagaggaggagggaatacttccaaactcattctaggagacgagtaatagcctgataccaacaccagttaaagacacatcaaggaaaaagaaaaccacagaccaatatctctgatggacattggtgcaaaaatccttaacaaaacactatcaaaccgaattaaggaacatattaaaaagatcatgtatcattgaacaagtgggttttatcccagggatgaaaggatgcttcagtatacatgactcaattaatgtggtatgtcgtatcaacagaatgaaggacagaaaccatatggtcatttcaattgatgctgagaaagcatctgataaaatttaacatctcttcatgataaaaatcctcaaaaaactggatgtagaaagaagaacatacctcaacataataaaagccatatgtggcagacccacagctagtatcatactgaagagggaaaactgaaagccttttctctaagatctagaacacgaagtggatgcccactttcaccactgtcatttgatctagtactgttatttgacctagacttccagtactagtactggaagacctagctagagcaataagaaaagagaaagaaataaaggacatccaaatcagaaaggaaggtgaaaggattcccactttaagcactgctatttaacctagtactggaagtcctagctagagcaatcagacgaaagaaagaaaggtggccaggtgtggtggctcacgcctgtaatcccagcactttgggaggccgagttgggtggatcacgaggtcaggagatagagaccatcctggctaacatggtgaagccccgtctctactaaaaataacaaaaaattagccgggcgtggtggcgggtgcctatagtcccagctactcaggaggatgaggcaggagaatggcgtgaacccgggaggcacagcttgcagtgagctgagattgcgccgctacactccagcctgggcaacaaagcaagactctgtctcaaaaaaaaaaaaaaaaaaaaaacacagacaaacaaagaacatcaaaatcggaaaggaagaagtcaaattatccttgtttgcaggtgatgttatatttggaaaaacctaaagactccaccaaaaaactattagaactgataaattcagtaaagttgcagcatactaaatcaacatacagaaatcagtagcatttctatatgccaacagcgaataatctgaaaaagaaatcaggaacataatcccatttacaatagctacaaataaaatacctaggaattaactttaccaaagaaatgaaagatctttacaatgaaaactgtaaaacattggtgaaagaaattgaagaggacacacacacaaaaaggaaagatattccatgttcatagattggaagaatcaatattgttaaaatgttcatactacccaaagcagtcacagattcaatgcaatccctatcaaaatatgacattcttcccagaaatggaaaaaacaatcctaaaatttatatgaaatcataaaaggcctagaatagccaaagctatcctgagaaaaaagaacaaaataggaggaatcacataacctgacttcaaattatactacagagccgtagtaaccaaaacagcatggtactggcataaaaacagacacatagaccaatgaaacagaatagagaacctagaaacagttcatacatctacagtgaactcatttttgacaaaggtgccaagaatatgcactggggaaaggacagtctcttcattagatggtgctggggaagctgaatatccatacacagaagatcgaaactagctccctgtctctcaccacatacaaaagccatatcaaaatgaatttacgactcaaatctaagacctgaactatgaaactactaaaaacaacattggggaaactccctgggacatcagactgggcaaagatttcttgagtaaaaccccacaaacacaggcaaccaaagaaaagatggacggatgggatgacatcaagttaaaaaagctctgcacaacagaggaaacaatcagaaaagtgaagagtagccaggtgcagtggctgacacctttaatcctagtactttgggaggccggcagatcacctgaggtcagaagttcgagaccagcctggccaacatggtgaaaccccgtctctactaaaaatacaaaaattacctgggcatagtggcaggcacctgtaatcccaactactcaggaggctgaggcaggagaatcgcttggacctgggaggcagaggttgcagtgagcccagatcgcgccattttagtccagcctgggcaataagagcaaaactccatctcaaaaaaaaaaaaagaaaagaaaagaaaagtgaagaggcaacccacagaatgggagaagatatttgcaaactatctatctgacaagagataaataatcagactatataaggagctcaaacaaccatataagaaaaaaaatcttataattcagttagaaaatagacaaaaggtctgaatagacatatgtcaaaagaagacgtacaaatggcaaagcagatatatgaaaaagtgctcaatatcattggtcatcaaagaaccataaatcaaaactataatgagatatgactttagcctgtttaaaatggattgtatccaaaagacaggcaataacaaatgctaacaaggatatggagaaaagcgaaccctcatacaccattggtgggaatgtgaattagttcagccactatgaagaacagtttggagttcctcaagaaactaaaaatagagctaccatatgatctagccattccactgctaggtatgtacttaagagaaaggatatgacctggcattcatatgcagaaaaatatatatatagaaaggaaatcagtatattaaagagatatttgcactctcttgtttattgcactattcgcagtagccaggatttggaagcaacctaagtgctcatcagcagatgatggataaggaaaatgtggtatatatacacattggagtactatttagccttaaaaaagaatgagatcctgtcatttgtaacaacatggatggaactatggtcattatgttaggtgaaataagccagacacagaaagacaaacttcacgtatcctcacttatttgtggtgggaactaaaaattaaaatagttgaactcatgggaatagagagtagaataatggttaccagaggctgtgaagcttattggggaagggtaagggggaagtggggatggttaattggtacaaaaaatagaaagaatgaacaaggtctggtatttgatagaacagcagagtgactaaataatagtttaattctatgtttttaaacacctgaaagagtataattgggttttaacacaaaagataatgcttgaggtgatggatgccccatttaccctggtgtgattattacacgttgtatgcctgtatcagaatatctcctgtacctcataaatatatacacctaccatgtacccacaaaaattagaagaagaaaatgtaagtaatgcatttcctcaaaaaattataggtaattagtattaatccactgtatgtaattgacatctattaaccacttcatccaacaacagcagggactcattcttctcaagctgtcacagaacactcaccaagatagaccataaaacgggaattgaacaatgagaacacatggacacaggaaggggaacatcacacaccagggcctgttgtgtagtggggggaggggggagggatagcattaggagatatacctaatgctaaatgacaagttaatgggtgcagcacaccaacatggcacatgtatacatatgtaacaaacctgcacgttgtgcacatataccctaaaacttaaagtataataataataaaataaaaataaataaataaaataaaataaaatgagacagcaaccacacacaaaaaaatacttataaaacagattttaaaaaatattaatcacataatgtctactctcagacctcagtggaattaaactgaaaatcaatagagaaagataggctctctgttccttctgtgtgataaaggacacagcagcagccatgcagcagcagccatgcagcagcagccatgtccctgagacagttggtgaaattgaaggttgtagtaaacacatttggctgtactgggcatctggtcaactgggctgcttttaactctggcaaagtggatattgtcatcatcagtgaccccttcactgactccagctacatggtctacatgttccagtatgattccaccagtggcaagctccacagcactgtcaaggctgagaatcacaagtttgtcatcagtggaaatcctatctccatcttccaggagcaagataccaccaaaatcaaatgcagtgatgctggcactggttgtgttgtggagtcaactggtgtcttcactatcttgtatatggctggggcacacttagaggagagagccaaagagtcatcatctctgctgcctttgaccccctgtttgatgggcatgaaccatgagaagtacgaaagcaacctcacaatcatcagcattgcctcctgcaccaccaactgcttagcattctctgaccaagatcatccatgatagctctggcatcatggagggactcctgaccacagtccctgctatcactgccacccaggagacctatggatggcttttctgggaaactgtgacgtcatggttgtggagctctgcagaacattattcctgcatctactggaacttccatggctgtgggcaaggacatccctgagctgaatggggagatcactggcatggccttcctcgtccctaccaccaatgtgtcagttgtggacctgacctgctgtctggagtaacctgccaaatatgatggcttcaagaagatggtgaagcaggcatcggaaggcccttcgagggcacactgggctacactgaacaccaagttgtcccctgtgactttaacggtgacactccctcttccacttttaattctggggctagcattgccctcagcaaccattttgtgaagttaatttcctggtatgacaattagttttgctacagcaacggggtggtggacctcatggtccacatggcctccaaggaataacagccctccggactaccagccctagtgagagcacgagagaaaaagagaggctctcagctgctgaggagtccctgcctcactccgtcccccaccacaccaagaagctcccctccaccacagttttcatgccatatcccctgaagaatgggaggggtctagagagcccccaccttgtcatgtaccgtcaataaagtcttctgtactcagccaaaaataaaataaaataatagaaagataactggaaaatcccaaaatatgtggagattaaacaactatttctgaataatgcatggatcaaagaagaaatctcaggagaaatttaaaaatattttgaactaaatgaaaatgaaaacactacttatcaaaatttataggatgcagtgaaagtcatgcttagagggaaatgtatagcagtgaatgcatatgttagaaaagtagaaaggtctaaaatcagtcatttaagtttccaccttaggaaattgaaaaaaaaaaggcaaattaaatccaaagtaagcaaaataaaagacataataaaaaattagaacagaagtcaataaaattaaaaacaggaaatcattagagaaaatcaatgaaaccaatagctggttctttgacagtattaataaaaatgcataagcctctagcaaggctaagagaaaaagagagaggacacagattacttctgtcagaaatgaaagagggttatcactacagatcccatggacattaaaaggaaaataaaggaatactatgaacaactctgtgcctaccaatttgataacctagatgaactagaccacttccttgatagacacagtctgccagctctacaaaaagataatctgaacaggtttatatgtattaaataaattgaatcaataataaccttccaaagcaggaagcaccaggtacagatgggtttgccggtgaattctaccaaatatttaagaagaaactataccccttatctacagtctctttcagaagatagaagcagagggaatacttcctaattcattctatgatgccattgttatgccagtaccaaaaccagagaaagacactactacagaccaatgtctctcatgatcttagatgagacaaaactacagaccaatatctctcttgatcttatatgcaaaaattctcaatgaaatattagcaagttgaattcaacaatgtatacaagaattataggccaggcacagtggctcatgcctgtaatcctagcactttgggaggccaaggtgggcaaattgcttgagctcaggagttcaagaccagtctgagcaacatggcaaaaacccatctctataaaaaaatacaaaaactagccaggtgtggtggcacacccctgtggtcccagctactcaggaggttgagatgggaggattgcttgagcccaggagatggaggctgcagtaagccaagatcacatcattgcctaggtgacagcaagaccctgtccccaccaccacccgccccccaaaaaaaagaaaaagaaaaaagtgtatcacaagcaagtgggatttatcccaggtatgcaaatctggtttaatattaaaaaatcaagtaacataattcatcgtattagcaggctaaaaaaaaaatcacatgattatatcagtgaatacagaaaaagcatttggcaaaatccaaaactcattcatgataaaaacacagttaactaggaatacagggaaactttctcaacttgatacagaatatctacaaaaaaatctacaagtaacaacatacctagtgatgagaaactagaagttttcctaacatcatgaacaaggcaaggatgtgccttctcaccactcctttttaatattatactggaagtcttagctagtgtaataaggcaaaaagggaaacaaaaggtaaacacattgggaaggaagaaataaaactctctttgttcacagatgtcattatcttatatgtagaagacccaagagaactgacaaaaacgctcctggaactagtaagtgattatagaaaggttgcaggatataaggttaatatacaaaagttaatcacttttccatataccagcagtcaacaaatagaatttggaattaaaaatacaataccatttatagtagtactctcaaaattcaattatttaggtataaatttaataaaatgtgtgaaaggtctatataaggaaaactacagaactctaaggaatgaaatcaaagaagaattaaataaatggagagctattgagtttcatggataggaagactcagtattgtcaaaatgtcagttcctcggagtatgatttatagattgatatgatccaagtcaaaatcccaggaagttattttgtggatattgacaaactgattccaaagtttatatagagaggcatgccaggcaccatggctcaagcctgtaatcccagcactttgggaggccaaggcaggcagatcacctgaggccaggagtttgagaccagcctggccaacatggcaaaaccctgtctctactgaaaatacaaaaattagttgggtgtggtggcgcacatccgtaatcccagctactcagaaggctaaggcatgagagtcacttgaacccaggaggcggaggttgcagtgagccaagagcacttcatgcactccagcctgggtgacagagcgagactctgtctcaaagaaacaaaacaaaataaagtttatatagagaagcaaaacattcagaatagccaacacaatattgaagtcaaaagttggacgactgatgctactcgacctcgagacttaatattagagctacagtaatcaagacagtatggtattggtcaacaaacagagaaatagaccaatgaaacagaacagagagtccagagatagacacacataaatatagtcaactggtctttgacaaagaagcaaaggcaatacaatggggtagacagtattttcaaaaaatggtgctgacaactagatttttaaaaaatgaatctagacatagacgttataccctccacaaaaattaactcaaaatagatcatagacctaaatagaaaatgcaaaagtataaaactagaagacaacaagagaaaacctggattaccttgggtatggcaatgactttttggatacaacaccaaagtagcgatccatgaaagaaataattgatgagctggacttcattaagatttagaaacttctggccgggcacggtggctcacgcctgtaatgccagcactttgggaggctgaggcaggcagatcacgaggtcaggagatcgagaccatcctggctaacatggtgaaaccccatcgccactaaaaatacaaaaaaattagctgggcgtggtgccgggcgcctcagctactagggaggctgaggcaggagaatggcgtgaaccagggaggcggaggttgcagtgagctgagatcgcgccaatgcactccagcctgggtgacagagcgagactctgtctcaaaaaataataataataataaagaaaaagatttagaaacttctgtgagtgaaaatgtcaagagaagacaagactgggagaaaaattttgtaaaagacatatctgataaaagatctatgcaaaatatacaaagaactcttaaaacttaacaattagaggccaggcgcagtggctcatgcctgtaatcccagcactttgggaggctgaggtgggcggatcacgagttcaggagatcgagaccatcctggccaacacagtgaaaccccgtctctactaaaaatacaaaaaaattagccaggcatggtggcaggcacctgtagtctcagctacttgggaggctgaggcaggagaatgggttgaacccgggaggcagagcttgcagtgagctgagattgcaccactgcactccagcctgggcaacagagcgagactccgtctcaaaaacaaacaaacaaacaaacaaacaagcaaaacactctgcaggatattatccaggagaacttccccaatctggcaaggcaggccaacattcagattcaggaaatacagagaatgccacaaagatactcctcgagaagagcaactccaagacacataattgtcagattcaccaaagttgaaatgaaggaaaaaatattaagggcagccagagagaaaggtcgggttacccacaaagggaagcccatcagactaacagcggatctctcgggagaaactcgataagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccactaccagccgctgcaaaatcatgccaaaatgtaaagaccatcaagactaggaagaaactgcatcaactaacgagcaaaataaccagctaacatcataatgacaggttcaaattcacacataacaatattaactttaaatgtaaatggactaaatgctccaattaaaagacacagactggcaaattggataaagagtcaagacccatcagtgtgttgtattcaggaaacccatctcacatgcagagacacacataggctcaaaatagaagcatggagaaagatctaccaagcaaatggaaaacaaaaaaaggcaggggttgcaatcctagtctctgataaaacagactttaaaccaacaaagatcaaaagagacaaagaaggccattacataatggtaaagggatcgattcaacaagaagagctaactatcctaaatatatatgcacccagtacaggagcacccagattcataaagcaagtcctgagtgacctacaaagagacttagactcccacacattaataatgggtgactttaatgggtgactgtcaacattagacagatcaacgagacagaaagtcaacaaggatacccaggaattgaactcagctctgcaccaagtggacctaatagacatctacagaactctccaccccaaatcaacagaatatacatttttttcagcaccacaccgtacctattccaaaattgaccacatagttggaagtaaagctctcctcagcaaatgtaaaagaacagaaattataacaaactatctctcagaccacagtgcaatcaagctagaactcaggattaagaaactcactcaaaaccgctcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaaaagagacacaaaaaacccttcaaaaaattaatgaatcgagctggttttttgaaaagatcaacaagctagaccgctagcaagactaataaagaaaaaagagagaagaatcaaatagatgcaataaaaaatgataaaggggatatcaccaccgatcccacagaaatacaaactatcatcagagaatactacaaacacctctatgcaaataaactagaaaatctagaagaaatggataaattcctcgacacatacactctcccaagactaaaccaggaagaagttgaatctctgaatagaccaataacaggagctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccaggcagagacacaaccaaaaaagagaattttagaccaatatccttgctgaacatcgatgcaaaaatcctcaaaatactggcaaaccgaatccagcagcacatcaaaaagcttatccgccatgatcaagtgggcttcatccctgggatgcaaggctggttcaatatacgcaaatcaataaatgtaatccagcatataaacagagccaaagacaaaaaccacgtgattatctcgatagatgcagaaaaggcctttgacaaaattcaacaacccttcatgctaaaagctctcaataaattaggtattgatggaacatatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacaacatgattgtatatctagaaaaccccattgtctcagcccaaaatctccttaagctgataagcaacttcagcagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaagaaatggaagaacattccatgctcatgggtaggaagaatcgatatcatgaaaatggccatactgcccaaggtaatttatagattcaatgccatccccatcaaactaccaatgactttcttcacagaattggaaaaaactactttaaagttcatatggaaccaaaaaagagcccgcatcgccaagtcaatcctaagccaaaagaacaaagctagaggcatcatgctacctgacttcaaactatactgcaaggctacagtaaccaaaacagcatggtactgataccaaaacagagatagagatcaatggaacagaacagagccctcagaaataacgccgcatatctacagctatctgatctttgacaaacctgagaaaaacaagcaatggggaaaggattccctatttaataaatgatgctgggaaaactggctagccatatgtagaaagctgaagctggatcccttccttacaccttatacaaaaatcaattcaagatggattaaagacttaaacgttagacctaaaaccataaaaaccctagaagaaaacctaggcattaccattcaggacataggcacgggcaaggacttcatgtctaaaacaccaaaagcaatggcaacaaaagccaaaattgacaaatgggatctagttaaactaaagagcttctgcacagcaaaagaaactaccatcagagtgaacaggcaacccacaaaatgggaaaaaatttttgcaacctgctcatctgacaaagggctaatatccagaatctacaatgaactcaaacaaatttacaagaaaaaaacaaacaaccccatcaaaaagtgggcgaaggacatgaacagacacttctcaaaagaagccatttatgcagccaaaaaacacatggaaaaatgctcaccatcactggccatcagagaaatgcaaatcaaaaccacaatgagatatcatctcacaccagttagaatggcagtcattaagaagtcaggaaacaacaggtgctggagaggatgtggagaaataggaacacttttacactgttggtgggactgtaaactagttcaaccattgtggaagcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaataatcattctcagtaaactatcgcaagaacaaaaaaccaaacaccgcatattctcactcataggtgggaattgaacaatgagaacacatggacacaggaaggggaacatcacactctggggactgttgtggggtggggggagcggggagggatagcattgggagatatacctaatgctagttgacgagttagtgggtgccgcgcaccagcatgtcacatgtatatgtatgtaactaacctgcacattgtgcacatgtaccctaaaacttaaaagtataataaaaataaataaataaataaaaacacacacttaacacttagaaaacaagctcggtatggtggctcacatctgtaatctcagcactttgggaggctgaggcaggtggattgcttgagcctaggagtttgagaccagcctgggcaatatgacaaaaccccatctctacccaaaatacaaaaaaattggacaggtgtggccgggcgcggtggctcacgcctgtaatcccagcactttgggaggctgaggcaggagaatggcatgaacccgggaggcggagcttgcagtgagccgagatcgcgccactgcactctagcctgggtgacagcgcaagactccatctcaaaaaaaaaactggacaagtgcggtggaccatgcctgtgttcccagctactcggaatgctgaggtggtaggattgcttgagcccagaaagcagagattgcagtgagccatgattacaccactgcactccagcctggggaaaagagtgagatcctgtctcaaaaaaaaaagaagagaaaagaaaacaacttgattaaaaaatggactgaaaacctaaacagacacctcaccaaagaaggcataaaaatggcaaacatatgaaaagatgcttcatatcatgtgttatcagggaaatctactacagtagattttggaccattctaataggccaagttccagcacactgaaaacaccaaatgctggcaaggacgtggaacaaaagcaatttttatgtgttgctggtgagaatgcaaaattgtcaactacttgggaaggtagttgggcagtttcttacaaaattaaacttactttgaccgtatgatcctgaaatcttactccttggtatctatcaaaaagagttaaaaacttgtatccacacagtagcctgcacataaatgtttatagaagctttattcgtaattgccaaaacttgaaaacaaccaagatattcttcagtaggtgagtggataaactgtggtacctttggacaatggaatattatttaccactgaaaggaaatgagatattaagacatgaaaagacttggagaaagctgggtgtggtaattcacacctgcagtcccagcacattgggaggccaaagttgacagatcgcttgagcccaggagttcaagatcagccttggcaacacagtgaaaccccatctctacagagaatacaaaaattagctgggtgtggtggtgtgtgactgtaatctcagctacccaggacgctgaggtgagataatcacctgagcctgggaagttgaggctgcagtgagctgtgactgcactccagcctggacaatggagtaagaacctgtgtcaaaaacaaaaaagacttgaaaaaaattaaatgcatattactaaatgaaaaaagccaatctgaaaaggctacatactgtataattacaactatagatattccggaataggaaaaactgtggagacactaaaatgcaattaaaaaattagtagttgcaaggggatggggtagagagagagaggatgaataggcagagcacagaggatttttagggcagtgaaatgctctgatactataatggggagacatgtcattatacatttgtccaaacccatagaatgtacaacaccaagaatgaaccctaatgtaaactagggaccttgggtgattacagtgtgccagtgtaagttcatcagttttaacaaatgtaccactttggtaggggatgttaataatcggggaggctatccatggccatgtatgggagcaggagatatttgggatatttttctatcttcctgtcagttttgttgtgaacttaaaactgctctaagtcttggccgagcgcggtggctcacgcctgtaatcccagcactttgggaggccgaggtgggtggatcacgaggtcaggagatcgcgaccaccctggctaacacagtgaaaccccatctctagtaaaaatacaaaaaattagctgggcgtggtggcgggcgcctgtagtcccagctacttgggagactgaggcaggagaatggcgtgaacccaggaggcggagcttgcagtgagcagagatcacgccgctgcactccagcctgggcaacagagcgagactccgtctcaaaaaaaaaaaaaaaaaacaaaacaaacaaaccacaaaactgctctaagtcttaaaaaacaattaaagagaggccaggctcatacctgtaatcccagcagtttgggaggctaaggcaggaggatcgcttgagtccaggagtttgagaccagtctggacaacataatatgagacagaaaaataccacaattagccatgcatggtggcatacgcctgtagtcccagctacttgggaggctgaagtgggaggatcacttgagcacaggggattgaggctgcagtgaaccatgatgacgccattgcactccaacttggtcaacagaacgcgaccctgtctcaaaaataaaaattaaaattaaagagaagtaattacagtgatgtgtgagaggaggaaaaaagataggaagattatgtcttaaggccaggtgcagtggctcacgcctgtaatccgaacagtttgggatgccgaggtgggagtattgcttgaggccaggaattcaaggttacagttcactataatcatgctacccgtactccattctgggcaacagaacaagaccctgtcaaagaaaaaaacaaaaacgttatgttttaaggaagcattgtggttaataatttatatttttggtagagattatttttctaaaagcactctcagaggaaaaaattaagctataaaaatttaaaaatcctaacaaattgccagtcttgatattaaaattataattaaaaatttttcttagatatcttataaaacagacattggcaaactaccaggtggccatttgttttaataaataaaattttactgaaacatagacatactcatttgtttatatattgcctatggttgcttttctgctagaacagcagaattgagtaaggcccacagcctgaaacacttactgtctggccctttttttttttttttttctgtctggccctttaagaaaaagtttttagatccctgttttaaaggacacaaatttgaatccttcctatagattaaaatttctactttgattatcatttcccttcagcctgaagaacttcctttagcatttcttgaagtgcaggtcttctagcagtgaatttttcaacttttatctgaaagtatctttattttattctcatttttgaaggttatttttgccagatatagaaatctgggctgatacgttgagggcattcatttagcatgttaaaagatgcagttccggcggggcgcagtggctcatgcctgtaatcccagcactttgggaggctgaggtgggtggatcatgaggtcaagagatccaagaccatcctggccaacatggtgaaaccccatctctactaaaaatacaaaaattagttgggcctggtggcgtgggcctgcagtcccagctactcgtgaggcttgggcaggagaattgcttgaacccaggaggtggaggttgcagtgagccgagaccacgccactgcatgccagcctggcgacggagactctgtctcaaaaaaaaaaaaaaaagatgcagttccaactgtcttctggccttcattgtttctaagtcagccatctttcttttgttgttctcttttattgtgtgttttttctctagatgcttttaagattttccctttatctttaattgttatcaatttgaccaagatatgccttagtatggggttttattttgtatttatcctgcttagggttctctgaggttcttagatttgtgggttgatgtttttcaccaaatttggggaaatttcagcatttattcagatcaaatatgcaaattttacaatgctatctttttttaatccttctaggactcaagtttcatacatttttaaaatttatttatttatttatttaagatggagtctcgctttgtcacccaggctggagtgcagtggcatgatatcggctcattgcaaccttcacctcccgggttcagtcgatcctcccacctaaaactcccaagtagctgggattacaggcatgcaccaccacgcccagctattttttttttttttttttttgtacttttattagagacggggtttcaccatgttggtcaggctggtcttgaactcctaacctcaagtgagccaccatgctcggccgagttacatacatttcagactgcttgatattatcccaaacatcactgaagttttgtttagatttttgtaataccttttctccttcagtttgtttaatgtctttgatttaccttcaagttcattgacccctttttttctgtaatgtttagtctgctgttaagcccagtcagcatatatttcactttagatgtcgtactttcaattccagaatttccatttggttcttttttactccccattctttaccagatgttcccacattttcctttaaatccttgaacatatatatacgcacacacatatatatacacatatacacacatatatatacatatacatatacatatatatataaacagttgtttataagttcttgtctgctaattttcacaagtggatcacctctccgtttgtttctgttgattcctttttttcttgattgtgggtcattctctgcttttttgtatgtctagtaattttattgtatactttatgagtattacattgaggagtttggattttgttgccttcttttaaagtgtgtcttcttttaaagggtgttgaattttgttctggcagacaaattactggaggagcctgcgttagggttccctagaggtacagaactaataggagatatatacatataataggatatattatatatatatatatatatatatatatatatatatatatatatatatatacccggctaccacacccggccacctctgttatttctgttcagctctcagccctatatcattttagatatgtgtgtgtatatatatatatatgtgtgtgtgtgtgtgtgtgtgtgtgtgtttgtatgtgtgtatatatatgtatatatgtacatatacattcttagatttgtggattgatgtttttcaccaaatgattcttcctcaaaaatgcctcccctgaccaaactatctaaaatagagcctcccaccactctctatcacatctccctgttttaatttatacacagcactctgacatttatattatgttctataacttttgtttatttattgttatctccccaacaagaatgtaagcttcgtaggacaataacttggtctgttttgttcactgctgaatctccagctgtttaaaacagttcttggcagggcacagtggctcacgcctgtaatcccagcactttggaaggccaaggcgggcggatcgagagatcaggagtttgagaccagcctgtatgtatatatatacatatacagcctgtatatgtatatatatacacacatatatatatgcatacacacacacacacacacacacacacacacatatatatataaaggggagtttattaagtattaataaagcctggatgacaaagcaagactccatcttaaataaataaataaaatttaaaatgtgtgtaacttgagtcctagaaggataaaaaaagatagaattttaaaatttgaataatatatgatctgaataaaggggagtttattaagtattaactcatacgatcacaaggtcccacattaggttgtctgcgagcttgaggagcaaggagagccagtccaagtctcaaaactaaagaatttggagtctgatgtttgagggcaggaagcatccagcacgagagaaagatgtaggctgttaagctaggccagtctcaccttttctcgtttttctgcctgttttatattcgctggtagttgattagaatttgcccatcagattaagggtgggtctgccttccccagcccactgactcaaatgttaatctcctttggcaacaccctcacagacatatccaggatcaatacttaaagtatctttcagtccagtgaagttgacactcaatactaaccatcacagagcctgttgattctgtcaggcttgtttatgctttggttttttgcttcattagagcaagttagtttttattttgtttttagtctcagagcatggcctttaactctagagtgtggcctaaaaatgataataatcataagtaattagtctagtgtggtgatgtgctcctatagtcccaactactcagaagggtgaggtgggaggatcatttgagctcaggagattgagactgcagtgagctatgatcatgccacagcacttcagcctgggcactagaacaaaccccaactctaagagcgtggtccctactcttaaactatggccttgtagcaactcatctgaataccgaagatggttggtgctccatgacctctgttatttcctttattttttatttttaatagggaagacggggagaattttagccttttttgtgtatgtgtgcagtggtgtgattgtagctcactgaagcatctacttcttgggctcaagctctcctcccacctttgcctctgagtatctgggactacaagtgtgtgccagcatgcccacctaatttttttaatttttagtagacacgaagtctcactatgttttacaggctggtctcaaattcctgagctcaagtgatctcccaccttggcctcccaaagcactgggattgcagggatgagctaccacacccaaccacctctgttatttctgttcagctctcagccctataggaggagctgtctgttagaccccatgaagtctcaccctgtgcatacacaacctggggcttggccaaagacctaagaggaaatccccatatagatttctgctctccgtttcatcccccacaggttcctcctctgtaatatcctttcctgcaaattctagccacctcagcaggccaaactctgatgatctctgtctcctctgctcacaaagactgcctattcatatatatcccttcttttaaggaccatggtcttgtgctgatggttgtacagtgcttacaaacagctgcctcatgtatttttcctgcctttataattgtttagggtagaggaaacccaatactggttagtatgtcattgctagcagtggaagttcatgttgtcctttttaaattaaataaatccatctctaagtttaaaggaaactcattactcacagaccatgtctcaggagccatatgagaacataattttaagtagtacatgtagacatttacctatatttcatggagggctgagatagtcccactaaccagtatttgagcaaatttcaagtgtgttgtatctgttcatatacacaaagcaaagaaagaatgttatatcgttgttttgtatttaatgtttatgtttcagaatgattaatattacttcatctctttctaggagtttttatggtcaattgctgatctgagtttcagtaactttccaaaacattactataagtaaatattcatcaggactctgaagtgcaagtcaactatataatcaggaggctcagaaaattgatcacagccggtcaataaattgattagttttacatgtaaattgtaaaactaatcagattttctcaatctaaatcttagattctctttcattctaaggataaatacattactttgacaactctaaatactccagtatgtattaatcaccaactatttgctaggcttgtctcataatccagaggaaaatattctcacttagtccccacattgatcatgcagggtaaatggcatcatctttattttatagatgagggttgaggcttagaaaaattaggaactaatccaaagtcatgcagttaataaattacagagccatgatttgactctctaaaagagaaaatctggtctaactccaaagctcatgtattttattcttttattctcttggctgtgcagtagaaccacctttggagctttcagtaaatatagaaacccatgccccattcccatgttcagtacgtctgtggtagtgtctgtaatattagaatgcagccagagttgaggaccactgcttatcagtgccatactccttctctatagccataggcactggatcatgaagtcctgttagtcaggaaattggaagtctagacagttttgagattatagccctgctgttagagtaagaaaatgggaggaaaaggcaggatcagttctttttttgcctctcagagtaggggctgcaactgaagcctaaaagagaagtagaggacgattaatcctaaaccacctgtcatctttgtaagcatcttaccagtttctttagaaatgtttactctgaatttttaagtcaagtgagaggtatgtcttatctctactgtcatgagctttttgtttcctcacctttgaaaaagggatatctatctaatttagaggtaagggtgacatgagactagtgcctggttattgcctccttaggagctaccagatacagtcccagcccccagttacctctgccacctagccacctattcttaaagtttttactattgtgtctctaatatggccccttctttcctgtctccctcatttctaacactttttcctcactccttagcttctcctcaaatatgctgcgcatgctcctgtctcaaggcctttgtacttgctcgtctttgtttgaatgttcttcctccaagtttcattcatacctctgctcaaatgattcctcctcaaaaatgcctcccctgaccaaactatctaaaatagagcctcccaccactctctatcacatctccctgttttaatttatacacagaactctgacatttatattatgttctataacttttgtttatttattcttatctccccaacaagaatgtaagcttcataggacaataacttggtctattttgttcactgctgaatctccagctgtttaaaacagttctgggcggccgggcacggtggctcacgcctgtaatcccagcactttgggaggccgaggcgggcgaatcacgaggtcaggagatggagaccatcctggctaacacggtgaaaccccgtctctactaaaaatacaaaaaattagccgggcgcagtggcgggcgcctgtagtcccagctactcgggaggctgaggcaggagaatggcgtgaacccgggaggcggagcttgcagtgagccgagttcgtgccactgcactccagcctgggcgacagagcgagactccgtctcaaaaaaaaaacagttttggcagggcacagtggctcgcacctgtaatcccagcactttggaaggccgaggcaggcgaatcaagagatcaggagtttgagaccagcctagccaacatggtgaaaccctgtctctactaaaaatacaaaaattagccgggcgcggtggcgggcgcctgtaattccagcttctcaggaggttaaggcaagagaattgcttgaacccaggaggtggaggttgcagtgagccgagatcgtgccactgcactccaacctggctgacacagcaagactccatcttgaaaaaacaaaacaaaacaaaaaaacagatcttggcatatagtagatactaaatattatccaattggctgggtgcgatggctcacacctataatcccagcactttgggaggctaagatgggcgaatcacttgaggtcaggaattcgagaccagcctggccaacatggtgaaaccctgtttctactaaaaatgcaaaaattagctgggcatggtggtgcacacctgtaatcccagctacttgggaggctgaggcacaagaattgcttgaacccacggggctgaggttgcagggagctgagatcacgtcacttcattctagcctgggcaacagagcaagactcagtctcaaaaataaataaataaatatataaataaatattgtcaaatgattaaatttctacactgataactctgctttataaataatacaaaaatcagtgataggataaaaactatatgctctaatggctttggtggcctgtattttctctttgtgataaatacattttattattttatctttgatacttttccttaataatggctttatcaatgatatatgttttagcagctgtagtggtcggatcttgcattgctataaagaattacctgaggccaggcacgatggttcacgcctgtaatcccagcactttccaaggtcaaggtgggaggatcacttgagctcaagagttcaagaccagcctgggcaatatagtgagaccccatctttgtttttgttttaaatgtttaaaagaaaaaaaaaattaccagagactgggtaatttataaagaaagaggtttaatcagctcatggttctgcgggctgtacaggcatctgcttctgaggaggcctcaggacacttgcaatcatggcataaggcgaaggggaagcaagcacatcttcacatggccggagaaggaggaagaaagcaaaggggaaggtgccatacacttttaaacaactagatcctgtgagaactctatcacgagacagcactatggggatggtgctaaaccattagaaaccacctccatgatccagtcacctctcaccaggccccacctccgacactggggattacaattcagcatgagatttgggtggggatacagagctaaaccatatcagcagcctagctattaatggtattttctgatagcagcatgatattccctgttgacttgtatatttttcccctggctctctggtcttcaatgaagaggaccgggttaaaatataaagagagctgctttatttatttatatttatttatttatttttgagacagagtctccctccattgcccaggctagagtgcagtggtgctatctcggctcactgcaacctcctccacctcctgggttcaagcgattctcctgcctcagcctcctgaatagctgggattacaggcacacaccattatacccggctaatttttgtattgttagtagagacggggtttcgccatgttggccaggctggtttcaaactcctgacctcgtgatccgcccacctcagcctcccaaagtgctgagattacacgcatgagccaccccacctgaccgagagttgctttgatatcaatcattgtcatgatattgtttgcagtctactctgcatctaattttccccaaactttcattgtttttaagctcacatttgttacaggttttttcttaatttgtttgagaagtattcttaatttgtttgacttagtactttcttatctgaagatttataggctgggcacagtggctcatgcctataatcccagcactttgggaggccaggacaggaagatggctggagcctgggagttccaagaccagtctggacaacatagtgagacctcctctctacaaaaaaaaattttttaattagccaggtgtagtgttgcatgcctgtagtcccagctagtcaggaggttgaggtgggaggactgcttgagccccggaggtcggggctccagtcagctgtgatcacactggtgcactccagcctgagtaacacagcaagacttctcaaaaaaattaaaaaaatgaatgcttatcataaatggtttataatgataaattaaaaaccatggaaatcttatagggagggttcattaaatttgttatatccataaaagtgtaatatgtagccactaaaaaggatgatgctgagctatatttattggcatacaaagatatatatgttgggccggatgtggtggctcacgcctgtaatcccagcactttgggaggccgaggtgggcggatcacctgaggtcaggagttcgagaccagtctgacccacatggagaaaccccatctctactaaaaatacaaaattagctgggcttggcgcatgcctataatcccagctacttgggacggctgaggcaggagaatcgcttgaaccggggaggcggaggttgtggtgagccgagatcgcgccattgcactccagcctgggcaacaagagcaaaactccgtctcaaaaaacaaaacaaaacaaaacaaaaaacaaagatacctatgttgtttcttgtttttaagacagtgtttccctctgtcacccaggctggagtgcagtggtggctcactgcagccctagcctcctgggctcaagtgatcctcccatctcagcctcctgagtagctggattacagatgtgtgccaccccacccagctaattgtatttacttttagtagagacagagtcttgctaggtacccctgggctcaaatgatcttcctgccttggcctcctaaaatattgggattacagacatgagacactgtgctcaatctgtatctgtgattttttaaattaaaaagaaaacaggttacaagaaaacaagtataacataatctcatttttgtggaggaaaaaaatagatacttgtatatgtatacacaagtatctcctatacaaaattggagggtaaggttagcactcttaattgtctccaagtcagctagcatttttctagatcatcgtttgtttcagtacgactaactataataattacctctttttttaatttttaattttttaggtatatagtaggtgtggggcttataactattacttctggcctctgggaagccctctaactattctatcctaggtataaataaatacctttctccttagttcaacaaaaccaaggctggggttttctaaaaggaatttttcaagaaaacaaaaaaaggaaagtaaacaaaaggcaaaataaaagcatagaaatcaaagtgtttacaggatacacactgctttttcttatgtcagtaaaagtctatccaccaactagttaagttgttacagtttatggggctctaaagtttttgggagctgggcatgatggctcacgtctataatcccagcagtttgggaggccaaggtgggacaattgcttgaggccaggagtttgagaccagcccggaccacatagtaagacctcgtctctacaaaaaataaaatattagccaagtgtagtagtgcaagcctgtggtcccagctacttgggaggctgagctgggaggatcacttgagcccaggaagttgaagttgcagtgagtgatgattttgccattgccttccagcttgggcaacagaacaaaaccctgtctcagaaaataaaaaataaaaataatccttgtgactctgcaacccaggctggagtgcagtgccgcggccttggctcattgcaacctccacctcccaggttctagcaattctggtgcctcaggcccccaagtagctggggttacaggcgtgtgccaccacgccaggctgaattttttgtattttttagtagagatggggttttgctgttttggccaggctggtctcaaacttctggccacaagtgactcacatgcctcggtctttcaaagtgctggaattacaggcgtgagccacctttcctggccccttgtggcaattttttacccagatctctctagccaaaactataaaattgagagttttgattcagcactatcatttggtaataatgtagagaaaaatggaatgacgtggaaaatatgtgtaaaatacaaataaaaaagattataagatagtatatatgatataaccctaattttaaggtatacagtataatgtacagaaataaaaaaaaacccaccagagagatactcttcagatgataacagtggttatctttaagttgtagtactacagttaaagtttaatttctttgtgcttttctatttttccaagttttctataggaacatgttattaagaagtatatatatatattttttaaattatttatttatttatttatttatttatttttttgagacggagtcttgctctgtcacccaggctggagtgcagtggtgtgacctcggctcactgcaagctctgcgtcccgggttcacgccattctcctgcctcagcctcccaagtagctgggactacaggtgcccgccaccacgcccggctaatttttatttttttgtatttttaatagagacggggtttcacgatgttagccaggttggtttcgatttcctgacctcgtgagccgcccgcctcggctgcccaaagtgctggaattataggcgtgagccaccgcgccaggactttttttttttttttttttgagatagagttttcactcttatcgcccaggccgcagtgcagtggcctgatctcagctcactgcaacctccacctcccaggttcaagagattcttctgtctcagcctcctaagtagctgggattacagacacgcaccaccatgcccggctaattttttgtatttttagtagagatggggtttcaccttgttggccaagctgggcgacagagcaagactctgtctcaaaataagtaaataaaagaaaagaaaagaaaatttgagcaactaaaaataacatattcttaataccttacctaacttgtgtcaatttttatttgtgctatgcatataaaaaggtctcactgttgaagatcactgtatctgaagagattcattttatttatttatttatttgagatgaagtctctgtcacccaggttgcagtgcaatggcgcgatctcagctcactgcaacttccgcctcccagattcaagtgattctcctatctcagcctcctaagtagctgggattatagacacgcaccaccacgcccggctaattttttgtatttttagtagagatggggtttcaccttgttggccaagctgatcttgaactcctgaccttgtgatctgcccacctcaacttcccaaagtgctgggattacaggcgtgagccactgcgcccagtccattttattaattcatcaaatctttgttgaacttctcttacatgctaggcatgttctagatgttggggatatagtggtgacgaagacagtttgtactgtcatggagcttatattctgggcagatttattggtcaaaaaaatctgtgatggggccgggcgcggcggctcacacctataatcccagcactttgggaggctgagggaagcagatcacctgagatccagggttcgagaccagcctggccaacatggcgaaaccccatctctactgaaaataaaaaacttacccgggcgtggtggcgagcgcctataatcctagctattacggaggctgaggcagggagaatcgctggaacgcgggaggcagaggttgcagtgagttgagatcatgccattgcactccagcctgggagacagggcaagactctgtccccccaccaaaaaaaaaaattctgtgatgaatggtacagtgtatcaattagtaactgtaaataaattagcataccaactataaggattacaaaattagaataaacatcatagaattagtgcaatgtaaattgattcacggtggttttttttttttttttttttagaaatcatagtatcaatgggaataatatggatttattttttttcttctagctttaaggaagcctcctatttcagtttctcaacatgaaagtcatcaagcaatctcccatcttccaactggacaacctctctccccaaatatgcctccaggtatgaaggcttatgcttataattccatttgaaaccaacttactagtcatgtacagttatatagtgtataaaatatatcacttagcagtatagtgaaatagcatttattctttgaggtaatgttatttttttttagactagtaaaagcagagagaaataataatctgaaactccactttatctggtggattgttagtctttttcttaagaacagaagaattatttattatgccactctgagctacattccctttcctctctgcctgctatacaggtttagcttcttcaaaatgtgttcaaatttatctcatagaggccttctataaattacagtgcccacctatattaaaatcttcgtacttatgaatgtatttgtttattttctaaacactcattccattttatagaacatttccctgaaatgagagtagatatgattgaagagacctgcttaagggagatgatggaaaggaaaaaggtcagagtggaataggatgttttgggatccaaaattaaagtcattgatgaggataaaaagggaggtggggaaagagaggtggtatccagtagataatgctaagaaagaatcaagagtcaacacttgtgagtcactgtatagtgaagatgacttagagagtagaaatttcaaaagccttactggattttggagatttctgatagtgatatggaatttggagggaggaaaagatatgagtatcattgctatattaatctatggatttctactgtatatctttttggtgaataagtttatggccattagtggagatactcacctgggaatgatcagtaaacttcccacagctaaaatcacattggttataatacttgattaaagaaatgagaataaacctttaaaaaaaaaaaaaaaagctttgtggctacccaatgttaaacaatagtgtgtcttagctttctaaagcagatcttgtgaaattcatctttaaaagattaaattaaattatattcttttaatttgatgtttttatgccacagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagtaagaatcaattgatgaatattatgctaaaaatatttctttaaatgtaatatgaattaaggtcttcattattctgctctctaataaatgtatagtgaagttatatatatttaaagagaaggtatgaaagtgtcaaaatttaaaggaaatacaggttttaaatggatagatacgattttaaagaaaactttaaaaaggttctcatgttctccattgttaaataataaatttcaggtgagttgactttttttaaaaatacaattagttcttatgaatataaacttttttggagaaatgagaaaaatatattttgataggcttacaaatgaaaactttgattagggaggagagaaaataaatagttttgaaaaatggaacattctgggagaaacatacactctgggggattgccttagtagattgctcaatactgcttcctcctccattccctgcaattgcattttcctcatttagatgttagaagtataagaaaaaattctagtagtagaatttgaggcaggagagtgtcccttagatcagcttccttaaactgtgcttttcactggttctgcttttcatggcatcttcttaccttcaattctgaatagacagaatctctaaaagcttcagtttgtctttggtttatttatttatttttaatttttatcagtcaccaggagtaagatcaagtctttggtttttatgatggcttctgtctatggcagcaactgtgcagagcactggttaggcagttatttgtacaaagattgcgtgtaagctaataattgaacaatgttatatttgtgaatttattcaaggtattttattttatttctttatttttatttatttatttttagagacgggggtctcgctttgttgcccaggctggtcttgaactcctgggctgaagtgatcctcccgccttagcctcacaaagtgctgggattacaggcgtgattcactgtgcccagcctattcaaggtatttttgttgatcttgtaacagttattcaaatttattcatatatgtgaatgtatagtttgcattaatttaattggctttcctttcttttttctttttttctgttttcttcaaataggaaattccttgatattttaaagcatatctgtgtatcttgaccaaagtattgtgtgaaaaacatttttattacaaagatttagctaacattttaaatataatgaaaaaatatttcctcaaaattgggttgggggattggcctgaaaacttacatctcaacaagaagaggtgtacagtaagagcataacaaataaaatatcttaatttgatcacttaagattttcttcttttttttttaaattttttttgagatggagtctcactctgtcacccaggccaggagtgcagtggcaggcaggagtgcagtggtgcaatctcagctcactgcaacctccgcctcccaggttcaagcgattcttctgcctcatcttcctgagcagctgggattacaggtccacatcaccatgcctggctaatttttgtatttttagtagagatagggtttcaccgtgttggccaggctagtctcgatcttctgacctcaggtgatccgcccgcctcggcctcccaaagtgctgggattacagtcatgaactactgctcccggccaagattttcttctaaacttatatttattctatacatttttttaattgttgccttacctgtatatatttttttaactgatatttgggtaaagaaggtggttggaaataattgctcggaaattattactctctacaataattttgaaaagagcctaggcatggtggtacacaactgtagtcccagctacttgagaggctgaggcaggagaatcacttgaacccgggaggcgaagtttgcagtgagccaagattgtgccactgcactccagcctgggcaacagagcgagactctgtcaaaaaaaaaaaaaaaaaagaaaagagcctattgagttttaaaccctcactccatattattttccatttatcattaatgtatatggagagttgaaatcaatgcatgcacaattttgtgatttactttgacattatttcttacattcctttttacttaatttaaatttttattaatatatacacatatattctgtatatattatatacatatacagaatatatgtatacatatacatatattctattgtgcttaggcaataataacagtttacttaggtctcctctcattgtttagatcatttcgtattttctcattgtagctgtcatgattgttactatcattttttttctccagttatttcctgttcttcctactttgcgtgttcctttaaaagtatagtcctcagaacgaaattactgggtcaaagcacttgactagctttatagcacttgttaaatagtgtcagattgttctctagaacagttttaaagtgtcactggagttatttaagtttaggggtttctctgtggcctggccacattgatttttatcgtttttataaggtatttagaatataacgtttccttaaaaatgttttaataatcatttattctggtggcctatatttatgtgagtaattttattataattatttcttggtatataatctgtgcatcagttttgaccacttagcctgaaaactttgtagatttgttctatttatttgtatcaactcttttctttttctttttttcttttttttttttttttttgagacaacgtctcactctatcacccaggcttggagtgcagtggtgcagttgtggctcactgcagccttgacttcctgggttcaaatgatcctcccttctcaccttcctcagtagctgagaccacaggcatgtgccatcacacctggctaatttttaaaatttttaaacaaaaatgaggtctcgttctgttgtccagactggtattgaactcctgtgctcatgtgatcctcccatctcagcctcccaaaatgctgggattacaagcgtgagccaccattgcccagccccgtatcaaatctttatagataattcagatttatcacagttttcctcttatattgtcgttcctgatataagactttcttatgctttatcatgcaaaagtttttttaattaaaaataattttttgttttggtaagttacacgtaaaattcaccaaaatgtacaattcagtggcatttagtgcattcacaaagttgtacaaactatcaccactctagttccagaatattttcatcaccctgaaacaaaactctgtactctcctaccctcagcacctggcaaccgctaatttgcttttttctctctgtctatggagtcaccaattctggatatttcatataaaaggaatcatacggccaggcgcggtggctcatgcctgtaatctcagtactttggaaggctgaggtgggtggatcacaaggtcaggagatcgagaccatcctggccaacatggtgaaatcccatctctactaaaagtacaaaaattaggccgggcacggtgactcaagcctgtaatcccagcactttgggaggctgaggcgggcagatcacgaggtcaggagtttgagaccatcctggctaacatactgaaaccctgtctctactaaaaatacaaaaaaattagccgggcgtggtggcgggcgcctgtagtcccagctacttgggaggctgaggcaggagaatggtgtgaacccaggaggcagagcttgcagtgagccaagatcgcgccactgcactccagcctgggcgacagagcgagactccatctcaaaaaaaaaaaaattagctgggcgtggtggcgcatgcctgtaatccaagctacttgggagggtgaggcaggagaatcacttgaaccagggagttggaggttgcagtgagctgaggtcacgccactgcactccagcctggcaacagagcgagactgcatcttaaaaaaaaaaaaaaaaatcatacagtatgtgaccttttgtgtctggcttcttttatttagcataatttttctgaagttcgaccatgctgtagcatgtagcatctatcagtattttatttctttttatggctggataatattcagttgtatggatacattttgtttattcatctgttgatgtatatatgggttgtttctatattttggctatcgaatagtgcttctatgaacatttatgtacaagtttttttgaacatctgtttttaattctttgggtatgtacctagatgtgaaactgctgagtcatatgatagttctatgtttagctttttgaggaactgccaaaccattttccacaatagctgtaccattttacattcccaccagcaacgtataagagttccaatttctccacatcccctccctccctcccttcctccctccctccctcccttcctcccttccttccttccccccgccactttcattcattccttctaccatgtagtacatatgaagtgatgtttccttgtggtttttatttgcatttcactaatgacattgagcaccttttctgtgtactttctggccatttgtatatcatctttggagaattgttctttcaagacctttgtccttttttaaaatttacttttagagacagaatctagctttgtcacccaggccagagtgcagtggcacagtcatagctcactgcagcctcaaactcctaggctcaagtaatcctcctgcctcagcctcagtagtagctatggctacaggcataccctaccatgtctggctagtgtatgtatttattttttagcttttgtggagatggggtcttgctgtcttgccctggctggtctccaactcctggcctcaaacaatcctcccatcttggcctcccaaaagcactgggattataggtatgagccactgggcctggccctttgcccatttttatgttgggttatttgtcttggttgttgagttttaagaggtttttgaaaaggtattctggttactagaccctaatcaggtgtatgatttgcaaatatttttgcacagtctatgggttgtcttttcattcttgatagtgtcctttcatgcacgaaagtttttaattttgatgaggtccaatttatctattttttgtttttgttcatactttgagtatcatatctaagaaaccagtgccaaaatcatggtaatgaagatttccccctgtgttttcttctaagactttcataggtttagctgttatatttaggtctttcatccatttaaagttagtttttgtatatggtttgaggtaaggtctaacataatccttttgtgtgtggataccagttgtcccagcaacatttattgaaaagactcttcatttcccattgaacaatcttggtatccttgtcaaaaatctattgaccacagatatatgggtttatttctgaattataagttctgttacatttatctatatgtctctccttatgccagtatcatactgttttcattgctataactttgtagtaagttttgaaattgtgaattatgagtccttcaactttgttcatctttaagattattttagctcttcatgatcccttgtaattttattgtaggatctgcttttccatttctactaaaaaggcagcgatattttaaaaggaattgtggctaggcacagtagctcacacctataattccagcattttgtggggccaaggcaggaggatcacatgaggccaggagttcaagaccagcctgggcaacgtagcaagaccctatctctaaaaaaaatttaaaaattagccaggcatggtggcacaagcctgtagcctctgctactgtggatgctgaggtgggaggattgcttgagcccaggagttcaaggttatggtgagctatgattgttccactgcactccagcttgggtgacaaagtgagccctgtctctgaaaaaataaaattaaaaaattggccgagtgcggtggctcatgcctgtaatcccagcactttgggaggccgaggcaggcagatcactggagcccaggagtttgataccagcctgggcaacatggcaaaaccctgtctctacaaaaaatacaaaaactacccacatatggtggcatgcacctgtagtccccgttacttgggaagctgaggtgggaggatcacttgagcccaggaggcagaggctgcagggagctgagattctgagattgtgccattgcattccagattgggcagcagagcaagaccttgtctggaaaaaaaaaaaaaaaaaaaaaggaattgcactgaatctgtagatcactttggagagcactgccatcttaacaatatgaggtctttcaatccataaatatgggatgtctttccatttatttaggtcatctttaattcctttcagcaatgttttgtagcttttagtgcacaagtcttgtgctgccttggttaaatttattcctaagcattttattgttttgatgtcattgtaaatcgaactgttttcttaattttccttttagacttcttgctagtgcatataaatatgactgatttttggcctggcctgatggctcatgcctgtaatcccagcattttcggagaccgaggtgggtggatcatctgaggtcaggagttcgacaccagcctggccaacatggtgaaaccccatctctactaaaatacaaaaattagccgggtgcagtggcaaatgcctgtaatcccagctacttgggaggctgagacatgaaaatcgcttgcaccaggaggtggaggttgcagtgagccaagatcgcgatactgtactccagcctgggtgacagaatgagacactctctcaaggaaaaaaaaaaaaagaaataagactgatttttgtgtgtgttgatcttgtatcatgcagctttatacaacttgacacaaaaggtctttatttgtatatattcaagcatattgatctagactcttatgatgattttcatttctcttatagaagatcatttcttttataaaaatcatttcttttattctatctggacataaatatactgttcttttttttgtttttgagacggagtcttgctctgttggccaggctggagtgcagtggcgcaatctcagctgactagaacctctgcctcctgggttcaagtgattctcccacctggccaatatggtaaaaccccatctctactaaaaatacaaaaattagctgggcttgttggtgcatgcctgtaattccagctactcgggaggctgaggcacaataatcttgaacctgggaggcggaggttgcagtaagccaagattgcgccactgtactccagcctgggcaacagagcaagaccctgtctcaaaaaaaaaaaaaaaaaaatcgttagtattcttgtgtttattcagctttgctttccatagagtaaaaactatttagttataagaaaaatttattttattttagttatttaagagacaggtggcctggcacagtggcccatgcctgtaatcctaacactgggaggccgaggcagatggatcacttgagcccaggagttcaagaccagcctaggcaacatggtgaaaccccgtctctacaaaagatacaaaaattagctgggcatggaggcgtgctcctgtagccccacctccttgggtggctgagttagcaggattctttaagcccaggagttagaggctgcagtaagccatgatcgtgccactgcactccagcctgggcaacaaagcaagaccttgtctcaaaagaaaaaaagagagagggagagagacagggtcttgctgtgctgccgggctggattcaaactcctgggctcaaatcatcctcctgccttagcctcttgagtagctgggatttataggcatgcatcactgagcccaatgaaaattcatttttttttttttagacggagtctcggtctgtcgcccgtgctggagtgcagtggcgtgatcttggctcactgcaagctccgcctcccgggttcacgccattctcctgcctcagcctcccaagtagctgggactacagacgcctgccaccacgcccggctaattttttgtatttttttagtagagacggggtttcactatgttagccaggatagtcttgatctcctgacctcgtgatctgcctgcctcggcctcccaaaatgctgagattacaggcgtgagccaccacgtccagcttgaaaattcatttttaagtacagttttgctttatagttttcttcttttttgacttacaatttttttctttcatttaacacttgtcaaatcattatttgtatctaaatcattattctcaaaaatttcattgtggccgggcacagtggcacacgcctgtaatcccagcacttttggaggctgaggcaggtggatcacttgaggccaggagttcgagagcagcctggccaacatggcagaaccctgtctctactgaaaatacaaaattacccaggtgtggtggtacacgcctgcagtctcagctactcaggaggctgagtgggaggattgcttcaatctgggaagcagaggttgcagtgagccatgatcacgccactgcactccagcttagacaacagagtgagaccctgtctcaaataaataaataagtaaataaaaaataaaagcacttgatactctgtaggtacaaaataacatgctgttagaaaaaagttgaaaattttattgaaaacactattagaaaaggaggggaagtccttagactttatatagttatcaccacaatttttgttttgttttgttttttgagacagggtctcactctctcacccaggttgtactgcattagcacgttcatagctcactacaaccttgacctccttgggctcaagggatcatcctacctcagcctcctgaatagctgggactacaggtgtgtgccaccatgcctggctaatttttgtatttttgcagagacagtttcaccatgttgctcaggctggtttcaaactcctgagctcaagcagtcctcccacctcagtgtcccaaagtgctgggactacaggcatgagccaccattcctgacctcactacaaattttttggcagctttaactttagtatttttgttttatagcttaatatatcatacttatattgatatatttataaagagctgcatatttttgtaaatttaattttgtattaccacatcatgcaaaagtggctagaacattttggggtatatttcaccatatttggaagatgtatttgggttagtttaatttaaactttagaatgtaggctatgtggtgacacaaaatatagtttagggatacttcaaagaaacagacatcttccaaaatagttgaaactgaaaatccaggcgaggcctacatgtttgccagctaggagggacataccatttgtatttagatgctttgaatagagataagaatttacttcaaatgtcagctcccatatggaaagtcatgagggtggttactccaaacagtagggagtgattgttgatcaaattgcttctcatattggcttttctgtatagcagcagggtttcatttatttaacagtggttattaatcattctcccaaggaacactggagaggcaagctagtgtatcacagaatacctgatcttcctttacatatagaatttttttttttttttttgagatggagtttcactcttgttgcccaggctggagtgcaatggcacgatctcggctcacccaccgcaacctccacctcccaggttcaagtgattctcctgcctcagcctcccaagtaactgggattacaggcatgcaccaccacgcccggctaatgttatatttttagtagagacggggtttctccatgttggtcgggctggtctcgtactcctaacctcaggtgatccgcccgcctcagcctcccaaagtgctgggattacaggcatgagccaccatgctcagcccccttttctaaggtccctcatcccatttataagagtggagccctaatggcctaatcacctcccaaaggccccatctcttaatatcaccacagtagggattaagctgcaacatgaattttggagaggacacattcaaactgtggcaattattagttacctaaattggctcatgaagatttgaaaacttgaataaaccaataatcattaaataagttgaataggtatcaaaagttccccccttccctcaaaagagactggtaaaagttaatgagagtttagcttgattactaattcagggtcactgtatgaaatcaagcaaaccaaaaactggttctttgaaaaggcaagtgaaattggaaagaccagccaggtgtggtggctcacacctgtaatcccagcactttgggaggctgaggcgggcagatcacgaggtcgggagatcgagaccatcctggctaacacggtgaagccccgtctctactaaaaaaaatacaaaaaattagccggtcgtggtggcgggcgcctgtagtcccagctacttgggaggctgaggcaggagaatggcgtgaacccgggaggtggaggttgcagtgagccaagattgcgccactgtactccagcctgggcgacaaagtgagactccatctcaaaaaaaaaaaaagaaattggaaagatcgtcagcacacattaagacaggaagagatgacacaaattctcaataacaaaaatgaaaaaaaaagaacatcaatatagatcctacaaataatattaaaggacacatgataagaggtattattaatttaatgccaaaacatttgcaaagttagatgaaatggccaatgtcctagaaaaacacttctatacaaaactgacagaaaaagatagggaaaatctgaatagttccatgtctattaacatattgaatctgtaagttaatattttggtacctaaatggtttcattgatgaattctttattttttatttatttatttatttttgagatggagttttgctcttgttgcccaggctggagtgcaatggcacaatctcagctcaccgcaacctctgcctcccaggttcaagctattctcctgcctcagcctcccgagtagctgggattacaggcacgtgccaccatgccctgctaattttgtatttttagtagagacagggtttctccatgttggtcaggctggtcttgaactcccaacctcaggtgatgctcctggcttggcctcccaaagtgctgggattacaggtgtgagccaccgcacccagctggtgaattctttcaaacatgaaagaatacaaccaatgtaacataaactttcagagaattgaaaaggaaaaaaacactccccaacccattttatgagaccagcataagttggacagcaaaactaagaatattatgagaaagaaaaattatagcagtttctcttattaatatagatataaaaatcctaaacaaggccaggcacgtagctcacgcctgtaaatcccagcactttgggaggccaaggcaggtggatcacctgaggtcaggagtttgagaccagcctggtcaacatggtgaaaccctgtctctactaaaaatacaaaaattagctgggtgcggtggtgcgcacatatagtaccagctacttaggaggctgaggctggagaatcgcttgaacccgggaggcggaggttgcagtgagccaagattgtgccactgcactccagcctggtgacaaagcgagactcggtctcaaaaaaaaaaaaaaaaattctgaacaaaacattagcaagtcaaatccagagatagataaaaattatatacatgatgaccatgttggatttaatctgaaaattcaagattgtttaatatttgaaaagcgatctatgtaatttaccacattaacaaaatatatgaggaaaatcatctcaaaagatgtaaagtgagcatttgaggaaattcatgcatttatgataaaacaaccaattttaagcaaagtagggttagaaagtaatttccttaactcgatagagtattttaagcatcctatgacaaatatcaaatttaatgattaattctcaaaaaccttcccttgagatctagaaaaggatacccaccatcatcacttctattccgcttttcactgtagattctaatcaatgaaataaagcacagaaaaggaaataaagagtatagagattggaaaggaagaaatataactgataagctgatattatttgtagacaatatgattttatatgtagaaaactcaaaacaatttataaacaaatgtatttagcaaagttattacatgcaagatttatatacaaattatatttctgtatatagcagcagtaaacatagtgaaacttttaaaaagaaactttttaatagcataaaaagacatcagataccttgaaaagttcttacaaagatttacaagaacctctataagctacaaaatattgttcacagaaattaattaatatataaataaatccatatccatggattggaatgctcaatgttgtaattatgtcaattcctcccatattaatctagaacttcattgccatcccaattataatcccagcagagtttgggggttttgggtggaatctgataagctgactctaaaatgtgtatggaaactgcaaaggaataagaatagccaagacaatttataaaaggaataaagtgtaaagacttccactatcagatatgaagatttattataatgctctttttttgtttgtttgtttgtttgttttgagacacagtctcgctgtattgcctaagctggaatgcagtggcgtgatctcagctcactgcagcctctgcctcccacattcaagcgtttgtcgcccaggctggagtgcagtggcgcaatcttggctcactgcaatctccacctcacaggttcaaatgattctcctccctcagcctcctgagtagctgagattacaggtgcatgccacaacacccagctagtttttgtatttttagttagagatgaggtttcactatgttggccaggctggtctcaaactcctgacctcaagtgatccacccgcctcagcctcccaaagtgctaggattacaggcatgagccaccgtgcccgacctactgtgctattttatacaagggactttaacatctgtggattttggtatctgctggggtcctggaacaagttctcagtggatactgagggaggaacaactctattcaccataaatcactttgtaggataaattgacctcatcagactggtacataatggctcaggcctcaggcatacaaaaacatttataaagcagaatatttcatgggctcagaggttatctctcagaatccagccaagggccagtcctgaaaacaaagctttctttggaatgtacagggtttgagcaaccacggaatacattgcatcacaacaggggatacattctgagaaaggtggtttttagttgatttcatcattgcgaacatcatagagtgtatctacacaaatctagatagtataggtttgccttggaaacggggagatggtaaggttgttcagatgctgtttgccataaattctagctaccatgcttctttcatttcctttatttctctttaccttccacaagtccagtccatcagtgaatagattgcttcctgtgcctactatatgcagggcctatatcccttgagatagaaatgtggtctttttgccctaatatgttcctgataatgaaatcaattcaaaagccagtcaatagttttcctacaattgttttgtgaagaaagcctgcagtaacatttttgttacagtttgtacaccccaacctcccacctctcatgattataactcatatctcaacagattataagtcatcacgtgtcatttaccttcagggtacttgaaatagtcacaactctaggtattaaattgaataatgcaagatcagttgaatgtgttaactaccaaatgaataaatgaaagtgaatactgccaatagatgaaggctagaaaaaagaggctgccttccttaaactttccttttcattctctctaggtttattgtaactagctctaatagtttcattttgcttacaatagtggtaatatattacattaatgacataaaaatataaacttttttttttttttgagacggagtctcgctctgttgcccaggccagagtgcagtggtgcaatcttggctcactgcaacctccacctcccaggttcacgccattcttctgcctcagcctctccaaggagctgggactacaggcgcccgccaccacgcccggctaattttttttttttttttctgtttttagtagagacagggtttcactgtggtctcgatttcctgacctcgtgatccgcccgcctcagcctcccaaagtgctggtattacaagcgtgagccactgcgcccggccaaaatataaacttttaaaaataaaatagttgagaaattgaaacccgtaaacgaacatcagactaatgcagcaaaagtgactcatcttggtgtttcctttgacttatagtacagaattaaaatatacggcctagtttttcttgattgaaataccctcttgtgattaagaaatgttattctcttattttctactggtttttttttttgaacgtgtttctattttattttaccaacaatttaaaactatctttagggccgggtgcggtggctaatgcctgtaattctagcactttgggaggccaaggcgggcgaatcacaaggtcaaaagatcaagaccatcctggccaacatgatgaaaccccgtctctcctaaaaatgcaaaaatcagctgggtgtggtggtacgcgcctgtagtcccacctactcaggaggctgaggcaggagaatcgcttgaacccaggaggcagaagttgcagtgagctgagatcacgctactgcactccagcctggcgatagaacaagactccgtctcaaaaatataataaaataaaataaaaaataaagctatctttatttaccaaagattgccaaattcatatgaacttgaaaagcatgcaggctagttatttaatttataagtgttcatttatttataggtcagtgataccatgtagacaatatacaaacatacatgtatacctgtacacataatacagacagacaaaagtaaagactttataactttattttaaaattttagccatgaggccaggtgtggtggctcatgactgtaatcccagcactttgggaggccgaggtgggcagatcatttgaagtcaggagttcgagaccagcctggccaacatggcgaaaccccgtctctactaaaaatgcaaaaaaaattacatgggtgttgtggtaaacccctgtaatcccagctactggagaggctgaggcagaagaatcacttgaacccaggaaatggaggttgtggtgagccgagattgcaacactgcactccagcctgggcaacagagtgagactccatcaaaaaaaaaaatttttttttaataaaacataaaattttagccacgagaaatggctacatttgctttctcatttaacatttgctttctcataccttcccaataaaactcactagtttaaaaggatagttgtattcaaactatgcctttgtaaatggaaaaggttaaagtttatctattccacatgaccaaagcccttactcatttttttctctactagtttctgaagtttgtagtctgatatttgagatgtcttacagaatgtctagcattctgtttgaagttttattgtgttgtttagcgtgaattgaaaagcgcgttaaatgcctaattaggtgatgtggagcatatgaagttagaccatgtggtatatgaattaaagtaaaatgtatgaaaaattacttcatatacatgccatacatgcttattacatatttaatagactttagctcacttagcccagaaaaggaatttaaatatggaaaataatctgttacaatttttcaaacttgatacaactcaaagactttcaatagctagtgggtgtgttgtttctttgtgttctcatgtttaaactattgggatgaagctatattgttgctgataatcaaatcattttcagctggccaccagagtgaaaataatattcaagcgcacaattgaattttgcaacaatataaggaaatctaggatccaaagtaaatataattactttattactcccctagctgggcacagatttaacagttttgttacggagcagcagaactgtattaaaggttgtaaaaagttgaaatgcctcagagatgaagtctactatttaattcctgttaatacacatcataggccaggtgtggtggctcacccctggaatcccagcactttgggaggccgaggcaggccgatcacgaggtcaggagatcaagatcatcctggctaacacggtgaaaccccatctctactaaaaatacaaaaaattagccgggcttggtggtgggcgcctgtagtcccagctactcaggaggctgaggcaggagaatggcatgaacctgggaggcggagcttgcagtgagctgagatcgcaccactgcactccagcctgggtgacagagcgagactccgtctcaaaaaaaaaaaaaaaaaaaaaaaacaaaaccacacacacacacacacacacacatcatagatttataccatcaaatgataactttgccctcattacttcttttttctcttcttaaatattgtcattccccaagatcacttctttgacttatagctgttttctgtaaatatttatttcctaaaattatattctgatagtttaaccaatcaccttgaaatttatgagttttaaatctacatgtttagccctcactttgcacctacattctagatccatatagctatgtgtctataaaacattttcatctggatgtcatactgtagttccaaattcagtttatctaaagcaacatttgctttctcataccttcccaatttgggatataggtagcattaattatagtttccaggctaggatttggaatcatcctttgactctttctgctccattatgacatatattcattttgtcattttcaaatgtatctgattcatcagtttctaacatttcctctgtcttcctagtgtaagtcctcatagcttcttacctaaatagatactggagatactgtagggcataaggcagatcagatttcagttctcagggagcttaaaagaaatcttgactactggttattgcctcctacataatgttcaaactcactctatcaaaaggaagccaactgaagccatgttcagttgtctccatgttcagatgttactttctagagcagtgtgcaatagcacacgtactatcacttcctaatttgtttacttatctgttttccttactaagttataggagatgaagataggatgttatttttgctttctgtttttatttttgaggcagagtctcatcctgtcacccaggctggaatgcagtggtatgatcatagcttactgcagccttaaactcctaggctgaagcctcctgagtagctgagactacaggtgtgtgccaccatgcccaactgtagatttatgatttatttttgtatcacagtgcatagtgcaatacctatcacatacatcagtgaaccatggatggatgaaagcattgtagatacttccattatactttgtcattggatttaaacagtgaccacaagtgaatataggagattctatatactttgtcattggatttaaacaatgaacacaagtgaatataggagccttttttttttttttttttttttttgagacaagagtttcactcttgttgcccaggctggagtgcaaatagagcaatctcagctcactgcaacctccacctcccgggttcaagcgattctcctgccacagcctcccaagtagctgggattacagccacccaccaccacagccagctaattttttgtatttttaataaagatggggtttctccatgttggccaggctggtctcaaactccttacctctggtgatccacccacctcggcctcccaaaattctgggattacaggcgtgagccaccatgcctggccccgtaattatctgtaatttgcttgttcaaacttactctaactttctcatataaatccagtcaaattaatctctttactatcttctaaataccccatctttgttcttacctgttctttcagtgcttctttctttccctgtcatagtctaatataattgtcttctttttgaactttcccttttctcacattgacatgtggctcttaaatgttgaataatttagcagtcccttatattgatcagtattatgcatttttgtctgtaccgttatattcattcaatgtttaatgcaaagtttgtctgatctccttaacttgattggcaactctgtgtaagttggttctgtgtttttcaacttttgttgtctgtgaaatgttggaagcccagtattaaaggttagctataaatatttctccaaacgtgataattctgtatatataatagcacagatcactgtttaacaaagggcaattgtgtcattattcattcttgttgatatttttattatctgagtatctatgtaattatagtattaaaattttgacttaatttaggctagtcagatcatcaaacacctaaaaaaaggaaattttaaattgttctgttggaatattataacaggtacaagtgggacatttctttattccatgtctgacaatattagtaaatgatatatattttttagtaccttgtcttagcctaatgttttgagtcttctgtatttcataactctgatttaaaaatgaaggccgagcgtggtgtctcacgcctgtaatcccagcactttgggaggccgaggcgggcggatcacctgaggtcaggagttcaagaccagcctggccaacatggtgaaatcccgtctgtactaaaaacacaaaaattagccgggcatggtggtaggcgcctgtaatcccagctactcaggaggctgaagcaggagaattgcttgaacccaggaggtggaggttgcagtgagctgatatcaggccactgcactccagccactcagtctcaaaaagaaaaaaaaaaaaagaaaatatagatttctgtaaatctctttttactgcctatattgacatcatttattttattattcaaaaagaaagataataaagcccatcaaaatgcttgatttataattaggagacactgttttcttacaaatagcctacctattctcttgtatgtttcttttctctaactctatttcatcaacttttctatttatttatttatttatatattgtacatatccaagcttatactagaatagttttaagatgaattcatgctctttttcttggccccagttactccagttacttcagtctcctgttgtccccacaccctcccttcttttttttttctttgagacagagtttggcttttgttgcccaggctggagtgcaatggtgcaatctcagtgagccgcaacctccgcctcccgggttccagtgattctcctgcctcagcctcccaagtagctggattacaggcatgcgccaccatgcctgcctaattttgtatttttagtagacacagggtttctccatgttggtcaggctggtcttgaactcccaacctcaggccatctgcccgccttgccgcctttttttttttttttttttttttttttagtcttgctctgtcacccaggctggagtacagtggcgcaatctcagctccctgcaagctctgcctcctgggttcacaccattctcctgcctcagcctcccgagtagctgggactacaggcgcctgccaccacaccgggctaattttttgtatttttagtagagatggggtttcaccatgttagccaggatggtcttgatctcctgaccttctgatcgcccgccttggcctcccaaagtgctgggattacgggcgtgagccaccacgcctggccacacccgcccttctttaaaagcctctgtaagtgcaatttgttctttaacgatttttcctgatggactctttacccaacaattagaaatacattggcttgatgatgtgatgaaccatctgtagaattgaccagtacccccagaattctatttgtacttaacctttctttccaagcaaaggaagctgtttattttttttcctgagtgttccattgcaatgtaaattttatttatttatttatctatgtatttatcttcagagatagagtcttgctgttgcgtaggctggggtgcagtggcacaatcttagctcactataacctcaaactcctgacctcaaatgatcctcctgcattagcctcccaagtagatgagactacagacccctggctaattttttttttttttaagagacgaggtctcactctgtcacccaggctgaagtacagtggcaatatcctaactcactgtagccttggactcctgggcttaagcaatccttctacctcagcctcctgagtatctgagactataggtgtggaccaccatacccagctaatttttgtattttttgtagagatgttacccaggctggtctcaaactcctgggcgtaagcagtcctcccaccttggcctcccaaagtactgctatgacaggcatatgccactgcacccagcctgcaatataaatttttgaaatatatttttaaaaatttagacctatcacagaaagttgttaaatttctaagtcttaaagtcttgcattattaggaagttaattttatggattaaaataaatctacttttatgctaagttaaacttaatgtctaaatatagttttagttgtattgcatttctaaatcagatcctagtgtgcctaacatttttattttcaatgtctaattgttgaatagttttctacagtaggtattatgtctatttatcttcttgatttctttttttttttttttttgagatggagtctcacttttgtcactcaggctggagtgcaatggtgtgatctcggatcactacaacctctgcctcccgggctcaagcaattctcctgcctcagcctcctgtgtagctgggattacaggcatctgccaccacgcctggctaatttctgtatttttaatagagatggggtttcaccatgtttgccgggctggtctcgaactactgacctcaggtgatctgcccacctcggcctcccaaagtgctgggattacaggtgtgagccactgcaccaggcctgtcttcttcatttctaatggttatgaatgtgtataatatactggcctgttataggtcagttttcttaagattccattgtctttttaaaaatctgtcttaggaaatgagaagagatacaccagaattacttgggattttttttttttaaaccactagggattctgatggcttaccttctttgtcatccctttttggaaatccaaaatgcacaccaccatacccagttaatttttgtattttttgtagagaaagggttttaccatgtttcccaggctggtctcaaactcttgagctcaagcaatccacctacctcagcctcccaaagttctgggattacaagtgtgggccactgcaccaggcctagattttcaaattttaaatatgtatcatatctagtaataaaataatttattctcctaaagtgttaatttagtcatacttatattagagaagtcattggttattaggaaaacattcctaaaaatggtgcccatttctttaagaaatcattcaaattttaagtggcaagcactaaaattaacacaaaagagaaattcttaataaaaattacatattttcagagtcttccctcttatatacttttgtcttggataaccttcacaaaatgtatccttttatatccagtaccccaaaagttgccagctttcacttgtttactttctggtctgccttccgtatagattccttcttttcttctctctttactcttgaattaatcctctacctacttcacaggccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaaggtgagcgtgggcctggcctccatgctataaccatgaaacccacctctaagttttttggttgaatttgtgtagaatttcccccacttattagtggcagtgtaacctaaattttttgttttttctttgtgacggaatttcgcttttgttgcccaggctggagtccaatggtgcgatcttggctcaccgcaacctccacctcccgggttcaagcgattctcctgcctcagcctcccaagtagctgggattacaggcatgcaccaccacgcctggctaattttgtatatttagtagagacggggtttctccatgttggtcaggctggtctcaaactcccgacctcaggtgatctgctcacctcaggctcccaaagtgctgggattacaggcatgagccactgcgcccagccaacctcagtattaatacaaagaggttctgtggagtttttcagttttattttgaaaacttttataatagtggaatttgtaaatctgtaaattattttaatttttaaaaattttggttatcttatgtgtattattgatacagctatgatttaaaacttagaatcttcagaaattttagaattaaattgtttaaaatgactctagactttacctaaggcaaatgcttctagaaaatacacttttccaatttctcatctaaaaacattttgttatttcaggtacaaatattgcccaggtagctttttcgttataaggaaagccacaaagggaatggttttctccacactgaagataagattatttcaccactgacatagcagaggaaggctatttttgaattttttctgagaggcttaaaatttatatttaacaatcaatatgtgaagagttttttttatatttattacacagattcaacatatttttcttattcactgtgttacttctgctgagcatttaacttagtgaaagttcagaatctacctgtgtgcatgcagccctacccatgcatgcatatcagagtgttttactctattacaagtttttaggctagttttctgcctgcttatattgtttagtagtatttgtggagctatttctcttttctataaaagttgattgtgaccttagtgtgtgatacattacatttttatgtgatacatggaaatttttcatcataacatgctttgatttcttccttagctgtttttaaagtaattaaatttttatttaggctcatgacaagcattgtttttataaaacccagaagaaaatgtagttgttctagaaaattatatggtttgtagaaaaaagggaaactagagactgacttttacctaggcactgttttcatagttcattttagtttaggaaaattatgattattggggatagaaaagagattcatatgtgctaggagttatataaggttatatttataagaatttttcaaacactttttggtaatattgatattgatataaatataaccttacaatattatgtactttttctataatctcatccttttttcataaattttatcattttttctcattgcttttgtgatttgtttggattatatttatttgcaattatttataacgttttaaggctttttcatgcatgtatatcatatcaccaattagattgtaagctcttggagggcaggaatttttatttattttgccttccattttgtttgtatccttttctacctttatacccaccccccacagtactttgcacatcacccacccgccacagtactttgcacattgtctttaactgataattgcatgcttttctcgttgagcatttattcttataactgtgactagggtaataactctttaacttctggtattacaaggttgcttggtttacactttcaatattctctaatttttgtaagggctttttcatctcattggataattttgaggtttttattatagtggtttatctcaatctttgttgtcaatcatttcttatatcttaaaggtgataattgtcagaaaattttgatttaatatttgtatggatttcaatctattgtaagtagatttattttcagtgccttctctctccctttcttgtactcttctccttcttcctcccctggttcttactgccaccttctacttcaagtccccaagaccctcatgttgccctcccattcctttcacaagaaaataaattcaccgatactaaggaatataaggaaatgacaaaagatgatgtcctcagtgaagtagagaaggggctgttacatttttggatttccctatttgcaagttaatcttacgtgagctgagtgttgccatttaacatttcttgtctcattctggcattctctagatgatagtggcaggatagggcacctacaaaggggaccaagaacaaaaagatgcaggaacatcagctccaacaaataaagagggataagtttgggtgaactgactaaaaaggaatactgaggagacctaaataattgttaacatgtttccagggatccttttttttaattgagacagagtcttgctctgtcacccaggctgaagctgaatcttcctgttgtagagttgatttttgtgtgtttttttgcttttttttttgagacggagtctcactctgtctcacccaggctagagtgcagtggtgcgatctcagctcactgcaacctctgcttcctaggttcaagcgattctcctgcctcagcctcctgagtagctgagactacagccgtgcaccaccacgtccagctaagttttgtatttttagtagagatgggggtttcaccatgttggtcaggctggcctcgaactcctgacctcaagtgatccacccgcctcagcctcccaaagtgctgggattacaggcatgagccaccacacctggccatccagggattctttaggtatattattaactgtccaaaaagtagggagaggtaattatggctgttccctaatttatcaacaagttggattccaaatgttcattactgtgccaatgtggaagtaatggttgggttcccagtatggtttgcacttgtagccaaagcaggcagaacatagagtagaaaaaaacattagtcagccaggcgcagtggctcacacctgtaatcccagaactttgggaggccaaggcaggcggatcacctgaggtcaggatttcgagaccagcctggccaacctctctactaaaaaatacaaaaattagctgggtgtggtggcaggcgcctgtagtcccagctacttgggaggctgaggcaggagaattgcttgaacccgggaggcagacgtgtggtaagccgagattgcaccattgcactccagcctaggtagcagaacgagactctgtctcaaaaaaagaaagaaaaaaagaaaaaaacattagtctagaatcaagagatagtctgtgtattgcttttcaagtcacttaaactctctgggccacaatttcttcatctgtatgaagactgctgaattagaataaatgatctttctcagttttaaaattctgtggccacattcaagttggaatcattatatataacacaagtattatgagaaaatatgtttcagatttcaggatgtctgaaacagatctattcccaaatccatgaaagaaagtagaaactttattgccactattgtgactctacagtgaaagataacaaaaaatgaagcacacacttaatgctcaatcaataggggctcttctctgctctctagtagtaggagtagtttcttaagttgtgaggtccctaggattagagattccagctgcaggataagattctggcttcacctaaatatactttggctttggtctccaaaattgtgtattatgaattgaggctttggcagcatatctgccagtagggagctgaagcattccagccttttatctgatacctgttcatttcatattaatcattggggtcagcactacttgtagagtgttttgtagaattgaggcctatttttcctgtgtttacaattatttatatatgtaagtatatatataaattatatataaacaatatataaaatatattctattttaataaaaatgtttgcatatttataatatatttatatagatatataaatggttatatatttataatatatttctattatatatttataacatatttctattatatatatttatatttatattatatatttaatatatttatattataatttatgatatatttatattatatatttatatatatatattttttggagacagggtgtccctctgtcacccaggctggagtgcagtggcatgatcatggcttactgcagcctcgacctcctggggtcaagtgatcctcccacctcagcctcctgagtatctgggactacaggcatgcaccaccacggctggctagttttttgtattttttgtagtggcaggatttagccatgtttcccatgtttcccaggctggtcttaaactcctggactcaagcaatcaggccacctcggtctcccaaagtgttcggattataggcatgagccgctgcacctggctcctcactggctttttgccccgaattcttgctttttttttaaattttttttattttctaagatggggtcttgctatattgcccaggctggtttcaaactcctgagctcaagctatccacttccctcagcctcccaaagtgttgggatcacaggcgtgagccactgcacccaggcgatagagctttctttcttttatcttttttttttttttttgtcgcccaggctggagtacaatggcgtaatctcagctcactgcaacctccccctcccaggttcaagcaattctcttgcctcagcttcctgagtagctgggattacaggcgtccaccatcacgtccagctgatttttgtatttttacaagagacagggtttcaccatgttggccaggctggtcttgaactcctgacctcatgatctgcccgcctcagcctcccaaagtgctgggattacggcgtgagcaaccacacccagccatggtagcgctttctttaatggaggtggcctttcttgacttcagagggaatttaggaattatttaataaactatggatatctttaaaatattcctttaatattcattttaccttgatgaactatttaaaattttgctgcttcctaaaaggaactaaaatattagttcttataattatatttagtggttatctgttattctacattagatttggttaggtgatttcataatcatgtactactgctttacagataaatgcaaagaggttgttggtagaaacttgaattctgggtagaatagctacactgaatatgaactccagttaatttaaaagtcctatgaaattctgaaaacaatgtgaagataccatattaaaactttgctaacaggtataaattaacaaaaaaatacttcatatttattgaggacattgcaagtaatgactgccttcatgtatattattttgaggtaggaaacacagttgttatctctattttcctgagaagataattacaggtccaaataattttaggaactagatcatgtttgttaagtacgtgagctgggagtacatttgtttttctgttcctagacatttgctcttatcctgatttcgctttttatttgttcacttaaaaattccaaaaagggccaggcgcggtggttcactcctgtaatcccagcattttgggaggccaaggagggcagatcacaccctcctggctaagatggtgaaaccccgtctctactaaaaatacaaaaaaaattcagcccggagtggcggcgggagcctgtagtcccagctactggggagcctgaggcaggagaatggtgtgaacctaggaggcggagcttgcagtgagccgagatcgcctactgcactccagcctgggcaacagagcgagactacgtctcaaaacaaacaagcaaacaaacaaatcccaaaaaggacgggcacggtggctcatgcctgtaatcccagcactttgggaggctgaggcagctggatcacgaggtcaggagatcgagaccatcttggctaacaaggtgaaaccccatctctactctctactaaaaatacaaaaaattagccgggcgtgatggcgggcacccgtagtcccagctactcgggaggctgaggcaggagaatggcgtgaacccgggaggcagagcttgcagtgagccaagatcgcgccactgcactccagcttgagcgacagagcaagactccgtctcaaaaaaaaaaagcccaaaaagtggctgggcgcggtgggtcatgcctgtaatctagcactttgggaggccgaggcgggtggatcgcctgaggtcaggagttcgagaccagtctggccaacatggggaaaacctgtttctactaaaaatacaaaaaaattagctgggcgtgatggcgggcccctgtaatctcagcaactcgggaggctgcggcaggagaattgctggaacctgggaggcggaggttgcagtgagccgagatctcgccattgcactaacaggctcggctacaacagcaagaccctctctctcaaaaaaaaaaaaaaaaaaaaaaaaaaaaaaaaaatgctgggcgctgtgcctcacgcctgtaataccagcactttgggaggccgagccaggtgtatcacgaggtcaggagttcgagaccagcctaaccaacatggtaaaaccccgtctctactaaaaaaaaaaaaaatacaaaaattatccgggcatggtggcgcacgcctgtaatcccagctactcaagaggctgaggcaggagaatcgcttgaacccgggaggcggaggttgcaatgagccgaattcgtgccactgcactccagcctgggcaacagagcaagacttcgtctaaaaaaaaaaaaaaaaaatcccaaaaagtaaagacaccttttcctttcaataactttcctattaaatttctagaaaattatccactgctacatgatgattaagtcttatcttaatttaatcattatattaaagtcctaaaagatgtgtttatagccataaggtgaggttctataatgtggatcctaaggagagctttctggagaggtacccgtgattattttcccttttaaaaacaaagataggctgggcgcggtgtctcatgcctgtaatcccagcactttgggaggccgaggcgggcggattacgaggtcagaagttcgagaccatcctggctaacacggtgaaaccccgtctctactaaaaaaatacaaaaaaattagctgggcgtggtggcgggcgcctgtactcgggaggctgaggcaggagaatggcgcgaacctgggaggcggagcttgcagtgagctgagatcgcgccactgcgctccagcctgggcgacccagtgagactccgtctcaaaaatatatacataattttttttaagtaaagagttcattgataattgattagcatgtatataaagtaaaagtgtgaaatggatataatttcaggctttaacacatattaagacagatttgggattatcatacctagtggattatactatttaaagatagatcatttgttaagaatatggggtaggctgggtgcagtggtcacagctgtaattccagcacttcgggaggctaaggtgggcagatcgcttgaacccaggagttaaaggccagcctgggcaacatggtgaaaccctgtctctacaaaaaaaaaaaaaaggaaaaattagctgggcatgtggtgtgtgcctgtagtcctagctactcagaaagttgaagtgggaggatcccttgagccctgggaagttgaggctgcagtgagccgagattgtgccactgtactccaacctgagtgatgggactgagaccctgtatcaaaaaaaaaaaaaaaaaaaaggtgcaaaatggttacctgaaattctagaaatgaaaatttctgtaagtttaacaggaaagttgttgaaaaagaaagttggtttgtttgacttttttttttttttttttttttttttgagatagggtttaactctgttacccaggctggagtgcagtggtgtgatctctgcttactgcaacctccacctcccaggctcaagcaatcctcctacctcagcctcctgagtagctgggactacaggtacacacaaccatgcctggctaaattttgtatttttagtagagactgggtttcagcatgttgcccaggctggtctcaaactcctgagctcaagtgatctgcctgcctctgcctcccaaagtgctgggattgcaagcttggacaaccatgcctggcctgttttgcatttttgaaagaagaaagttttagagtgttaaaacctctcatacctaaagtaatagtttttagaaaactatagtatacatatgaatttagattccaatgtatgactttctttaaattatattaacaaaaattaagctattgggtaatagtatgtgacccagaatgtaagaaaagtgattttttaagtctgcagagaagccaaaagatatcataaaaatccatgtactctacgccaggcgcggtggcttatgcctgtaatcccagtactttgggtggctgaggcaggtagatcacaaggccaggagtttgagaccggcctggccaacatggtgaaactaaaaatacaaaaattagctgggtgcggtggcaagcgcctttagtcccagccactcaggaggctgaggcaggagattcccttgaacccaggagacagaggttgcattgagctgagatcatgcaactgcactccagcctgggcgacagaatgagactgcatctcaaaaaaaaaaaaaaaaaaaatccatgtactccaaagggactctccaaggctctcatcaaaatacttttcattcttgttctaatataattttaatactcttggctgaggccggtggatcacttgagcccaggagttccagactagcctgggcaaatggcaaaaccctgtctttacaaaaaatacaaaatgtagcctggtgtggtggcgtgcacctgtggtcccagctacctgggaggttgaggtgggaggattacttgaggccgggaggttgagactgcaagtgagccatgataataccactacacttgagcctggccaacagagcaagattctgtctcagaaaaacaaacaaacaaacaaacaaaaaaacctcttcagcagtctcatttcaaaacctgtaatttgcagcaaaattagaaaagaaggattgctattggcaggtaaattgacaagaaggcaaagtgatcacaactcatagccaagaaagagccagaaaaatctgtaatagccaaataaatcaaactccatagcactatttggagtaatttaatacagccactcaaagaggctttgaggattttagtaacagtaatcttttttttctgtttagttaagaaaaggttaaactttggttgttataccccatttaggaagccaagaggaagctacttttgcagagacgtaaagaaattcactaaaatgttaaatgttgggattatgagtgacttttatttttctgtcttttataattttaaaaatactaatattggatacttttataatttagaaaaaaaaattgatgtttaaaagcctgaaaatgtgtacagaaatgtttctaccaaagctttaatttaaaggactaaatatcatctatatagaaataatatatttaggctgggcactgtggctcacgcctgtaatcccagcactttaggaggccgaggtgggcagatcacctgaggtgaagagtttgagaccagcctggccaacatggtaaaaccccgtctctactaaaaatacagaaattagccaggcatggtgacaggtgcctgtagtgccagctacttgggaggctgaggtaggagaatcgcttgatcctgggagacagaggttgcagtgagccaagatcgcaccactgcactccagcctaggcaacggagtgagagtcggtctcaaaaaaaaaaaaaagactacatttatataaaaatattaactcctcaatatttgtgcgttcctaaagttttactagttatgtctatctggctctatttctgtttgtctgtcatctatgtctattttctaaagatttgttaaaattaatcttgcaaaatagttccacatacttttcactctttagccaagcaactaagaaatagaacactatttgtactaggtgtaaaataacaagcaggaaactaccttaaggctatgaaaaactgagacattaattggatttctgcagtgatttaaaaaataatatgttgatacaaaattattttacttacagatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaaacttgt

SEQ ID NO: 660 - DNA, 7394 bp, Homo sapiens
gtggcaaccacccacgagcccgcgtcggtgcccgccccgcagggggacctactatccggcgccgagccggaggggggaaacggcgcccgccgcccgcccggagcccgcgagcaaccccagtcccccccacccgcgcgtggcggcgccggctccctagccaccgcggccccaccctcttccggcctcagctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtccggtggagtccgcggcatttacggtgccggagctcgggcccgggcggccttggcttggccttggctcagcccctcctccctcggcttctgtctgtggcctcgtggcgtctgggccgtcctgcccattcagtccagggaacgacccggacccaccccgacacccccagcccctgccctgacccagggagttagttggatccccggatacccatctggggccgacactggcagtctcagagcaggctttttgcaaacacccctcagtgctggggagatggtgaaagatcacgcctgccggattccgaatcctttctctccttaagccaaattttagccacttccaattacaaagcacagtatgtatacttcaaacttaagtggtgaacttaggctccgctccttatgggttttctaatgttaatttttagaatctgggtccattagctgtttagagcaaatattgttatcctgtagtccaaggagggtatagataagcatgttttccaagaaaagggtctggagctttcattagattctcataggatttttaccgtcaccaaaatcagattcagaaccacttctctaaaaatatggctctattctctctcccatcctcaggttagcttcttgtaccttccctcccctagcaacgcccctttaaagaagctaagttggaaatggtctctttcctcaggtgtattttgacctacgaattggagatgaagatgtaggccgggtgatctttggtctcttcggaaagactgttccaaaaacagtggataattttgtggccttagctacaggagaggtaagtggctggagcaggggtagtcaactcacatgaagtgaaattggcactggggatggcagcaaactgacctgcagagttcagccgatctgtagcgtggacctcactgagcaccgactgcctgttgccctgggaacacagtattgccctttcttaagagtaatggggccctgaccaggcacagtggctcacacttaaaatcccagcacttttggaggccaaagtaggaggattgcttgagcccaggagttcaaggccaacctgagcaacatagcaagaccctgtctctacccccgcaaatttttttttttttttgagacggagtttcactcttgtcgcctgggctggagtgcagtggtgcggcctcagctcactgcaacctccgcctcccgggtttaagtgattctcctgcctcagcctcctgagtagctgggattacaggcatgcgccaccacgcttggctaattttgtatttttagtagtgacagggtttcaccatgttggccaggctgaactcgaactcctgacctctggtgatccgcctgccttggcctcccaaagtgctgggattagaggtgtgagccactatgcccggccaaaaaaaattttttttaattagctgggtgtgacggggtgcacctgtggtcccagctacagctactcaggaggctgaagtgaaatggaggttgcagtgagccatgttcatgccactgcactccagcctgagcaatagagtgagaccctgtctcaaaaaaaaaataaattaattaaaaataaaaggccgggcgcagtaactcatgcctgtagtcccagcactttgggaggctgaggcgggtagatcacctgaggtcaggagttcgagaccagcctggccaacatggcgaaatcctgtctctactaaaaatacaaaaaattagccaggtgtagtggtaggcgcctgtaattccagctacttgggaggctgaggcaggagaatttgttgaacccaggaggtggaggttgcagtgagccgagattgccccactgcactctagcctgggcaacaagagggaaactccatctcaaaaataaaaataaaaaataaaaaaacaggctgggcatggtggctcacacctgtaatcccagcactttgggaggcggaggagggcagatcatgtgagtttaggagtttgagagcagcctgggcaccatggtgaaaccccatctctactaaaaatacagaaatcagctgggcattgtggtggcacatgcctgtaatcccagctactcaggaggctgaggctggagaatcgcttgaacctgggaggtggaggctgcagtgagcggagattgtgccattgcactccagcctgggtgacaagagagaaactctgtctcaaaaaaataataataaaatttaaaaaatgagataaaaaagagtaaggggtccagagcttcctggggagacttcacctagggtgagggcagtgggttttaaggaaacaacagtgccctatttcagtttatattaactttccattgagccagcaggtgacctttcttctcagttttcttgtatctgttcttatgattggaagaaatgaggggaaaagcattatgtgatgtagaattgtataaagcttgggaattgtatggaggcagagggatttccacatctgtgtgtaccatgcctgtcctgtggcgcctgcccgctcacttagtagcacactgaacagtgaaagtggtcagcagtggtgtctcttctgcgagcaggagttgtggacttgttcctgtgaggcctatttaatgtaatgtcttcctgctgccccataccacctccttaccttctcttccctttttctagaaaggatttggctacaaaaacagcaaattccatcgtgtaatcaaggacttcatgatccagggcggagacttcaccaggggagatggcacaggaggtaaccacaggtcctctgggccaaggagtatgtcagtgtagcctccacagtgggagggccaggttctgctggggagaccaggcctctttcttccccagctctagaggcaggcctacttattacttacctactttgagaccagcggcacccttctttgaagagggaacccagtacaaaggagagagaataatggggtggacctgatggtagatctaagagaatctctcccaggtgaccgtcctgctgatccaggcctatagcctggtgacctttcctgatacctcttcagaatggggattggggagagaggcgtgtggaagcaaagtgaagacatgtgggtacgcgattctaggtcagatgcccaaagcctgtccaggctaccctggaagccccagcaagagtgagagggccaggcgtggtgactctgtgatcccagcactttggaaggccaaggtggctggatcacttgaggccaggagttcaagaccagcctggccaacatgttgaaaccccatctctactaaaaatacaaaagattagccgggcgtggtggcacgcgcctataatcccagttacttgggaggctgaggcaggagaattgcttgaacctgggaggcggaggttgcagtgagccgaaatcacgccactgcactccagcctgggcgacagagcgagactccatctcaaaaaaataaaaaaaagagtgggagcagttactttccttgacagtctttcaccagagaccactctgtgagggccgaccctcaccttggcattaacttgcacacataggacagaaagacccccggacgcctgcatgagtctcactgagctcaggtacagcctgctgctcccttagaacacagctcactcctcgatgagtgtctatggggctctgtggtgggggttgaggatgtgaagacccatggggcagtggctcccttttacttccaacaactgaaaatgtacaagtgagccatgatgcagcgtttaggactcaggctcacaaaggagaccaaagaactgtatttgtggagtcagacgcagttgggctcgatccagtgtctgccaccttcttgttttgtgacctcaggcaagtgagtccttggagcttcagtttcctgttctgtacagtgagggtggagagagttgtggggccatgaggattgggctagatctggagtgtgaagtgcctggcatgcagtgagtgcttagtaagtcagccattgttgaagtgctgacaagcagagggatcccctcaggccagggaacgggggaatgaccttgcggatgtgaggaaagatttcagtggggtcctcaatgaggagaatttgaacgggcagaaaagaggcagggttagggcatgagcccggtgctgttctgtggcaggagcttggccaaaggtggggtgaggacatctgtacccggagtgcagagaggtgggtgatgtcctgcagcctgggcttcggcctgcagggagtcagggccacagagctgagtaagaggatgacccctcacttggggtgccaggggagtcatgtggtggcagatccaggatgtggaggctagggcaggcaggctgctgggggcattggtgccactgaccctgggcagggagatttggacctgatcctgaggtggctgagagcagagattcgagagcagaccaccttggtctgaactctagccccgctgttgctctgctggggctccttttattctctgtgcctcagtttcttcatctttgaagtggagttagctcctcctcatagagtggattgttaaatatgtaagatgcttggaacagtctctggctcacactatgagcaccctaagcactcgcctactgcagcggtggtggtgggaatggaaagaaagagtaagtacatggggagtgggtagggacaacctgagccacgtgcagaggaaaaggggtcaaaagaataactgaggtctggagagaaagatgacaaggtatgttgagtttaaatagaaatgtccatttgagtttggaacccctgtatcttgagagagtggctggagctaaggatggagatttgggggttttctggataacaactataatcaaaatcccacagttggctcaaatgggggaggcttttagccagcactccagccaggtctcactgcacatgtggcagagtccagtctccccagcgtgggggtgagaggtggagcacaggcagaagcaccctgtccccaccagccagagtctggtcattcttggttttcagtcatcctacctgctgcccaatcagaaacatcttcctggttggcatctgtctaggacagtttcccagctcagttccattctgtggaaccacaggatgaaggtaggtgcagtgagaaggaaaaaagagttttgcatgcaaatatgtttgaaaggtgttagataaaacaaaatgaaaatgaccccatttttggctgagtttcttggggcctcatgcacagtgtcagtctccaaggggtgatagggaaaaagaagggtttcggtgttcctcgtggaagcagctttggaactaggatctctgaaatggcatagagatcactccggattgcccttaccatatccccaagccccacgtggacagacgcgtcacacacactcacagctgtcttttattcctgttcattccttgttaagaggctttgactctccagaatccaaggggcagcccctcttttctgcccctccccacacatctctggctgctttctcctctgcagctatgcctgtgtcttttgtgctcataggaaaacaggctggtcagccacagcagtcctccttttctggagagttccgaccctgttgactcccctgcatcctgcacggcacttccctccaccaaagtccctccgtggcaggcctgggccatagctaaggggagctgataacatgcgccttatttaaaagccacaaaactatcttctcaaagtaatccttctgtgagctgttcaccacatcagcctggcctgatgccccacttggcctcagtcagcatggcttggctctgaggccagaagataggaaggacgctgcttttatgtccttgtagtccactccagcctagcctggcacagaggacaggttaagccccctcagtcctggccccgaatgtctgcttggtttggcgcaatccagcgcccctgacctgctctgtcttttttcccaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggtgagttgtggaagcaagggctactactgggcaatcctcaccggggattcaacacagaccccagggcaggagctccatgtgtccatccctttcccaaaaggacccaacccacagatgcagcccagtgctcctgtccagaataaaccctgtacctccatgcctccaaggttctaaattcttccagccccctcagagcccagccaggaaggctgcacaactgccagagcctccctcccctccttcactcagtgacgtgctggtcccacccctgaggtatacagagtgcagctgaacgcaatgtccctgagaagccacatgccctggtcaccctcttcctcctcctcacccttggcccaacctgggtcttacttcaaaggaacaaaattcctgtaccccctcgtcaaatctgcattctccctgctctggccaggagtctgttagaattttggtgcctccagttttgtgtgctgttgatcacttgtgggtcttagccctcctgagccatacgctggggcctttctcctgagcggtggacctcctgatccaccatgccctcctgcttccacctttcttttccaggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttaatatataa

SEQ ID NO: 661 - DNA, 12712 bp, Homo sapiens
gggctctatgaaggatcagagggtgctaaggaggcacagagaaagagcttttaacgtgggtattttactgttccagggttgccactcaagtacctacagaacaaacgggtgtagctgtaaactgtggcaaactgaaagcatgtaggcacagagtaagtagctagagctgatttttttcaggaaaggccacaaatcccaacttttatgagctcctcttttaaatgctgtaaatgttttacaatggcggggcgcggtggctcacgcctgtaatcccagcatttgggaggccgaggggcagatcacttgaggtcaggagttcaagaccagcctggccaacatggtgaaacctcttctctactaaaattacaaaaattagccgggcatggtggtgcatgcttgtaattccagctgctagggaggccgaggcgggaggattgcttgaacccgggaagcagaggttgcagtgagctgagatcgtgccactgcactccagcctgggcgacagagcaagattccgtcacacacacaaaaaaaaggcgtggggggaggccaaacaaaaccccgcaagacacatttggctatgacctgccagtttgctaggcattcttccaaccttccctccctctgaccaagaaactgagtgtccactattttaggccctgggaaattcagtagcgaggaggccagacagcttcgttgcatcatggggggctctggtactgtgcttctccaacttcaggatgtgtaggaatcacctgagcagtcttgttgagaggcggacactgactcgggaggtctggggtagggcctgaacgtttgcctttgcggttctaacaagctctcaggtgatggcgatgctactgttccctggccccgaggtagaggaagatttaagtaaaagcttcctggaggaggcgcaagtgaaccgcaggagctttcccggacgcccgagaaagggagaaaccccgaaggaattcctcctctctcggggctgggtctccgcatccacgccgggtttggtttcccaggctatcccacgtgttcgggcgtccgtgtcaatcaggttttccccggctgggtccgggtttaaaggctgctgctgcgcagggcgctcccatggtgccgcgcggcgggcgggtttggattttaaatccccgcggccaatcagtggcgcgcaggcttttgtaacgttcccagcgccgcgtttgaattcggggaggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggagggtgagtgtcgctgctggggaactggaactgcctgcggggcagttggagcgcccagacctggagctgctggaaagagtacccagcaagggagagcctgggacttggagctgctagagaagggtgctgggagcctcccgcttacgtatggaaagtgtctttggtaagggcttcttggctctgggagctgctagaggagggggttccagtgaagtggagtctgagtcatgttgctgatagggaagtcagcttctggacgcgaggtgctggggggaggggtgctggtaatggacgctagggccctggagtacccagggaggagtcccaggttagtgatgccgcgccctgggagcttctggggtggagctgggtcagtgggggggtagttggagccagacttcgggccttccgggggagatacgagtcaggaaagggatctggtgctggggactcggagcttccggagtggggctgagagaggacccccaggtaaggggggaagctagtaggagaaggggtgctgcgaatggttgtggacagtgttaaggcagggtccagatgccgctgtgctggagaaggaatggggtgggggcatagggaaggagagaaacccaccaagacccctctttcatcccttgggagtccagagtccagtcctgtgcttcctttgcctggtaaccctctcccttccccaccggcctcaatccacctccccatccctcctgccctctccttcccacccacagtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggtgagttgctgagcctgcaggggtgcttgacatcactacaagaggctggaatttggaggaggctgggagaaaggaaggagacaacccacaagtcagtatcttgcctacagatgcattatttttttgtgccccaatgcaatattttttttttacaaagaatttgaatttgtttttattttttaaattggaaggtttgattgaacaaaaagtttgattcagaactccttttaaacaggtgaaagcttcagtaatacgaggacagcattttcttagggcagccctttgctgggctggaaaacagctgtccccttcagacttctttgccacagtctctactcctccctattcttcacagacttgccaagtcttggaggttaacttgcttgatccttgaaggcattggagttttactatccctgtcagttcctgtttcaaagcatagcccctttctaaaaggaggggtgagaagtgtcactggaggcacctccctggtgtcagcatgggaggaagattcctgggcaagccttgctacatacaaggagcagaggcttgtgggatcagatggccctggttctggatggtcaaaccttaactagccttctgcattgacagatgtcagaggctggcatctaagtaccaactcttcctccctctgtcccaggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtaagttgggagttgtctctggaccaacctggtctcagcaggggcaactttgggacatcctacctggctgaccttttctgtggacctttcggcctgctttacagaaagcctactccaagggacaagtcatccccaaacaaagcctaattgtcatatctttccctgtcactggtgtatcctgtcggatttctgcagcctaggtcatgggtacagcggaggaggaggagggagagtctccacaaccttactgtagtcctttgctagagttgtccacagggcagcatcaccatcatctgggaacttgtatacacaatctcaggacccagactacttactggatcagaatctggatttttaacaaggtcccttggtgattcccttgcacaataaggtcttaaacaccgatgagcattagcatggtgggggaaattaggccaggagttacagatggaaagatgatgtgccagtggtctgtctggattaagaccatcagcagcggttggtggcaggcagaggcttgggccttttcaggtgttatctttcttgttttgggcctaggtactggagagttagaaatgagttgtagcaatggctttcatacgtctttgcagtggggttttttcaaatgaaaacttgaagacttaagtacagaactgctaaaggtggagctgcttctgtaagcgcaggtagccctttgacctgttttgcatgacaggcagcatctgaggcccttgcacagagtcctagatgaccacaggctatagctaaaaaatcactggcccttaagaatcctggtctcaccatgtgtattctgctgagggcttattctagccaatgtcatggcttctggggctgctcagtggacttagggattgtcttcaggggccccagagttagagtgagtgtccagaggatgcctgacctttgttctgaccctgagatgatttctctcatgtctgggttgtggctgggagactggtgccaaatcctaccttgtgcttacaggtataccttgttagtgggcaaaccaccttttgagacttcttgcctaaaagagacctacctccggatcaagaagaatgaatacagtattcccaaggtgactaatgatgctttaagtttacatttattttgttttccccagaagctgtttatggagcccagcaatatcctaggaccagaaataggtctatcccacctctaaggtagccacagagcttgagagggcctgtgtctgaaattgcatacagaacttgacatgtatgtgcacataagcattttttctagggggagagagttggcagattctcaagagattgggtaacccaaaagttgtgtaaaaagcaaaaaacaaaggaggtaggaaggagtaggaggcaaaagtgcttaatctttagaaatggtttatcttaattcaaatggattctgccacttagcgagatcacattgggcaaatggcctgcatcttttttttttttttttttatttgaggtggagttttgctcttgttgcccagtgcagtggcatgatcttgactcactgcaacctccacctcccaggttcaagcgattctcctgcctcagcctcccaagtagctgggattacaggcacccaccacctcgcctggctttttttttttttttttgtatttttagtagagacggggtttcaccatgttggccaggctggtctcgaactcctgacctcaggtgatccacccgccttggcctcccaaagtgctgggattacaggcgtgagccaccatacccagcctggcctgcatcttctgaaccatagtttccatatataaagtggagttcctgccttggagcacctcacagagtgccttgcatgtggtgagtgctctcagaattatgaatcactgtgaatcccagggcttcctaatggcatagttgtgtgcattttctttttttttttttttttttttttgagatggagtctcgctctgtcgcccaggctggaatgcagtggtacaatctcggctcactgcaagctctgcctcccaggttcatggcattctcccgcctcagcctcctgagtagctggaactacaggcaccagccaccatgcccggcttcttttttctgtatttgtggtagagacagggtttgaccgtgttagccaggatggtctcgatctcctgaccttgtgatccacctgcttcggactccctaagtgctgagattacaggcgtgagccaccgcgcccggccatggtgtgcattttcacaaccaccaacagaaatacatttaaaggaatagctggttcctgcagaagcctagcacacagccagtttgaagtgtagtgtccttgtgtgaagccaggaggcctgtcaccataaggacagacatagtaaatccatcacaaagtgtcagttcactgtcagagacagcatggaatcaagccagctagacaaggccttcaccctctctgtgcctcactttcctcctctgtgaaaaagggatgataatagatccccaccccttagatgagttggtgagggctaagtgagctaaacacaggagtgcttagaatgctttcctggcacatagtgagtgctaggaaagtgagttggtgttcggccacagtccattgacccttctgtcaatggtgctcagtaaagctgacagtggagaacttggcattgaaccaagttgtgaaccactgacctgtggtgtatttgagactgggggctgcatgtgggctggggacctgcagctcctttgaggccgtactgtactccaggtccccttcacattctgcttatggctgtccctctctctgccccagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggtacaacaagggtctgggtaagagagcagaccccccagagaaagcccaggttgtaggggtgtgtgcagcttagtccctggccctgagagctcaggtgtggagtaggacaggcctctgtccttcaatccgtggttccaatgcccatctgcttctcggccctgccaggaaagactgaccttaccatggctggataaacgtaccatgcccaagaagaagaaaatggattgaatgccaagcctgaaaaattctttcaaatcactttaattaatttaattttttggagacagggtctctcctctattttccaggttggagtgcagaggcacaatcacagctcactgcagctttcaactctagggctcaattgatcctcccatctcagcctcccaagtagctgggactgtcaggcatgcaccaccatgcctggctgacttttctaatttttgtagagacagtgttttgccatgttgcccaggctggtcttggaactcctgggctcaagcgatcctttcacctccaccaaagtgttgggatgacaggcatgagctgctacatctggcctttaaaaaaatttctaacactttttcatgattcattgaaaaacataaaaatttccttttttttgtggcgtgatcccggctcactgcaagctctgcctcccgggttcacgccgttctcctgcctcagcctcctgagtagctgggactacaggcgcccaccaccatgcccggctgtttttttgtatcttttagtagagacggggtttcactgtgttagccaggatggtctcaatctcctgacctcgtgatccgcctgcctcggcctcccaaagggctgagattacaggcgtgaaccaccaggcccggccttttttttttttttttttttttttttttttttttttttttttgagacagggtctggctctgtctcctaggctggaggggagtggtatgatctcgatttcactaaggatacatagttttaaaaagtcacttgaaatactttttttctctgtggatatatcaccaatttgatgtacaacttcagttcatttttcagttttcaatttttaggtattggtttttcttaaacttcattttggaataattttaggcttatacagaaaagttgcaacaacaacaaaaaactccccagagttcctacataccttgcagcaattattacagtggaattttttttgagacaggtctcaggacttgctgtcacccaggctggaatgcagtggctcactcatagcttactgcagccccaacatcctgggctcaaacagtccccctgccttaccctccagagtagctaggactacaggcatgtgccaccatacccagctaattaaaaaatttttttctttgggaggccgaggtgggtggattgcccgagctcaggagttcgagatcagcctgggcaacatggcgaaacgctgtctctactaaaaatacaaaagactagccgggcgtggtggtgtgcacctgtaatctcagctactcgggacactgaggcacaagaatcacttgaacctggaaggcggaggttgcagtgagccgaggtctcaccactgcactccagcctgggcaacagagcgagactctgtctcaaaaaaaaaaaaaaattttttttttgtaaagacaagatctcactatgtcgaccaggcttatctcaaactcctgccctcaagtgatcctcctcggcctcccaaagtgttaggatttacaggtgtgagccactgtgccctgcctagaatgatgttctaatggtaatttttcttttcctcactttttttgcatttaataattggaattcttctgtaaggaagagctgttccttctctccgattgatttatttatttggttatgtctgaaatagactcatggatatttttattctttgggctatattttaaaggattacttatttctctgcttttatttatttttttaaatttgagacagggtcttgctctgtctcccgggctggagtgcagtggcacagtcgtacctcacagtagctttgatctcctgggctcaagtgatcctccagcctcagcctcccaagtagttgagactttaggcatgtgccaccgcgtctgaccaatttttaaatttttggtagagatgaggtcttgcccacactggtctcaaactcctgagctcaagtgatcctcctgcctcagactcctactttttttctttcagttttaattttttatatagcattttaaaaacttaaggaaattttcagttacccgaaggtggagagaactgtatgatgagtcccatgtttcatctatttttactagttatcaacatttggacagactgttttatttattccagcctcctgccttttttgttaccggtgttttaaaaaattattatttactatttattattatttatttgagacattcttgctttgttgcccaggctggagtgctgtggcaagatcatggctcactgcagcctccacctcctgcgttcaagtgactctcccacctcagcctcccaagtagctaggactacaggtgtgccaccatgtccagctagtttctgtatttttagtaaagacagggttttgccatgttgctcaggctggtctcaaactcctgagctcaaacaatctacctgcctcggtctctcatagtgttgggattacaagtgtgagccactgggcctggccttgctggagtgtttaaagcaaatccctaatatcttattatttcatacccaagtccctatcatgacatcgttttttaattgaaaacttaaacattttatattatacaaggagaattagcacatggtggtgggggaataaataaataaggaaaaagacaataagaataatctgtgtttctactgcccagatataatcagcgttaaaatttcatgttatcttttcaagcttttttggttataaataagcatataaagcaaattttggggtggaaaaaaatttcttgtgtttttatttaaatgcctactgaatccattctgtggatgaactgaactactcagcccttccatctgcctggatgctgaagatgctttccattctttgctcaaagctgggcagctctgagctgctggtgccttcaagctgtttgcctgagtggcaggtcatcctgcagggccacaccgttgggtcagaggccacggcttctgaagatctgttgcctcacagtgagcactatgtgcctgtcacctgagcatggcagctgctgctctagtaaccaggcactgattcagtttccccaaagcagtggtagctaagagaatttttctttcggaagagtttcagctgtggcaggggagtcccgtgcccttcccaacgcccctgtttttgtcaccttcctaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaaggtgggtactgcggggccctgggcggggcaggattgcttggggcatctggaaaaggcaggaggaggcttggccaacaaagcactggtgacttgttcaggccctgtctgcataggaccattggtttccccatttcctgatatccaaggccctgcttccgtggctcctgccgccttttctgatccgtcttttttactctagcacctcgatgtgccaccttcatacgctgtttcttttgctcagtaagttcctattgtatcttcaagacccttgaaataacagacccagatgtactgcagcctcagggctttctccctggtcctggcacgaaagcacttcttccagacaccacatggctcacactgtggcctccttcaagtgtctgctccagtgtcagctctgtgagcatctccctggcccctctgctggtgcttctcatcctcttgcccactgcatagttctccataacacttctcacccaacatagtccaacatgtccttctttgtttattggatttaaattaaggggtttgttgcatgcactgaacgtaacattttgatgtgtttgcaactggcttctgtcttcacagtttcttaattactccaaactggaaaactagatgcctctgactcttaccatgatagaagtcactgatattttgcccatacttaaattgattagtctttgcccctacaaccacagtgtaagctccgtggaggctggggttttgtctgttgctcactgaacctgcaacagtgcctggcacggtaggccttcagtaaatgggtcagtggaatgaaggagtgagtggaacttggtgcgctgtgctgagactttctctgcagagatatctgtgctgctgcttgtctgagcctgctggcagcagaggccctgctttgctcttctctggggccctaggcctctcaactgagcccaggtggggtgcccagcaggcttccctgttccctggtgtgggccacatgtgtggagcagaggggaagaggctggtcctgaccaactaactgtctgtctgtttctgtctcagaggaggctgaggatcctgcctgcatccccatcttctgggtcagcaagtgggtggactattcggacaagtacggccttggtaggtttcttccagaacaggtgggtgactcaggcacagccaggtgaccttttcagttgttacagactctggcctttttgagctcccaggtactgttctcagtgccctcctctctccatcccaggcctcccagttccagctcccagtgctccctgactccccagctttttttttttccagagacagggtcctgctctgtagcccaggctggagtgcagtggcacaatcatggctcactgcagcctcaaactcccaggcccctaagtagctgtgactacaggcgtgcaccattatgctcagctaatttttaaaatattttgtagagatggggtctcattacgttgcccaggctggtctcaaactcctgggctcaaacaatcctcctccctcagcctcccaaagtgctggaatcacaggcatgtgccaccacgcccggtcccactccccactttctattccccctttctgagacctctctccaccgatccctagggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaaggtgagtgccgtccggcccatggggggtggtgttgcagaagtgggacctgtgctggaggatcagactctaattctggaaccccttacctacttttcatccagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggtgagctggaggtcaccaggcgcaggagagagctggggtaggctccgcatgcctggcagtggcccatgtgggttgaatgtggagtgagcggctcaggtacctataacctgttgtgtcttccctctactccctaacatacactggcctctgggatcgccaacccctgctgctcttctcttgcaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 662 - DNA, 26888 bp, Homo sapiens
gccgggtttgggggttgggacctccggctgcaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgccccctggtgagtccattctgccgaggcgggggaagaaaggcggggctgggccgggggcgagagcgcggggaactgttgggcctacgcagcgccggggcccttcattcctgtgggcccctgctgcggcgggcacatttctcattcccgggagctggaggcgcctcgccgagagcgggggagtcggtgctgatcggcccaaggaaaacccgaaggctgcgctcacgcagggcctcatccttatctcggtgctcttgtggcacttcctatttgcagagggttttgccaccccttcccccagtccaatatgtagctatatcttttctgcgtgagtcagtattaatgctcctccagtctacagactaggcatcccaaagccttgtagtggaagcggacgtttcaccaaatgcagaagtcctggatccctagggtatttcctttcatcttacctcacgccgcacagccattggtttctagccaaggtcactgagtggctgcagaatggtcgtaagtgctttcttgaggcaggtaatttgtccgtcacatggtgtacagtttctcccttcagctgatcacttacatctcagtaccggcagatacctctgtccaaacgaaaggagtacgtgaacaagaataattccatcagaatctgtccatattgtctgttttaaatagcatttctttaaaatgtcaaaaaagactccaatgagaaaataaccaatattgattacatactccactttagggtgacttaagtgatcaagggtgtaaattccttagatagaactaactcgaaataaaaaactgttggggagaaggaagagcaaataagatttctggcccagtcaacttgagtgtttgttttttttttttatttgtgtgtgtgtgtgtttttaaacctccagatcattaccagagtaaacagtgattcctttatcctggggatagctctctatatataattcaatatatataattacagtacttaatttttcccctcctggcacagtgacccttggtttaatactatccgtgttcaaaaatgtcagtaaaagttgtgtataacttttatttgcttcagactcaggtcttcccttcttagcctcaaacaacttgctaagggttacacgaaaaaagtcctgtagtaaagaccacctgaatcagaatgatgtgctagagatggcaaattttgtttgcagcttggacagattttgtgtccagggcatttctggggctaactggcagtacagattacacatatagatagttcttatacatctctggaactcatgttctctcttaggaacaactcttcccaattatataatcatgctgttagctttgagggggtgtcaataatttgtaaaaactgggggtgtcactaagtttgtcagatctgagtgatgctttttactacaggggtcatgcaacaatttaaagtaggaattgttggagaatagtgggccactagaatattagtttaaaaaaggaattttggggctgggcatggtggctcccgcctgtaatcccagcactttgggaggccgaggcaggcggatcacctgaggtcgggagttcaagaccagtctgaccatcatggagaaacccccgtctctactaaaaatacgaaattagccgggcatagtggcacatgcctgtaatcccagctactcaggaagctgaggcaggagaatagcttgaacccaggaagcagaggctgcagtgagccacgatcctgccattgcactccagcctgggcaacaagagcgaaactctgtctcaaaaaaaaaaaccagaattttttatttgaattgaagggggtgtttcctactttaaattgttacacgtgctaccctaaaaactacatatcccatcaggcactgactgtcccaagaattgggtggatctctgctgtggtgtctgcttttaattggtttaaaagaaaaagtcatcctccacaatttcagcaagaaagatgagttttctgaatgagcaatttggagttaaagaagtctcctgttgaggtctttatttcttcacattccactacattttttttgtgtgtgtgtttgtgtatttttttttttttgagatggagtctcgctttgttgcccaggctagagtgccatggcactatcttgactcactgcaacctccgcctcttgggttcaagtgattcccctgcctcagcctcccgagtagctgggattacaggtgcctgccacaatgcccagctaatttttttgtatttttaatagagacagggtttcaccatgttggccaggctggtctcgaactcctgacttcaggtgatctgcccaccttggcctcccaaaatgctgggattactggcatgagccactgcacccagcctgtttttttgtttttgttttgttttgttttgttttgtttttgagacagagtcttgctctgttacccaggctggagtgcagtggcatggtctgggctcactgcaacctccgcctcccgtgttcaagtgattctcctgcctcagcctcctgagtagctgggattacaggcacgcaccaccaagcccggctaatttttgtattttagtagagacggggtttcaccatgttagcctgatggtgaactcctgacctcaggagatccaccctcctcggcctcccaaagtgctgggattacaggcgtgcgccacctagcctggcctctgtatttttatttattaacatttcagctggaaatgttttctgactgctatattcctttgtacagttcagtagtactatcttacaagaaacagttaaaaaatccttagtaagagtaaaatggggtctggccctgttgtgcattcctgtaatcccagcagtttgggaggccaaggcaggcagatcacttgagatcaggagttcagaccagcctggccaacatggggaaaccccatctctactaaaaatacaaaaattagctggacgtggtggcgcacatctgtaatcccagctatttgggaggctgagttgggaaaatcacttgaacccaggaggcagtggcgaggtaagagaccagcctgggcagcatggccagaccccatctctactaaaaaatgacaaaaattaaccgggcatggtagcacacgcctgtagtcctagctactcaggaggctgaggtgggaggagaagatcacttgagcctgggaggtggaggttgcaggaagctgagattgcaccattgcactccagcctaaatgacagtgtgagaccatctcaaaaaagaaagtaaaatgggcttttttttttttaaccttattctcgtcacaaaatagacctatttaagcaaattctttttccgctttcatgtttcaagtgaaagtgaaaggtgaaagcttgctttgcttgctttttttttttttgagacagtctctctctgttgccaaggctggagtgcagtggcgcgatcccggctctgcaacctccgcctcccctgtctggctaatttttttttttttttttttttttaagtagagaccaggtttcaccatgttggccaggctggtcttgaactcctgacttcacctgaatcacctgcgttggactcccaaagtgctgggatttcaggcgtgagccaccgtgcctggcttagtgaaagctttctttgcagttgattttgtagactaatatttccattatggagttaatctgctatatatttttaaggataagagtatctgaatttctctggggaaataacactatttaaatgtttggaaatgtccgaaaatttattgattagtgttaatatgtaatattaagtccttggccgggcacggtggctcacgcctgtaatcccagcactttgggaggtcaaggcgggtggatcacgaggtcaagagatcgagaccatcctggccaacatggtgaaaccccgtctctactaaaaatacaaaaagttagctgggcgtggtagcaggtgcctgtagtcccagctactcgggaggctgaggcaggagaatggtgtgaacccaggaggtggagcttgcagtaagccaagatcacgccactgcactccagcctgggcgacagcgagactccttctcaaaaaaaaaaaaagtcctcaacatctatttatgctatagatgtgtatgctaccctctaagacagtagtaataaataatggctgggtgcaaaggctcacgcctgtaatcccagcactttgggaggccaaggtgggcagatcacgaggttcaggagtttgagactagcctggccaacatggggaaaccttgtctctactaaaaatacaaaaattggctaggcacggtggcaggagcctgtaatcccagctactcaggaggctgaggcaggagaattgcttgaacctgggaggtgcaggttgcagtgagctgagatcatgccactggactccagcctgagtgacagagcaagactccgtctcgaaaaaaaaaaaaaaaataatatatgtgctaatttctttacttgtaatccccaccccgagttgatcttttcaacatcaacatttagctcatattttttttttccttccctggacaactaactggttgatcctgcctctctattggcatctaataatactgtgtcacccctgccagactggtgttcctataaggaaaggactataccaattttcttatcaaagacacttgataaggcacttatcaaaaagtacttgacgcatggcacacatgatgaagtgatgattatgggtgaatatatgttggaattcattatcaactgccaggtgccatccctgaggatagatagaattaattgtgttttaatattttctaggggtgggtgaaagaagtagtggttaatcttgaaggatgtatgttaaccaaccctgatttcccttaaataccacctgagttccattcctgctggatttgaagaggagagtctcctccagcctcattgaaactctttttgtggatttgatgaccttatggatattgccaaagtttaaggcagtggattttagtcccagccttgcagcttacacacacacctggttgctccccagatttctggagattctcattcagtaagccatgcatacttttgttgttttaatgctctgtgggtatttttgataagcatctagagttgacacctactggcttgacctagtaactattgtatgtgatttttttctcttaaaatgtttgaagatagttgaaacaattaactcataaatctgttgcctcagccttgacaactactatatattcaacagaaatctctcatctgtctcttctttattctcattgctgccattccggtccaagcttttattgtctgccatgtgaaatatattatcttctagatggctttactcttgtctctattttctccctttctgtcagtctttgacattgctgattgacgtagtcttagtacacgtgcacgcacatttattatctcacaaaagccctttacagttctctgaatgcatcatgcttactggtattcttttacgtttgctctactatctccctcatcttaaataccctgccctcttctctctgaagcgttaaatccttaaagacccagatccaattgttactccctttaaaatccatttactatgcagtattaaaggaatacagaggatataatgaataagaccctatttcacacacataagataccactgattgtgagaggaactatcttgtgtctcactgagaaagaaatactaccactgaaactataacatgactgcaaaatacatcttaatatcaggaaaaaacaatgaatctgaaatacagcataaggaatagcatttgtttgcactcagtctgaaaaacatagccagtacatttgaagtcccctatgtgcccctttaccatcttatacactcctttatcttgaatttggtatttatcatttggttcttttatactttaataggccgcctgaaggccttggagaataagctgttataatcctttattttaaacaagttttaggtgtacaatatttccaagttatccatcacttgataaaattacaccattgactattgaaatatatctgctcaagtttcttctctattatatttctatttttgctgtctacgggaaggttacagaactcaccttctcaacgtgatccctctgcaaccctttggcttttgaaaaggtgatgtacagctggtgctagctgtatatacactgattaggattttctgggcagaggagccggtgcttctggtggccctctgggaaaggtattctagtttacatgttttgttatcacttctcatggctaggtgaactatgtagctgtaaaaatcaggcctgccatctaaaagacttaatatcatacttgagacattacagggtttcagtcacaattttgtgtccccacccccaccccgagacagagtcttattctgtcacccaggctggagtgcagtggcgcgatgtcagctcactgcaacctccacctcccaggttcaagcaattctcctgcctcagcctcccgattagctttgattacaggtgcccaccaccacgcctggctaatttttgtattgtcagtagagacggggtttcactattttggccaggctggtcttgaactcctgacctcgagtgatctactcgccttggcctcccaaagtgctgggattacaggtgtgagcttcagtcactatttttaacaaccacaatgctggtttcccagggaattgtattttcctctggggaattctatcagaaatgggattatttctattttgtccttcattcagcctcattaattggtcaaaagggcattaacccattcaaccctctttaataatgtggcgtacacctttgactacagctttcacaacttagttatactttgtattgagaaaatagagctgccctgtgctgagccagtactatggagtcaacctcagtctaggggtaggacctttacctcttgagagttctggtttactttaacaataatgaatgttgttcatgtgatgattttgctttttggaagtgtctactagctcaaaggtagtattatagtttgagattcttcctagtgagacaacattaacaaattcataggactaaactgagaatttggcttttttaatacgtatataggtgtggacactgcaagagacttgcacctgagtatgaagctgcagctaccagattaaaaggaatagtcccattagcaaaggtaagtacaggtggattcttcactaaaggacgtgaagtattttaaaaagtagtttgttgtctcagctttgttacatggaaaaaaataacagtaataaatagtttgtaagattaacattcattttctctactcttattctgctaagaagagcgaatactagtttctgggcaaatacacaactgacttgtagtttcaaaagattaaaagtagtggctgggcgcaatggctcatgcctgtaatcccagcactttgggaggccgaggtgggtggatcacgaagtcaagagattgagaccatcctagccaacacggtgaaaccctgtctcaactaaaaatacaaaaattagctgggtgtgatggcacgtgcctgtagtcccagctactcaggagactgaggcaggagaattgcttgaacccaggagatgaaggtttcagtgagccgagatcgggccactgcactccagcctggtgacagagcaagactccgtctcaaaaaaaaaaaaaaaaaaaaattaaaagtagtgagagtaaggaaattactggcataagaagtaaaatagaccaggtatggtgcctcacagctgtaattccagcactttgggatgattacttgaggccaggagtttgttgcctgggcaacaaagcaagacctcatctctacaaaaaatttaaaaagctgggtgtgttggctcacacctgtagtcccagcttctcaaaaggctgaagcaggaggattgcttgaggctgcagtgactagacactgcacactactagactccagcctaggtgacagagtaagaccctgtctcttaaaaaaaaaaaaaaaagtgtaatcccagtactttgggaggccaaggcaagtagatcacttgagaccagcctgggcaacatggcaaaattccatctctactaaagatacaggcaggcttccatagtcccagctactcagaggctgaggtggaaggattgcttaagccagagaggttgaggctgcactgagctgtgattgaaccattgcactctagcctgggcaatagagcgaaaccctgtctcaaaaaaaaaaaaagtagtaaagtatatggtaaataagaattaaagatggaaagcagaagtacagctataaaggttaaaataatcattgaggctgggcacggtggctcacgcctgtaatcccagcactttgacaggctgaggagggcggatcacctgaggtcaagagttcgagacccgcctggccaacatggtgaaaccccatctctactaaaaaatataaaaattagccatgtgtggtggcaggtgcctgtaatcccagctacttggaaggctgagacaggacaatcgcttgaacccaggggggcggaggttgcagtgagctgagatcatggcactgtactccagcctgggcgacagagcaagactccatctcaaaaaataataataatctacaagtaaatgagttccctaaactgctatgtgataatcacaatgatggtaatacgaaaatgatatgaggatattgatgaaaatgtaaccaaatggtcaactgtaaacttggtatttgtttttacaattaaagtaatgcttccagaatgttgccattctgtagtaaacccatagttgttctagtctaaaagctcttacctctgccaaatagttcatatataaggctatttttggaaattacttttaatcttatcaagcagcttgccataggaaaaaaatttaatcatagccaggcgctgtggctcacgcctgtaatcccagcactttgggaggccaaggcgggtggatctcctgaggtctggagttcaagaccagcctggccaacatggtgaaaccccgtctctactaaaaatacaaaaattagccaggtgtggtggccggtgcctgcaatcccagctactcgggaggctgaggcaggagaatggcttgaacctgtgtggtagaggttgcagtgagctgagttcgtgccattgcactccagcctgggcaacaagagtgaaactccgtctcaaaaaaaaaaaaaaaaattcaatcacaattcctacctgtgtgactatagacacattaattaattttctggatcttagtttacccatcttagagcataaggatcatacttcataatcttatggagattaaatgagataatatatgcaaagtacttgtgcctgggttggagtaagtggctcgttccgggaaattattttccttcttcctgataggtctcactagatcggttatgttatggtatagcccagattcaaactagttcagggtacgtgtacaggtgttggtacctttgataatagctctagatgatttgcaaaatcaaattacattacacctaaaggatatgtaccaccatcgatatatccccttggtgatagtcgtaatcaaagtaagccactgttaataatttaagtgatttatccctcatgtgttctgaggcagaaaaaagatgaagaccaccgctttagctaatagagactacaagggcagaatttaaacaggaactttgcattttatgtgaggcctaggaatctcaattttaaagaattccttaggcagttctgatgtagttaggcaagctccagtctgcctttaaaatctaatgttctgtggcatatatgccaagaattccttgatccccttaggatttgaccaatcctagtattttgagaatataggaagaacctgcagcagaaacttggataagaaaatagtttgtgtattttgatctttaggttgattgcactgccaacactaacacctgtaataaatatggagtcagtggatatccaaccctgaagatatttagagatggtgaagaagcaggtgcttatgatggacctaggactgctggtaaggatcctgaattacattctggaaactgatgttaagtaccttattctttgtagtggaaacataaaaatgtgtttttctacacagtatactttcagtcttaaaacttcctcatctaagaggtcagtttggtggtaacaaaagacctctctaaatgaacagattatataagtaatatagaaaatacacaaacttgatttataaggtcagctcgacattttttcattttacaaatatttattgagtaattactgtgtgccagatattctaaatatactaggtcgttggcatttattgataaaatagacaaggtccctactcttgtgaagcttacattctgggggatgagggggagaaggcaacaaacaagttttaaaaatatagatgagctgggtgcagtggcacgtacctatagttttagctactcgggaggctgaggtgagagactgtcttgagcacagcctgggcaatataagtttgtccccatctccaataaaaagtttgggccggggccgggtgcggtggctcacgcctgtaatcccagcactttgggaggccgaggcaggtggatcacgaggtcaggagatcgagaccatcctggctaacacagtgaaaccccatctctaccaaaaatacaaaaaattagccgggcgtggtggcgggcgcctgtagtcctagctgctcgggaggctgaggcaggagaatggggtgaacctgggaggcggagcttgcagtgagccgagatcgcgccactgcactccaacatgggcgacagagcgagactccgtctcaaaaaaaaaaaaaaaagtgtgggccaggcacagtggctcacacctataatcccagcactttgggaggctgaggtgggcagatcacgaggtcaggaatttgaggccagcctggccagcatggtgaaaccccatttctgctaaaaatagaaaaaattagcactgggcgtggtggcacatgcctgtaatcccagctactcaggaggctgaggcaggagaatcacttgaacccaggaggcggaggttgcagtgagccaagattgtgtcacagcactccagcctgggcaacagagcgagactccatctccacacacacaaaggtatgtgtgttatctccatgtatatatggataaccatctcatacccattaggatggctactatttaaaaaaaaaaaaacaacgaaataggccgggcgcggtggctcacgcctgtaatcctagcactttgggaggctggcggatcacctgaggtcgggagttcgagaccagcctgaccaacatggggaaaccctgtcactactaaaaatacaaaattagccaggagtggtggtacatgcctgtaatcccagctactcgggaggctgaggcaggagaatcgcttgaacctgggaggcggggttgcggtgagccaagatcatgccattgtactccagcctgggcaacaagaaggaaactccgtctcaaaacaacaacaacaacaaaatagccaatgttggtatggatgtagagaaattggaaactttgtgcactattaggaatgtaaaatgggacaaccactatggaaaacacagtatgttggttcctttaaaaattaaaaatagggccaggcctggtggctcatgcctataatcccagcactttgggaggccaaggcaggcagatcatttgagatcaggagtttgaggccagccaggacaatgtggtgaaaccgtctctctactaaaaatacaaaaattagctgggtgtgatgcgcatacctgtaatcccagctacctgggaggctgaggcaggaggatcacttgagcccgggaggcagaggttgtagtgagtcgagatcgggccactgcactccagcctggggaacaacgcaagactccgtctcaaaaaaaaaaaaagattgaaaaaattaaaaatagaaggccaggcacggtagctcatgactgtaatcccagctctttgggaggccaaggtaggctgatcacttgaggtcaggagttctagaccagcctggccaacatggtgaaaccatgtctccaccaaaaaatacaaaaattagctgggcgtggtggtgcacacgtgtagtcctagctacttgagaggctaaggcaggagactcgcttgaacctggaaggtggaggttgcagcgagctgagatcacaccactgcactccagcctgggtgacagtgagaccctgtctcaaaaaaaaaaataaaaatgaaaataaaattactaggccaggcgtggtggctcacgtctgtaatcccagcactttgggaggctgaggcaggcggatcacaaggtcaggagagcgagaccatcctggctaacacattgaaaccccgtctctactaaaaatacaaaaaattagccgggtgcagtggcgggtgcctgtagttccagctactcgggaggctgaggcaggagaatggcgtgaaccctggaggcggagcttgcagtaagcggagatagcaccactgcagtctggcctgggcgaaagagtgagactctgtctcaaaaataagtaaataaataaataaaattaccatatatatgatccagcttctgtatgcccacttctgagtatacatttagttctcacttaatgttgtctatagattcttggaagctgtgacttttaagtgaaacaacctataacaaaacttgtttttttttttcctcatcaatgttacaggaaacagtgttattctaggacttgctatgcattctttctcttgaagttgcagtttctgagaacatatgaataatattgaggacttattgtatacccaaaagaagatagttgtacacctatatccacagcagcattattcatagtagccaaaaggtagaagtaacccaagtatcttatcagtgaatgaatagtaaacaaaatacggtatatgcatccagtggaagattattcagccttaaagaagaaaattctgactacatgctgctatatgattccacttacatgaggtagcacaaatagtatacaaaattgtatgtttaaaaatggttaacaagggccaggcatggtggctcacgcctgtaatcccagcactttgggaggtcgaggtgggcagatcacgaggtcaggagttcaagaccagcctgaccagccaacatagtgaaaccccgtctgtactaaaaatacaaaaaattagccgggcgtggtggcaggagcctgtaattccagctactcgggaggctgaggcaggagaattgcttgaacccaggaggcggatgttgcagtgagccaatgttgcaatcgcgccattgcactccagcctgggtgacaagagtgaaactccatctcaaacaaacaaaaaaatggtttaacaaggctcatgcctgaaatcccagcactttgggaagctgaggcaggtggtttgcttgagcctaggagttggaggccatcctgggcaacatagtgagaccccgtctttataaaaatacaaaaaactagccaggtgggatggtgcatgcctgtagacccagctactcaggagactgaggcgagaggtctgattgaccctgggaggtcgaggctgcagtgagcaatgatcatgccgctggaccccagcctgggtgacagaaggagaccctgtctcaaaaaaaaaataaagaaaagaaaaaaaagattggaaacaaatgtccatcagttttgcaattgtgtctgcttaaataaactgtggcacatttatagtgaaacactatgcattgtaaacaatgtttctgttaaaaaaaaaacttttttttttttttttgagacagagtctcactctgtcacccaggctggagtgcagtggcacgacctcggctcactgcaagctccgcctcccgggttcacaccattctcctgcctcagcctcccgagtagctcgggaccacaggcgcccgccaccatgcccggctaatttttttggtatttttagtggagacggggtttcaccgtgttagccaggatggtctcgatctcctgacctcgtgatctgcccgcctcggcctcccaaagtgctgtgattacaggcgtgagccacagcacccggccaaaaaaactttttaataataataaaaaacgctatgccactgtaataaaaggttgaggtagctatgtatatataattgcctgtttatgcagaaaatgtctggaaggatatacaagcaactgaaatcttggctgggtgtggtggctcacgcctgtaatcccagcactttgggaggccaaggtaggtggatcaaaggtcaggagatcgagaccatcctgtctaacatggtgaaaccccgtctctactaaaaaaatacaaaaaaaagtagccgggcatggtggtgggcacctgtagtcccagctactcaggaggctgaggtaggagaatggcatgaacacaggaggcagagcttgcagtgagctgagattgtgccactgcactccagcctgggcgacagagcgagactctgtctcaaaaaaaaaaaaaaaaaaacctgaaatcttacaaggaggaaactgggtgactagggacaagggtggcaagaagatttcatcttatacccttttgtaccttctgaattgtgaatgatgaataattgccttctcaaaaattataaataagttgtgttgtcataacttttattttgacttctaagatggaattgtcagccacttgaagaagcaggcaggaccagcttcagtgcctctcaggactgaggaagaatttaagaaattcattagtgataaagatgcctctatagtaggtaagtagcaaatattaaaccgtgccacagaattgtcagtttggtttccaaaaccctccatgtctgggaaaaccacagaattaaagcagttaaggaaaccttggggcagttgagaaggcaactgacagaattgggtcagcaattactataatgtactatatagtacattatataattactatataatgtaattataatgtggggggcaattggtgttttatttgagtgggtttgtgttctcatagatgtaaaggtttaatttcaattaaagggactggaaggggtgggtgtggggaaaaaaataaaggactaggataggaatatcttcagcgttttctaatgcttcttaaactctgagatttgactcacaatagggtagttatgactgaaaataaggttttaaggtaggaagatacaagtaaataataaacctctgctattttcacagaaattagggaactttaaaatcagatcgctaggatttatcttgtttttgcagcattcattgctttctcatgtgttgcagtatctcgtttttaaatgacatgagccagttaaacactttctgcatcttagatgttcattgttttgttttttaaatgtgatatatgataaatttgactaaaaaataaatttaaacataaaagctatgtttgtgcttctcttagtctcctaattactgtaataaaactgactttcgcctggctcagtggctcacgcctgtaatcccagcactttgggaggctgaagcgggcggatcacctgaggtcgggagtttgagaccaacctgaccaacatggagaaaccctgtctctactaaaaatacaaaattagccgagcatggtggtgcatgcctgtaatctcagctactcgggaggctgaggcaggagaaacgcttgaacccgggaggcggaggttggggtgagctaagatcgcgccattgtactccagcctgggcaacaagagcaaaactctgtcgcaaaaaaaaaaaaaaaaaagtgactttctggcagcagaatatggtttactgtttaaatttggctaaaagccactttttatcatctagattttactgattctttatattttacaaggagttagcatgtatttattaaacatttatgttttagtcacttttctaaatgagtagttctgaagacaaatatagagaaggaaaaaaattgggtgaagtggtttacagtttattttgacatgtcatcttaatttaatccttctgatacctgaaatagtccctgaaactcttaagcaatttgcccaaatttgttcaattatgggaaagtaaaatgaagacttgaacactgacaaattttctcccttggctctctcaagaaatgtttctgtaaagggtagagggaaaattctcatcctaaatattgtgcctgtctgaggtagtcatggcaaagcagacccagtcctcaaaatagaatgaaatgtttatggtttatggaatagacgtttatggtttggaatgtccatctgtcagcacttattgcttcttccttgtgtttaatattttctgtataggttttttcgatgattcattcagtgaggctcactccgagttcctaaaagcagccagcaacttgagggataactaccgatttgcacatacgaatgttgagtctctggtgaacgagtatgatgataatggagagtaagtgactgagttgaatctcctgaccaagtattattgtgtgaactggtgatactgattgactgggacaaggtttcactctgtcacccaggctggagtgcagtggtgcaatctctgctcactgcagcctccacctcccaggttcaaacgattctcgcgcctcaacctcctgcatagctgggagtacaggcacgcgccaccacaccctgctaatttttgtatttttagtagagacagggtttcaccatgttgcccaggctggtttcaaattcctggcctcaagtgttccacccacctcggcctcccaaagtgctgagattacaggcatgagccaccgcacccagctgaattggtcatttttatacctaatttttcccaagggtttattgagtactttcaaggcattatgctacatgcccagaaactattgctgccttcaaggaacatccctctatctagtagagggagattgtatgcatgaacatatataaaaatgaaagtgtaagtgtatgtagaactatatatggagtggttggaagtacaaaagagggagtgtttttttcttcttatggggtaggggggtaatatcagaaatattcatagagggggtgactcttgaaggatcagttttctctggaaggttatggcctttgaaataaaaattattccagatagagcaccaggagtgaaggccttgagatgtaagatagcctaggcatgttggggcccatagtactgctggagtattgtttgtgattgagatcataatgaaagataagattggagtattaagcagagaccaaattataaattttaagtgccatacaaaagagctttgattttatcttttagacatttgagagccattaaaagactttgggctggggagtaatgcctagtgttccattactggaatactaagcttgtgggagttatttatatcctcctgctcaaggtcattgccaaggtctgatctttcacaaaaacaatttgcaacctcccacgtaaatgggttaaatttgtgaagaagtcactggcagccacatgataatgatttgaagggggagtggtgcaaggcattctaaggattctaaggagaattctaaggactataaggagaatctaaactgaggatgacatgtgagagtctaaactcggtcaacagcattagtggcaatggataggaaggggtgagtataaaaaaatgtaaacaatagtcactaactatgagtgaaaagaagattcagagcaagtttgagtttatttttttatttttttcagacagagtctcgcccttgttgcccaggctggagtgcagtggtgcgatctcggctcactacaacctccgcctcctgggttcaagtgattctcctgcctcagcctcctgagtagctaggattacaggtgtgcaccaccacacctgggtagtttatgtgtttttagtagagacagggtttcatcatattagccagtctggtctcaaactcctgacctgaggtgatctgtctgcctcgggctcccaaagtgttgggattacaggtgtgagccaccacacccagcccgctattgtttctaaaggtttgaaaatctactctaacccccttttgagataatgaaaaagctgaagcccagaaggattaaattgagacctggtccaacgtgtttggaattagttggggaactatgattagaaccacgttctcttaattttctaacccaaaatttagtaaaccctatacccaattattgcacttaagattaaggtggttagcatcttagtgttaatgagaaggtcttgttgctgaatctgtggtactagaaaagagtccttatgtgcttagatgttgctagttaaaagtggcagcaaaagtacatagtctgagctttacatgaaacatgggagctccaccagtaatcccagcatttttggaggctgagatgggaggatcgcttgagcctgggagttcaagaccacccttggtaacatgatgagacccccatctctacaaaaatttaaaaaataaattagttgtgcatggtggtgcacacctgtgttctcagctatttgggcagctaaggtaggaggatcacttgagcctaggagttcaaggctacagtgagctataatcacaccattgcactccagcctgagcaacagagcgaaaccctatctcaaaaaaaaaaagatgggagacagttcttctgctatctgcctactgagacttttcttttttttttttaaggggtatcatcttatttcgtccttcacatctcactaacaagtttgaggacaagactgtggcatatacagagcaaaaaatgaccagtggcaaaattaaaaagtttatccaggaaaacatgtgagtacttctttgtatcttgtctgggatttatttgcttgattttagtttgtttacctcagttattaagccgagctatattttggcgtaaacagtctatttggggggattgtaatagtaatagtttgagtttatattaaagcagtaatgtgtgggtgttagaactcctgttgtcatcctgtaaggtatatattgctcagtacttgttctaaatgtttaaaatctctttccttcataaatgctatcaattattttgtggcaactttatgatatagctaaaaacttggcaagccagttgataatggattatttcatttcagttttggtatctgccctcacatgacagaagacaataaagatttgatacagggcaaggacttacttattgcttactatgatgtggactatgaaaagaacgctaaaggttccaactactggagaaacaggtaataagaattatgtttttccctcatgaacaagtttacccaatgtatagacagtcccttctaactatcttgttggttccttaagaatctgtaaaacaataaatggttccttaagaagaggtaaaaaaaaaaaaaaaaaaattaaagtaactatcctgttaccatgtgtggtataaaagcaggaaagaatgggaacatttggcttccaaattgtctacaattgacttcaaatggctacatttgaagccataaggacaaataaactgttttcacaatctgttgggcatgtatttcgtaggtgtttctttgctttgtgacacagtgactccaagtagaaggtggaaatttgatataaaatgcacttaaaacattgtgcttacttgcacattgagcctctcagtgcattttacccttacaaattttgttttcagatcagttattatgcctataatagatttcagttatatattacagcaagatttagcaggaatgcaccagttgattgggtatcaccaatttgccagtgaagttcagtaaggcattgaagtatatcataaccctgtgtcagtgcccaagagctcagactgttcagactgattccagaaggctagaactatagaacttagtctttgctttccaatcacttgcttcttagtttcaaaagtgcttgaccaccctgtatagtcttggcacaaatgtctcttgtttcccacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgtgagttgctagttgggctttgattctccaaggcaattattaaagccttttatactacaaaggatttctaaagaacaataaccctggaatgtgaagataggtcttttaatcaagacctatgactgtcatttttctcaatttaaatataggtactttagaccaggcgtggtggctcacgcctgtaatcccagcactttgggaggccaaggcaggtggatcgcctaaggtcgggagttcgagaccagcctgaccaacatagagaaaccccgtctctactaaaaatgcaaaaaaattagccaggcacggtggtgcatgcctgcaatcccagctactcaggaggctgaggcaggagaatcgcttgaacctgggaggcggaggttgcggtgaaccaggatcgtgccattgcactctggcctgggcaacaagagcgaaactctgtctcaaaaaaagaaataaataaagaaaaataaatacatataggtactttaaggattatgatccttaatgaattctgaaaactaatgaaaggatggcaggttggaattcttacatgattccacttggtcattagaaatagcagataaagggtgagcacagtggctcacacctgtaatcccagcactttgggaggccgaggcatgtggatcacaggagttaaagaccagcctggcccacatagtgaaaccccgtctctactaaaaatacaaaaattagccgggtgtgacggtgcgcacctgtaattccagctactggggaggctgaggcaccagaatcacttgaacccgggaggaagaggttgcagtgagctgagatcatgccactgttctccagcctgggtgacagagcaagactctgtctcaaaaaaaaaaaaaaaaaaaaagaaagaaatagataagattggacagcctcctttgggccagatgtggtggctcacacctataatcccagcactttgggaggctgaggcaggaagatcacttgatcacttgagcccatgagtttgaggccagcctgggcaacatagcaagaccccgtctccaaaaaatttaaaaatctaaaaaaagattgaacagtctccttgatactgacgtaatttcaaaccaaaccattcccccccctcatccctacagaatgtattttctttttgaaatagcacatgggtctaaagtgaactcagaatcgggaagatctgaagaccccggaaacaatttttaccctcactttctgagattttgggagattgagacaagagaaaatcttccttgtgagccagtcaataaaacaaaatactgtaaatagtgtgctccagagcaataagaccttgttttcttacaaagatgaatctccagaagaccaatgattctcctttctctgaactttgtaatccacaaagaacacactagaaataaaaggaacggtttgtttcttcagtcggtagttctgcatattgagagatgagagtcccccttttttagccttgaaaagctaaaatacatagtaactattcaaagaaattgctgtaattttctcagcggtgggaatagattaacaagccttacccttgttttccaattgtaggcgtgatgggaaggctctggagaggttcctgcaggattactttgatggcaatctgaagagatacctgaagtctgaacctatcccagagagcaatgatgggcctgtgaaggtgaggtgctcacagcctcatcaagctatgagcaattgcctgtcctcatttctttgttccaaaactgtggggtctaaatgaagacttcgttggccatctctttttttttttgtccttactcccgagtcataaaataagcattggcaggccaagcggtggctcatgcctgtaatcccagcactttgggaggcaaaggcgggcacatcacaaggtcaagagtttgagaccagcctgcccaacatggtgaaaccccgtatctactaaaaacacaaaaaaatcagccgggcatggtggcgggcgcctgtaagcccagctactcgggaggctgaggcaggagaatcgcctgaacccaggaagcagaggttgcagtgagtcaagattatgccactgcactccagcctgggcgacaagagcgaaactccatctcaaaaaaaaaaaaagcattggcagggctcataatgcttggtaggggcaagcgtgtaaagcctgcgtagaattttctgatgaaatttatattgggctaagttactcttgaggatagagcaacccctaagaacagtgtgttgctttgaattttttatagggatgtggtcttactctgttgcctcagccttctgagtagcttggactgcaggcatgtgccaccaagcttggcttgaaattattttaaggaatggttgggtagcacttctatgtcctgtaacttcctgaacatagtttgacaggtgacagacataggaacgagttggtatctagtgaatgacaacatctttaatacaatctgtaaatgtgatttgggtttccatgacttattttctgtggtaacacatcaaattagagagggattgggtctaggaacaaatacagttgtgaatttatttttttatgttaccaactagagattcttctgtgttttccaggtagtggtagcagagaattttgatgaaatagtgaataatgaaaataaagatgtgctgattgaattttatgccccttggtgtggtcactgtaagaacctggagcccaagtataaagaacttggcgagaaggtaagtgtgaaccctattctgaggataacatttgagcgggagcagtaagtttatgtatgtattcagcattggctaatttggttggttcctaagtactgatagatttttttcccaattacttgctgtttactcactttctcgtgactgccccctagtgctccagcctgtgcagtgcctgagatacccacttttaacattccattcctcaggctcaatctagataatggttaaaaatatctaaggacttctgaattttggtaatggcttacatgaatccatatggtccttcatcttaaaacatttggcttagcccctgtaatgtcttattcagaccaggtaaatttgaaggtggcaatatgtagagtcttaatacaagagaaaaaagggaagcttgtggaaagtgaggtactaccatctgcaaaccactcttcccacatgaacagcagtttatctgctggaattacaggtgcgcaccaccacacccggctaatttttgtatttttagtgtttgaagaatgagattgttttaagtcttcaattgactaagtgtccctctgtcactgaaaacttgaaatgtaaacatttaacctgttttattaacagctcagcaaagacccaaatatcgtcatagccaagatggatgccacagccaatgatgtgccttctccatatgaagtcagagggtaagtggcttaaaacttaacaaaagtgtctaggcaatagataggaataaagcttgtaaccaccaggaaatcattactagacatagttttcatattcagttgaaggcagaaccactgattccttcttggcttaagagttctgcagtatgggcccacataactgcttgaaattaataaatgtttctttccccagttttcctaccatatacttctctccagccaacaagaagctaaatccaaagaaatatgaagtaagtgaattgtcccatatccccacaaatatatacacagacgtaaacacacaaccttaaacatagttctttaattgggtttatttatttatttaattattttttgagacggagtttcgctcttgttgcctgggctggagtgcaatggcgtgatctcggctcaccgttcaagcgattctcctgcctcagcctcccgagtagctgggattacaggcatgcgccaccaccccggctaattttgtatttttagtagagatggggtttctccatgttggttgggctggtcttgaactcctaacctcaggtgatcagcctgccttggcctcccaaagtgctgggattacaggcgtgagccaccgtgctaggctaattgggtttatttaactaaaatctctttaaactctcatgggcagtatatgtggctgctaatatgcttttacaaactcagaagtcttcctgtttgggtggggcagatcagggttctttaaaaagttacacttttaagctgatctttctgttttcagggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagacccctttaaactgtcttattttccaccagattgagaaccagatgttctctacacactatcactgttcaatagagctttcttcagtgatggaaatgctctgtaatctacactgttcagtacaggtagctacggagcatctgaaatatggctagaaactacatttttgttttgattaatttaaatagccatacagttgctaccatactggtcacggcagctgtagactgactgggtccatagttcatcacctcaaaattctttcaaaatttattatctctttctctccttacatgtttatttcccaggcctaccctggtgattagaacagctgaagggcctttcttgttaggctgtccatgccctaaggatgggttcctgtttatccttgccacgcagctgagcttactgcatgtttatatctcccaaggactgttctctgctcagaaatgccctgtcaagggtgtggcatcacgcagtttcatccaagttgtttcaggaattgctgacactgctgggtgcagttctatcccctaaagcctagggtgtggccctttaacttccccttcagtagaactgggaaaggcagtaccattcctagttatgagtgaagcatccactttcttttgtaacaatgaggaacagaaaggataagactgaagagtgatcttttgtccaactaaaccatttatctccttttgtaggtaaattcaaatcctgcccagttatagttttcagtcactggagaattccaggtaggagccctactttaggtgatcctaggaactcctatgttcagaaaagaattttcttcctactatataattacagtatttagctgtcaattttaagatgaatttggtagagccttatagtaaagtatgtatcttggtcacacacaaagcttggaaaaagtaaaagatgtctaaaccataatcttgtaactcataacatctgggctggggcccggggatctaattgtttagagagccccaaaagtggctcagatgtaaagccagggttaagaaccatctgccttggaagatttaagggaaacatataaacttgtacaaaggacacagaagcagtcagttttaattttttagccatgttggtaaaagttcattttcagtacatgggtaacacccaggccctttcccattatatccaggtatgctacaagttcttttaactcttatcagaagttattattactgtttccttagagaggctaccaggctaaaattcacttagtttggtttgtctaatgtcctcattattttatcctgaagatgatgtcatttctcaggacttgaaaatgacttggctgaactaaaggtaaaaaagccaagcctctgtcacttttcctagactcctaggcacagctatggagtctttgcacagtgcccataccctaaaaattaataatgaaaaccaaacctcaagaacctagagcagctctctacttgccaccatggactccagtggtcagcataagaaaagcagatagttgcattctatttagtttatagctgctttgttcctttgtgtttcactaagcagaggctcaaaaattcccttgataacttcagctgcccctgttcttttcctcaaactccaggatgagacctttaatgtgggacaatttctggtgaaggtactcacagcgacgcttttcttctctgtaacttgggtactgctgcagagaaaaagcatccatgtcaaaaagtaaaaattctcattctaccttgc

SEQ ID NO: 663 - DNA, 99958 bp, Homo sapiens
gcgggaaagagtgccgcctcagctgagggcaagcgaggagatggctgtgaggcaggcggcgacggcgggcactcccgggcccaggagagaggaagaggcggcgcttctattcgagagggcccattaccggcacgacccgcgctggctgctgcccgtgaccccccgcctgtgcctggcctgcgcgctggagctgctgccggaccccggcgtgtcggtgcgggcggaaccttttcttcagaagacctgggtttggccatttccctcagcaaacgcggccaggcccttgccagacccgctccggtgaacccgacgcgaaaccgggcccccgcgctgtgttcactctcctccctgtcagcccgtcccggacccggccgcagcggcctctcgggcccctcagccccaggccggcctgcgggcctccgtggagcccggtccactggctctgcgcctgaaaggacggaaatccggatcccccgggacctcacccagtctcagggacacaccttcccgccttccgccttctggctccttccctttgctgcccctgcctccatttcccggggattcggccttagctcaggctcccgccatttcagcctcccgccatttcagcctccactcacctgcgggccaggggcgcatgcggcggccgctcctcattcccttcagctgtcggggtgtgaatcggaggaggggcagtctgggctccgaggggacaggagtgacaggttacagccgggcagaagtgggggtgaacgggaagactgttccttgggcagagctggccaaagcgggctgcctgggtcctcattgcctaccgcgtttgcaatgaagtggttttgtttgtttcgagacggagtctcgctctgacacccaggccggagtgcaatggcgccatctccgctcactgcaacctctgtttcctgggttcaagcgattctcctgcctcaacctacccagtagctgggattacaggctcccgccaccacgctcggctaatttctctatttttagtagagacggagtttcatcatgttggccaggctggtctcgaactcttgacctcaggtgatccacccgcctcggcttcccatagtgctgggattataggcgtgagccacggtgcccgacctgcagtgagttttcttgtccatggaggcatccaagaagactttgggaggtcaagtttctctccaattcatgggaggggaattcgtgagtgggtggattggctagatcagcagttctcaattttttttttttttttttttttttttgtagaaacggtcccgggggtctccctgtgttgcccaggctggtcttgaactcctagtctcaagcaattctcctgccttgacctcccaaagtccaaagtgttgggattgcatctgtgagccaccgtgcctggctgcgttctcaaatattttgatttctttctttctttttttttttttttttgagatggagtttcactcttgttgcccaggctggagtgcaatggcgcaatctcagctcaccgcaacctccgcctcccgggttcaagcgattctcctgcctcagccttccgagtagctgggattacatgcatgcgtcactacgcccagctaattttgtatttttagtatagacggggtttctccatgttggtcaggttggtgttgaactcccaacctcaggtgatctgcctgcctcagcctcccaaagtgttgggattaaagacgtgagccaccacacccggccaaacagctggatttttatctatttctgcattcagtctgttgtgctatcatgtcatatagtctcaaaaactccactgtacacttgtgggagaataagaatgagaaagactgggccgggtccggtggctcacacctgtaatcccagcactttgggaggccgaggtggttggatcacgaggccagaagttcaagaccagcctggccaacatggaaaaaatttaaaaaaaaatgaggaagactaagaacattttaatattatatgaaaatatttttgttcttgtggacctctgggaagtgttttaggcacccttaggaattcccacactgtgctctgggaactcgtaaactagctaataacctctgaattttcattaaggatggaaattctgaggctgcttttcttggacagtaaatcagagatgaataagacagtgcagcggggagaaataagagaacatgttagaacttagaagaatgaacatgtttgtagtcaagtgctgttcagggtaaggagaggaattaggaaaggtttcttagaggaggaagcattcaaattaggtttaagaagatgggtgagatttggaccagaggaagtgggaggctgattatcccaggaggtaggtattataaggatgggttttggggataatcagagtgtttgaagggaaagtgaaagagatgagattggagagacaggttgaggacagttacttgaagagtttgaaacccagctaaggagcttgaacataatctgtcagatgaaggagagttactaggattttttgagtagctcatatagatcactaccttaatctattacgtaggatgaattggtgaaggaaaaacaggagccttacagtagcacagatgagaagcaataagagatgcaacttctaccttttattgagcacacttttcttttgagatggtttcgctctcgttgcccaggctggagtgcaatggcgcaatcttggctcactgcaacctctgcctcccaggttcaagcgattcttctgcctcagccttctgagtagctgggattacaggcgcctgccaccatgcacggctaatttttgtatttttagtagagaagaggtttcaccatgttggccaggctggtctcgaatgcctgacctcaggtgagccacccacattggcctcccaaagttgggattacaggtgtgagccactgcacccggcttgaacacactttttttctttttttttttttgagacagttttcctcttgtccaggctgtagtgcaatggcgcgatcttggctcaccgcaacctcccctcccagattcaagtgattctcctgcctcagcctcccaattagctggggatataggcatgcgccaccacgcctagctaattttgtattcttagtagaaaccgggtttctccatgttggtcaggccagtctcgaactcccaacctcaggtgatctgcctgcttcggcctcccaaaatgttgggattacaggcgtgagccaccatgcccggcctctgaacacacttttcttttcttttttttttgagacaaaatcttgctcttgtcccccaggctggaatgcagtggcgctatctcggctcactgcaacctccgcctccctgggtttacaggcacctgccaccatgcccgagtaatttttttatttttagttgagatagagttgcaccatgttggccatgctggtctggaactcttgagctcgtgatacgcccgccttggcctcccaaagtgctggaattacaggtgtgaatcaccgggcccggcctctgtttttgctttcctcaccaacttgttaggcttaaatgagctggtggacaaaaatgatttgtgaaaaataaattgctatgtaaatatagggcattaggaaccttagctcatgtataatcttctgtatgaatacatggattcctctgcgtaaatgatatccttttccaacctcccttgaaggagtatggatctcaccgtagtttaaatgatcccttgtatcatcttgtaattgtatttggaaattacggttgttggattcagaatagccaaaatttggttgctattgaatgtttttcttcatttgcttcaagttagtgcgcaagaagcacatgttgtcctgcttccaagatgcccttgtgaggcatacctccctggtcacgcaactggtgtctcaggatcagagagtctgcatccacttcataagtgtgctttttggtaagattaagagggaaatttgacatgagttttgaatgtatagtatgtatatctgcttttggggctcttggaaaaatgatcttagatgatttaggttttttgtattgtaatactttatcagcaaattgttttgtcataatgatgtagaaatggccctttttctaagatccaagatgcattttacagtaactgactttactagagccaagaagttagtaaaagtaagaagatgaaaatgggaaatgttggccgggcgtggtggctcatgcctgtagtcccagcactttgggaggctgaagtgggtagatcacttgaggtcaagagttagagactagcctggtcaacatggtaaaacccccatctctactaaaaataacaaaaattagctcagtgtggtggcgcgtgcctgtagtcccagctacttgggaggccgaggcatgagaattgcttgaaccctggaggtggaggttgcagtgagaccagttcgtgccaccacactccagcctgggtgacagagcaagagtcccgtctcaacaaaaataaaaattcttcaaagagtccagtatacacggtctttgtacaggaccagaatggagtctgctgacctaggtatgaccctgctcaacttactttccctctcctgtgccttaatatcttcatgtgtgaagtatgatagattaaattttatctgatgttctttcttttaatgtgacggtaatgtccagtggaatgagccctttcagggaggaaggcagctaacttgtatttactgcttttctgtgccagagacttttcaggcttttaactgccaagacaatttttaagggagctaggatgatctccaagcttcagggaatttatgctaacaagtgacagaactagaattttatcccaggtctgtcatagacaccagagcacatggggtttttttttgctgtaccgcattgacaattcttaccctttttttttttttttttgagatggtgtctcgctctttcgcccaggccggagtccagtggcgtgatctcagctcactgcaacctccacctcctgagttcaagcaattctcctgtctcagcctcccgagtagctgggattacaggcatgtgccaccatgcccggccaatttttgcatttttagtagagatggggttttgccatgttggccaggctggtctcgaactcccaacctcaggtgatctgcctgccttggcctcccaaaatgctaggattacaggcatgagccactgcaccctgccacaattcttatctttttttgagatggagtcttgctctgtcacccagactggagtgcggtggcatgatcttggctcacttcaagctccgcctcccaggttcacgccattctcctgactcagcttcccgagtagctgggactacaggtgcccgtcaccacgcctggctaattttttgaatttttagtagaggtgggatttcactgtgttagccaggatggtctcgatctcctgacctcgtgatccacctgcctcagcctcccaaagtgctggaattacaggcgtgagccaccgcgcccggccaattgttatctttttaaagcctgggcaggtcatcgaaagtcaaagtatttggtgctgagagtagaatttagctggaacattgtttatagctgcttttagacttagaatttacaatgtgcctgtgtgggtctatttctctttgaagagaactcttaaccactccttttttttttttttttcttgagacagtctgtgttgcccaggctggagtgcagtggtgcagtctcagctccttgtaatctctgcctcctgggttcaagtgattctcctgcctcagcctcctgagtagctgggactacaggcacaggccactactcccggctaatttttgtgtttttagtagagagagggtttcgccatattggtcaggcttttcttgaattcctgacctcaggtaatctgccacctcggcctcccaaattgctggggtacagatgtgtgccaccgcgccctgcctaaccacccctttcttacctccctctgctccaaggactattatgcagcatggaagatgggagtgtgacagacctctgtattgaaggtaagttgaaaccttgtatctagcacttgaagatgaaagtattagtctgaattgcagctctggttacttgagaccttggcgaaattgtctgtttagacacagataagaggaaccccattagttttcaatcactaattcaacatttgttttttactttttttttttttttttgagacggaatcttgctctgttgcccaggctggagtgcggtggtgcaatctcagctcactgcaacctctgcctcgcgggttcaagcgattctcctgcctcagcttcccgagtagctgggattacaggcatctgccaccacacccagctaatttttgtattttgagtagagacagggtttcatcatgctggctaagctggtctcgagctcctgacctcaggcgatctgcctgcctcagcctcccaaagtgctgggattacaggcatgagccactgcacccagtctttctttttctctctctcttctttttgttgagacatgggctcattctgtcacccaggctggagtgcagtggtacaatcatagctcactgcagccttgaactcctgggttcaagcaatcttcccgcctcagcctcccgagtatctgggactacaggtgtgcactaccatgactggctaaaaaaatttcttttcgttgagacagggacttaccatattgactaggctggtctcaaacggctattctcaagcaatcctcctgcttggcttcccaaagtgctgggattataggcgtgagtcaccattcctggccttacattttttccttgggtatttactctgtgctagatactggatcaggcactacggatacatagatagataagacatggtccctgtcctctaggagcttacaatctggagaagagattgactgacaggcaaataactagatttgatgagtgctgttacaaaggcacatacaaaactcttttttagtacatctcgtattggttcattgaaagttgtctgcacacagatggtggttaaaactgttgaagtggactgagcatggtacaacatgcctgtagtcctagctactcgggaggctgaggtgggaggatcccttgagtccaggagtttgaggtgacagtgagctatgatcatcccactgcactctagcgtggatgacaaagtgagacccctttctcttaaaaaaaaaaaacaaaaattgtcgaagcgcatgggtttacctataaagggtttgtagagaaagaaggtaagagccctggtatgtgacgattcttgcagagagagtgagaattgtactagttaggatccagtcaggaaatagaaaccacaccaattatttgaatagaaaaaaactttaaagaatggttaagtaggccgggcgcagtggctcacgcctgtaatcccagcactttgggaggcttaggcctgtggatcacttgaagtcatgagttcgagaccagcctggccaacatggtgaaaccccatctctaccaaaaaaaaaaaaaaaaaaaaaaaaattagccgggcgcggtggcgggcacctgtaatcccagctacttgggaggcagaggcaggagaatcacttgaacccgggaggtggaggttgcagtgagctgagatcgcgccactgcacttcaacttgggtgatacagtgagaccctgtctcaattaaaaaaataatgttggttaagtaggtaactgaagaaaaagagaacaaccaaattttcatggagatagcaattatagaaaacaactccctcactggggctgggggaacaaaggaaagaggctggaattgttaaaacttagaagtttggaggaagggcctagttatgaaactcagacctctgagtggcactgactagataataccgttgtctctggaggaggagagatgcaatgaaggtggttctggaaaaactgcaggctggattcggctgctgtcatagaatggcactgccactgccaggataaagaagtgctaaggtgccaggcatcttaattgtgtgggtctgtggtcctagctactcaggagattgaggtgagaggatcacttgagctcaggagttcaagtccaacatgggcaacatagcaagactgtctcttaaaaaaaaagtgttaaggggatacttacatgaatgggaagacttatatgaatgggaagacttacatgaatgggaagcagacaggaaacccataggaaacaaaaaggaaggagcaaatcccttcttcctatagccttgccatctctttctagtgctcattattggcagagcttaatgaggttcagctagcaaagcaaaaatgtgatttgcagagtccagtcttagtcttccaaggcagattacagggtgggttctggagctcaaagacaatagtgtaataactggtttgatccattcctttggctacttggtgtccaaacacccttctccacatatttgaactcccatagaacaaaaacaactttttgtttacctaacaagatgtaactatccttcattcatatacttcatacagactaagccattgtcaatttgtccccaacataaggaggttaataatttatttttaaattcaatcacagtcctatatgaatattctgttaccgaaagactaaattttaaagctaacctccaccaaaacttgtacaaacaataaggaaaaaaggagagagaagaaaacagttacagaaatatattacaatcttcattttcataactggtcaaaacgatatagttaatatttataatttccttcttaatggtgtttgttctatgtatcctttgccttcaacgagggtctcaactggtcagggtttttacatggtagggtgactcacaccttcattcctgaaaggtctgaatcttttttttttttttccaagccaaactgtatccagctttattaaagatactttccataaacagtcatggtatttcaggcaggacatgggcagacagtcgttaacagtatacaacaactttcaaactcccgtcttcagtggataccaaaaatcggaaagccactataaaacccaatgaagtcttcatctgatgctctgaacaggaaaagtttagagtgagggttgacatttcacatttagcatgttgtttaacaactttaaacaagccgaccctgactttcaggaagtgaaatgaaaatggcagaatttatctgaagatccacaatctaaaaatggaggcactgttctttcgacagatgccatctcagtggcatcactggaaagtctagattgcctgacacactggtaaccaatgattaggggtcaggtcccaacagatgtctgggtcttaagggagttaagtctatgctgaaaggtagagagggagaagaggacataaaaacgaatttgtttttccataccacaaggcttttgtgccaaagtggccacgtgtgtcaaagtcagggaatccctcctcctgggagccaagaggaagtctctcacaactagaagggaaagatgtttccccacatcagtccagctgtgaagacattctattagtgacatatgccccttccccaaaatataacagtgaagtgttctgtgtgctaacaacatagcttaaaaaaattctgcatttttataaaacttgataaaaaatagtatttcaaactgtacagtcaccagaagtacacagttaccaaaaatgtacacacttcacttggcatctccagcaccttcagctttctgtgcctggtctgtcttggcatctccattttctgcagggttattcccttccttgccagcatccacttttccctttttccctttgggtaccttctcttctttgcaggggcctttttaggcttgggctctggctttggaggagcagattttgcagacaaccttgtggatcttctctgtggttcgtccttcaccttggctttatctcctttagcatcaccttcagcctttgtcttgggcatggtggcagcagcgacggcagcgggatgtaggtgctgtgcgcgggatgcagcggcacacgggctttggtcggtccaggggttgttctcgcctcttcttctgaaaggtctgaatcttcagtggctcttcctttttttttggttgctgatgtttttcattaacttttactattgaatatgagactagtaagaagagccccagagaatacctggttccagacatagtcctccttgccattattgttagtggcaactgagtttcccctggatattgggatcagtcattccaggtagtagaataatcccttatttgcctattggttgaatgacatgaggcctcaaaatggccagatgatagtcacaacttctaattcaatgaaaccattgtgtgacctctcatggaagcattctttccttaggaactaagatctttagcagagcccaaagttgcaggataggatatgttgtgggctaaatttatatgtaccccccacccccggcaaatttatatgtggaagccctaactctcagaacctctgaatgtgagtgtctttggggatagggcctttaaaaagttgattaagctaaaatgaggcaattaggatggaccctaatccaatctgactagtatccttataagaagagcaaatttgaacacacacacagagacaccaggggtgtgtgtgcaccaagcaaagaccatgtgagggcaagtgagaaggtagccgtctgcaagccaggaagagaggcctcagaagaaaccaaatctgctgacactttgatcttgggctttcaacctcaagaactgtgagaaaatttctgttgtttaagccatccagtctgtggtattttattatggaagccctagtgagctattataggatacaaaaattctgcaagtgggttagtaagtgtaatagggaaatgactcccactttaccccttgattctctgacccatgtattctactgtgggtaagacagcaccgaatgttgatcaccgcatcaaaatatataccacatggaagatagaaccctatcctttcagagtggtgtctttcagatggtggaataactgagtcttcagaggccattccacattcttttaggtcaggtggttccagctgatagagtatgggataagggcagtgaattttatgggtgtgatcccattgcctcacttcttttgtgaaatgagttccttaatccaagtgatgttgtgcagaataccatgatattgaataagccattctgtaagcttacaaatgtgtttttggcagaagtatcatggtttgggaaggcaagtctgtattcagaatacatgtttattccagtgaggacaaatctctgcctctccatttgctgttggcaggttaggcactcagtcatagcagtaatcaatttagccttgacaagggaaagtccgtgttgttgagcccagcgcatagcctccagctctgccaccatagccaacttgtacatggatccattgaataagcacttgatggtgagggaaacaggtggattagcattcacaaaatgtgccattttgactacctggttactgagaatctcttctttaatagatgttctttagggagcattcacacaagagacaagtgtcttcccactttatgctccctctgaaaggtccatcttcttctccaggcctcattgtcaccagtatttctttttttttctttttttttgagacaatctcactctgttgcccaggctggagtgcagtggcgcgatctcggctcactgcaagctctgcctcctgggttcacgccattctcctgcctcagcctcccgagtagctgggactataggcgcccgccattgcgcccggctaatttttttgtatttttagtagagacgatttcaccgtgttagccaggatggtctcgatttcttgacctcatgatccgttctgaccccccgggggattttccttcatcattttccttctaggccacccttgagtggggctacaatcctgcagccatccacttctggttggtatcagcatggcttgcagaaccatcagacctcaggaacttcacctaggtggaaagcactagaggaagactaagggtgaggggtgaaggacttgctccttcctcatggttcctgtttgctttcttcctgcttcttgtttctgtgcgtgttcgcctagaatgcttcttgaacctccagtgacagaaccttcccacagcagctgctgaatttagtttgcagcttttccaaccttaccaaatctctcctcaaagccaccagcagaagtaccacaaatgattgtagagaagggtgggtttggagctaagagataatgttgtaataattggctataggaacttgcctataattctttttttttagtatatataaaggagcaaactgaggaaagaaatagtagagataatataaaatagcagtttttggccaggcacagtggctcacacctatagtccctgggaggccaaggcgggcggatcacctgaggttaggagttcgagaccagcctggccaacatgtagaagccccatctctactaaaagtataaaaaattagccaggcgtggggggcgggtgcctgtaatcccaactactcgggaggctgaggcaggagaatcacttgaacccaggaggcagaagttgcagtgaggcgagatcatgccagtgcactccagcctgggcaacaagagtaaaactccggctcaaaaaaaaaaaagcattgtgttttttttgtttgtttgtttgtttctttgatacggagtctcgctctgttgcccaggctggagtgcagtggcgcgatcttggctcactgcaagctccacctcctgggttcacgccattctcctgcctcggtctcccgagtagctgggactacaggcgcccaccaccacgcccggctaatttttttgtatttttagtagagatggggtttcaccgtgttagccaggatggtcttgatctcctgacctcgtgatccacccgccttggcctcccaaagtgctgggattacaggcgtgagccactgcgcccggctcaaaagcagttttcaaacctggcttcacaatagacttacctggagaactttagaaatacactagaattttatatttagaaaaatattttaaagtataaaacatttaaatatatttaagtatatttaaatagaaatagatgtgtgtgtgtgtgtgtgtgtgtgtgtgtggagcaatatatatatatattcacattaaacaaaacaatatattgggcttttcccttagacattcaattggtctggggtgggacttgggtattagttttgtttgtttgttttttttttttttttagagatggagtctcgctctgttgcccaggctggagtgcagtggcgtgatctcggctcactacaaactccacctcccagattcatgccattctcctgcctcagcctcctgagtagctgggaccacagatgcctgccaccatacctggctaatttttttgtatttttagcagagacggggtttcaccgtgttagccaggatggtctccatctcctgacctcgtgatccgcccatctcggcctcccaaagcgctgggattacatgcgtgagccaccgcgcccggctgggcattagaatttttttaaagcttcctaggtgagtctaatgtgcagcctgagttgagaaccactgataataaatcaaagaaggccaggcatggtgactcacacctattatcccagcactttgggagacaggcaggaggactgctgaagcccaggcatttgagattaccctgggcagtacagaccctgtccctacaaaaaaattaaaaaattagccaggcatagtggcatgtacctgtagtcccagctgcttgagagcctgagtgggaggattgcttgagcccaggagttcaaggctgcagtgagctatgatcacaccactgcactttagcctggatgaccctgtctctaaacaaagcaaaagcaaaatcaaaagaaaaaaaaaaaagaagccagaactcctttagtttagatgtgcacacatagttgtttttttgttttgttttgttttgtttttgagacagagtttttgctctcgttgcccatgctggagtgcaatggcacgatcttggctcactacaacctccgcctgccgggttcaagcaattctcctgcctcaacctcccgagtagctgggattacaggcctgcacctccatgtccggctaattttgtttttctaatagagacgaggtttctccatgttggtcaggctggtctcaaattcctcacctcaggtgatccgcctgcctcggcctcccaaagtgctgggattacagatgtgagccactgtgcctggcctgtgcacacatagttaaatggaagaaatagaaaagtataataccaattagcccaggcaaatcactatcctgcactgattgagtagaagggccatggaaggtggactctgggttgggggtgcctcctggttagtaatactgttgtgtctgttcagtccttattcagatcacaacgcagctgaagctggagcagactatccgttgcctgctggatgagtgccacaaagaggtcagaaaatagctatgggttcttgagtctctcagaatcctcagatgtcagagctgggtcaaccctttgaacaaatgagagattgaagtccagggaggaaaaggagctttcctgaggtcactgagttggtggcagagtcagagctaaggcctgggtccactgatcatgctccagtgttctttacagctttcttctttcccctttcaatctcccaaatgttacctccatgcaatgaagtgccatctttctggcataatcatcccatggttcattttccgtgacttcctaattataatacagatttccttgatgaagttgtcaaggaaatatgttctctatgtcttgttttggtggttttatttaattttgaattgtatacattacttagtactgaaggtgtttggttctatcagcttactttgtactgaaggcgtttgcttctatctgaggtaagcattgagtggatatggtatgtttaatctgctttcttcagtgtagtcaaagaaattagttagccaggcacaatggctcacacctgtaatcccagcactttgggaggctgaggtgggtggatcacttgaggtcaggagttcgagatcagcctggccattatggtgaaaccccgtctctactaaaaatacaaaaaaaaaaaaaaattagctgggcgtggtggtgcatgcaagtaatcccagctactggggaggctgaggcaggggaattgcatgaacccaggaggtggagtttgcagtgagctgagatcgcaccactgcaccccagcctgggtgacaaagcaagactccatctaaaaaaaaaaaatatcagttaaagagcagcttttgtgttgtatttaagactgaggaataatatcagaataactttttatttaatttgcagaaggaaaacaaatgtttatcttgttaaaaccatcaagaacatttcattataaattatatttcaattatatcatagttattttacatatgattaatatgtcagattgaatttataattatatatatcagtgcttatgattatgatgagatgatgccacttaacatttattgagcactttctatgggctagggattgtatgaggtggtttatatgtaatatctcattcagccctatcaacaaccctataaagctgttactattattatttcccaccagagttaagaatcttgccaaaagtggtatgactagctagtcaatagaaaaggtaaaatatggactattgactctccctgtaaagcatgaagcatagtgcctggtatacagagaatgttcagtaataggagctataataactatgataacaataattttttttttttttttgagacggagtctttcactgtttcccaggctggagtgcagtggcgcaatcttggctcactgcaagctccgcctcccgggttcacgccattctcctgcctcagcctcccgagtagctgggactacaggcgcctcccaccacacccggctaattttttgtacttttagtagagacggggtttcactgtgttagccaggatggtctcgatctcctgacctcgtgatccgcccgcctcggcctcccaaaatgctgggattacagcgtgagccaccacgcctggccaacaataattttttttttttgcatcgagtcagtgttctgtctttatgacatttcaaacttttgtcccccaacttctggttctatggaggcaaaatatgtagattttaattcagtttaacaaacatgcactgagctaggtactgaggactctgagaggactcagtccctttcctctgggagttcccagtccagtgggggagctggacactaagctaaaaaagctgattgctgactgtggtgagagacacatgcaatacaggcattggtgtgggtagggaaagatcagttttggtggaagatctgtcctgatcctaattgacagaatggagcatattcactttctgtagctgtgtaacatgccctccatgcgaggcagcctggccaccctgacccttcttggcaagttggtggatgccatccctgctctggcagacgagcttgtaatggagcatggtgagtgacctgtgggaggagctgccactacccttttacctgcttttatcatactgccatttgggtgtcccattcactctgtacacctgggaagtcattactttcctgctttagccttcagtttccccgtctgcaaaatgtactgtatgtcggtcaatttgaaaaaggtcagttttttgactctattcttggactatttccattcattcttttttttttttttttttttttttttttttttttttttgagacggagtcttgctcttgttgcccaggctggagtgcaatggcgcaatctcgactcactgcaacctccacctcccgggttcaagcgattctcctacctcagcctcccgagtagctgggattacaggcatgtgccaccacgctggactaattttgtatttttggtagagacggggtttctccatgttggtcaggctggtcttgacctcccaacctcaggtgatccgcctgcctcagcctcccaaagtgctgggattacaggcgtgagccaccacgctggccttccattcattcttttttttttttttttttccctgagacgagtcttgctctgttgcccaggctggagtgcagtggcgcgatctcggctcactgcaagctctgcctcccgggttcacgccattctactgcctcagcctcccgagtagcttggactacaggcgcctgccaccatgcctggctaattttttgtatttttagtagagacggagtttcaccatgttagccaggatggtctcgatctcctgacctgctgttggacccgcctcagtctcccaaagtgctgggattacaggtgtgagccaccacgcccggctccattcattctttaacacaaattaattaagtacctactatgaaccttccttttggatggaaggaggaattctggaatatagaagcacttttttctgtcagtgaaatgcaaataaatatctcccagaggatttaccaaagggtaaataacttctttaagttggtttcccctttttaaaaaaattaataataataataataattttttgagacagaaccgggctacagcgcagtggcatgatcttggcttactgaaatctctgcctcccaggttcaagtgattttcctgcttcagcctcctgagtagctgggattataggcgtccgccacaacaccaggctaatttttgtatttttagtagaggtggggtttcgccatgttggccagactggtcttgaactcctgacttcaagtgatctgcccacctcggcctcccaaagtggtgggattacagccatgaggcaccatgcccagcctaattattattattttttagagaccagatctcactatgtagagcaggttggtctcaacctgctggtctcaagtgatcctcccaccttggcctcccaaagtgctgagatttcaggaatgagccactgcacctggctttctttttcttttttcttttctttttttttttttttgagttggagtctcgctctgttgcctaggctggagtgtggtggcatgatctcggctcactgcaacctctgcctcgtgggtttcagcgattctcctgcctcagcttctcaagtagctgggattacaggcgtgtgccagcatgcccggctaatttttgtatttttagtagatgctgggtctcgtcttgttggccaggctggtctcgaactcctgaccttaggtgatccttctgccttggccttcccaagtgctgggattacaggtgtgagttactgtgcccagtttggttttgcctttagattaagcatgcagaaagcattttttgtgggggattatagggacttaccattactaccccgttaggaataatagattggagtttcatatagcagttgacattgtgaaatttcccttggctccttggttgttttctggacaggcaacctgatggagcatctgttgagaggcttagtataccccagtgagggcatacaagcttctgtctgttacctttatgggaagctatactcctcaccagtggcagctgagatgctttcaggacacttccgtgagaagctttttcccctcttcctttccatcctggatggtgcccagacaaaggagctgcagattaactgcttgggtaagacatgaggctggagaaaaaagggagaataagtttttgacattttgctagaagacttgagatattgggttctctagtagtggggaagtttgctgttttgcaaaaggtagaagccacaaggcttgagagataagagacacactgtgtgaaagatgcctagagttggtatgacatcttaagaatgttgcctttggaggaaaataggaaggaaagtgggacagcaattttttctgcctttactgcctgccctggtgcatcctgtatttgctggcaagttaatctttacattgtatagctcacgtcctgtcactttcttaagtcagaaattcttccatggttccctctggcctccagggtaaagcctaggtgtcttagtgcattttatgctgctataacaggataccacagactaggtgatttataatgaaaaacttattggttcagaaatttattggtttgtagttctggagcctaggaagtccaagatcaagaggctggcagttggtgaaacccctcttgctctgtcatcccatggtggaagggcaaagagagggcaagagaaaaagctagaggggactgaacttgtccttttttttcttttttctttttttttgagacagagccttgctctgttgcccagcttgagtccagtggtgctttctcagctcactgcaacctctacctccccggttcaagtgattctttttttttttttttttttttgagacagagtctcacactgttgcccaggccggactgcagtggcgcaatcttggctcactgcaagctccgcctcccgggttcacaccattctcctgcctcagcctcccgagtagctgggactacaggcgcctgccaccatgcccagctaattttttgtatttttaggagagacggggtttcaccgtgttagacaggatggtctcgatctcctgacctcgtgatccacccgccttggctcccaaagtgctgggattacaggcgtgagccaccgcgcccggccggttcaagtgattcttatgcctcagcctcctgagtagctggcattacaggcacccaccatcacatccggccaagttttatatttttagtggaaacggggtttcaccatgttgcccaggctggtctcgaactcctgatttcaggtgatctgcccaccttgccctccccaagtgctgggattaaaggcgcaagccactgtgcctggcctgaacttgtccttttatgaggagcctactctcatgataacaaacccactcccatggtgatggcattaattcattcatgagggtccaaacccaaaccccaaactcatgacccaaacaccacccgtaggtcccagctcctgataccgctgcattggggattcagtttccaacacatgaactttggggaacacattcaaaccatggcactaggtttctctgcttgttacttgaggctctttagaagccccaacatacccttttaacgtcctctcctgctatttttttacataaatacataaggtctatcaactgttctaagcagggagatttcttattttgggcagaacagatgggcactgtaattggtgcctggttgagggcctgttctcaggtagaagctgtagagaaaagcatagtctattggtgacagcagcttcttttcaaaatttggatcaggagctctgttatgaatgacctagccatacatagtgagcattcgttctatagctggccctgtgctgggctctgaggtcacagagatgatcaaatccaagctttatcttaggggagctcacaggccagtgtagaagacacacatggacaactagagtctagtgtgatgagtgccatcttggaggtgcacagcagagggtaggagcaggggacaggagaagcttcctaaaggaaaggatgcctggactgagtcctaaattgggggggagaggaggaaggcagaaacacgggccagagcacgaggtatgaagcagcctgtatctgcggtaacttgcagcagggcagtgttggagttagtgcatatagaacaaaagggtgcaaatacaggccctagggtgaggcccttggcagtcctacagctcacctaaccacagcagagggaaatctcaactggttatactgggaattcccacttttattttttaaaatttttatttacttatttattttgagacagggtcttgttctgtcacccaggctggagtgcagtggtaggatcacagctcactgcatccttgacctccagggcttaaatgatcttcccacctcagcctaccgagtagctgggaccacagcctgcactactatgcctggctcaattttttttttttttttttgacggagtctggcacagttgcccaggctggagtgcagtgggcgtgatctcagctcactgcaagctccacctcccgggttcacgccattctcctgcctcagtctcccgagtagctgagattacaggcgcctgccaccatgcccggctaatttattttttattttttattttttttgagacagagtctcgctctgctggccaggctggagtggagtggcgtgatctctgctcactgcaagctccgcctcccaggttcacgccattctcctgcctcagcctcccgaatagctgggactacaggtgcttgccaccacgcccggctaattttttgaattttttttttttaagtagagacggggtttcaccatgttagccaggatggtctcgatctcctgacctcgtgatccacccacctcggcctcccaaagtgctgggattacaggcttaagccactgcgcccagccttttttttgtatttttagtagagatggggtttcaccatgttagccaggatggtctcgatctcttgacttcatgatccgcccatctcggcctccccaggatatgtccgcctcggcctcccaaagtgctgggattacaggtgttagccaccacgcccgttctttttttttttttttttttttttttgagacggagtctcgctctgtcacccaggctggagtgcaatggcacaatctcggctcgctgcaacctccgcctcccaggttcaagcaattctcttgcctcagcctcctgagtagctgggactacaggcgcatgccaccacatctggctatttttttgtatttttagtagagacggggtttcaccgtgttagccaggacagtctccatctcctgacctcgtgattcgcctgccttggcctcccaaagtgctgggattacaggtatgagtcaccgtgcccagcccgtgcctggctaattaaaaaatttttttttgtagagtctgggtctcattatattgcccaggctggtcttgaactgctgggctcaagagatccacgtgccttggacttccgaagtgctgggattacaggcatgaaccaccacacccagccagaattcccgtttttaaatgctaccccttttttttttttttttttttgagatggagtctcgctctttcaccatgctggagtgcagtcgcacgatctcagctcactgcaacctctgcctcccgggttcaagtgattctcctgccacagcctcccgagtagctgggactacaggcgcgtgctaccatgcccgactaatttttgtatttttagtagagacggggtttcaccgtgttggccaggatggtgtcaatctcttgacctcgtgatctgcctgcctcggcctcccaaagtgttgggattacaggcgtgagccaccgcggccagcctctttttttttttttttaaataataaaaaaaattaaccctatgcatgtttgtcagacccgagggcctcttttatcctggtcaacgggagtgctaaccttctttcagacaacacttaaaggtcacctcttctctggagcctttccttcccaccctctcccctcagccagggatgtagtcacatcctttggacccttgaagcaccaagggtcttatattctgtcttatgtcatcttattcacttactttacaacccaagatcctcataagttcttattttatttaatttacttatttttaaagatgggacctgttctattgcccaggctgaagtacagtagcatgttcatagctcactgcagcctcgaactcctggcctcaagtgatcctctcaccttgatctcccaagtagctggtattacaggtgcacgccaccttgccagcattttaatttttttttttttttttttttgtagagatggggtcccactatgctcataagctgtttatggtctaatccttattaacctctcaagcctcatctctcacttctctatctgtccccaccctaactcagccttactgaaccaaatccatctccaggaacacaccatactctcctgcctttatatattcctctgcccagaagttggctcacatccaacttctcatccttcaagatttggttcaaatatcttcttatagaagccttccctgggcccccaggctagattagatgattcatttgatttcctgcggtcctctgggcttttttccacattatttaattttaatatttaatattctgacatgcatttctttacttgtttgttaaagtatgtattatttggaacactttggtgacttaccatgaatcccagcataagtaccagaatccttaacatagcttatgtggtcttttgtgactacttctcaaatgtaatttctggacttttttttcccccagccattctggctttctttcactttctagaatgttgttctctgtatctggaatacttctccccacttcacctacttttacgtacttatttttcagattcagcttaaatggtacttgctgatggaaggctttactgatcccccacactgggttaaatcctcatatacattttcatgtatttgggtatttctcatttacatcatttatcacaattataagggtcatttgtctgacttggttttttttttttgagatggagtttcactctgtcacccagggtggagtacagtgacgccatctcagttcactgcaacctgtgtctgctgggttcaagcgattctcctgcctcaacctcctgagtagttgggactacaggcacatgcctccatgccaggctactttttgtatttttttactagagagggggtttcaccatgttggccaggctggtcttgaactcctgacctcaagtgatacacccaccttggcctcccaaagtgctgggattacaggtgtgagccaccacgcctggtcttgtcttacttgtttttgtgtttgtttctcctacaggagtgtatgctccctttgttagtcaaaaaatattttttgagttcctgctatgtgtcaggaactgtgccaggtgatggatgatgttatgttgaaaaaactcacattattcctgccctcatgaaacttatagttgagtgaggcagtcgggctatgtttatcttgcttactcttgaatccctagacccttaggcctagcacttagtgggctctcactagatctgtgtggaagagagtcgggtgcaaaaagcaaattggtgcttaaggattctaaccattcttcatatttgtagagggatgaagaagtttctctggggatgtctgaggggctatcttgggagtactctggtgcctgtgttcctcttgccttacttcccaatccctttgtttcctaggtttgctgaggcagctgttgaagtatgatctctttgtgtccatgatcatgaaccaggatggactgggagaaagtgctaagaatatcgaagggtcatcaggaaatacctcactgcctttggtgctcaaaaaggtagttgtcttgtgattcctggtctctaggttcaataacaaggggacccaagtgcttcttgggccttgtcttcatctaccactcctatctcagatttccaagtgttttcttactgggcaaaataatatactggctgggggcggtggctcatgtctgtagtcccagcactttcggaggcctaggttggtggattgcttgagcccaggagtgcaagaccagcttgggcaatatggcaaaaccctgtctctataaaaaatacaaaaaagttgggcgtggtggctcacgcctgtaatcccagcgttttgggaggccaaggctggcggatcatgaggtcaagagattgagaccatcctggccagcacagtgaaaccccatctctactaaaaatacaaacattagctgggcgtggtggcacacacctgtagtcccagctactcgggatgctgaggcaggagaatgccttgaatctgggaggcggaggttgcagtgagccaagaccgcgccactgcactccagcctggtgacagaacgagactctgtctcaaaaaaaaaaaaaaaaaaattagctgggcgtgggcgtggtggtatgcacctgtaatcccagctactcaggaggctgaggtgggaggattgctcgaacccaggaggcggaggttgcattgagccatgatcatgccactacactccagcctgggtgatagaaagtagatttcctttcatttgtaaattctttttttttttttttaagtgccgaggtcttgctctctccactcaggctggaatgtagtggcacaatcacggctcactgcagcctcaacctcctgggctcaagcgatcctcttgtctcagcttcctgagtagctgagactacaggtgttcaccatgaggcatggctaatttttaacttttcgtagagacagggatctttctatgttgcttgggctggtctcaactcctgggctcaagtgattctcccaccttggcctccaaagtgctgggattacaggtgtgagccactgcacctagcctcagttgtaaattattattattttttttttgagatgtagtctcgctgttgcccaggctggtgtgcagtggcgtgatcttggctcactacaacctccgccccccaggctcaagcaattctcctgcctcagcctcctgagtagttgggattacaggcgccaagccaccatgcccggctaattttttgcatttttagaagagacggggcttcaccatgctggccaggctggtctcaaactgctgaccttgtgatccgcctgcctcggcctcccaaaatgctgggattacaggcatgagcccccaggcccagccgtaaattcttacctctgcacttccccttcacatttgggctgcctgaaaatggagaatacttacagcaatagaaacaaagtcacctcagttgctttagggatcagattctgagcttggtactgagaaccttctttatctggatatccttcagcctcactttcctgtctcttccaccccacaacccagtgctccagccacatgcagtctttccctggtcctgcatatgctaggtcatcctgtctcactgcctgtgcagttgctcttcctctgcctatagggcatttctcctctctttatctgctgatatgagtcagccttcaagcctatagggctcccctgtcaccctggctcctttaggcggaatgtgacccactgtcaccgtgcttacctcataccatattgtggttgactggctgggagctctttcagggcaaaacctgagtctggcatctttccccagtgctcggcacgggggctggcagagctgcaaaccctgatgtgatagcaggggttgattgcccaaactctggggctctttctgcagcaaggaagaggaggaggagctctggttagaagtgagaagggaggccgggtgcagtggctcatgcctgtaatcccagcactttgggagaccgggacgggtggatcacgaggtcaggagttcgagaccagcctggtcaacatggtgaaactctatctctactaaaaatacaaaaattagccaggcgtggtggcacacacctgtaatcccagctatttgggaggctgaggcaggagaatatagcaagaaaagtttgtcctgagactacagcaagaaaagaaaagaactgacttctaaagaaaatagtttagtccatttcagagtttaaatgtcggtcatcaagtgtaatgagctaggatcaggtttctgacttaggaatcatacacgtattccataagttttagtgtagttttaagcttaaaacttaacttaaaagcagtaacttaaaagcagttactgttgccattttcaaacatatgtacttaaacaacaacagggaaactaaaaatgtgttatcaaatcacaaaactgaagtgtaatgaaatttaaccaattaaacttcaaaaaagaatatttattttaaaccaagaatcattgttttaatggatacatatcatatttctttgattctgagatacattttttcacattttaacagctctgaaattgggagacattttaccatcaatggtgcatcatagtttaattgggagcactttttctttcttagtggtacataaaataatggcttgcgttacatcaatagcatcttaagatacaatatgtcatttcttttataaaagagaacaagataaagattaatttctttttttttttttgagatggagtctcgctctgtcgcccaggctggagtgcagtggcgatatcttggctcactgcaagctccacctcccggattcatgccattcccctgcctcagcctcccgagtagctgggactacaggcgcccgccaccacacccagctaattttttgtatttttagtagagatggagtttcaccgtgttagccagcatggtctcgatctcctgacctcgtgatccacccgcctcagcctccctaatttctaaactcctttatatactatcagaaaatctggcttttttttttcttttcctgataagtctgacaagtaggaaggctgtttatgtgtccacttgtaagtccaatatggctgagatggggttaagcttgcagtcctcagatgtatctttaccagacattagtagtctcatgtctacttggtcctttttcttaaaagctgtaaaaccaggtatgccctccattcttctggtgatgtatattctgtttggcatttttctcccccaaaatcagcttctatgatacttaaaatctgtggttgcagttaacgcttttcttgatttctgaaagtgttagaggcatccctaatagctatggtgacgagtaggagtttggatattattcagagtgcaatggaaattcactgagatgtttggagtagcaaatatgcctgatctaaaaattctgatgggggaggcatcacagttgtgggtagactcctagatttggacttggctgacctgagtttgtgccttagctttgccacttatcagctgtgtagcctagagtaagtaacctaaccttgctaaaggttcccaaagactacccctaggtttgatgatttgctaggaggactcataggactcaacgtatagtcatactcatagctacgatttacggcagtgtaaggaaagcagtatcagcaaaaggaaaggtgcatggggcgaagtctggtggaaccaacacaagcttccagagtcctgtctcagtggagtcacatgggatgcacttcttaatttccccaggaatgaactgtgacatgtgaaaccttacctactgaggaagctcatcggagtgtcagtaccccaggtttttatgggggactggccgttcacgtaggtatcctctgctgagcatgtaccaaaattccagactcccagaaggaaaacaggtattcagcataaactacagttgtcccttgtatacacgggagattggttccaggaccgccggcatatacccagacccacatatactcaagtcctacagtcagccctggcaaactccagtaagttggccctgttcatatgccagtttcacatctagtgaatactgcattttccatcagcgttcagttgaaaaaaggccacatataagtagaaccacacagttcaagcctgtgttgttcaagggtcaactgttcattgtacacatagtttagtcacagtgagccactctctcagttccgttaggaaccctcctgaaatccaagttcccaaacccagccaagagccagccttgcagagagggttttctaagtataatagcctcaggcctactgtgttaaatcttttctgtgcactcaataaattgaggtttatagtagaaccttcccttgttatgtcacagaattgttgcaaacatcaaagccagatgagggccagctgggcacagtggctcatgcctgtaatcccagcatttagggaggccaaggtgggaggatcacttgagcccagaatgggccatatactgagaccttgtctctataaaaaattttaaaatgagctggggctgagcatggtggctcatgctgtaatcccagcatttggggaggccaaggcaggtggatggcttaagctcaggaatttgagaccagtctgggcaacatggtgaaaccctgtctctataaaaataaaaattagccagggtggtggtgcatgcctgtagtcccagctacttgaggggctgaggcaggaggattgcttacgttggagaagttgaggctgcagtgagtcatgttcacacggctgcactacagcctgggtgataaagtgagaccctgtgtcaaaaaaaaacaaaatagtaataaggcaaggcgtagtggctcatgcctatattcccagcactttgggaggccaaggcaagtggatcacgaggtcaggagttcgagaccagcctggccaatatggtgaaaccctgtttctactaaaaatacaaaaattagctgagcgtggtggtgcacgcctgtagtcccagctactcaggaggctgaggcagaagaatcgcttgaacccagggaggcggaggttgcagtgagccaagatcatgccactgtactccagcctgggcgacagagtgagactccgtctcaaaaaaaaaaaaaaaaaaaggtaccaggcatggtagcatgtgcctgtagtccccgctactcaggaggctgaaatgagaagatcgctggatacctggaggcagaggttgcagtgagccatgagccatgatcatgccactgcactccagcctgggcaacagagtgagacctgtttcataaataaataaaccagatgactttgaaagtacttttgttaatgaaggcttgagcacttattggtgataacagttacagtgttctttgagtgcccctggtgagttttacattgtgttctttccttatttttctcacctgctgctgttcacggagaccccttcccataatccataactgctctcctgaccaccatccttgtgcctggtgccatgtgggacaggaaggatcgaaaatgaattaggctattgccctgaggcacctaggccagtttttctggtcctattcgtggtgtgactggggtactttttgctgcctgtttctccagcttctcctctctagagatgaaaccctgcaggtggccagtgctcactgtataactgcggtgcttgtccactccccagcaaagcatgcgtcagccttcatccacgctgacatcccaggtaggggaacacttctaaccttctcctccctatactagaaggatggggtggtgacaggttcaattgtgtatgacagaccctatgaactatgtctcataacatctgaatcctattgctacagatttcttgtatgaccttgagcaatttgttaccgatttttgtcatttatttggtcatctatgaataaaaacctaatgtggggtggtgaaaagacctgtggaccaggtaggcaacaggaaacaatatttttcaagggactattatgagcagggactgttatgagatgcattgcaaatgttaccacatttaggtcttcatcttcactattttatagataaggaaattgaggctcagagaatgaaataattggcaggcctagtcattggcagagatgggataaaaagtcaagtctctctgactctaaaaactctttttccttcatccacgccactgcccattctgagaattaggagacttaagttccaactctacttccgccactaatagtgcctcttctctgggactcagtttccccacctgttaaaaagaagaggttaaaccataaccaagggcactttccaggtttattagtggattgatgatcatgactcatggagaggatatgtgaacagatgaagtagcaagagtaaggtgctgaataaatccaaggccttagcatcagttaagggatcgtgatcacatggctgtcatttattgttttctcatcctctcccttgttagagttcctctttgagcatctttcttcttccagtgaagtgctcgtctggtccagctgtaactgcttgacactcctggtagaagagccactctttttttccaagtgccacacggtgtatggttggtagtaagggtcctgtactagctttgggttgggtggacggcagtttgcacttgggtagcagccgcagtgatggggggctagcctccaccttggaggggagcactgagtctagacatttcatcagcccaaactcattaccagatttcatatgcaagtattgatatccaaatgttctgctgttcgctgattatcggaagtatatatgtttagacgcttcagcaagggaaggacacttcttttagccactaaatgaattcctgttgcatgttaacaacaactctaaacagtgttactcaaccttagatttagttctttcccatgccgcagatatctaaccatccaggtagtctctaagttttgctaatttattctttcaaagtttcttgaaactgtccttccttgtctgggacttttttttttttttttttttgagatggaatctcaccctgtcacccaggctggagtacaatggcgtgatctcggctcactgccacctctgcctcccaggttcaagcaattctcctgcctcagcctcccgagtaactgggattacaggcatgtgccaccacgcccagctaattttttgtatctttagtagagatggggttttaccatgttgtccaagctggtctcaaactcctgaccttgtgatccacccaccttggcctcccaaagtgctggattacaggcatgagccaccacgccaggcgactttttctttttttgagacggagtcctgctctgtcacccaggctggagtgcaatggcacaatcttggatcacggcaacctctgcctctgcctcccaggttcaagcacttctcttgcctcagcctcccaggtagctgggattagaggcgactgccagcacacctggctaatttttttgtatttttagtagagacgggggtctctccatgttggccaggctggtcttgaactcctgacctcaggtgatctgcctgcctcggcctcccaaagtgctgggattacaggcgtgagtgcactgtctgggacttattataccacatctagatttttagagtaggcacattcagtcattcattttatattcctagtttatgccaggcaccaggctgggacctggagatttagagataacaaataacattggttcttgccctcagaaaagggagagagatgcaaagggaaatttcattatgagctgattagagctctgctagagggaagcacaggagctgtgggggctcaggggaggttcacagctctgaatggatcagggaaggctttttggaggagtggggttttgacctgattctccaaggaggaacaggagtatgccaagtggagaaaatatggcttggtcagtaggtgttcactgaaaacctcaagtgccagggactgtgctatggcttgtactgggtgttggggagatgaatcagatgagggcccggcctcaaagatctcacagtctggtcccattagctcaatcttgtcagggtccctccacgagtggcctccaactcatacatgctgtccagagcctgtcacctcttctgggtgggcagtgaaggaacaagagagcactgatccctggcctctgtcatgtcatcctgtggtagggatcgaggcagtggtgaggagcctgcagggaagcctgaagatgaacaacatagagctgcacaagcagggcctgctgcttttcgctgaaatcctgacccggtgagcaaagtggtggaacatgaggcttgtaggggccagactgcagaaggaaaagtgggctttcactcctggtggggtcagtgagaagagttcacctactcgtttctcatcttccatttctcaggcagccagaggagatcaagctgttcacaagctcagccatgtgcagagatgctggccgtgccctccaagaagcagttagcagccctgtgctggaggtggctgctgaggccttgaaggccacttctgcttttctgaggtgagagacccaggcaggctgaactttccatccctgcatatacctaagggcctgttgaggccagggtagcggatatttaagtatccctagattacttataatacctaatatagttggcccttcataattgtggattccacatccatggattcaaccaaccatggattgaaaaattttttttttttttttttttggagatggagttttgttcttgttgcctaggctggagtgcaatggtgtgatctcagctcactacaatctctgcctcctgggttcaagtgattctcctgcctcagcctcccaagtagctgggattacaggtgtgtaccaccatgcccagctaatttttgtattattattagaggcgaggtttcaccatgttggccaggctggtctcgaacgcctgacctcaggtgattcacctgtctcaacctcccaaagtgctgggattacaggcgtgagccaccgcatccagctgaaaattttaaagaatggatggttgtgtctgtattgaacacgtacagactttttttcttgttattattccctaaacaatacagtatacgttggacatggtggctcacacctgtaatcccagcactttgggaggccaaggtgggttggatcacctgagcccaggagttcaagaccagcctgggcaacacaacagaacctgtctctactaaaaatccaaaaattagccaggcatgttggtgcacacctatagttccggctgcttgaaggctgaggtgggaggattgcttgaacctgggaagcagaggttgcggtgagctgagatcacaccactgcactccagcctgggtgacagagtgagaccttgtctcaaaagaaaaaagaaaaaaagaaaccaggccaggcacagtggcttatccctgtaaacccagcactttgggagaccaaggcaggtggatcacttgagtcaggagttcgagaccagcctggccaatgtagtaaaatcccatctctacaaaaacttaactgggcatgatggcgcatgcctgtagtcccagctactcaggaggctgaggcacgagaattgctgcagaggttgtagtaagccaagattgcgccactgcactccagcctgggtgacagagcaaggctctgtctcaaaaacaaaacaaaacaaaacacccaaacagtataataactatttatatagcatttgcattgtattaggtattatatgtaatctagagatgatttaaagtatactggaggaccacgtgcggtggctcatgcctataatcccagcactttgggaggccaaggtcggcggaccacctgaagtcgggagtttgagaccagcctggccaacatgtagaaaccctgtctttactaaaaatataaaaaattagccggatgtggtgtcacacacctgtaatcccagctactcaggaggctgagataggacaattgcttgaacctgggaggcggaggttgcagtgagtggagatcacaccattatactccagcctgggtaacagagtgaaattctgtctcaaaaaataaaataaaataaaataaaataaataaagtatgctggaggatgtgcataggttatatgcaaatactataccattttatgtaaggagcttgagcatcctggttttggtatcttcaggggtcctggaaccaattccccacagatactgagggacgactatgcaatgtcaatgcaatgtagacggggcgcggtggctcacgcctataatcccagcactttgggaggctgaggcgggccaattacctgaagtcaggagttcaagaccagcctggccaagatggtgaaaccctgtctctactaaaaatacaaaaattagttgggcatgatggcgcttgcctgtaatcccagttactcaggaggctgaggaaggagaattatctgagcctgggaggcggaggttgcagtgatctgagatcttgccactgtactccagactgaggccacagagtgagactccatctcaaaaacaaacaaacaaacaatggaatgtaaatagttgtcatgctgtatttaaaattttttttgagatgaagtttcgctctgtcgcccaggctggagtgcaatggtgtgatcttggctcattgcaactgctgcctcccaggctcaagcaattctcctgcctcagcctcccgagtagctgggactacaggtgcgtgccaccatgcccagctaattttgtatttttagtagagatggggtttcgccacgttggccagggtggtctcgaactcctgacctcaggtgatccacctgtgtcggcttcccaaagtgttaggattacaggtatgagccacttgcacctggcctacattttatatatttttttattgtatttttttcttttttttgagatggagtctccctctttcacccaggctggggtgcagtggcgtgatcttggctcactgcaacctccgcctcccaggttcacgccattctcctgcctcagcctttctagtagctgggactacaggcgcgcgccaccacacctggctaatttttttgtatttttagtagagacggggtttcactgtgttagccaggatggtctcgatctcctgacctcgtgatccgcccgcttcggcctcccaaagtgtttttttttttttttttttttgagatggagttttgctcttgttgcccaggctggagtgcaaaggcatgatctcggctcaccacaacctctgcctcccgggttcaagtgattctcctcctgccacagcctcccgagtagctgggattacaggcatgcaccactacacccggctaattttgtatttttagtagagacggggtttctccatgttgggcgggctggtctcgaactgccgacctcaggtgatcccccaccttggccttccaaagtgctgggattacaggcgtgagccaccgtgcccagccatattgttattttttttatagattttaaaaaatatttttggtccacagttgattgaatccatagatgtagaatccacaatacagagggccaaattatacttccaaagtgttatgttatcatgtcttttgtattttctctgttgttttgaatttatatcttgaaagaaaattctctttcattttggtaaggagtagcagaggtaactgtatctgttgactccatcacctttaatcagaagctggcagctctttaacacctatgaactccagcctctagccctggttctcttactgtagttcctctttgaatgctctcagccactcacagagcttcagctactagctatatgttgataatgctcaaatctatagttcttgcctaaaatgcctgtgttagtttcctattgctacaggaccagattaccacaaacttgaaaacaacaggtatttaccttctcatggttctagggggccagaagtccaaaatcagtatcactgaaatgaaatcaaggtgtcagcagggccacactccctttggagcttctaatacggaacacttccctgcctcttccagcttctggtggctccgggcattccatgacttaaggtcatatcactgtaatcactgcctctgtgactacattgtcttctcttctctatgtgtataatctccctctgccttttctctttcttttcttaaatttttttcttttttctttttctttttttttttttgaaacggagtcttgctttgtctcccacgctggagtgcagtggcgtgatctcagctcactgcaagttgtgcctcccgggttcacgccattctcccgcctcagcctcccgagtggctgggactacaggtgcctgccaccatccctggctaattttgtttttgtatttttagtagagacagggtttcaccgtgttagccaggatggtctcgatctcctgaccttgtgatctgcgtgcctctgcctctcaaagggctgggattacaggcgtgagctaccgcgcctggccaaaaaatttttttttattttttgtagagatagggatcttgctatattccccaggctggtcttgagcttcaggcttcaagtgatcctcccactttgacctctcaaagtactgggattacaggcatgagtcattatgcctggctgcctctctctcataaggctacttatgatgggatgtaggggaccacctgaataatccaggataatggctttatctcaggattctctgtgaaaactttactgtagaaaataacataggttcctgggattaggacctgacatctttgggtaccaccattcagcccactatagtgttttcctgaactccagaccacatttccaactgcctggtgctttattccagaaccttcaatctcaatttgtccatgctactagcatatagagaaaaacacccaatttgggatctaaagaattagatttgggtccctggctccacaaacagtactcagtcacttcttgttcattcctctgatctgctttctgtttcttgaacacatcaaacttattcctgccactaattattccaactctgcccaaaataatattcccttaaatcattgtgtgactgcgtttttcttatcattcaagtctcattcagaatttcctttcctaattgaccttatcagactgctatagcacctatcaaacatttgaaagttattgtttattcttttttttttttgagacggagtcttgctctgtcgcccaggctggagtgcagtggcgcgatctcggctcactgcaagctccgcctcctggattcacgccattctcctgcctcagtctcctgagtagctgggactacaggcgcccaccaccacgcccagctaatttttaaaaatatttttagtagagaaggggtttcagtgtgttagccaggatgatctcgatctcctgacctcatgatctgcctgcctcggccttccaaagtgctgggattacaggcgtgagccaccgcgcccggcctctttttttctggggggtgaggggtcagagtctcactccgtcacccaggctggagtgcagtcatgcgatcttagctaactgaaacctctgccttctgggttcaagcaatttttctgcctcagcctcccaaatagctggaattacaggcgtgagccactgaacctggcctattcatttgttttgtaccccgcctccccccactaaaatataagctccaggagctaaaggaccttgtcagttttttcactgctctgtctctggctcctcataggtagtcaatatgcgaatgtaggatgttaaaatggacagtgagactaagggatcctagcaccacaatgggaaattattccttagcaaggtgcttgaaatcttaaaaaataataataataaccgaggaaacccatatttatagagtaacttttattttgttaccatattttctcttttaattttctaacacagtaatgtattcaaataatacaaaacaaaatattggctgggcacggtggctcacgcctgtaatcccagcactttgggaagtcaaggtaggaggatcgcttgaggctaagcgtttgagactagcctggacaacatagcgccaccccatccctacaaaacaatataaaataaaataggccaggcacagtggctcatgcctgtaatcccagcactttgggagtccgaggtgggtggatcacaatgtcaggagattgagaccatcctggccaacatggtgaaaccccatctttactaaaaatacaaaaattaggctgggtgtggtggctcatgcctgtaatcccagcactttgggaggccgaggcgggcggatcacgaggtcaggagttcgagaacagcctgaccaacgtggttcatccccgtttctactaaaaatataaaaattagctgagcacagtggcgggtgcctgtaattccagctacacaggaggctgaggcaggagaatcgcttgaacctgggaggcggaggttgcagtgagccgagatcatgccactgcacttcagcctgggcaacagagcgagactctgtctcaaaaacaaaacaaaacaaaacaccaaaatacaaaaattagctgggcgtggtggcacatacctgtaatcccagttacttgcgaggctgaggcaggagagtcacttgaaccagggagttggaggttgcagtaagccaagatcacgccactgcactacagcttggtgacagagcaagactctgtctcaaaaaaaaaaataaataaataaataagtaataaaataaataaataaaattagctgggtgtggtggcatgcacctatggtcccaactacttgggaggtaaggcgggaggatcacttgagcctgggagtttgaggttacagtgagctatgatcacaccgctgcactccagcctgggtgacagagtgagatcctctcttgaaaataaataaataaattatagaggatttatcatgaaaaggaataggctgggcatggtggctcacgcctgtaattccagcactttgggaggccgaggcaggtgcatcacctgaggtcaggagttcaagaccagcctggccaacatggcaaaaccctgtctctactaaaaatacaaaaaaaaaaaaaattagctgggcgtggtggcgagtgcctgtaattcccgtcttaaatttaagacattattcattgacttgccagttagaaagatcaatatttaattagctcacattttttgtcttctctacatgtccttggcatttttgctatttaatattttgtttttaacctttaaataatgtacctaaaactggtatttcttgttccctcaacttgaagcagtgtctcctgagttcctacgtggttagcagcaccccaactcttcttttcccctctcttccctacttctacttctcaaggccagtcagctatacctttaattttacattgtgaaagttgttaatatttatagtctcttctgtaactatatttaagtctttgtgatttgactctaggttggttctaaaaattgaaacaaaaaatagcatttacgtgacagtgacttcagtctgtcttctttcctcctttgtccttccctgaatttgaatctctaaatctaggacatgaattctagagtgggagggatgagtaaaccaacaaggtaacaaaagcataagtaagagcaatgtcaatcagaggcatctatgctgagctggaagtcttccagcaggacactgctagaggggaccagtagtgccttttgggcaggaagtggtatttcagttgtactatgaagggtgagagttagatttgtggaaggacctggattagcaaaacatttgggttcgagagtatagagattgctcagggtgcagtagccagttgaccagcaggttacatgaagcgggtgttgcctggagaagcaggaaagctgttgggtcagaattgtggagagagatggatagggggcaggttattaagccttggattattttactttttttttggtggggggggtggagtctcgctctgttgctcaggctggagttcagtggctcgatctcggttcaccacaacctccacctcccaggttcaaacgattctcctgccttagcctcgcgagtagctgggactacaggtgcccgccaccacgcctggatacttcttgtatttttagtagagatgcgttttcaccatattggccaggctggtatcgaattcctgaccttgtgatctgcctgcctcagcctcccaaagtgctgggattataggcgtgatccaccgcgcccggccaaagatgattttacttttgactttaacttcccagaatgtttactgacgtggtccctctgaggtggggtggttcagagtgtctttggaaagcacaactagaaggaagaatgaagagtgagagctgctaaaaagaatttaaagaggccgggtatagtggctcacacctgtaatcccagcactttgggaggctgaggctggaggatcgcttcagctcaggaatttgagactagcctggataacctgaggaaacgctatctctacaaaaattatccaagcttggtgtatgcctgtagtcccggctactcaagaggctgaggcaggaagattgcttgagcccaggagattgaggctgctgtgagttgtgtttgtgccactgcactccagcctgggcagcagagcgagaccctgtctcaaaaacaaaaacaaaaacaaaaacaaacccaagaatttaaaggtggtggaactagggcttgatgatcgtgtaggatcgtcaaacttggagcttccagagatgaagaaggaaaggggaaatcaagccgtaaccatatgcagttgactgagaacctgttagaaggcccaacagatggctctcagtgctcaacaaaggctcagggatgagggtcttgctctgtcaccaggctggagtgctgtgatgtgatcttggctcgctgcaacctccaactccctggttcaagcgattctcctgcctcagcctgccgagtagctgggattacaggcacgcgccaccatgcccagctaaattttgtatttttagtagagacagggtttcatatcataatgttttaagaaagtttacaaatttgtgtcaggctgcattcaaagttgtcctgggctgcatgcggcctgtgggctgtgggtgggacaagcttgctttagaggggacatggccctgacgacacctcaatttcagatttctagcctccagaactgtgagaggataaacttctgttgttttaagccacacagtttgtggtaatttattatagcagccctaagaaaccaataccctgtgaaatagtcattcattcatttgacatctgttctattaatcatcaacttacaatgcatctgtctctgtttaggtaaagtgaaaagatggaactggtccctttcctcttggaaactcacaattaaactagtcaatgactgttggctcttctgagtctatagaatctgagggttcaaatgggccttaggtgttacctgtctacatttaccccacactcataatgattgaatctccaaaagtacttttccagtctctgcgtatagtctcatagaatggggaatcacttctccctagagatggtccccaatacttctatagactttgactcagaaaattctcaggctgatgctgggcgtggtggctcacgcttgtaattccagcactttgagaggctgaggcggcagatcatgaggtcaagaaaccccgtctctactaaaaatacaaaaattaactgggtgtggtggcgtgcgcctgtagtcccagctacttgggaggctgaggcaggagaatcacttaaacccgggaggcagaggttgcagtgagcttagattgcgccactgtaccccagcctggtgacagagcgagactccatctcaaaaaaaaaaaaaaaaaagagaaaagaaagttctcaggctgggtgcagtggctcatgcctgtaatcccacactttgggaagctgtggtgggtggataacttgaggtcaggagtttgaaaccagcctggccaacatggtgaaatctcatctctactaaaagtacaaaacttagctgggtgtagtggtgtgcgcctgtagtcccagttactcaggtggctgaggcaggagaattgcttggatctgggagatggaggttgcagggagccaagatcacaccactgcactccagcctgggtgacagagtgagactccatctctggatcttagtaacatttacctgttgatcctggttttcctcgttgagttaacaaagtttgatccctcttccccagaagagcttattacttattggaaaacagtagctgtcactctcttgatgcacgttcaattctaggtagtgcttcttttaccagcaggctctcctctgcgagaaaaccttgtatccttaatagtaataatagacacagctgacatttataaggacttattacgtattaagcatcatgctaagtgtttggcatacattatcgaatttgatccccataataagtctatgaggagagtactattagcctcatttaatagatgaggaaattgatggttagagagggcaaggaatgtacaagaagttgtgcagttagataagcattgaagtaaggatttttttgagacaaagtcttgttctgtcacccaggctggattgcagtagtatgatcacggctcactgcagcttctaccttcttgggctcaggtgatcctcccacctctgcctcttgagtaactgaaatcacaggtgtatgccaccacacttggctaatttttgtggagactgggtttcaccatgttgcccaggctggtctccatctcctggactcaagacatctactcatctcagtctcccaaagtgctggaattaacaggcgtgagccaccattcctggcctggagtaaggatttttatcagattagattccatgttctgatccaactgcactgcctctcattgcctgagaacctggggttatcttgggaataccgttgccttaccgtgaacctgcttttgtctctctggatgcaggaaggaccatcagagcactccacctgtgcagtatggggaactgcaggctttgctagaagccatgctaaaccgatgtgcggagttttcccagaccttgctgagcaggaggcccctggtcagtgtactgcagcctgctgcttccgaagatcatgctgcagtgtgtttttagaaagataattagtatattcccttacttttgtatgctatttcatgactttttctcatgcacacatggctacaatgagatgctttttccctaatagcagaactatgaagcttaaggattactattgtcatttttacagatggggaaactaaagccacgagggttaaataatttttctctaaggtccaaaactataaagtacctaagcctagaacagtaaattccagggtgtttttaccccagtctattacacacattctctgtttatatcatataagcagatagggtaaacatgctcacaaaattatttaagtctgaattcactagaatcttagaatctgaccaatgtgccatgtgttgtagctgctggcttttaatagcctgtagacttaagatatcaggaaagacactgtcagtgtgaatgttgattatgtctttcaggattaactttggaaactaagctctttacacctgatggagtggggattttcttgtgttttagagcaactaatagggccattatagtcaagctaatgcccactagcctgtgacagctttctgcatataatagaccaatagtcattcctgtggttcagagagactgtaggttagggtccctccaacactgctaccatttttttttttcccgagatggagtcttactctgtggccccagtctggagtgcagtggcacgatctcgactcactgcaacctccgcctcccgggttccagtgattctcctgcctcagcctcccgagtagctgggattacaggcatgcaccaccacacctggctaatttttgtaattttagtagagacagggtttcactgtgttggccaggctggtctcgaactcctgacctccacctcggcctcctaaagttctgggattacaggcatgatccactgcgctgggcccctgctaccatttttttttattctgagacggagtcttgctctgttgcccaggctggagtgcagtggtgcgattttggctcactgcaaccttcgcctccggggttcaagcaattctcctgcctcagcctccctagtagctgggactacaggtgcccgccaccatgcctggctaattttttttgtatttttagtagagacggggtttcactatgttagccaggatggctacgatctcctgaccttgtgatctgcctgccttggcctcccaaagtgctgggattacaagcgtgagccaccatgcccagctttgctatgatttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgcctctacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggcctatgatttttttaaaggagctatttgcaaggatatagccaagatctcttggaaagttaggtgtatgggaatgtcagactgcagtgtgagaagaagaggtctacagtcatccaagcatagactgagacacagcatatacttgatcactaggttcctgtctctccttcccacctcagggccatgcctccagtagagattcagagaaggccattcttcaaaggggaaagttcctcctcagcactctggagggatttagaagtgcctgcaggtgaggggccctctgaggtatgaagtaatagcatggaaggtaggggtggaagggattcagacaatgggtgaagttctagaggcaacacttgatttctgatactctgctgtatggcaaagaggactttggctggggtaggggttgggggtgtgtggaggaggcttgaggacaggcagctaggggtaggacctttctaaagattccttcctcatggagtttttgctactgtgccatgaggttgtgtcttattcaccttcgttccccaccaccccccaactagcctagcactacaggtattcactgaatggttgctaaattaattcagtttacattaacaaatgtttgttgtatctactgtgtgccatgcctgatgctagacagtgaggctagaaagaaaagtcagaatggctcctgccctcaaggagctcacagtctcttggggaagagatgctttttggtatatatgtgggatttgttgggttttcaagaatccggggaaggtattccagatagagagagcagcatatttaaaggcaaatgaatgggaaatagcaaatagcatggcatattcggggaaatacacacaatggggtagaagtacacatagttgggggagggggtagggagcaagaatctggagagatagccagggatcaagtcctctcctcattgtggtctattgaattttctcccagtctgataatagagatactttccctggaccctgagcacaggcactccccgccaccccccaggaagctgtttgtaacctttaggttgcataggtggtagtggatatactcacacattgatttcttaggttggctatagaattccagagtgagccttcagcccaggagaatccattcacagctcccagcgccaagaaggaagacaccttggaggccttctcagaatttcttctcagtgcctgtgactcgctgtgtatccccatggtgatggtgggttctcctgagccacgggcaacatgaagcttggggaagagaagaatgtgcaggcgagccaggctcagaggcataaggcagtgactgctcaaaggaactctctgggggcctcagcagtgcaattcttgctgctacctttcctttgttctaaaaataaaatgtagtgtttgattatgaaactaacaggttcatcttaagaaaaaatagaaagcagtaataataaaataataagtgggtaagtttatggagtggaaagtgcctaatattcactatctgatttagttctcccaatgaccctgggagatggatgctataatttgccctaatttacagataagtttgtcatatttctgtagttataaagcaagcccataacgtgctgagattgaacctatgacttcaggtcccctagcttttcttgtgtctttaataatgagcagcagtgaatgtctgtgatccaggtgttaacaaggaacatgtatgtgtgttctgtaaaatgagagatggccactctgaagagagacttgatccttgatcctgaagagcttcattttgagctgacttgaggttgagatggtgggaagagcagggccaagagctgctgactctgggtaaccttggatgagtaacctcctgcttgaggtttgggcatcctatgagcctgtgaggagtccctgttagtcgggaaagggcaactcctaaccatttactgggaacagtaggtggcagcagggaggcacctctggctctgcaccagcgaggctctcttccttgaagaagccattgagctggagtctgcaggaggtagtggtcaggaaccctggactgtggccctgacttaacccactaacagtaagacttgggcaactcatcgcagtttactcacctgccctgccttcctcctagatttttgaagtgttagagctaaatctagaagtagatcatagaattattgtattagtccttctttctacttttctgtattttacacattttctttaatgagcatatattacttttataataataataataataaaacaaccaaacttgctctaaaaatgaaaggaaaggtgtcaacaagaacagtgcctctgaggacccagctgtttacagaaagggaactgagactcagggaagggagaaggtgactacccaagggcacactgtggtggctatgtacagagcctgaactagaaccctgtttctttttttttttttttaattcagagctgtgtttaccacataagactgcctcatgactcttgaagaattacctgaaggctggtctgagtgcaatggtatttacaactaattgatcacaaccagttacagatttatttgtttcttctccattccccctgctttacttgaccagccttaataataacgggccgggtgcggtggctcacacctgtaattccagcactttgggaggctgaggcaggtggatcacttgagatcaggagtttaagaccagcctggccaacatggcgaaaccccgtctctactaaaaatacaaaaattagccgggcgtgatggcgcatgactgtaatcccagctacctgggaggatgaggcaggagtatcgcttgaacccgagaggcagaggtttcaatgagccgagatcgcaccactgatcgccagcctgggtgacagagcaagactccgtctcaaagaataaaaaaaaccccacccccacccccccaaaaaaaacaaatatgaaggcagtttataaactatattattattattactatcgtaatagaaacatgagagtcactctgcattatggtttagaaagcagtttttacacaccagaccacatttgtttctggaagggatatcttgttattcccactttagtcttgggaacagaagcccaaagagataaagtatctagtacaatctatcaggtgatccaagccttagatgtaggtttggactttaagttccctagcttttgttgtgtctttcaagtgaaaggagttgctagatttgatgtgagttttctctgatgccttttcttcagaggctcagtccccgtgggctgtgttctctctcctggttctttgcagagacacttggagcagaccacccacccagctttgatggaagttttcctctcaattctacataacctctttgtcatcgttccccacatgaaggagaagttttccaagaagcttggtaggcagcaggcaaatgtggaggttgggagggaggcaagcaccttaggcaatgctcagagagtattcaaagagaggataagttgtgggtgcacatttactaattcattcagaatctgtatctattctttgtccagtgatgagtgaaaggaagtgtcaggcagcaatcaaaagtcattaaaggggctgggcgtggtagctcatgcctgtaatcctagtgctttgggagaccaagatgggaggatcacctgaggctaggagtttgagaccagcttggacaatacagtgagaccccatctctaaaaaaagattaaagaaaaattagctgagagttttcagtaacattagcgactaattattaataataactaacatttaagttcttacagtgtgtgagactgttttaagtgctttgcatgtatggactcatttagtcctcagaaaaaccctaggaattgtctattatgattgtactcattccactgatgagcaaactgaatctcagagaggttaagtaacttgcctaaggtcacactataagtggtatgcccaggattcaaatccagggaatctgactgtagaacatgcttttttttttttgtctgagattgagtctcgccctgttgcccaggctggagtgcagtggtacgaacttggctcactgccagcttcgcctcccaggtcatgccattctcctgtttcagcgtcctgattagctgggactacaggcgcccgccaccacgcccggctaatttttttgtattttttagtagagacggggtttcaccgtgttagccaggatggtctcgatctcctgacctcgtgatctgcccgcctcggcctcccaaagtgctgggattacaggcgtgagcgaccgcccagaacatgctttcttaatctctgtgctatatttggctcttatcattataatttaatgttttttcttttattcttgtcacatggcatgcaacaaatgttgtgcaacaagtctactgtggagaggcagccagggctcagccatgtaggcccttgttggccatgtgaggaatttggatttttttctttttttttttttgagacagagtttagctcttgttgcccgggctagagtgcaatggcacgatctcggctcaccgcaacctccgcctcccgggttcaagtgattctcctgagtcagccttccaagtagctgagattacaggcatgtgccaccatgcccggctaattttgtatttttagtagagatggggtttctccatgttggccaggctggtctcaaactccccacttcaggtgatctggccaccttgacctcccaaagtgctggggttacagacgtgagccaccacgcctggcctggaatttggattttatcctaggagttttgttgagttttaaagaagtggagtaacatgttcagatttctgtttcagaaagatctttcttggagcagtgtggactatgagttagagggaggcagattggaggcatgtatctcagcctcttgcattaactcaggttggtggtaggaactaaggtagtgttggggcatggaatagctggatgtagggcttgaaagagagggaacagttcaaggtaatgcctggcttctggctggcttctatgtggatggtggtgtgtttaactgagagaaggctcactgggggaggatctggtttgggggggtcagtagagggtatggtcagtttgggtcagggtgaaagtgagatgttccagtgaagatgttaggtgggtaattgactgtgtctgaagacaagggagagatctgggatttagatataggtatagaaatcttcagcatccagcctttcattcattcaacaaatattgggcacctactgcatgcaagatataggctagggctggagatctagcagtgaacaaaacagacccctgtccttgtgaggctgactcctcagtggggatcaggtgagattcttcaaagttgagggtgtaaaatgaaatgatgaaagaagccaagacaaaattgagcatttaatggtcaggaggaggagaggtacgagcatttggagaggtaggaaggaaaccagaagggtacgatattaaggaagccaaatgaagagagttttgtggattggggagtagtcaggagtgtgaaaggcatcccagaagtcaagtaagatgaagattgaaaaatgtccattggacttggcttcatggcagcttttggccacattggccggagcagcttctgtgggagtggttggaatggaagccagaccagagtgagttaaggaatgagtgcaagatgaggcagtagagacaggatacacaactattttaacaagtttggtgtgtggggaaggtgagaaatgggggtgtgagtagaggggaacatggaatcaggaaggattttttctaccccctaagattggaaacacttacctgattagctgctgataggaaggagcagtagagagactggttgttagcccatgtgagttggaattcttctcacctctcttacttgtttattgagattgtacaaattaattttcttatctccagtgtccttagctagaacatggtgataatagtgagaattaaacaagatgatgcatatagatttcctgaagactgcatccctcagccattgtgataactgatacacacttctttccttccttctaacattcttcctgcctgccatacttccggacccaagaggatctagtcttggggcgctggatgggaggcaagtgtagatctcttgggggcagtggtggggaataggggatgtagaaaaaggctgtgagatctgtagggagatctgtgtagcatgaagccaggtagcacaggatcagaggctcaacctgcaagagggaggagggaagcaggcactgccagccaggaatggtatggagacttggagtaggagggtggagaaactctggatccctgagagattgggccaagaggagcccatctggaagggaagcttggtgccccttcctgggaaagtcatgggttaaattgttgccccagagagttgctgtgaaaccctgagggattccctgtcagctgctttagccccaggataaaatacagattattcccaacccaggggctggtgaagtgggagcttctgatgtcgtctttatctaggattctgcttttacagtggcccagggaaggcagaacagaggttagtattgactgaaagccttactggggagactgggaggagccagcagcacaaaggcctgggccagggtcaacagctaaggcagaaactgctggctgggtgcagtggctcacgcctgtaatcccagcactttgggaggccaaggtgggcggatcacctgaggtccgataccagcctgaccaacatatagaaaccctgtctctactaaaaatacaaaattagctgggcgtggtggcgcgtggctgtaatcccagctactcaggaggctgaggcaggagactcgcttgaacctgcgaggcggaggttacagtgagccaagatcgtgccattgcactctagtctgggcaacaagcgtgaaactccatcttaaaaaaaaaaaaaaaaaggccaggcgcagtgggtcacacctgtaatcccagcactttgggaggccgaggtgggtggatcatgaggtcaagagatcaagaccatcctggccaacatggtgaaaccccatctctactaaaaatacaaaaattagctgggtatggtggtgcgtacctgtagtcccagttactcaggaggctgaggcaggagaatcacttgaacccgggaggtggaggttgcagtgagctgagatcatgccactgcactccagcctggcgacagagtgaggctccgtctcaggaaaaaaaaaaaaagaaaagaaactgttattggacctctgttctgagaatcaattgctttcaacagacaattcagagatgagaataaaatagtaactactgttctttctgcatctgaaactggattgttttctataaaactgaaagaagggatagaaggagcagatgtgcccttcctaggtccttgtcaaatgtaccaaattgtagtggaggatcattcagaatggaagaaaatgaacacttattgcagcacttactttgagccaagtatttgttagatgttctccatacatttatcttacttagctttacaacaccctgtgaggtacaaatatcaaaactgagtctcagagaagttaaaaaacttttccggagtgaaactactagacagtggtggagtacattttgaaccaagtctgtgtaactctgaaaccagagctttttgataccacccaggcttgggactctctgtgacaagtctggtttaaactgctctctgctttattcccacttctctgaagcttcctcatccttcatacgactgaccctggagctgaaggccaggttttgcagtggtctgaggtatgtgtggtcccaggcaagattgagtggccaaggggccaatgtccctcttgatgggacaagtgggaattgttggctggtgtgttttagtcatgggctcatggtggtgttgacatagtgtcagcattgctcagcatctggtgcaataagctggtcatgcttctgtaggttgtattgaatctaacgtggtaaggatcttattcctggtgatacttggatgggtacctgtcacatcaaaactgggagaggcctggtgcagtggctcatggctgtaatcccagcactttgggaggccaagatgggaggattgcttgaagccagcagttcaagatcaacttgggcagcatagcaagaccctggtctctacaattttttttttttttttgagatggagtcttgctctgtcacccaggctggagtgcagtggtacaatcttggctcactgcaacaaccgcctcctgggttcaagcaattctcctgcctcagcacctgaatagctgggattacaggtgcttgccaccattcctggctaatttttgtgtttttagtagagatggccagactggtctcaaactcctgacttgaggtgatccgcccgccttggcctcccagagtgctgggattacaggcgtgagccaccgtggctggccacaaaagttttgtgttgttttttttttaattagccagacctggtggtaacacacctttagtcccagatactcaggaggctgaggcgagaggatccttgagcttatgaggtcaaagcagcagtgagctatgatcgcatcccactctagcctggacgacagagtgagaccttgtttctaaaaaaacacaaaaagccccaaaaaacgctttcagagatcatttgtttaacctcttatttaaatgaggaaactggccgggtttcctccgccttctgagttcaagtgattctcctgcctcagcttcctgagtagctaggattacaggtgtgtgccaccacgccaggctaattttgtatttttagtagagacagggtttcaccatgttggtcaggctggtctagaactcctgacctcaggtgatccaccagcctcagcctcccaaagtgctagaattacaggcataagccactgtgcccagccccatatttacttttcatagccaccttaagacctcctctgccacggccatggctagaatttcactagcctctggcacaaagcagtggtgcccaggcatatggcagggataatgctctcccagccaaagtagcaatgtcatctcttctattctttcttcttctccctctaagtcactcagccctaaaccaggtgtgttccaatttcctctactatatgtgcctcaaccttctctcagctccagagaagacaggaccaccttccaaagaaggtaagatgctacaatttgaccactcatgtggcctgtgctggtctttagagtctgggtgccttgctgattgactagatagtgagttagtacagccacgagatttctttgcctgaggctgcccagaggaatcggagtgatgcaattataggttgattcctagggatatgaagtaatagaactggaaaatgatggaacccaaggctcctggcaccttagagttgagaaggatcctaatgttcatcaagtccagttccttcttcctgacagtctcctctgcaacatccccataccataggcctcaggagtccagtgttcactatagcattaatagtgtgttctatttcttcattcattcaagtagtgtttcttttttctttttctttttctttttgtttttcttttattttaagacagtctcgctctgttgcccaggctggagtgcagtggcatgatctcagctcactgcaacctctgccttccaggttcaagtgagtctcctgcctcagcctcccaagtagctgggattacaggctcctgccaccacgcctggctaatttttgcatttttagtagagacgggccttcaccatgttggccatgctggtttcaaactcctgacctcaggtaatctgcctcggcctcccaaagtgctgagattacagatgtgagctaccgtgcccagccaagaggtgtttcttgagcacctgttgtgtgtcagactccattccaggtgctggtgaaagagccagggatacaaagccctgctgtcataaattgaaacaggcaggcaataagcaaatgcatactatgtcagagatccataggcactatgaagaaaataaaactgggcaaaaggatagagagtgatagaaggaggagagagacatgttagatagggtggtcagggaaggcctccatgtggaagtggtatgtgagcagaggtctgagtcaagtaaaggaaagccatgcagaatctaggcaggaggaacagcagctgcagggctgagagctggaagtttttcctcttgttgaacattcattgagcttctgctacctgccaggggaggcctaggtactgctgtggatagagcgattataacagtatgttatttgccctgaggggttcctctatcttagacctgtctcctgatataatagaaaacagtttaataattgtttcatcattcattcaacaaatatacctctgtgggtaagacctagttctggctcttttcccccttattatatttgtgaagattctgtgtcctctcccccactctctacacctgctgctctcttttatctttcccagacatcatgctgagagggagcaaagcccaggtgagcatttttattgcttccaacatagcttggctactggttctctcactatgctggctactcctttctgcaatctccctgttaaggcatgatctggcctgcagagagaatagcatgatttctgccatgtagcctaagactattggcagtcacatcaccatcacctctcatgctcataagtgcctgctccactgcttctggcagttcccttgcttgtcaaaccaaggggagccccacacatctcctgccttaaacactggggcttcttaaatctcattgtgccaggaaatgcagcacatctctcataacattcagactgctttcttttatatatcaggagaaaggcaggtggatgtgtgtggctgaaggatatttgtttcattattattatattgatgagagcatgctttggtggacaagcactgaacttggaattaggagagctgacctggctctgctaccaaattgctgtgggacatgcgctatcctcaccctctgcttgcccaggacttggccctggcaggatggattctttcggttgaccttcaactgaggtcctgtctttcaatctctcatccactcactgctggaaggattatctgaaaacaaagtcttaacatcttaactcccctggctttcagctgtggtctccacacatcagtctgtggagtagtgtcaaatagtgatgaagttttctctggtccatggtgaaatgtggaacataaggataaagttgactttatttaggtttttttgtttgttttgttttttgaggcagagtctcagtctgttgcccaggctggagttgagtgatgtcagctcactgcaacctccacctcccagattcaagtgattcttgtgtctcagcctcacgaatagctgggactacaagcatatgtcaccatgcccaggtgatttttttgtatttttagtagagatggggttttgccatgttggccaggctggtcttgaactcctggcctcaaacaatctacctgccttggactccaaagtgctaggattacaggtgtgagccaccgcacctggcctttattcaaattttaaactctgaagtcagtctttttctttcctttttttttgttttgggacagcgtcttgttctgttgcccaggctggagtgcagtggcgtgatctcggctcattgcaacctccacctcccgggttcaagcaattctcctgcgtcagcttcctgagtagctaggactacaggcacttgccaccacgcttgtctaatttttgtatttttaatagagacagggttttgccatgttggccaggctggtctcgaactcctgacctcaggtgatccacctgccttggtttcccaaagtgctggcattaccggcttgagccaccacgcctatccttctttcctgttcttttggtattaaaatattctttcttttatgaaaccgttttcgtaagaaatctagaagtctctgccctcaggatgaagtcccaattccttaagtggcatttgcttaaaggtctttcacagtccaactgcagattacatcacatagttccccagcttctgacaccccacatctattcactgactatccagtgacactgaatggaaacatggcatgtcttctcatgccttcaggcctctgaacaccttgcttccttttctcttttctcctgtcgctgcctcttttctcctcaccctccacagtttgtttctttctttctttctttttttgagacggagtctcgctctgtcgcccatgctggagtgcagtgacatgatctcggctcactgcaggctccgccttctgggttcacgccattctcctgcctcagcctcccaagtagctgggactacaggggcccgccacctcgcctggctatttttttgtatttttagtagagacgggttttcaccgtgttagccaggatggtcttgatctcgtgacctcgtgatccgccagcctcggcctcccaaagcttgctttcttttttctgagatggagtttcgcgcttgtcattcaggctggagtgcaatggtgccatctcagctcactgcaacctctgcctcccaggttcaagcgattctcccacctcagcctcccaagtagctgggattacaggcgcccgccatcatagccggctaatttttgtatttttgtagggacggggtttcactatgttggccaagctggtcttgaactcctgacctcaggtgatataccctcctcagcctcccaaagtgctgggattacagcctggcccacagtttcttcctctttgacctttccttccccatgccaggcagcctgagtcactccctcctcaatatagcgctgatcacatgtcctgcaattgcctgtctcattatgtgtctcttcccatcagctgccagttcctggaggtagggcctgggtctcacagcctgtcctgagtagtagccactcaatgaacatatgtcaaatgaatgaaagaatgaatgtttttgggaggccaaggtgggtgaatcacctgaggtcaggagtttgagaccagcctggccaacatggcaaaaccctgcctctactaaaaatacaaaaaattagctgggcgtggtggtgggtgcctgtaatcacagctacttgggaggctgaggcaggagaattgcttgaacccagaacggggaggttgcagtgagccgagatcatgccattgcactccagcatgggcaacagagcgagactctgtcaaaagaaaaacaaaacaaaaaaggaatgaacgttaatttttgagacatatccatgtccttctgcttgtgaagtttagtctttcccggtaggttgaaccttgctcaaaggaagaggagcctctgatttccttatttcccactatactgcatttacccttgctgccctgtgcagtactctgcatgtagtaggtactaatgtgctgattacctgttcttctatgttctctgtgtggctttcctctacttattccctccctagaactctctgcagtgtctgagctcctgcagcatgggctgccccagataagcagcaggagccctgaaagccttgccttcctgtctgatcgccagtacatggagggagctgctcgccagagacagtactgcatcctgctcctcttctacttggcctacatccatgaagacaggtcagtgcacagaggtgggtggctggtggtgggtcttgggaccttcatcagcagttcagttcaataaataagggcatctctccaagcctgatgctgggcactggggacacggggataagtaagaaatgggttgtgtccctgagaggctcatatcttagaagtgggttagaacaggtgggtagacactgtgctgagagacagaggcctagaaagccagtgagtattccttgctatccttgagggtgttgtttgtccacagaaaaaaacttcagtaggttactttggttttaatcattactgttcaatttattacatttttaaaatcatggctgggcatggtggctcacgcctgtaatcccaatgctttgggaggccaaggtgggctgatcagttgaggtcaggagttcgagaccagcctggccaacatggcgaaaccctgtctccacaaaacatacaaaaattagccgggcatggtgttgcacacctgtaatcccagctactctggaggctgagacaggagaattgcttgaacccaggagacagaggttgcagtgagccaagattgtgccactgcactccagcctgggtgacagagtgagtgagactccatttcaaaaaggatataaaaataaaaataaaagggctgttctttcttaagctgtaagaaataatttgttgggccgggtgcagtggctcacacctgtaatcccagcactttgggaggccgaggcgggtggatcacctgaggtcaggagtttgagaccagcctgaccaacaaggtgaaaccctgtctctactaaaaatacaaaaatcaggccgggcgcggtggcttactcctgtaatcccagctctttgggaggccgagatgggcagatcacgaggtcaggagatcgagaccatcatggctaacaaggtaaaaccccgtctctactaaaaatacaaaaaaattagctgggcatggtggtgggtgcctgtagtcccagctactcgggaggctgaggcaggagaatggtgtgaacccgggaggcagagctctcagtgagccgagatcgtgccactgcactccagcctgggcgacagagcgagactccgtctcaaaaaataaataaataaataaataaataaataaaaataaaaatacaaaaatcagccgggcatggtggcaggcgcctgtagtcccagctactcgggaggctgagacaggagaattgcttgaacccaggaggtggaggttggagtgagccaagctcatgccactgcactccagcctgggtgtcagagtgagtgagactccatctcaaaaaggatataaaaataaaaggactgttctttcttaagccgtaagaaataatttattgggccgggtacggtggctcacatctgtaatcccagcactttgggaggccgaggcgggtggatcacctgaggtcaggagtttgagaccagcctgaccaacaaggtgaaaccccatctctactaaaaatacaaaaatcaggccgggtgcagtggctcactcctgtaatcccagctctttgggaggccgagatgggtggattacgaggtcaggagatcgagaccatcatggctaacacggtgaaaccccgtctctactaaaaatacaaaaaaattagccgggcgtggtggtgggtgcctgtagtcccagctactcgggaggctgaggcaggagaatggcgtgaacctgggaggcagagcttgcagtgagctgagatcgcgccactgcactccagcctgggcgacagagagagactctgtctcaaaaaaaaataaaaaaaagaataaaaaaaataaaaatgaaaatacaaaaatcatccgggcgtggtggcaggcgcctgtagtcccagctactggggaggcttagacaggagaattgcttgaacccgggaggcggaggttgcagtgagctgagatcgtgccactgcactccagcctcggtgacggagtgatactctgtctcaaaaaataaataattaattaataataataatttattggctgggtgtagtaggacgagccgtagacagaacctctcagacaccgaattgtagaaggaagggctttattcagctgggagcattggcaagctactgccttaaaatctgagctctccaagtgcacaatttctgtccctttcaagggctcacagcactaaagatttcacatgaaagggtcgtgattgatttgagcaagcaaggggtacgtggcaggggctgcatgcaccggcggtcagagtgaaacagaacagagcagggagtttcacagtgttcttccatacaatgcctgaaatatatgtgtaacatcgggttctaagtcatgagttgatttttaaccgctaggtttaagccaggcaggcccaggcctggttttgggcctggcgccgggctgcctggctttgatttcacttctttgttttttttcttaaaacaggtactgagtagaaaacaatataaaacaatatgagagggtctgtctcttccctcacgggtgcggtggcttacacctgtaatctcagcactttggaaggctgaggtaggtggatcacctgagttcaggagttcaagaccaacatgaccaacatggtgaaacccagtctctactaaaaatacaaaattagctgagtgtggtggcgagcgtctgtaatcccagctactggggaggctgaggcaggagaatcacttgaacttggaaggcagaggttgcaatgagctgatattgtgccattgcactccagcttgggcgacagagtgagactcagtgttttttttttgtttttttttttttgagacggagactcactctgtcgcccaggctggagtgcagtggcccaatctcggctcactgcaagctctgcctcccgggttcacgccattctcctgcctcagcctcctgagtagctggaaattcaggtgcccgctaccacgcccggctaattttttgtatttttagtatagacggagtttcactgtgttagccaggatggtctggatctcctgacctcgtgatctgcccgcctcggcctcccaaagtgctgggattacaggcgtgagccactgcgcccggccgactcagtcttaaaagaaaaaaaaaattattaaggtaaaatttacacaacataagcttgaccattttaaagtgaacaattcagtggtatttaatagtacctttaaaatgcacaaccaccaccttcatctagttctagaacatttccatcactgcaaagctgtcacttccgttcctcctccccagctcctggcaatcaacaatctgttctgtctctttggagttacctattctgaatatttcacatagatggaatcatacagtgtgtgactttttgtgtctggcttcttccacttagcatatcattttagaagtccatccagtgagcataatgtttgtaccgtgtatcagtacttcattccttttatggctgattaatatacctttgtatgtatacaccataatttgcttttattcacctattggtggacatttgggcctatccaccttttggctattgtgaatagtgctgttgtaaacatgtgtgtacatgtatttgtttgagtagtgtttttaattctttttgggtatattctcaatcctctcaccttggcctcctcaaatgctaccattacaggcgtgagccactgcacctggcctcctgtttgctgtcttttcgctttcttttctttctttcttcctttcctttccattcctgtcctgtcctatcctgtcctttcctcttttccctcccctcccttcacctcccttcctcttacttcccctcccctactctaccctccctttttccttaccttccccttcccccttcctctcctttccttttgtatcttgctctcttacccaggctgaattgcagtagcacaatcatggctcgctgcagcctcaacctcctgggctccagcgatcctcccatctcagcctcccatgtagctgggactataggcatgcgtctacacaaccagctaatttaactgatttttttttttttttttgtagagaagaggtctgactatgttgcctaggctggtctcgaactcctggcctcaagcagttctcccaccacagcctcccagagtgctgggactctaggcatgagccatcacacctggccgttttcactttcttagtggtatcttttaagcacaaatgtttttaattttgatgacctctaatttatccatttttttcttttgtcatttatgcttttggtgttatatctgttaaatacaccactgtttaatgataaatacaagaagagaggggtggagcagctgccagagcagggccttctgaaccccagcagtagcacccttctctttaacactgctggtccagctggcagatagctcacctcccaagtgtgaatgaggagtatttggcccctaactgagccttgcacaaggcacagaacaatgtgatgtatatatatggcagtgctttgtaagtatgtatagcacactgtttgtctaagatgtcattaggctgtgggcatattggggcaggacagtgggctgaggaaggatgcggccaggcagaatagaagagcccagtggcctgccaactctgcctttctcactcaggcttttcttggttgacaggtttgtctcagaggcagagttatttgaggctgtgcaaagcttcctcctgtcgctgcaggaccagggcgagcgccccccactggtggtcttcaaagcctccatctatctgcttgcaatctgccaggacaaagacaatacactacgtgaggtatggaccacaatgcctgggctccttgtccttctgtacctctttacattagtgttccctgggagaccatgatgatgatagtgtatagacaagcgggtggtagagagagacaaagcggaggtgttaggagtgtggagaggagtaggatgcagactcatacagagcctgtataatttacctaattatctcagccttcctgggaggaagagattatttgcattctacagataagaaaatcgggactgaggctgggcacggtggctcacgtctataatcccagcactttgggaggctgaggtgggcggatcacttgagttcgggagtgcaatggtgtgatttcggctcactgcaacctccaccttctgggttcaagcgattctcctgcctcagccaggagttcaagaccagcctgggcaacatagtaagaccttgtctctacaaaatattaaaaattaaaaaaaaacaacaactctttggtcacctttggaggatgctatgcaacaaactcatgtttttgaaaactggtaaccacaggaaaagaatcaagcacttaacctatgtttcctatgtaatctaatctaacccttcagagtaactgaatagttaatgaggggaagtttcctttttttttttttttttttttgagacggagtctcgctctgtcacccaggctggagtgcagtggcaggatcgctgtggcaggatcgctgctgaccacaacctccacctcctgggttcacgccattctcctgcctcagcctcctgaatagctgggactactggcgcccgccaccacacccggctaattttttgtatttttagtagagacggggtttcatcctgttagccaggatggtctcaatctcctgacctcgtgatctgcccgcctcggcctcccaaagtgctgggattacaggcgtgagccaccgtgcccggctggaagtttccttttatacaagtatttaagttaataaacagataatgacagaactagaatattattgttttgtaatccctaattaattagtggatctaggcaatgatcaccagtggctgctactagcacaaagagagagacaacaggacattgtgtgcccaggtgtgtcttacttgaaaacccattcacttccactatgcctttctgtttccactcaaattaaaccaggtctactctcatcacatttgcctcaacagtaatcaaaaagaggcaaaattaatagtcaatggaggaagagtgcctttagctttagactgaagggtccacactaaggaacagaagcaatattctatgaaataggtgagaggttcagtgatgaatcagacgtggtccttgattccaggagtttataaggaagctggagagagaaaacttgtccacacacaaccaccacgaaagtgatccaatagcctaattaacaatgatctgagtcccagcaatccactttctttaataaactgttaccagaagaagataccaataccttagagctctttgctcctgtaccaaccagaggtggtactaaggaatgagccttaggagtcagtcaagtctgagctggagtccgactcccgcatcagttaactgtgtgacctagagaaagttacttgaacttcagtcttgattttttttttcagaatactaataatgttcatgacctgagaagcctttgcttcaaaatgaaaagttctaataattgaacaaccaagagtcttgctcttgtttcccaggctggagtgcaatggcgccatcttggctcactgtaacctccgcttcccaggttcaagcaattctcctgcctcagcctcccgagtagctgggattacagtgggattataggcatgtgccaccacgcccagctaattattgtatttttagtagagacgggttttcaacatgttggtcaggctggtctctaactcctgacctcaggcgatccacccacctcagcctttcaaagtgctgggattacaggcatgagccaccgtgcccagccagaaaatttttaaaaattggccaggtatggtggtgcgcacctgtggtcccagctactgggaaggctgaggtgggaggattacttgagcgcaagaggtcgaggctgcagtgagccatgttcatgccaccgcactccagcctgggtgacagagtaagacgttgtctcaaaaaataagataaaatttagtataaatatataaagggcaacatacaatcacaacttgatttttctactcaattttattttgatattatttcatcttacaaaaaaatttcaagaacagttcaaagacaccgattagccagattcaccaatttttatttttatctcatttgcattctctctcttcccatccccacccccttattctttttttctgaaccacttgaaaataattttcagagagtcattttattcataaatacttcaatttgtatttcctaagaattaggactttctctgttacataatcagtgtacagtgatcaaaatcaagaaatttaacattgtatataatattgtgtaatccttagtcatcaatagtcaaatttcactataccaaaatgttctttttttttttttttttttttttttagacggagtcttgctctgtcgccaggctagagagtgcagtggcgtgatctcggctcactgcaacctccgcctcccgggttcataccattctcctgcctcagcctcctgagtagctgggattacaggcacccgccaccatgcctgactaattttttgtatttcttagtagagacggggtttcaccgtattagccaggatggtcttgatctgcccgcctcggcctcccaaagtgctgggattacaggcatgagccaccgtgccggccatacggtttttgttttttgagacagagttttgctctgtcgcccaagctggagtgcagtggcgcgatctctgctcactgcaacctctgcctcgggttcaagcaattatcctgcctcagtgccccaagtagctgggattacaggtgcgtgccaccatgcctggctaatttttgtgttcttagtagagacagggtttcaccatgttggccaggctggtctcgaactcctgaccttctgatccacccgcctcagccttccaaagtgctgggattacaggtgtgagccaccgtgcctggcttacaattccttctatattttttagttggaattctactgtatggacgttttctttctttttattattcattttactcaatattattattatttttcgagacagggtcttgctctgtcacccagactggagtgcagtggtgtgatcacaactccctgcaggcttgacctcctgagctcaagcaatattcccacctcagcttcctgagtagctggtaccacaggcatgcaccactgcatatgcctggctaattatttttatttcctgtagagacggactggtctcaaactcctgggctcaggcaatccccctgccttagcctcccaaagtgctaggattacaggtgtgagccactgctcctgtctccagtattatttttgagaattactcgtgtagattcacgttgccctagtttatcaggaagttgttctgattagagtgaaaagaaaggttagaagggaggtgaaagagtttagaaggcagaacagggaccatcaagctactggaggcagggaagctctttgttctgggcagctggttgggctaaagaggtgtgggtagaggagcaccctccatggtcactgaggtccttggtgagcaatgggactgcctagatgaggtagtgctgcaaggggcaccttcaggaggctcgtggacgtcttccccataaaatttgcctgctagctcccaggcctttccttggcttctgtctctgatgtcaccttctttatgtggtatctttatgaaaaggcttccttggtaccatttacctgtgaatgccctttatgtagaagcagggtaaccttgtatacatgcattgtgcagaaaggcaggactcctgggtccacattctcgttctgttgctaatgttctgggccttcctggcgagatctccttccctttctgggccttgggcagagttatctctgagatcctttctgattctcatggtctttgagcctttgtggaagcagtggaggagatacacactgatgtgtgttaaggtatgtgtctgaggatccccaatagccagagtgtgggtgtctctgtggggatggatatttcagagtgtcaggccttacttatgcctggaaactcttccttttcagcaacttcattgcagtttgatcagcatttcctaagctgttgaacacaactctatgccgatgattttttatttgcttctcaacatttcagctactcaaccaatgtggattgaccacttgacatgagctaggtaccatgtggggccctgtcaggtctgaaatgaatcaaacaagttccttgccctcagagaacacaagtttgtcaggagagacaaaaagatctcctatgggtcaggcagctacagtaatgagtgctctcctggagctgggggactggtcaagaaccagcaaagcattatatagcatcaggagaggctttgtggaggagatggaggaggtgaagggagaactttgaagctgagagcagagtatgatttaatgtacagaagtgggaagatgcccaatctatccattcaaggaaggaagcctagcttaatgtgccttagctaagtcatatgggaggtagaatagagaggagctgaaaaggtagacttaagtctttattaacatgcttgaaaatgaaattaggccgggcgcagttgctcacgcctgtaatcctagcactttgggaggccgaggcgggcggattgactgagctcaggagtttgagagcagcctgggcaacatggtgaaaccctgtctctactaaaatacaaaaaattagctgggcgtggcggcatgcgcctgtagtcccagctactcgggaggctgaggcaggagaattgcttgaatcctggaggcggaggttgcagtgagctgtgagctgagattgcgccactgcattccagtctgggtgacatagtgagaccctgtctcccaaaaaaaaaaaaaaaatgaaattaagggaacaattccatttacaatagcatcaagaaattaaatacttgggaatataacttaacaaagtataaggactttgtgttagtcagttctcgcattcttataaagaactaccagagactgagtaatttataaagacaagagatttatgtgactcacagtttcacaggctatacaggaagcatggctgaggaggtctcaggaatcttacagtcatggcagaaagcaaaggggaagctggcatatcttatatggctggagaaggaggaagagagtgaaaagggaggtgctacaaactttaaaacaaccagagctcatgagaattcactcagtatcacaagaacagcaacggggaggtccacccccatgatccagtcacctcccaccaggctcctcctccaacactgaggattataatttggacatgagatttgggcggggacacaaatccaaatcatatcaacttatatagtgaaaatttcaaaacattactgtttttctctagtttttttcttaattaaaaatctaaattaacagactgcattcatgaattggaagacttaatagtttaagatggcagtgctctccaaattgatcggtagattcaatgcaatctgtatcaaaatcccaattgtacttttttgcaaaaatgaataagctgaacctaaaattcatatggaaatgcaaaatagtcaaaacaatcttgaaaaaaaagaacaaagttggaagactcataccttttttattttggaacttagcaaaaaactatagtaatcaggatagtgtggtactgacataggagtagacatatagatcaatgaaatagaattgagagtccagaagtaaacccatacatttatggtcaatttttgatgaggatgccaagataattcaatgggggaagatttgtcttttcagaaaattttcaggaacaactagatatacacatgcaaaagaatgaagttggactcttaactcatatcatacacaaaaatgaactcacaatgagtgaaagacctaaatgagccaaaactgtaaaacccatataatagcatattaaggaatttttttttttttgagatggagtttcactcttgttacccaggctagagtgcaatggcgtgatcttggctcaccacaacctctgcctcccgggttcaagtgagtctcctgcctcagcctcccaagtagctgggattacaggcatgtgccattatgcccggcaaattttttatttttagtagagacggagtttctccatgttggccaggctggtctcaaactcccgacctcaggtgatccgcccacctcagcctcccaaagtgctgggattacaggcatgagcccccacgcccagcctcatactaagaaatttgaacattgttatgggaatgcaatgggaagaggtaggtttgtgaggagtaagaaattattcaacaaggccgggcacggtggctcacacctgtaatcccagcactttaggaggccaaggcgggcagatcacctgaggtcaggggtttgaaaccagcctgaccaacatggaggaactccgtctctactaaaaatacaaaattagccgggcatggtggcacatgcctgtaatcccagctactcaggaggctgaggcaggagaatcacttgaacccgggaggcagaggttgcggtgagccgagatcatgccattgcactccagcctgggcaacaggagcgaaactctgtctcagaaaaaaaaaaagaaattattcaacatatctccccttcaccccttctgtgccaggccctatgctaagtgcacagattaatctgccacagtccctaccctcaagcagctttcagtctagtgtgggaagtagacatgcacactgacaattacaacccactgtggtaccatcatcaagctgggtttcttgacctcggcactattaatattttgcaccagatcattcttgtgtgataagctttgtaggatatttagcagcatccccactctctccctactagatcccaatagcattcccccaatcaagatagtaaaaaatgtctccagactttaccaaatgtcccatggggacaaaatcacccctagttgataacttctgttataaggtaagtacagtggtattttctcactaaagtgccttgggatgagctagccaaggtgtcctggaatactgagatgacagtacatttttcctagtcatctcttggccatgttggggtctcttgggtcctctgcaaggtgtatttacctcctttctttgttttgcctccagactatggtcagtgcaatcagaaaattcctagaaggcatcccagacctgcagctagtctatactcaccatccgctcctgctcaggttctttctgttgtatccagagctcatgagtaggtatgggcaccgtgtcctggaactttggttcttctgggaagagagcagctatgaggaactggatgatgtcacctctgctgggcagcccgcccttcctgccagcttagtagtcctgttccagttgctcagaagcatccccagcatcctgctcatcttgctggtaggcaaccactcattcatttctacattcagaaatcgtgggccttctctctctgagagccggtttactgaggtcaggaggcacccacatctgcttcagcccacctccagacttatcactgtctgcatgtgagttggaggggtggtggtctcttctacttgtaggtgcctagtttctgtaaatccatactctttcctaagtctaatggaagtctaccaactgagagatgtgtgcctctcttccccccaggggatgacactatgaaatgcagatcttagtcaccatcccctctcacctccctgtcatctctcaagcagattctgctgacacaggtttaatgttaaaggaagcccatggggcatgtagatggacatttctgatggcagagggactcctcctcttttttgccatgacttacatgataatattatatgtacattacttgctcaggcatacctagaattgtcagatgccccagtacttttttttctggagacacagtctcacactgttgcccagggtgcagtgccgtggcatgatctgggctcactgcaacctccacctcccgggttcacgcaattctcctgcctcagcctcccgagtagctgggactacaggtgcacgccaccacacccaactaattttttacttttttttttaagagatggggtttcaccaggttgcccaggctgtcaatactttttggtgaagtacgttactgaaattcccatcaggaattagatgggctaattagattagataaggtaaactgcctagtggctggctttaactccactttttttccttccactcaagaaggcaaattgaacaacaaattagataccaaggagagtagcaggggacagaactaagatactaggttttcttcaccagatgaaatattcggggtcagttcttcacacatagtaggtacttataaattatgacccattgaattatgggtctagaccaatctaagtctgtccagggatagtagtgacaatacagtcatgcattgcttaatgatggggatacatttttagaaacacagtgttaggtgattttgtcataccaacatcatggagtatacttacagacatctagatggtctagcctactacacacctaggtatatgggatgacctgttactcctaggctacaaacctgtacagcatgttactgtactgaatattgtagacaaatgtaacacagtgacatttgtatatctaaacatagaaaagatacagcatgactatatcttatttatttttattttttttcttttttcttgctctgttgcccaggctagagtgcagtggcaggatcatggctcactgcagcgtcaatcttctgggctcaagtgatcctcctgccttagcctcccaagtaactagaattggctgggcgtggcagctcatgcctataatcccagtactttgggaggccgagccaggtgaatcacctgaggtcaggagttcaagaccaagtagctggaactacaagcatgtgctactgtgtctggctaatttttatattttttgtagagacagtgttttatcatgttgcccaagctggtctcaaattcctgggctccagcgatcctcccaccatggcctcccaaagtgttgggattataggcataaacgactgtacctgccattttttctttttaaatacatgaaacataggcttagagagatttgcccatggtcacaagagttggaaatcaaaatattaaaacccagatttgactccctatctatcagttgttctgtctgaggctctctttttactcagtctgtttattcttcctgggttatctcattcacacccatggctttgtttgcctcctggctgtatggtgatgactcaaatccctgcaccacccctgacctctctcctgagctcatacccatgaagtcaaccatctatttgacatttctgcctaaaatggagctcattatctcctctcccaaattccctttctcagcctgggtcttcctagaatggagaggtccctcactaactgaaggctgtgctaggccactaacttcacaggatgtaaatattaaaagaagcaaaccaaacagaaattgaatctcaggagaccaaatacttagagtctacatcccagggaagctggagtggatgccccaccatttatcctggtgacccagtccttgtccttgaatgtgcaccatccttatcacctctcctttctggaggtggtggaggtcagggcagagaggagtcttgtgtttcacttggcatagagcttaacagaaaggagctgccttcaagatgagttgttgcatagaggactaggaagatagaggctaatctgaacttcagttttctcccacagaaaatggagaaaacatgagggtagatgagatagtatgtaggaacactcttggtttgcttcacatagtgggctgtcattcactaatcattgactgcctctgaaccagataaagttcatctcagagaagctaattgaattgcccaaggtcatatagttaataagggtcatggctatgactagagcccaaagtgagtaagtttttcactaacttagatcctagagacatcaatggtaaaaaaaaaaaaaaaaaaaaagaacagcaaggaggccgggcgcggtggctcacgcctgtaatcccagcgctttgggaggctgaggcgggtgggtcacaaggtcaggagttcgagaccagcctggtcaacatggtgaaaccctgtctctactaaaaatacaaaaaattagccgggcatggtggcacgtgcctgtagtcccagccactcaggaggctgagacagaagaatcgcttgaacccaggaggcggaggttgcagtgagccaagatcgagccactgcactccagcctgggcgacagagctagacttcgtctcaaaaacacaaaacaaaacaaaagaacagcaaggaacaactttattgtctgttcatatatataattcttaccatttctccccagcttctagccagaggaaggaaaaagagtctaaaaattttgtgttgataccaatttctgttttttatatgggtaattaacagctgaaaacaaagctgttaattgccactcttatcaatgggtggtctttcatgtaggttttttagatgtgaagggacaatgacatcacagaaactctgtttgtttcctctttggccaagttacgctggtctgtcaagacccagagagttctggacagcagagactacagattgggtcatagttttgcccagagccttcccactgatccatatggtggggtcctcacgttcctcttcctccagcattcaccatagccacacaaagctgagtagccccttccttttatacctttaacattcattaactcagacttctgagggaccacctctgtggcagtggggcagtgatgtgttggtgaaggcacaagaccaggaaactggtttgactctgggatctatgaccttgggcaaatcatgcccctcccttcccgtcgggcttcagcctcatactctgtaaagtaaaggtattggaaaaaattatctagattctctctagccctcccattctgtgacctttttcttttcagagatgttttctgagtctctacaaggtgacaaagatgaagtagacctcatcccttcccttcattaactcacagtgcagtttaatttacaactttattactttcttgatatgcaaactgattaacctgccccagttttctcatttgaaaaattggggtgacacctatatggaagagttattgtagaggtataaataatgtataaacaaatatacagctactgtataaacacaacatagtacctgacattattaggccctgagtggttgttattgatatatagttgtttttccagcaactgcggaggtttctgagagccaaacttagacatccctgtgaccccatccctctccttctgcccagtgatcagcacacctgggtttgtctggccagatgcattgtagccatatctctctgtgtgtcagtagctgtcctccctggagagggagtctgtgtgaccttggattcataaccctcagtcctaactggcccagcgcattagcctgtccaaaggaattggcttctttgagctagcaggtgccaggagctatcagtagggtagcctctggtgcagctttctgactggctttgtctttaacatatactcactaaaataactctgaaagcaaaataaaaagcatcttcccatcttccgagcctaagacctttatagcttggggcagagataaccagatgccttggtagagaacgggcctgacctggtcctcacttgcctttctgtgcactgaatctgtcctaatttatcctctgcctgcccagtgacatcatttctctttccttcttctcttctttaaggcacactcaggttccctgtcttgaaaacaacctcttgaccctaatcctaccatttgcaggagggaggcatcctggaaaatagagctttgggcttggagttaggagacttgcattcaaattctgtctgtgccactggcttatatgacctttagcaagtcatgtaatctctctgagcctgttttctcctgtttaggatggatttaataggatggacctattctttttttttttttttttgagacagagttttgctctgtcacccagtctagagtgcagtagtgcgatctcggctcactgcaagccccgcctcccgggttcatgccatcctcctgtctcagcctccggagtagctgggactacaggcacttgccaccacgcccagctaatttttttgtatttttagtaaagacggggtttcaccgtgttagccaggatggtctcaatctcctgacctcgtgatccacccgccttggcctcccaaagtgctgggattacatgcgtgagccaccatgcacggcctaggatggacctattctaagggatggttttgaggcgtcagtgcacctagaagagcctttggtacataataggtgctgagtaagtgacagattacccagtttttgtgacatcataattatgggcccttttcctgcccctctattcctcattgtcacttttccccaactgcagtaccctctgatctctggctttcttctctcctgctcaggacctcatctattccagcccagtggacacagctcacaaggtactgattagcctgaggaccttcctgaggaggaatgaggatatccaagtgggcggtcttatccgaggccacttcctgctgatcctgcagcgtctgctagtggagcatggggcatccccatcaggaggtcagtctgcaggtgctgtgggcacactttgacctgaaagccagtcgagaatgggcatctctacccttgttaggtctgctccaggagagagaatcagggttttatctgaaaaagaaagccaggccattgtggcatcaagctaaacttcacctcctttctctcactgcagagtgggcgtacaacatgcttggtttgctgtgtgtgtgtttaacatgagtggatgtgtttgatgtgtgcatgcatatccccaccctgtgcagcatgtgctcagtgttgtttgtcacaagcatggcagccccctgtgggaagaagaaagtgagaaatctggaggaggatggaggcagcagcagtccgcaggggctggggagggaggtggatctgtgatgtgttggaagctcctagtgagatccgggggattagtttccaaatctggaatggtactcactggagtcaaggaagcttgatgtttggtacagtatggagacactgaaaatttggattggtttattttattgtatttatttattttatattttatgtatttattttattattattttatttttgagacagtctcactctgtcacccacgctggagtgcagtggcaagatctctgctcactgcaacctctactttccaggttcaagcaattcttgtgcctcagcctcccaagtagctgggacttacaggtgtgtgccacgacacccagctaatttttttgtattttcaggagagacggggtttcaccatgttgcccagggtggtctcaaacccctgagctcaagtgatccgcccacctcagcctcccaaagtggttggattacaggggtgagccactgcgcccagcttagtttttttctatttttagagaagctgaattttaaaaataatttttttttttttttgagagagggtctcactctgtcgttcaggctggtgtgcagtggcgtgatctcggctcactgcaaccttcacgtcctgggttcaagtgattcttctgcctcagcctccatagtagctggaattacaggcatgcgccactgcacctggctaattttttgtatttttattagaggtgggtttcactatattggccaggctggtctcgaactcctgacctcaagtgatccgcccgcctcagcctcccaaagtgcttggattacaggtgtgagctaccacactcggcctaaaattatatttctaagcaaagcgaaaggcaatctgtggctacctgacagaggactgagggtttggaagtagatttaaaggtgtcaagaggagatgagttatttcttttcagggaaggacaagccatgtttagctgataatactggttaagaaccttaagatgtagtggaaacatagtgggaaggccatgggcattggattcagatttgggtctatttgggccatagactgggtgacttataaacaacaggaatttatttctcccagttttgggggctgggaaatccaaaatcaaggtactgaaagattcagtgtctggtgaaggcctacttcctggttcataaatggctgtcttctttccttccttccctccttccttccttcattccttccctgcttccttccttccttccttcgttccttccttccatccatccttctttctccttcatcttcttctttcttcttcttcttttcttcttctcctcttgttcttcttcctcttttcctcctctttcccctccttctcccctccctcctcctccttccttccttctcctcctttcttccttctcctcctttcttcctcctccttctcccctgccccccacagccttgacctcctaggctcaagcaatcccccaacctcagactcctgagtagctggggttataggcatgtgccagcatgatgacttgtcttcttactgtgtcctcacatgacagaaggggtgagggagggagctcctcgcagtttctttcaaaaggccactcatcccattcatgaagattctaccctcatgattcagtcatctaccaaaggcctcacttcctaatactattacattgggggttaagatttcaacatgaattttggaggaacacaaacattcagaccacagcatcctgccactttctggctgtgggaccttggagaagtcactcagcctctctgagcctcaattttgtaagtgcaaaataggaataacaatccatgcttcacattttgtttagtgggattaaatgaaataatgaattcctggtaccaacctatgtctggcacttagtatatcagttacgcctgttctaaatgaagaaagaaataggagtaaatcccaacaaaacacctcaccccttaggaaacaaaaaactttgaacctgttattaagggccattgaagcagggcagggtgtctgaccttcaggtgatctgagcatcaggcttcttgcccagtcctccttgttcttcacagcctcggggaacctaccattgctgctgagcctcctctccctgatgcagctcaggaatgtgtcagagcaagaactggacagcgtggccatgaagctccttcaccaaggtgccctggctgcttgggatagcgcccaagggcccagggctggacgtgcagtgggtgctcactaagtaggctggtgttcttctttcttctactctttcatccctttggaagaagctagtaggtcagtctgtccctagggttttcttgctaaaggacctctcagggctttctctgcttgttctctgggaatgtttgggagacaccctacctctgcaaaaaatcagcattatgaggccaggggggtgctcatgcctgtaatcccagcactttgggtgtttgaggccggaggattgtttgaagccaggagttcaagaccagcctgggcaacatagcaagatcctgcctctacaaactgccaggcctagtggctcacgcctataatcctagcactttgggaggctgaggcagcatgtcgtttgagctcaggagttcaagaccagccttggcaacatggtgaaaccctgtctctacaaaaaaaatacaaataattagctgtgtgtcgtgatgcagacctatatatagtcccagcaacttgggaaggccgaggcgggaggattgcttgagcccaggacgtcaaggctgcagtgagctatgatctcaccactgcacccagcctgggcaatggagtgagacctcgtccctaaaacaaacaaatctgtatgacaggcacaagctctagagtcaggaaggcctgggtttgaatctcagcttagtcactagcaatcatctagtctctgtgagtcttaggttcctcataggtaaagtagtagtactttcctaaactagggttaagatacggaatacttatctagttgttaagataaggaatacttatctagttagatagagaatgtcacacagtgcttgacacacagtagaccttcaacagatcctattcatgcagattccttttttcctggcacaaggtcagctctccagctcatcctacaattgactcagatctgatgatccagttcacagttctccaggcttttttcttacccacaccccaaacctcctcggtttctcaactcatgatgctgccatcacttcacaggcagcacctgcaggaagatttgctgagggaaggttgaaatgaataggaaaaatgacatgtcttcagtgtttgtggaccccccagctcctgtagccacaggtgaagatggggcatcttccctgcctggagcccagtccacctcatgagaacatcagtgtcagattcaaaaaaaggccactggggacgcattgcagatggcctcagcctggtgccagtcatcaccagcctgtctgtgagatcaaggctgacactaagctaggagggggatctgtgtgtgacaaactcagccttcagaagagcctctgacagggagtaacaggctgaaacccacacatgaaatgtaataggacatttacatataatccttgagcacttctatatgacagcagagagtagaggactgtggttcggggtggaggtactggtgtgggagggagctgagacctgcttgtctgggtgagcaccgaagtcagggtgtgatgtggctgccaaaaagtgaatggagctgtaggtaggtttcatattaggatggggatagggagatgggaagtgggagttcccaagagtaaagggatatgttctatagatatctacagtgtaatgttgcactgatgaggcctgggagaatgcagaagcacatctaatcttgccttgagaggttaaggaaggcttcaagggggagatgaactttgagctgaatttttttcttttctttttttttttttttttgagacagggtctcactctgtcacccaggttgaagtataatagcatgataactgctcactgcagcctctacctctcgggctcaggcgatccttccacctcagcctctcgagtagctgggactaccagtgtgtgccaccatgcccagctaattttttgtatttttttgtggagagacggggtctcaccacattgcccaggttggtcttgaactcctgggctcaagcaatctgcctgcctctgcctcccaaagtgttgggattacaggcgtaagccactgcggaggcctgagctgaatcttgattgctgacggggacaagaggagttagctaaatgaagtgatgtgagagaggggatgtggcaagtgcagggaactgcacttcattcgactgttaaagttcccttgggaaggtggtgacgatgttcacaggatggatccctttgaaatcctaaagtctttctgtgatgtgcagctgtaggctgcttgcctgatgtttgtctagatggagggtgtgaatgtgccttaaggtttgtcactgtgtttctttccattggttgtaatatcagggatacttagtttgtgcttgctccccaagactgacatctgaaatagccagtcgcaggctaccacctatgacaagtgtgagtgttttgcgacaggccgactggggactttcatctcttgcagtaagcaagctgtgtgggaagtgcagccccactgacgtggacatcctgcagccctccttcaacttcctgtattggagccttcatcagaccacacccagcagtcagaaaagaggtgcaggggcccgggctgggacagtgaagagtgctgggcagtctgtggtcctctgtatctcaactttttcatcttaaaaaaacaaatagggttgtgtgtgtggctggtggtcataaggtcctttctggctctaataacctgagcttctgttatgaagctgggacccttagagcctcaggatgatcctctgtttgtttgtgaagccccaatcaggtgctaagcaccatagtggcacttagctgaagctcctctgtaactcctgtgggccctgccttgcccacccccgacagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcaggttagtctttaactcctgtggctttgaggcatggggtggcactcaaaggagtgttgaagatcctgagttctggtcccagctctgggggcttattagctgtgtgaccttggcaaggtatttaccctttctgagctcagtttcctttcctacaaaatggggaaaacatctcaggattgttgtgaggttgtttcatattaatccacttaacacataaggtttacctacactccaggctctattcttggcacagaggaataaaaaatgaatatagcatgtgtcctacccttagggaacttgtagtctttaaggataagattgtactcagcaaagatagtgggagaaggcattccaagtagagagaacaatatgagcaaaggcatgaagctgcacaaattcaggacatgctctgtatatttggggagtggtgaggtgctctgtgtgatgagaaggtggggaatgaatggagcagaaaagaccagacggggaggcagaagccagcctgcgaccttaaagtgcagcatggcaagccgtggaatgccacacatggttaactgtcattattactgttcgagaaggtgatgcagggaagaggagagcagtggacttatccacagagcacctccttcccctcagcccctccctcttgtagggccttgtcatcacagtgccctgcgtgagctcctctgtgggctacttctcatggaaaccatctgctagcctctgtggtatcctcacactgcgcccaatactgtgccaatctagtgatgggcacacagaagtgacatgagttttaaactttggcctctagaggggcaacaagctgtggcaaatctatgctctggcaaatcctgcaggttgttgcctgtggttggtttaggacagaaacctttcctaattttccgtgtgaggctgctgggctcatccagctgtctgcagtcacctgcctaggagaaaacttgcattttgtccttggctctgccctggccctcagctcacacctaggcaattacctgctcctagctacctccagtgccctaactcaggcctgatcattcgtcctccccactaatgtgacctagttacagtctcctggccacccgcctcttccctcctctgcatgtcctatcattgcagccacagtctgtcctcacaccccttctgcccaagctccttcagcagcctttttgtcctcctctaggcctggccctctgcagccttactttctgccattcccacccaccttccctgtcctctggccaggcatttgtgcttctcccagtcagctatgctccttcacattgccataccttttttttgtctgttttgtttattattaatagacttcatttttaggacagttttagatttatagaaaaatggtgcaggtagtacagagagttcccatataacaccccccctcacccccgacacacatacacagagttccctgttattttattttttcagacaaagttttgctctagttgcccaggctggagtgcaatggtgtgatctcggctcaccgcaacctctgcctcctgggttcaagcgattctcttgcctcagcctccctagtagctgggattacaggcatctgccaccacacccagctaattttgtatttttagtagagacggggtttctccaagttggtcaggctggtcttgaactcctcacctcaggtgatccacccacctcagcatcccgaagtgctgggattataggcgtgagccactgtgcccggcttgtcttaatttcatagatgaagaaagtcaggcatgctgagagaggtgcagtaacttgcccaaggccatacagctgacaggtagcaaagccaggattttattttattttttaaagaaatggaatctgtcgtccaggctggagtgcagtggcagtatcccagctcactgcagccttggcctcccagctcaagtgattatctcacctcagcctcctgagtagcaagaactacagacacatgctaccatgcccagataatgtttttgtattttcttgtagagatgggtcttcgccatgttgtccaggctggtcttgaactcctgggctcaacgaatcctctcacctcagccacccaaagtgctgggattacaggtgtaagccactgtacctgacttgagagccaggattttgatttggcctgtctgactccagatcttctgagttaggtgtatagtgaacagagccagagactgaaccacagatgaggccagagaaggctgtctgatggaggaggccagtgaggatgggggagatttggaagaaaaagagttctccaggttcggacttgattctccgcatgctcctgaagccagggctggtgcagcttggaggactctgtgtggcctcctccgtccccttttgatgcagtggatatgtggggggaggtgatagaagagattttcaggcaggttattttctgcccaggcttccagaacatgggggttagccctttaccctgtgccctgccaggttcaccagacactctctgtggaaatggaccaagtattgaaggctctcagctttccaaagaaaaaggctgcactactctcaggtatgggtccacaagtctccagcagaagaaaagctttttccctaggttttcagataagaccagcaccctgaccagccaatggtcactccataattgtctcatcttcattgtctcccatcctgtgacagagctgggtgggaggtgggaaggagacaggaattgggtgtaaggaatctcctgcttccagctgccatcttatgcttcctgcggacagccctgcgacaaagcttttcctctgccctggtagccctggtgccctcaggggcccagccactgccagccaccaaggacactgtcctagctccactgcgaatgtcgcaagtccggtccctggtcattgggctgcagaacctcctggtgcaggtaaggcccttgctgagtggggcttgcttctcccaggacaacagcaggaaggggtggctgcctgtcgagagcctgatactcctaccagggcttggagggtggattaagacttttttaaaaaaattatttctattatttttattttatttatttatttatttatttatttagagacagagtttcgctcttgttgcccaggctggagtgcagtggcgcaatcttggctcactgcaacctccgcctcccgggttcaagcaattctcctgccttagcctcccgggtagctgggactacaggtgcctgccaccacacctggctaatttttgtatttttagtagagacggggtttcaccatgttggccaggatggtctgaatctcttgacctcgtgatccgcctgcctccgcctcccaaagtgctgggattacagacgtgagccaccgcgcctggcatttttattttatttatttatttatttatttatttttattatttttttagacggagtctagctctgtcgcccaggctggtgtgtggtggcgtgatctcgactcactgcaagctctgcctcccgggttcacgccattctcctgcctcagcctcccgagtagctgggactacaggcagccaccaccacgcccggctaattttttgtatttttagtagagaaaggttttcactgtgttagccaggatggtcttgatctcctgatttcatgatcctcccgcctcggcctcccaaagtgctgggattacaggtgtgagccactgcacctggcctatttatttatttgtttttgagacagagtttggctcttgttgcccaggctggagtgcaatggtgcaatcttggctcactgcaacctccgcctcccaggttcaagtgattctcctgtctcagcctcccgagtagctgggattacaggtgcatgccaccatgcccggctaatttttgtatttttagtagagacggggtttccgcatattggtcaggctggtctcgaactcctgacctcaggtgatccacccgcttcagcctctcaaagtgctgggattacaggaatgagccaccacacccggcctatttttatttttttatttttttatttttttatttttttattttttattttatttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccctatttttattttttaaatacagatggggtcttgctatatttccaggctggtctcgaactcctggcctcaagtgatcctcttaccttggcctccagaagtgctaggattacaggcataagccactattccctgcctgggtgagacttttaaagctacagtgacagaaacaaaactcaatttggcttataactgagaagtcctggggtcaatactggcttcaggcacagctggatcccagaagctcagagaaggtcatcagactctttccatctattggctttgcattcctcactgtcagctttatttttatgagatagtaggatgaccagcagtagctcctagcttatatcctctatggaaaaaagatttctctttcctcatagttcccagaattgagtctcattaggctggcttgggtaatatgccagtcaccatggctggggcatgggatgccctgattggcctggcttgggtcagtgccctctcctggaggccagagcatgtggtcaactctccatagcccaggtggactggtcctaagagagggatggttccccatgggaaaactgctaccagaagaaggaggggatccagagcaagcaaaagcatgtctacctccaaggggtttgtgttttatggcttaggagacacttgtagatcagtgtttatgtagccatcatatcccgagccctgacccaatgtcatggcctatgaaggatactgggggccccaggaagatgtcccaggagtgggccctatgctgagttagcggttgttgagtcttgtcctgtggcacatccttgcacaaggctctgtgctctttagggatcaaacatctatcctattatagcacttagctctctgtttcaagtttccattttcatatcactattcccccaaccaggctgtgatatactcaagggcagagtctgggtctggttaatctttgtgtgtccttccccttgtgggtttaaagctaatttagaatgcaggaatcagatgagaaccaaaacataagctttattgctggtaaacatcatagtagaatattggctgggactctggaacagaatgggctttttttttcctgcagtttttcaaacatacagcaatgagagagttttacagtgaacattcatacacccaacacctagattctactaataacattttattatacttgcttaatcatatctgtccaaaatgagctttttaaaacaccctccttcttgccagaccaggggtccacaggcgggaaaaactgtgtttgcattatggacacttagccagctggccaggatcttaagagtttaagttcatgggagcataatctttaataccttaatcctgccctgatggcacagtagatcttaagctagtatcttgcctgctagataaaaccttccttgggtgaggagggccagttagggaaatgctttctccctaatgtttctaaaagcgctgatgttcctgttttaagattcagaacaggaggtgtggggggaatgatttcccaatacccagcacagagcttggcacaaagttggcatctgggaatgtttgttgaatggatgaaaaccacagaaattaacattacatgatcccagccatttaggcactcacagattataggaaacacaaataactacatctaataccaaaatgacctattagcagttgagcattcctaatacaaaagtccaaaatccgaaatgcccaatgagcatctgctttgagcatcatgttggtgctcaaaagttttggatatggggatatttcagatttcaaatttttaattacagatactcaaccagtatttgtttttttgtttgtttttgagatggagtctcgctctgtcacccaggctggagtgcagtggtgcaatcccagctcactgcaacctctgcctcctgagttaagtgattctcctgcctcagcctcccaagtacctgggactacaggtacgcaccacaatgcctggctaattttgtatttttagtagacatgaggtttcaccatgttggccaggctggtctcgaactcgtgacctcaagtgatccacctgcctcggcatcccaaagtgctgggattacaggcgtgcccagcctcaacctgtattggaaggctgcacaggagaggtagcatttgaactgggccttgagtgatgaaaaagccttcttcaaaccaatagcctaaacactagggtggggtgccagtgaggtttgtgggttttgttttgttttttttgagacatagtcttgctctgtcacccaggctgcagtgcagtggtatgatcccagctcactgcaacctccacctcctgggtttaagcgattcttctgcctcagcttcctgagtagttgggattacaggtgtgtgccaccatgcctggctaatttttgtatttttagtagagacagggtttcaccatgttggccaggctggtctcaaactcccaaccttaggtgatctgcccacctcggcctcccaaagtgctgggattacaggtgtgagccaacgtgcccagccaccagtgaagtattgtatagcactttcaccattcgcctctcatgcccaagagcctaggtgtctccctggcctgtgacattcaactctgcctctggcaactgtttatttttatttttgagatagggtcttgctgtcgcccaagctagagtacagtggcatgatcatggctcactgccaccttaacctgctgagcttaagtgatcctcccatctcaacctcctgaatagctgggactacgggtatacaccaccatgcccagctaattttaaaatacttttgtattggtagtaaggccaggcgcagtggctcatgcctgtaatctcagcactttgggagccaagacgggcggatcacttgtcaggaatttgaggccagcctggccaacagggtgaaacctcatctctactaaaaatacaaaaaaattagccgggcgtggtggcgcgcacctgtaatcccagctacttgggaggccaaggcaggagaatcacttgaacccgggaggtggaggttgcagtgagccaagatcatgccagtgcactccagcctgggtgacagagcaagactccatctcaaaaaataaataaataaaaaataaaatactttcgtagagatgatatctcactatgttgtccaggctggtcttgacctcctgggctcaagcaatcctctggctttggcctcacaaagtgctaggattacaggtgtgagtcactgcacctggccttgttttaattgtagtaaactatatataacatacaatttagtattttaatcattttaagtatatgggtcagtggcattaagtacattcacattgttgtgcaactttcaccatcatccatctctagatcttttcatcttcccaaactgaaactctgtacccattaaacaattccccagtcccctcccccagcccctggcatctaccattttacttgctatctctatgaatttgactactgtagggacctcatgtaagtggaatcctgtatttgtctctctggtagtttttgactgtctgtcctcaacagtccctgggaaggggaacccaacctgagaagctcatgactccccctgtagaaggtgctgggcctaccctgcttatgggagggtattgctgaggagcctgtcttagcctcacagtgactgccctataattgcctagtgaacaggaccaagtaggcttttcctcttttctctcactgtcacactctcgagaaatttcctggccttctttgttcagccacaatgtcccctctgtcactgcccaggacctcatggctatagctaagcctccttcattcccttcaaccagtttgttgtttaaaactagtttgtttgtttttttgttttgttttttgagacagactctcattctgttgtccaggctggagtgcagtggcgtgatcttggctcactgcaacctctgccttccagttgcaagagattctcgtgcctcagcctaccaagtagctgggattacaggcacttgccaccatacctggctaattttttgtatgtttagtagagacagggtttcgccatgttggccaggttggtctcaaaactcctggcctcaagtgatctgcctgccttggcatcccaaagttctgggattacaggtgtgagccaccgcacccggtcttaaaactcgctttttattcatttcttcattcatttgttcaatgattcatacattcagcaaatatttattccacagtaacccagcaatagaggaaatccctctcccttgagctcccagaatggttcattcagctgtgaattgagtatcacattatcatattttattatatgatagtggtttacattatcttcttccactgaacttctttttttcttttttttttctgagacagagtctcactctgtcacccaggctggagtgcaatggcgcgatctcggctcacttacaacctctgcctcctgggttcaagtgattctcctgcctcaccctcctgagcagctgggactacaggctcccgccaccatgtctggctaattttgtatttttagtagagacaaggtttcaccatattggccaggttggtctcgaactcctgaccttgtgatccgcccacctcagccccgaagtgctgggattacaggcgtgagccaccacacctggtctgaaaacttcttttaggcaaaaatgccccgtgtgggaagtcagaggaggcttcacagagaaggtgacatttgaactcagccttgaagggtgtctaggcagaggtatagagggaagggcattccggcaggacaacagcatgtataaaatcacatattctgaaagtgcatgctggggtgtggggtgtgatgaagcagaaaatgagacaaaaagctgggcagagccaaactgagccatgcctcatacattaggctaagaatcactgtgcgaactgtggaaggacatctatcagactgtgtgtttgaaagctctctctcgggctgggtactatggctcatgcttgtaatcctagcactcagggaggccaaggtgggtggattgcttgagtctacgagttccagaccagcctgggcaacacagcacaaccctatctctataaaaaatacaaaaaattagctggacgtggtggcacatgcctgtagttccatctactcaggaggctgagatgggaggatcacctaagcccaggaggttgaagccaaagtgagctgtcatgatgccactgagctgcagcctgggtgacagagtgagacctgtctcaaaagaaaaaaagcaagttccctctcagccacagtgggaaagatgggggcaaggagagtgcctggaggtaaggcaactggtgaacaagaggctgtacatgcagatgacagctaggccatcctcatacccatgagggtggctaaaataagaacacagataatagcaagtgttgacaggaggtggagaatgtccacacaaaaccttgtatctgaatgtccatagcagcactattcataatgatgaaaaagtggaaacaaccccaatgtccatcaactgatgaatggacaaattgtatatccatacaatgaaatactatttgaccatacaaaggaatgaagtactgacacatgctacaacatggatgaaccttgagaacattaagtgaaagaagtcagatacaaaagagcacatattatgattctgcttatgagaaatgtctggaaaaggcaaattcatggagacagaaagtagattagtagttgcctagggctgagtggagagatgggggaatgaagagtgactgctgagtatggggtttctttttaggggtgatgaaaatattcttgaattacattgctgtgcaactctatggatataattttaaaaaactactgaattatatcctttaaaggatgagtattatggtttgtgaattatatctcgataaaactatacttttaaaaactggtgtcaagggagaaaaatgacagtgaagcctaagctagggctctgggtgctggtcctccttgacacctctgggccaaagcagcctggtggcaccagcactacaaactgagtgctgatcagctatgcagaatcttcagcagttgggtggcccagtgcagtgcagtggaaggtacagtatctagagtcacaggaatctgtgtcaaagcccctgcccagcctctgacttgaaaatgtttagcaagtcactttttactaatctttatgttctccatctgcaaaataaaaggctgacatgagaacagcctctattcccccaggaatggagcacggtggaggaaagtgttagttgaaataagagtagagagagtgtccagggtccaccatcctgggtcacatggggtgaaggggcaggtcagtggcagcagagggctgtgaagaagggctgtgggcactggagtgataagggtggttatgggggtgataagtgtatgtttaactttataagaagccatcaaattgtttcccaaagtggctgcaccattttatcttcccaccagcaatgtatgagtgccagcttctccacattctcctcaacacttggtgttgtcagtctttttaactttagctattggtagatgtacaggggtacctagtagttttaatttgcatttccctaatgactaatgataaatattttcatgtgcttattagagcatacaattttgatgaaagatcctgttgctttaaaaaaaaaaaaaaaggttgaaacccactggcttaagtaaactgtgaggctctgtaatctataaatcttttagtgtggcccagggtccatcttcttttctgaaacaaagcattctttttttttttttttttttttttttttttttcagatagagtcttgctctgttgcccaggctggagtgcagtggcatgatcgtggctcattctgctcccgggttcaagcaattatctgcctcagccgcccaagtagctgggattacaggcgcccaccaccacgcccagctaattttttgtatttttagtagagatggggtttcatcatcttggccaggctgaactcctgacctcgtgatccacccgctcagcctcccaaagtgctgggattacaggtgtgagccaccacgatggagtttcgctctgtcgctcaggctggagtgcaagtggtgcaatctcagctcaccgcaacctccgcctcccgggttcaatcgattctcctgcctcaacctcctcagtagctgggactacaggtgtgcaccaacacacctagctaatttttgtatatttagtagagatggggtttcaccatgttgaccaggctggtctcaaactcccgacctcaggtgatccagacgctttggcctcccaaagtgctgggattacaggcgtgagccactgtgcctagcccaaagcactctcctgaatgtaggtaaatcacacagtataagcactgtgctctgtatgagggtgagagatgaagccaataaacatttcttgattatctacagggctataatcccaaatctgaaattctgaaatccaagtaactctgaaaaccaaatgttttttcttggttggcaccaaaagccattggtagcaaaacctgacctgattttttttttttttttctgcagaaggaccctctattgtcccaggcctgtgttggctgcctggaggccttgcttgactacctggatgcccggagcccagacattggtagaaactctccacattatctgatgttcccatgagagagattagagggagcaacacccttccaccctcctgctccagccttccattcccttgtgtgactcatacttgttttgtttaattcttttagcagcactgcaagggcagtcatgcccattatacagatgggatcaataaggttcagataggtcaaatgatgtgcccaaccaaggtcacaatgctcttaagtggcagagcccttcttactgcctgccttccacaatcatggcgtatatagtttcaccgagccagtcaacataagtggattagaagcccagggaagaaagaaccctccttgggtcagcttgttcagtgccctgtctctaactgggtagcccctttttaagccaataggagaaggtcctcttgagcaatgtcccaaggcaaggtcttggaagcattaacaacccagtgtttcttgaagctctccacgtggcctcccagccttggaatcggtttttgctgtttaccctcttggatgctggagagaattccttcctcagacctgagattttgaggctcatgaccctggtaagtgcagaaaggatatcttgtggtctgaggagtgtcatgagctgggtggtgctgaagaggccagggtctccttactttaggtaaccctaatccttaaagaaggtggaagggctcggcaggccttcaccctacaagagacttgctgaaagaattcctctgaatgcccatatctcctcactccaggggactccgacaccctttcccctatttctctcatgacatgttgaccagggcctgtctaccacatgccaggtctgctagatactaaggatatcaatgaaccagatactctgcctttagggtccctcagtctaaagaggacgacagacaagtaaactagtaatgtaaatatgatgctacaagtggtagagtagaggagatgctaactgtggggcacacagtaagtgccccttgaataaataacaaagcagcaggcctaagaatgacagcgaagtggatcatcaacaagtacatcagtggttggtgtaggaacaaagaggaaagagtaattgcttctcagcagtgaaggtaacattttagctgtggcttgagagattaataggcagagaggaggaaaggtattccaggtagtgaagtacaaacaacaggtacaagagcacatggtggtatgtcaggggagccacacgtagttcattttggccatgagtgttcagtgcaaggttgggtaggagggagccaaggccaaaggggtcaggagggccagctctctcaggatctcacaggttgccttacttaccccacttccccatgacacagtcccacctctgcccactaactctgagctccttgaaggcaggcaggttctgtgggcttcaggacagtgtctcctaaagttggggcacagcagttgtctatgatgaaggagatgccaaatcactgggtgtttgggggtttctcttcctgggccagtttatgcggtaccggagtagcagtgtcctctctcatgaagaggtgggtgatgttctgcaaggtgtggctttggctgacctgtctaccctctcgaacaccacactccaggccctgcatggcttcttccagcaggtgggtgggaaggggaggccatgcagccactgtaaagctagaccctcaacaccatcttctcttggagggtgggagctctggccacagcaaccaaggaatgggaggagggaagtacagaggatggaggcagttagggcctgtgtggaatgggcactgaggaggcctgtcttccctgccctcttctccctgcagctccagagcatgggacacctggctgaccacagcatggcccagaccctgcaggcctccttggagggccttccccctagcacctcctcaggccagccacccctgcaggacatgctgtatcctttcttgcatctatgatgaaggagatgccaaatcactgggtgtttggggcttctcttcctgggccagtttatgcggtaccggagtagcagtgtcctctctcatgaagaggtgggtgatgttctgcaaggtgtggctttggctgacctgtcttggcctgggcaagctctcccaggccataagaagctgtggcatcatgcttcaggacctaggtgcactagtcttctaaagtaagcaggggtcaattaacagtgttgacaacaacaatgccgtgtcctgttaatattaagttcctacagaaagcaggcacattacatgcattttacatatatatatatttatttattcatttttgagatggagtcttgctccgtcgcccaggctggagtgcagtggcacgatcttggctcactgtaacctccgcctcccaggctcaagcgattctcctgcctcagcctcccgagtagctgggactacaggtgcctgccaccacgcccaggttttttttttttttttctatttttagtagagacagggtttcaccatattggacaggctggtctcgaactcctgaccttgcgatctgcccccctcggcctcccaaagtgctgggattacaggcatgagccaccatgcccggctacatgcattatatttaatcctcacatcagctaggagtgttaaggtacttgtagtacaggttgagcatccctaatacaaaaattagaaatccaaagtgctccaaaatctgaaactttttgagtgctgatgtgatgctacaggtggaaaattccatacctgacttcacatgatgagttgcagtcaaaatgtagccaaaactttgtttcatgaataggccaagtgcggtggctcacgcctgaggccaggagtttgagaccagtctggccaacatggtgaaacctcatctctatgaaaaataccaaaattagctgggtgtggtggcatgtgcctgtagtcctagctactcgggaggctgaggcacaagaatcgcttgaatcggggatgcggagggcagtgagccaagatcacaccactgtactgcaccctgggcgacaaaacatgactctgtcccagaaaaaaaacaaaaaattttgtttcatgaataaaattatattttttacattctttttatttattttttttaagacagtgtcttgctttgtcacccaggctggagtgcactggtgtgaacatagctcactgtagccttcacctcctgggcccaagggatcctcccgcctcagccctccgagtagctgagactacaggtgcacaccagcatgcctggctaatttttgtagatacagggtttcaccatgttgcccaggcttgtctcaaactcctgagctcaggtgatctgcctgccttggcctcccaagtgctgggattacaggcatgagccactgtgcctggcccatgaacaaaattatttaaaactgcataaaattaccttcaggtggccagacgcgtggctcacgcctgtaatcctagcactttgggaggccaaggtgggtggatcatctgaggtcaggagttcaagaccagcctggccaacatggtgaaaccctgtctctactaaaaatacaaaaattagtcggctgtggtggcacacgtctgtgatcccagctacttaggaggttgagacaggagaactgcttgaacttgggcggcagaggttgcagtcagctaagattgcaccactgcactccagccagggcgacagagcaagactccgtctcaaaaaaataaaaaattaccttctggctatgtgtacaaggtgtatataaaacaaatgaattttgtgtttagacttgggtcccatccccaacatatctcattattataggcaaatattacaaaattcgaaaaaaaatctgaaatacaaaacacttctggtcccaagaattttggataagggatactcaacctgtacctacctcctagggttgtagcaaggacttaaatgagttaatatatgtaaagcaccaaaaacagctcctggcttggtgtgaatgttatattggtgtctgttattattcctactccctttccaaataacgaaactgaggccagagacattcagtcgtgcccagaatcacagagctagtgatacaatcaggatttgacctcagatttgcctgtctccaaagctacatcaccgaactcagaaaggagctagtccttcccccatgagctttggagacagttgtccaagcgcagttggttcaagtgatcctcagcccaacacacacacacacacacacacacacacacacacacacacacacacacacacacatagtgtgtgtctctgtgactgccatgttcttaagaaagcttggatggccaggtgcacacacacacacacacacacaatgtgtgtgtgtctgtgtgacttccatgttcttaagaaagcttggatggccgggtgcagtggctcacgcctgtaatcccagcactttgggaggccaaggtgggcagatcacctgagctcaggagtttgagaccagcctggccaacatggtgaaaccccatctctactaaaaaatacaaaaattagctgggcgtggtagcatgagcctgtaatcccagctacccaggaggctgaggcaggagaatcactggaacctgggaggcagaggctgcagtgagccaagatcgcgccactgtactccagcctgggcaacagaccaagactccgtctcaaaaaaaaagaaagcttgggggccgggcgcagtggctcacactgtaatcccagccaaggtgagtggatcacttgaggtcaggagttctgagacgagcctggcctacatggtaaaaccccatctctactaaaaatacaaaaattagccgggcatggtggtgcatgcctgtaatccaagctacttgggaggatgaggcaggacaatcacttgaacctgggaggtggagattgcagtgaccagagagccgagattgtgccactgcacactccagcctgggtggcagagtgagactatgtctcaaaaaaaaaaaaaaaaagcaagcttggggctgtggcagtggtcagagaccctctggtaggtggctggttgcacccagagacactgcagtccagagatactgcagtccagaggtgtgtgtgagggtagtttgcttcctctgcacccctctggctgcctccctggctctcttccttgccccttccgtgcaatagttccctgttgaatagcaactacctagcccaggtgttcaggacccaatttcagaatccatcccactattctcaggagcacttctgttcttgcctgaccattcttgactgttttgggctctggaagtgtgatgcccccatggttggccccacttctctgctgttttcctctcatgttttgctgccagctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcacata

SEQ ID NO: 664 - DNA, 6249 bp, Homo sapiens
ggcagccccgaaatcgaggtgtgtgcgtgtgtgcgcgcttcggaagccttgggaaggcacgaggacgacagggtcttccattctttttcccgctccaggcctcaatttaccgatccgtaaagcgaaaggggccaatagcatataaggccccttccagatctgacgctttttaatttcctatcccacctggagcaacccttccgtgccgctgacccgcttcaacttacctctcgcctgctcagctaagagttcccaggccgctgccggagatcgtgcttccgccccacgccgaggaaacgcctgcgcccgccgccaggaaggaccccgcagacgccgctgtcgcctttctgcccgggaggacaaccctctgcctgaggaccagttccgaggtatgcccgccgcggactggcaaggcggagtagcgggtccccaagacgagtagcccaagacgtgggctgctccaaagagggtgagagctgaggatgaacgaatctgatcaggcgcctcgggaccaccctgaaaatggggggaggggccttcgggcagatcacgtggtcaggctgttagcgcagttgctaggcaaccacagctgcgggcgtggtctgcgcggggttgccctcctgttctggtttatcaggggatccccaaagaaagcaaggggaccaaggccgggactgctggggtgaaggtccgggaggctgagtaaggggacggaagggttagttctatgtattaaatgcctggggagggctgagaactggacacctgatttcggttactggccaccccagccccttcttggcgttcagattccctacgttggggtagggtggctatgggattggttggggacttcctgcttccttgcgctagggctgttggtgatgaccccgccacaaaatctagctcaactcactaggagtttgcagttcagagaggtcccacaagtaaatgccagagccacgactagaacccacgtagagaatctctctgcagtggctcacgcctgtaatcccagcactttgggaggccgaggcgcgcggattacttgaggtcaggatcgaaaattgcttgaaccccggaggcagaggttgcaatgagccaagatcgcgccactgcactccagcctgggcaacagagccagaaaaaaaaaaaaagaaaagaatatctctgtagaaatgatcagtcagcctcagatatgcagaaactacagaagtacagtgatagaactaaaggcattgcccaggtacctagggacctctgttccagccctgggctggacagagggatttggggatggggtcattgagctccttcctttgccccttctacttgatttcctgctcagtcattgcatctggtttgggtgaaagtctccttcctcattaaagacattcaatgaagaatgaaactttatccccgagctcaagggtaactaacaagagttctgcctttgtgtgaggtcccctgtcgaaacgacttgctgtagaacaatcctatgggggaagagtgaagaaactgaattctgagatcccaatgcctcctcgactgaagcaccaaaattaaaaatatttttagaggcaaagagcaaaattaagacagaactccaaattgaaagtcaggactctgtattctattttcagggacaagtcttgtgtaagtcctcactgtgaaattcaacttgtctttgtaaaatagaaaaccagatttttgtaacacctcccaatctgagtgacatgatgtccagagtgctttggggtcattttgtgttctggtgaataattcagaggtaccctctttcccctgatattgactgtccactgacatgtattccctttgccttcccaggcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggttggctcactgccatttttctcaggccctcctgttatggtggattatagtagttaactctgaaatcaaaccattctgggcttcagtcctggccccaccgtctactgtttgatcttatgcaatttccttaacttctctgagtctcaattatttatctgtagaacagtaactgttataattaaatgagttcttgcacataagactgagcaagtgtctgacacatgtgaggtgcttgaaagcagtcagctatcgctgttgttattattatggtcatattggtccgtaacaggtttatcctataccatgcaaagtctagctgcctcacacccacagacacagcattaagtccattgcctaatttctgtcctttgcctacaggggtattgtccttgcatcacatctgaagccactggagcggaaggataagatgggaggaaagagaactgtgccctggaactgtcacactattcagggaaggaccttccaggatgtggccactgaaatctccccggtaggtgaggccctgcccctttagtccagcaggattctctgccctaaagcttcaatcctgttttttcattttgttttgttttgttttgtttttttaaccacacatacctcttctttatttgtcatgttaaaccaacagagataggtttctgcctccaatcccagaaagaaaaacaaacagcagatggcaaagctgagttgaagtgggcagaatgagtcagaaagttgggctaggaaggtcggcttcccttagtcctttgactttcattctcagatcagaattgggatgctctgcctctgggttgtatggtgtctagtgtaatgatcctgtggcagtgttgagagagagaccccaacattcagatccttgagttcctttctctcttcctgagatttccaatcaacccatccacccgacttacagtaaaccctgacttactcttgaagaccagagctatgtctccattcatgagtaggaaaattccagtataaatgagaatctcaaatcatggcgtggattccttggggccctccctgtttcatccccagtttcctcatctgaaaatgaggccgccaaggaccacagctttcccagtgctcagacagtagtgagatgaagacagtaagatgaagagctacaggctcccctccctgtcactgttgcagaacagctggaagagctcctgactccctttccttcctttgtggtccaggagaaagcccccctccagcccgagacgtctgctgacttctatcgtgattggcgacgacacttgccaagtgggccagagcgctaccaggctctactgcagcttgggggtccaaggctcggctgcctcttccagacagatgtgggatttggacttcttggggagctgctggtggcactggctgatcacgtggggccggctgaccgggcagcggtgctggggatcctatgcagcctggcgagcactgggcgcttcaccctgaacctaagcctgctgagccgggcagagagagagagctgcaagggcttgtttcagaagctgcaagccatgggcaaccccagatccgtgaaggaggggctcagctgggaggagcagggtctggaggagcagtctggtgggctccaggaggaggagaggctcctgcaggagctgctggagctgtaccaggttgactgatgcggcaagctaccctcagaggtcccagtggtcactggaggcagttttttggttgttgtcttgggggttctgcaggaccataataagaaacccacacctggttcccttctcaacttggaattttcagagcaaaaacaggaatcaagtcttccccacttctccagtccctcagtgtctcgctgttttgaactgtgtgtatccatggacagtcaagagctcaggaagttgagagcggttttgtttcccacccttagagtctgccaagcctctagcccactggccttgagagatgagtgtgtgcccaaccaaatgctggctataccagttacagcctccactcataaaagggaaaaagcaaaatctttatggtaaacaaacactgatctccacagctcttaacaagaatgtttatagccccaaaccaatgaatggacatgtaatcaacaaatgatcaaatactacatcatttgaggtgttgaattttcccctagagactcagttcttgtgcaggttgggcctgggaaagtcccaagccatcagctcaggtccagccagcctcccggatggccagatatgcaggagggtgggtttccttcatcccccaggttgatgaaagacttttccaccaggctggcagggcagggcctggagcactgaggcagagatctccctgcccgagcacctcggcccgcccttctcattccggtttcctttgacccattcttgggtgagcgccagtgttctagaaaggggagtaaaggccaggttctagaatggctttccccccccaccctgagatcaggtctggaatgttagaagggcatcttgtacatccactgggaataaattgccttgcacttggcggcttcctctgcagattgttgctgcttttcctggctgcataatcctttcctcatctagaggcttccgcttagcagagctttctaggagccctatgagcctttaatgccctggttttgccctgcccctctgacccctgcctccttcaggtatgcacctggccctcaccactgtgctcctgtgggcatgggggctccaggcctttgaaattgtggagaaggaaaacatttttcagaggaccccctgccctgctttcctgatgtttgaaaatgcagcctacctggccgacatgagctttgagcttccctgtcactgcaaacccgaagaggtgccagctgtagtctggttctaccaaaagcacctaggtagcagccacaccaaagtgctgacggactttgatgggcgggtgctgacggaggcagcccaggtacgtgtgggcagcgacatgctgacccgcttcagcatccgcatgttcagcttgttggttttcagggctcagtctgaggactcaggcctgtacttctgcggcacccgcaagggggactacttttacgcctacgatgtggacatccagaacagtgagggaatggtggccactttccaggacaagggccaggagccctttgcagatgaatactatgggcacctccatgtcttcaccaccttctgggaatggaccccctgtgaccgctgcggagtgcgtggggagcagtggcgcatcggcctctgctacctgcagagcccagacctctccccacgctacctcaaggccgtgcccgatgtggtgtcttgtggctcaagggctgtgccaaggaagctgcggaccaaggccagggaccacacgcctgaggtgctggttcggagctgcttagtaccctgtgagaagacaaagaccatccgggagggcgtgctggccatcattaactatgtgtccaaagtgggcagccggccctgggtgccccaggtgcccattcagttccaccagcagagactgggccatggactcatcatctcctgtcctggggcccggccagagcatgcagtggcctgggacaaagaccgccagcacctctaccgcacacagtacctgaagggtgtcaacaggtccatgagggtgttcattgaccacggcaaccagctccacatccgcttcacccagctggatgaccggggcatctactattgctggaggcagggtgtgctagttgctggcttccggctgggtgtgacatctcatgggcactacccagcctcgttctcagatcctgagactcgctcggctgtggagctcaccctgataggctacctgctcatcacagcagtctttgtcaccattcacttctgtcgttgctgctgctacttatttcactgttgtcccagcttctccccctaggagctctcttcagctctgaagaccagttgtccttcaatgtgtttgttaaatgataccagatgtctctgggtgggtaccctgggttgggacaggtggtaggaacatgtggacaaatctgttacagcctgctccccattttcatgggcaggtctgggacctgatctgagaagtggaggggcctgaggctggtgggagattggggactgagctcaggatggaagtagggcacatgtgtttcctgacttcacatttaggtcagagaaggaaagtgtgaactcagatttatccagtggtaaacactgatcagtgttgaatcatg

SEQ ID NO: 665 - DNA, 6046 bp, Homo sapiens
ttttgtatttttagtagagacggggtttcaccgtgttagccaggatggtctcgatctcctgacctcatgatccgcccgcctcggcctcccaaagtactgggattacaggcgtgagccaccgcgcccagccagaaatagttttaaaaaaagaaataaggagcgtgcggcccgcgggggaagcgcctttaccagctcgagcctgcagccccccaggccgcgccgtcctcggctcccccgggcagcgccggggttttgtcaggcgcgcgctgctgtttgcctggattgcgctcattctgaccctgaagccagcggccccactgacacgccctgaaaagtgggagccacacgcgggatccggagaccgcgctaaagtcccacgcacgacggcgcccgccggcgagtccacgcccgcacgtcggcgcatgcgcgcggccaagccggtgcccgcgcccaccagcgcgcatgcgcgccccgtcccttccctccccccgtgctctgccccgatggttcggtccgcgccgggggcggggccagggcgcccgcgggaaatttggcgggaaccgcgcccgcctcttcctcccttccttctttccttgctttcgccgcgcactccgccgccatggagcagcgccgcgtcaccgacttcttcgcgcgccgccgccccgggcccccccgcatcgcgccgcccaagctggcctgccgcacccccagccccgccaggcccgcactccgcgccccggcctccgctaccagtggcagccgcaagcgcgcccgcccgcccgccgcccccggacgcgaccaggccaggccaccggcccgcaggagactgcggctgtcggtggacgaggtgaggggcgtggggagactgaggccggggagttgggggcggggagactgaggcccggggggcagggctcggggaaactgaggcggagggacgggggcggggaaacaggcgggggggacggggcgcagggaactctgggacaggccgggggatcctgggggcgccctgccaccactggggacttggctggctcctgagatgagcaggaggcactggggggcttgcaccgggatccgatgatggggctggaagtccagcttctctgcgaggccagggcaggggtccgacctggaaacggccccggaagacgagagcaaggctgtgtccccggccttagcacagaccaccatctacgggaagtcctaagccccccagccatgcccgtcccagttaactcagagcggcttctgatccttcggggtcctctgcagagccaggagcaccaggtcttgtcatgagttcacccttggggtccctcccaccaggtttccagccccagtacccccgaggccccagacatcccagcctgcccttctccgggccagaagataaagaaatccaccccggcagcaggtcagccgccccacctgacatccgcgcaggaccaggtgaggggcggggcctggggcagatgcgggagggctgagtggtgccggcctgcctgcctgcctgacggcaccgtgtcccctgatccccctgaaggacaccatctctgagcttgcgtcatgcctgcaacgggcccgggagctgggggcaagagtccgggcgctgaaggccagtgcccaggatgctggggagtcctgcaccccagaggccgagggccgccctgaggagccatggtgagtgctgggtgggcggccacgaggccccggcaaaggccgggttggtggcaggcgtggcccagcgagcctgtcagaggcccaggtctgctccttccagggagggtggtggtgaggtcaccagggcgcggacccagacccctgagaaaaaggtcccgggcactgctggcgctgtgccctcagtccctcctgcggggggcagctcctgcctcggggactctggcaggtttcaaatgctcctgatgcattggtgtgttgtctgcctctgcccctgagagctgacgaaactgcgctggggagagggcagagcttccctgggggagctgcgtggacacagcagagctggggtgtggagccgggctttcccgtcaccactgctacccctaacggtgccagtgctggtgggtgtgcaagggccgcgaaagccatcgtgtgtggcatggcaggccccatcggagggtctccctggccgaggggcctgctgtggcgttggaggggtaggggcctactgcttctcatgaggctcctccctccctgacagtggcgagaaggcgcccgcctaccagcgcttccatgccctggcccagcccggcctgccgggactcgtgctgccctacaagtaccaggtgctggcggagatgttccgcagcatggacaccatcgtgggcatgctccacaaccgctccgagacgcccacctttgccaaggtccagcggggcgtccaggacatgatgcgtaggtgagtggccgggggtgggctgtggctgtcctggagttgggggtgggcccgggcctgcctcctgagccgcccccatcctcccataggcgttttgaggagtgcaatgttggccagatcaaaaccgtgtacccggcctcctaccgcttccgccaggagcgcagtgtccccaccttcaaggatggcaccaggaggtcagattaccagctcaccatcgagccactgctggagcagggtgagtgctgggtgcgggacctcggtttccccatctgtgagccgcacagtttccagggtgggtgtgaggtgctgggcatctggcccaggactggtcacgggtgggtggctgggtggcctggtggggacttaggcctggactcgtcccacagaggctgacggagcagccccccagctcacggcctcgcgcctcctgcagcgacggcagatcttcagccagaagctggtggagcatgtcaaggagcaccacaaggtgagcggcccccggccccgctgtgtgaagatggtggcaccagcactgcctcagcacctaaccctgtgcttggagcatccctgccactcacagcttctcccgggatggaactgggctgggttcaccctgagctgagggctggtgtgctcagggtgcagccgcaggcactgaggaggtccccaaggcgttcagcgagcgcggaccatgggaggccttgtgctctccctccaagctgagcactgggcagaggctgagtgacttgcccgaggcggcccggctgggacgtaagcacaggcctacctcacatgcagtctgcccttgtctcagatgtgcccagggtcacccatctactccttctccccaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccagggtgagactgcgaggcttgggcagcccatttctcccgggtgggtgggccagcctgaccccaggcttaagaggtggaagccttggtgatgagcttgacgcctcatctggcttcctccttggctggcggatccagagagttggtggcatttgccctctgtccccagctgcagcctctaagcctggctctgccactagccccatgtggggagttggcctgggcaggcgatgctgcacactgggacactgcattgaccggcacagaccacccagtgtgctgggtgaacttgtgccttgagagataccggggactcctgggcagacagccaggggcacgttgcatcttgtgacctctccagtccaacctgtccctcccgcagatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcgggtgagtcgtccccagtgatggcgggtgggcgcctggtgacctgctgcccactaaccaggtcccggtacctgctgcagatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggtacgtgcagggcggggtgaaggggcgtgcagggtggaattgcctggtgctgcagctgcctccccagctttctgagcagaggtgtctgtcactgatctgttctgttcagatgtgcagtgggcgctggcctcttgcactggtgtgtcctgggcgctctgccctccttggagccacccctgagcctccgcccggcccctccacacctgcagcctctggaggcagcttccccctcacagctctggccctttccctgaccacctgcagtccttggtcagaaggggccccacatgcaccctccactgcctcccaggcctctggtgaccaggccctgagcacataggggtcctgacgctacagggcacctcctgcctcagggctttcatgggctggcggcctccatgctcggtgcctcctcacagggcctcaactgtaggcctggctctctccggtcactgttcacaccacccagacctgggcctctgatcagaaccacctctgccctaagtcctggtgatggggccctgagggcgaccaggcaggcacagaggttgggtggtcaggctggtttcaagtgctgcccgtgcagggctggggcccagcaccagcctcagtgtcctcctctcctcccccaggggaaatggagaagcacctgctgctcctctccgagctgctgccggactggctcagcctccaccgcatccgcaccgacacctacgtcaagctggacaaggccgcggacctcgcccacatcactgcacgcctggcccaccagacacgtgctgaggaggggctgtgagcctgggggccactgtggacagacgtgggcttcagaagctcgctggcctgggcccaccagcattttcttttatgaacatgatacactttggccttcctttccccagcgcccctgagggccagaggcagatgtgggctgcaggctgcacagcccgagggtctctggctgcgggcggtgggccccttcatggggctcacctggtggattcacattaaaccggtttctgtgggcacctctgtccttgctgctggtggggaagggaagccagatccagcaccccctggggggccatcgggagtgtggctgggggtgaagggggctctgtggcaatatggggttgggtagtgtgggtggcaggccatcccctctaatcttggaacctctgaatatgggacctcccacagcaaagggtgacttttgtcattaagaaagactggggtgggtgtggtggctcacgcctgtaaccccagcactttgggaggccaaggtgggcagatcacgaggtcaagagatcgagaccatcctggcgaacatggtgaaaccccatctctactaaaaatacaaaaaattagccgggtgtggtggtgggcacctgtcgtcccagctactagggaggctgaggcaggagaatggtgtgaacccaggaggcacagcttgcagtgagcgaagatcgcaccactgcacgcactccagcctgggtgacagagcgagactccgtctcaaaaaaaaaaatttcaagactggagaggtgatcctgaattgtccagctacgccccatgtcatcacagggccttcatgacagggccagagccagccagctttgaagacgcggccctgccccgacacaggcagcctggagaagctgggcaggacaagtaggacatccctggagcctccagaagggactggcctctgcccacaccttgacttcagtatttctgacctcctaaactctaataaagtcatgcttacagccacta

SEQ ID NO: 666 - DNA, 42357 bp, Homo sapiens
ggcggcagcagcggcgcgggcgggagggcgaagagcagcggccgcctgaggggagcccgcgcctccgccgcctgagaggaggtcgagctgccgccggggcgatgctggaggagctggagtgcggggcgcccggcgccaggggagccgccacaggtcggttcgggcccgcgccgaggggaagggggggcgcggcgcgcggcctggacgggccgaggcggcgatgggaggcggacgggcctccgggcgccaagcctggtcctgcgggccgggcgttcaccccctggggccttctcatccccagcgagggcctggcgtccccaagggcacccttgttgacgttattgttgtagccgcgaccatattgtttgtttccggcgcttttgcgtcagttcgtccctccaggactctctggggcggtgggtcggaggggccgagaggggaaactgaggcccagggaagcgaaagggcttgccctgcaggttactggatgcgtttgtgtcccttgaccatgttggaccttgcagcgggtggggaaactgaggcccaaggtcgcacgggctcggggaccagtaccgatgccgctgagggtcggggtaagcccgggtaagaagaggcccagatggtagagatggccaggagggtgggactcccgagttcttgctccttcctgatatgcaccgtgacttcctcctccgtgtgccttggaatggggtctttggagcccaccacaggcctcctgaaacgtgggagggtgaaccaaggaagaccagactgtccctctcccttgctggactctgcattacataacgctttggcagcacttggcattacgctttggcacatagtaggtgctcagtaaataacgtgaacgaatgaagggctagaatggacgccagtccagtttctcagcctcagcagtgttgatatttgttgccgtcctgggcacggcactgcagggtgttaagcatcatccctggcctccgccttttgcaggccagtagcagcccctctcaccatgccttagtaacagccagaaataccattgccctgtgtcccctatggggcagattccgccttggctgaaaatcatggctgtagttccttctagcctgtgggatttcccggagacataaaattaatataaagttggtactgtcgtggagctgtgatgttttaagtcaggatgtttaactttatttatttatttattttgagactgagtcttgctctgttgcccaacctctgcctctctggttcaagcgattcttctgcctcagcctcccaagtagctgggattacaggcctgcaccaccatgcctggctaatttttgtattttttagtagagacggggtttcaccatgttgggcaggctggtctcgaacttctgacctcaggtaatccacctgcattggcctcccaaaatgctgggattacaggcatgagccaccatgcctggccaggatatttaactttaaaaaaaaaaatcgctactcgctaggaccatgctatcatgaaaggaaagtatattttagtgccaaataaaattagaaaggatgtaatcgcagaataaagagcagttagtaactttatacacacatatgtgttaatcgtgtgtatctttggatctctggattgggagtgtcccgttttatatacaagattttttaatgagggtgggtcctgtttttaatgaggttgtttctgttccacttgcaccaaagctagtgactcaaagccacacaaatagatttttgtgattgtctcgaaaataaagttaagtgactaaaaatcatatccttcagttagggggtagaaatccatggcttttggtaagtggacacttgagaatgatactgtctttatttctttgaagtggctagaaaggaaacatgaattttctcagtaccttttcttattcactaagcttggggcggtgggtgaggggtggtttcatgtatggacgatggagttttttaggaagccccagtctgcttttaaaaagtactcacttttatgtaatgcttacaaaacatacgtagattaaccaaaataactaaactaggttttgccaagccagatctcctggtaagtgtgagcttcctaaacttactctgtttaaggtatttatctaaagactcgcttctatttatgatcactgctgcatctgctttgatattattagatggtttcttgagattttttttgcaggaaaatattttgtcttatcttctcttgacagcacttcagctcctgcctggcaagctcaaagtgctttaaattgtggtaccttcatgaattctctttaaaaagaaaaggatcccttttctgattttacagatttggtggtggtatgggggcttgggttggaggaagatgtttggggatcatgggaatgaaataggtaatctgatgttttctctcctccctacttttactcattccactttcatttcatgaaacagttccggttactctcttagttggctttctgatttattccagaccctaaccaggtaccataggtgcagcatggaacaagtctttctgctgtcatagagttggcattttgtttccagagagacgtaataaacacgaaagtttcagattaaatgccacaaagaaaataaaacaagacatgacagtgtctagggtaggatttctcaacctattaacattttgaggccaagcgccgtggccagcactttgggaggctgaggcgggtggatcacgaggtcaggagttcgagaccattctggctaacatggtgaaaccccgtctctgctaaaaatacaaaaattagccgagagtggtggcatgcgcctgtagtcccagctacttgagagagtgaggcaggagaatcgcttgaacccaggaggcggaggttgcagtgagctgagactgtgccattgcactccagcctgggcgacagagtgagactctgtctccaaaaaaaaaaaaaaaattttttttttttggcccatataattcttcattgtggtgtgctgtgcattgcattgtgggacatttagcagaatccctggcctctacccactggatgtgaatagcatccctttgagccctccctgcatcatgacaaccaaaaacatctctagactgtgtcaaatggcccccgaggacagaggggtcagaattgcctccaccttgtacataattggctctacatatgtatttgctaacttgattatttgcagaatttaacagtttaccctttgacacttttatttgcagccatggattgcaaagatagaccagcttttccagttaagaagttaatacaaggtaattatttggaaatgggttaaagagttgttcgtagtttatagtcttccttgtctcttgttggagacctcagtggaagcctggagctagaggggagagaaacagtccttcttcagaccaggaagctgggaaaatgcttttcacacagtaatgtctcgtggggttcccacaagtaaaccccgaggcctccacttatgcacgattggtgttttgtaacttgcagctgggagctctcctgtatgttgtagggagcgtagcagcatccctggcctcttcccaccggatgccagtaagtgcatcctccaagtcgtaacaaccaaaaatatctctatacgtggctgatgtcccctgggaggtagaactgccccctcagagaaccactgttgtcctggaagataaatgctcccaaatccttctgcataaaacggggagtgtgttcacccttgggccagatgagcggttggattgtaatttttttttttttttttttgagacggagtctcattctgttgcccaggctggagtgcagtggtgcgatctctgctcactgcaacctccgcctcctgggttcaagcaattctcctccttcagcctcccaagtagctgggattacaggcgcgtgccaccacacccagctaatttttctatttttagtagagatggggttttaccatgttggccgggatggtctcgatctcctgaccttgtgatccccctgcctcagcctttcaaagtgctgggattacaggtgtgagccaccgcacccggcccagattgtatttttagaaactacagttttgggtttttcaaacttgggctgggtgcagtgttgcatacctgtaaaaccagctatttgagaggctggggtgggaggagtgcttgagtccaggagttcaaggctgcggtgaattataatgacaccactgctcttcagcctggatgacagaggaagactctgtctcttgaaaaaaagggggacgccagatgctaggctcacacctgtaatcctagcactttgggaagctaaggtgggcggattgtctgagctcaggagtttgaaaccagcctggccaacatggtgaaaccccgtctctactaaaatacaaaatagctgggcatggtagggggcacctgtagtcccagctactcaggaggccgaggcaagagaattgtttgaacccggaaggaagaggttgcagtgagccaagggtgcgccactgcactccagcctggtgacagagcaagactctgtctcaaaacaaacaactccccccacaccccccccaaaaaaaaacaggtttttatttggtctattacatgatgaaatagttaataaaagatgcaatggcattgaagtaagtgaacataggttctttgggaaattcactctccaaagtgtttctgtgttcctcctaaccagcccgaagcctggcagactctgggagaacagtttgattgatgagaaaagcctaacagagcctagggtgctgaggccaggagaaaaaaaaaaaaccctgtccacaaatgtgtctatattttctacttgagaaccagatgcagttattatcaaatgagattttcacccattaaaaataaatttggaatatgaactgcatctgaaataaacaaatgtctcttgaaattctggcgatggctctgctaaaaggcttgtcaggattttgttttttaagttaggatgttgaagcggggcatggtgactcacatctgtagtcccagcaccttgggaggtggaggcgggcagatcacctgaggtcaggagtttgagaccagcctggccaacatggcgaaaccctgtctctactaaaaatacaaaaattagctgggtgtagtagtgcatgcctgtaatcccagctacttgagaagctgaggcaggagaatagcttgaacccaggaggtggaggttgcagtgagctgaggtggcgccattgcactccaacatgggtgacgagcaagactgtctccaaaagaaaaaaaaataagtaaaattaggatgttagaaaaggatagaatgaaaagatagcaccccccaccccctctttttttttgagacgaggtcccttttgcccaggctgcagagtagttgcaccaccacagctcactgcagcctctacctcctgggctcaagcgatcctcctgcctcagcctcccgaagtgctgggattatagatgtaagtcagtgtacctggcttcagatagcccctgccccgtcttttttttttttttttcttttgagagtttcgctcaggtcgcccaggctggagtgcagtggcgtgatctcagctcactgcaggctccgccccccgggttcacaccattctcctgcctcagtctcccgagtagctgggaatgcaggcgcccgccacctcacccggctaattttttgtacttttagtagagacggggtttcaccgtgttagccaggatggtctcgatctcctgaccttgtgatccgcctgccttggcctcccgcacccggccttttttttttttttttttttttttttttttgagagggagtctgtctctgtcgcccaggctacagtgcagtgttgggatctcagctcacttcaacctctgcctcccaggttcaagcgattctcctacctcagcctcctcagtaactggtattacaggcgtgtgccaccatggcctggctaatttttgtagttttagaaaagacggggtttcaccattttggtctggctggtctcaaactcctgaccttgtgatctgcttgcctcggcctccccaaagtgctgggattacaggcatgagccaccacacccggcccagatagtccctttttaaactttaaaattatctcccacccccatgtcccaacaaatcagtaattttcaagctcatgagtggttgtaactttaaacgttcactagagatggctttctgtctttgtttcagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagagtgagtatctcccatggagtccctgcacatcagtgctcacggatctcagagcgctgtcagtctccactgggtcacccaggtgttttgtggcagagtgagcggggccacgggctgggtcctgggactcgacgtggagttcttcctggtatcaaaactcacagtgttcagttctgcattcgttgtgatgcccctgggacttaattcatcaacagtgtacctggtgtactgtgtgaataacaccctgctgttttgccttcgttgttcacatctaatcagtgatagcttagccgttttagggaattaggatctgagctggtgctgtaacccctcacttcagattcgaggtccagctttctctgtgcccttcctgtctaagcatagaaatgtagggacggggctgcaaagacactgagcactgaagtggcagtgagacggcaggaagcatgacttggggaattctgtagggtcagcacagccagccatcttaaaaaccttacctggggccaggcacagtggctcatgcctgtcatcccagcactttgagaggccgaggtgggaggatcgcttgaagatcacttcaaaaccaacctgggcaacatagacaccatctctatgaaaaaaaattacttttttttttttttttgacagagtcactctatcacccaggctggagttcagtggcgtgatctcggctcactgcaacctccacctcccaggttcaagcgattctcctgcctcagcatccctgatagctgggattacaggtgcgcaccaccacacttggctaatttttatatttttagtagagacagggtttcactatcttggccaggctggtcttgaatttctgacctcaagtaatctgcccgtcttggcctcccaaagtgctggaattataggcatgagccactgcacccagccctgcaaaaaaatttttaaaagttatccaggcatggtggcacatgcctgtagtcccagccacctgggaaactgaggcaggaggatcacttgagctgaggagttggaggccgcagcgagctatgatcacactgccgcgctccagcctgggtgacagagcgagaccccatctggaaccatttttaaggaccccataagggggacttttgcatggtctgtctctgttattgattttttattagcacaatggtgtccttaaggtcttagggaccaaactgataaaatcagtcacgagtcccacggtgtttagtggtgtcttttgattttataattttttactttttatcttaagtatgtagaaccagaagagacagtgcctttttatgtttttggttttgtagcacttttgtttgttcatgttgggtctttatatgagagtagtagatcctgagatgggtcatttaatctgtacctgtaagcaggtacagtagaccacctggaccataaaccaccaaccttgttcgctttcgggattttgagctctaaggaaccatttatttatttatttttgagacagagtcttgctctgtcacccaggctggagtacaatggcgccatctcagctcactgcaacctccgcctcttgggttcaagcaattctcctgcctcaccctctcaagtagctgggattagaggcacccgccaccatgcccagctaatttttgtatttttagtagagacggggttttgccatgatggccagactgatttcaaactcctgacctcaggtaatccacccgccttggcctcccaagtttctgggattataggcgtgagccactgtgcttggccaagagcatttatttttctgaatgacttcatttcttgtctttcacctgagaagatgaaaaaggaaaaaatggcttcctctttaggtttatgaaatgttgtaaaaatggtgcaaatctttttttttttttttttttttgagacatggtctcaccctgtcgcccaggctggagggcaatggcatggtctcagcctactgcagcctccaccttctaggttcaagcgattttcctgcgtcagcctcttgagtagctgggattacaggtgcccaccaccacgcctggctaatttttgtatcttttcagtagagacgggtttcaccatgttggccaggctggcctcaaacttctgacctcaggtgatccgcttgcctcggcctcccaaagtgctgggattacaggcatgagccaccgccccagtcttctactttgttttatatgtgctggtttgttatataggtaaactcttgtcgtgggggtttgttgtacagattattttatcactcaggtactaagcctagtaccctcttctaagttactaaatgtgccagactggcatgtacacatttcagcttctacctaatccaccactcaatctcccaaaatcagagttgaagtctctccccattgggcatcctgtagtgtacattcgatcacttgaatttcttccaggctgctgccgctttgcaaaatttcgtcctgtgatgtgagccatttagcaagaacgggacacatggctgggcgcggtggctcacacctgcaatcccagcactttgggacgccgaggcgggtggatcacctaaggtcgagagttcaagaccaggctgaccattatggagaaaccccgtctctactaaaaatacagaaaattagctgggtatggtgacgcttgcctgtaatcccagctacgccggaggctgaggcgggagaaccgcttgaacccaggaggcagaggttgcggtggcctgagatcgtgccattgcactccagcctgggtaacaagaacaaaactccgtctcaagaaaaaaaaaaaggacaggacacaagcacatgtttccattaagtttgtttccatgtccacagcttagtctgcaaactgggaagtcccctcgttgggcatcatggtggcacaatcctgcccgctttctaaaacaactgagcacatgaacccagtgtgcaacatttaggaaaccctgcatttaggacgctagatcttgttctgaacacagactcgaggttttgggatgcacttgaaggcaatattatcccaacttttcagataatttacaagtggtaaaggcttcaggctggcccagagcctatggcagaaagcggccacaaccacccgcagagggcctgtcagtcaccgaagctatgagggaagcgattatcgggaggcctcctcatgccctgatggcagggatccctgagatcccagctgagagagactccatccccaacccctactttatctccgaacctttaaggagtcctgcatttctggtttggttggtttgcttgcttcatagttggtacctaactcttttttattttttattttttttgaggcggaatctcactcttttgcccaggttggagtgcaatggcgtgatcttggctcctgcaaccgctgcctcctgggttcaagcaattctcctgtctcaacctcccaagtagctgggattacaggcacgcgccaccaggcccagctaatttttgtatttttagtggagatggggtttcaccgtgttggacaggctggtctcgaactcctgacctcgtgatccgcccgcctcggcctcccaaagtgctgggattacaggtgtgagccaccgcgcctggccagttggtacctaactcttaacacctttccttgccgtgacgtccaagccacccccttcccacaacccctgttcctctggggaatacactgtttttgcactttacctccctaccagcagctctttccagattgcaggggcgagctggtgggaagcttgcagattgtttcgcactgccgtgtaatctgtgtgcttgtcactggggtctgttcttccttgagttggtacagtgaaatatgcattgagagtcccagggcagtcattgccactgtactttgtgggctggcttgccttctttattatttcttctttaaaataaaagaaaatgggagtttgttccgatacaggtcctgctgtccctttgcagggagcttcatggcgtgtttttgtttgttttggtttttgttgttgttttagtactgcaggatctggagaatctcactttggagaaacaatgatttaaaaagatccccctttagatactcccagggtcctttgaatagctgaagtgttcctttttagtattagagttttctaccatgtgggaaagaaccatttctgaagtttgcaatcagacttgtgatttagcctcttctgttagtgatcgagatgattatttgacaaatgatcatgttggtgcagttgtgttactggaatctttggcttgcttctgtgcccagattgctggaacttctttccatatacttgaaattacatttgtaataaattctccatgtttaaaagaaatactggtctaggtgcagtggctcaagcctgtaaccccagcactttgggaagccgaggtgggaggattgcttgagcttaggagttcgaaaccagcttgaccaacatggtgaaactccgtctgtacaaaaaatacaaaaaatagcggggcatgggggtgcacacctgtagtcccagctccttgggaggctgaggtggaaggatcacttgagccaaggaggcagaggttgcggtgagtcatgattgcaccactgtgctccagcctgggcaacagccagaccgtctcaaaaaaaaaaaaaaacaaaaaggaaaaagaatggaaaccttgaagccctctgttctcccaggaggttgccattattatcatcatcatcaccttgtgtttttctgtgtcctgtatatccagagagatctctaggaaacacccagtatcattttgtttccttgtgtatgacatatactgtaaatatctgtctttgttactcaagggtgtcttagatgttttttatattgggatggaaagatggagctctttttaacagctgcgtgatatcccatggtgtggacatgctgtaggttacagagctgttttctcagttctgctgtttctgtgcttggctttcacaaaatgattgttcccttgagcttccttctacaagtggccttgggctgttaaggagaatgaggtcttggtagctcaaggcaatgcgtgcgttcttattttcccagcttgcactctctcatgcttgggccaattggaggttttctcttttcccccctgcctccgctcccctgctgtcaggttttagcggcttatctggtctgggcttagaaattagataccctttagtataaaatcagagtccataggctctgagaggattatctgagaaagggtgcaggaattttcatgcccacacatagtgagctctgtcgcgactccttgggattgtcggtttttgtgttttggcttccttctgggatcctggatcacgtttttggcagttgagggtgctgtctgaccgggctccagctgggtagaatgtgggagtgttgcatagaattttgagagtgagatctataaacacttgggtcaaatttcaagaagataaagttctgtcagacttcaaggtccatctgagggtttggcaaagcaaaaaagataccagttttaaattaagcagtaattgctctgttttggttgttggatattactgagcgggctcttgccagtcacatcaagtctgttatctctggactcacagcagagggggggcattgtaagaggcaggagattctgcagctgagcttcaggcatgggcaagactaaggaactgaattccccgccaccccaagaccacattccgtattataatctctgaacacaaagggcagccccggagagctgcggctcccatattctgcagttaaatccctcagcgtgggggagaggcacacagccttggcaggcagagtagatgctggagagacagatgctttttctgcagcatttggtgaggctgcctcgggctggcatttctgttgccacattctcagcaaagactgaacaccctggcctgatctcggtggtgaaagagctcctgccaacacgggcagccttctcacaacggctcggcctttccctaaagaaaggtttagtccagaaaggactcagtgggacccaggtggaaaggctgtcttgagctcattcatctgaagcttttattctgtgagaggtcctagtcaggggttcagctttcccagataaagaaatcactgttggccgggcgcggtggctcacgcctttaatcccagcactttgggaggccgaggcgggcggatcacgaggtcaggagatcgagaccatcctggctaacatggtgaaaccccatctctactaaaaatacaaaaaaattacccaggcatggtggtgggcacctatagtcccagctactgggcagactgaggcaggagaatcgcttgaacccgggaggcggagcttgcagtgatccgagatggcgccactgcactccagcctgggcgacagagcgagactccgtctcaaaaaaaaaaagaaatcacttacataattttgttgacccctcagaccattgccaggaaaatgggcctttggtttttcagtcaacttcagtcttacactgcaagtctgcaatgaacccggagaactatttcttcccactcttaagcgtctcttcccattgctcttcacttctactagtttggttttcaggattccctgccccggtgggagatagcttaggccaaagtccagactccctgttcgtcttccttcctgggaccatttaggtggatggtgagtcacaccatggatcctattggtaattcctagtagctcatgctcagtttgaaggtaggtgatagaaaatattgtgccctagaaggtagaagtcctagaaaaccccagcaagtttcccttttgtcttaagctttcactccacattctaaaaagcagagttggctgggcgcggtggctcacgcctgaattcctagcactttgggaggcgaggcgggtggatcacctgaggtcaggagttcgagaccagcctggccaacatgatgaaacccctatctccactaaaaatacaaaaattagccaggtgtggtggcacacgcctataatcccagctactcaagaagctgaggcaggagaatcgcttgaacttgggaggtagaggttgcagtgagccgagatcgtggcactcgctgcactccagcctctgtgacaggagtaagactccatctcaaaaataacattaaaataaaaagcagagttgagctagacagaatgtaaattagtggtgcacaggaaaccagcctggagacatgttttatttgattaatttagtatctttttattttttttttagacagtctcactctgtcacccaggttggacagctcagtgcagcctcaacctcccgggctcctcccaccccagactcctgggtagctaggactacagatgtgcaccacaacacccgactaactaaaagctttttttagagacagggtcttgctttattgcccaggctggtcttgaactcctgggctcaagtgatcctcccgccttgacctcccaaagtgctgggattacaggcatgagccactgtgcccgtctgtgtccatttttaaacacctaaaaaaattcatatgaaattcctaatatcagcttctcttggagaaattggaaggaccagcaaatagggatctatattcctgtaagaactccatctcctttggacaggcaggtcctctctcctttgctacaaatccatcctctccctgtcgcccaggccagctgtcgctttttttttttttttttttttaagacagagtctcaccctgttgcccaggcaggagtatggtggcgcaatctcggctcactgcaacctccttctcctgggttcaagcgattcttctgcctcagcctcctgagtaggtgggattacaggcacctgccaccacgctcggctaatttttgtatttttagtagagatggggttttgccacgttggccaggctggtctcgaactcctgacctcaggtgatctgtctgcctcggcctcccaaagtgctggaattacaggcgttagccaccgcgcccagccttgtctgttgcctttatttctgagcttgccttgtttttcttgtgcttggtgtccttcactcatttctttatctgcctccgtagtctctcttgttatctaatcccagatacacacatgtatgcacacttactggagtttgtgaccctattatgacattttggttctgttggtggaaaaactgatcacctggaaaggtttctctttttctcgaagcaattgaaataacccgtgtttaaagataaacgtcttctgttttcagataactaagaaattcgtcaaaggctctacagagaagaacaagctcagactgcaaagagtaagacattttccctgaaatagaaaattaacctgctgtgctttttgcattaaatagtaagcaaagccctttgaagttcctttggtctagtttttacattttccccagccttctctgaccatcattttgattcctgcttcattttaagtacttggacttcatggtttgtggattgtgtcattttttggcttgctgagtgagtcctaaggttttgtgtgtggccttttctaagcttttatcaatagtgctaccactgtcttaatggttcagtatcccattgtagcttcaaattaccttccaaaaacccagtccatttccttgtagtcctgtctcttttttttttttttttttttttttgagacagagtctcgctctgccacccaggctggggtgcagtggtgcgatctcggctcactgcaagctccacctcccaggttcacgccattctcctggctcagcctccccagtagttgggactacaggcatccaccaccacgcctggctaattttttgtatttttagtagagacggggtttcaccatgttagccaggatggtctcgatctcctgacctcgtgatccgcccgcctcggcctcccagagtgctgggattacaggtgtgagccgccgcgcctggccagtcctgtgtctttcacttattgctaagtgctataacatctgaatagcctctacactcgatgggtggttatcctttagtgactctctgcttagtctcctattctgtggggggcatcaccacgttttccacacagcaatgcagggggcttttgttttgttttgtctttgagacggagtcttgctctgtcaccagactggagtgcagtggcacgatctcggctcactgcaacctctgcctcccgggttcaagcggttcttctgcctcagcctcccgagtagctgggactacaggcacttgctgccatagccagctaattttttttttttttttttttttttgtattttagtagagatggggttcaccatgttgcccaggctggtctcaaactcctgagctcaggcaatcctcccgtctcagcctcccaaagtgctaggattacaggcctgagccactacacctggccgcaggggactttttacttattgcttaaaggttagagaaattgaacatcatgtcataccgaaacaaaccaaaactccagggaaggcctctgggctttgcctatgcagtgccagctcacaggaggggcctggtgaccatgggctctgcgtttactgagtgtttcctgagctccctgatgttcactgggcgtttcctgagcttcctgatggccacactgagtttttgtgtttcagatttggggttgatttttattttattacttttttttttattgagacacagtctctgttgcccaggctggagtgtagtggtgcaatctcggctcactgcagcctctacctcccgggttcaagcgattctcctgcctcagcctctcgagtagctgggattataggcacgagccaccacgcctggataattttttgtatttttagtagagacagggtttcgctatgtttgtcaggctggtctcaaactcctgacttcaggtgatccacccaccttggcttcccaaagtgctgggactacaggtgtgagccaccacgcccagcctgatttttatttttacagtttatctcattctttggaacaagagcacttttaaagctcattggaacctccgagtcccgcacaccgggttggggagcggagaaagtatccaacggcggctgaagaaatctgattcacctgcagtttctagaagccttctatttcctgcttagcaacagggtgggagactcttcacccagttatgtttatagtctccttgttcagtccagacggtcaccttcctcgtgtgtctcgtatatcagatgcagtcacacagcacactggcaggaaatgcacatcagacatcttccaggctgtgtctctgtggcttttgttaaagctaccagagatgtattggaacacatttagaatttttccttagagacaagggcagatatcctaacccaaactgaaagctgagctgtcaggctccagacgtgtgggaagcccatattggatgagaggtggtcctcatgcagtgttaggagcgggcacctgtggagctgggcaggtgagcgttttttttttttattttgagacagtctcgctctgttgcccatgctggagtgcagcggcgtgatctcggctccctgcaacctccacctcccaggttcgagcgattctcctgcctcggtctcccaagaagctgggattacaggcacgtgccttcatgcccagctaatttttgtatttttagtagagacggggtttcaccatgttggccaggctggtctcgaactcctgacctcaagtaatccgcctgcctcggcttcccaaagtgctgggattacaggtgggagcctgcgcctggctgagcatgtttaacattgaacttcagattacgtaatgactgagtgtcccaggccactgccaagtctttggaatgaggaacgtagtgatgaagtgttacttccttaaagaatttgaaacaaggctgggcgtagtggctcgcccccataatcccacactttgggaggccaaagtgggaggatttcttgagcccaggagtttgagacaagcctgggcaacgtagtgtctctactaaaaagaaaaagaattcctgggctggttgcaatgggtcatgcctgtaatcctagcactttgggaggctgaggtggacagattgcttgagcgcaggagttaaagatcagtctgggcaacatagtgagactccatctctacaaaaattagccaggtgtggtgacaggtgcctgtggtcccagctactcgggaggctgaggcaggaggactgatttgagcccaggacggaggttgcagtgagccaagatagcattgctgcactccctccagcctgggcactagaatgagactctatctccaaataaataaataatgtttttttgttttgtttttcagacagagtcttgctctgtcacccaggctgcagtgccgtggcgtgatcttgaactgccttgtgggtttaagcgatccttgtgcctcagactcctgagtagctgggactataggtgtgcgccaccacattcagctaatttttttgtatttttggtagacttggggtttcaccttcttggccaggctggtctcaaacttctggcctcaagcaatttgtctgcctcagcctcccaaagtgctgggattataggtgtgagccccctcagcccagcaggattgtgttttaaatgaatcttatattgaatttcccacaagtaccaggacacagggctaattcttaacatttttctcatgatggaaggaagcataatggattatgaaaatcacttctgtggctgggtgctggggctcatgcctataattccaacactttgggaggctaaggcagaaggattgtttgaggccacgtgttcaagaccagcctgggcaacacagcaaaaccccatctctaggaaaattacaaaaatagctgggtatagtggtgtgtgcttatagcccctgctactcaggagcctgaggtgggaggatcacttgagcctgggaggtcgaggctgcagccagctatgactgcaccactgcactccaccatgggcaacagagtagactttgtctcaagaaaaataaaatcacttctgtgtaaagttgttgactggaggctcctcctggagctggtctctgaattcttatttattcatttatttttttaactgagtctcagttgcccaggctggagtgcagtggtgtgacctcagctcactgcaccctacgtctcctggttcaagtgattctcctgccccagcctcctgagtagctgggactacgggtaccctccaccacgcctggctaatttttttttttttttttattaaatggagtctcactctgtcactgatgctggagtgcagtggcaccgtgttggctcactgcaacctccgtctcctggtttcaagcaattcttctgcctcagcctccccagtagctgggattacaggcgcccaccatgcctggctagttttttttaaaaatatttttagtagagatggggtttcaccatcttggccaggctggtctcgaactcctgacctcaggtgatccacttgcctcggcctcccaaagtgctgggattacaggcgtgaaccaccgcgcgcagccaatttttgtatttttagtagagacagggtttcaccctgttgaccaggctggtctcaaactcctgacctcaggtgatctacccacctcagcctcccaaagtgctggaattacaggcgtgagccaccatgcctagccttggtccctcaattctgttcatcccgtccaggccgtgctgtcctccatgctgtgaaccgagcttcctcctgggagttggagggagggccacctgtcacttgccacactgtcttgtaggatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggagtgagtgtccttggaggccatgctgggcccgccaccctgctgctggattccgctcctggccactctgatggggcctttccacttcacaggcagatggcggctcccttcagttccttcccatttctccttcgtgaggtgcccgtggggccctgacgtgggagcggtggaaagcagctccctgctctttagtgctcccccacgtccaactcaccctggaccccttgtctctgctgtgaccatccttccagttcccaaccaacttaggcatttgcattgcaggattgtgggttttgtctgtgctaattgtgctctgactggctaaagttttttatatatattctagtcacaggaagaattttattgactgttttccatttttattgtgaagacctatgtaaaagccttatactagacatgaaaataacttatattcatttaatgtaaaatgaaatacttgccatatactaacagttgagtgctgcggtcccttccagagccaaagcaaagagtcggctgaaatgtcatttgctgtctcacagggctaaacttgaggaaaaaaggaaaaaggaagaagagaaacggttaagagaagaagagaaggtagagtgtttcccacagagcttccccgtcccagcccgttggagaagcagatgcccaaagtggaattcttgccacagccgtcacctaatattctcttggtttggggaaaccaaatggcgcccgcagggagggcgagtctgtctagatgcgttcttgttgcttcttcccagtgctggctgtcacatgcctactggccctgcaatcctggcacttctacccacaagggcaacttggacattttgagattggctggctcagttgcgggtccgtgggttttgagagctgaaaatcacagtagtgccttcaagctaaaatgcttgacgttcggttctgggggcctttgcatgttttgcaacacatactgttcctcttcctctcctctttctcatcaccatctcttaacatcacagcgcattaaagcagagaaggccgaaatcacgaggttcttccagaaaccaaagactccacaggcccccaaggtgagcagccggctgcctttgcttttgggtttcagctctgctagacttttcctttctgaaagtgaaagggtctctccccagccagcttctctcattaggagggagggagcctccagtgacctagggcacttccatttctggttaagtcttgaggctcaatattttgtccttcgctttgtcccaaagaggtaaaaagtggcatgtctgattaaacagtgctgttttcagaggttacttcatgaataattttgtgttaggcgtaagagaaattcaccatgtttttacccttgggaaacttaggcttaaggagggagcacgtttagctgtaaaacaacagtacaattcacaaaggtttactttccctgcctggcgtcggtcacctggcatctcagaccttctgagccaccatctgtgcatggaaaccacagccctccttcccctttacccagagggagcccatctccaatgttaggggtccttcagtgcctttccctgctccactcactgtatttatacacatgtgtacttagctatctcagatttgtgccatgttgccacatttagatgtatttcattctttttaatgtatctggcctttatttattttttgaggcagggtctcactgtcacccaggctgtagtgcagttgcacaatcaaagctcaccacagccttgacctctcagggtctggtgatcctgtcacctcagccttcccgagtagctgggactacaggcatgtgccaccatgcctggctaattttttatttttattttttttgagatggagtctcactctgtcacccaggctgcagtacagtggtgcgatctcagctcactgcaacgtccacctcccgggttccagtgattcttctgtgtcagcctcccaggtagctgggattacaggcacatgctaccacacctggctaatttttgtatttttagtatagacggggttttaccatgttggctaggctggtcttgaactcctgacctcaggtgatccgcccgcctcagcctcccgaagtgccgggattataggcgtgagccaccgtgcccggcctaattttttaatttttttttgtagagactgggttttgctatgttgcccaggctggtctcgacgacctggcttcaaatgatcctccaaacctcggcctctcaaagcacttggattacaggtgtgagtccctgcacctggcctgtccttttatttgtatgttgagacatttgatggcaattgtgtatcctgaaggtgcacaatgtgacattgttgtacctacacatcatattgtgacagccagagatccacatcatgtattttcactgccgcataatacttcataatgcaatgatatggtttctctctttttttacaaaaattatttatttatttagagacggagtattgctctgtcacccatgctggagagcagtggcgctatctctcggctcactctaacctttgtctcccgggttcaagcaattcttctacctcagcctcccgagtagctgggattacaggtgcctgccaccactcccagctaattttttgtgtttttagtagagacggggtttcaccatattggccaggctggtcttgaactcctgacctcagatgatctgcccatctcagcctccctaattttatttttagtagagactgggtctcactgtgttgccagggctggtctcgacctcctggtctcaagcatttctctcgctttggccacccaccgtgctaggatcacaggcatgagccacagagcctgccactatctcaacctctttgcccctcagtggtgtagggggggtccctgcacatgcttctctgcacacatgcattcctctgggacagccaagtaagcatgagttcacctctaggacaaaatagcatattgctgaagcatcatgagccatggccagagtgcgtgccagatgggaaactcagatgtacattcccggcgatgtgtggaaatttcctccccattctctgctatcactgcaatttttatgggattaattttcttttaactttgccagtctgatggatttttaaaaattgacattgttttactttccatttttacttgactcttggtgcagttgagcatctttttctgttcgtttgccattttagttcttctatgacttgccaattcctatttttttacctatttttctacaggattttctttttttttctttgcctgatctgtaagttttttttaacatagtctagtatttcattctccgtgatatttcgtctcagcctgttacctctttgtttacagtcttttttttttttttttttgagacacagtttcactctgttgctgaggctggagtgcagtggtgccatctcggctcactgcaagctccacctcctgggttcacaccattctcctgcctcagcctcccgagtagctgggactacaagcgcccgccaccatgccccgctaattttttgtatttttagtagagacggggtttgcaccgtgttggccaggatggtctcgatctcctgaccttgtgatccgcccgcctcggcctcccaaagggctgggattacaggtgtgagccaccgtgcccggcctttgttgttttttgtttgtttgttttgagacaaagtttcgctcattgcccaggctggagtgcagtggcatgatctcagctcaccacaacctctgcctcctgcgttcaaatgattctcttgcctcagcctcccgagtagctgagattacaggcatgtgctgccacgcccagctaattttgtatttttagtagagacggggtttttccatgttggtcaggcttgtcttgaactactgacctcaggtgatccgcctacctcggcctcccaaagtgctgggattacaggtgtgagccaccacgcccagctacagtgtctttcattatactgaaatttctccttttggccaggtgcggtggcttatgcctgtaatctcagcatttggggaggccaaggcgggtgaatcatctgaggtcaggagcttgagaccagcctggccaacaaggtgtctctactaaaaatactaaaaatacaaaaattagccgggcgtggtggtaggcgtctgtaatcccagctgctcatgaggctgaggcaggagaatcgcccaacccaggaggcagaggttgcagtgagccgagattgcaccactgtactccaggctgcgcaatgaagcgagactccatctcagaaaaaaaaaagaggagttgtgatctttcaaaaaaagaccctgtctttttttttttttttttttttttttttttttgagaaggagtcttgctctgttgcccaggctagagtacagtggcgtgatctgggctcactgcaacctctgcctcccagatccaaacgattctcctgcctcagcctcctgagtagctgggactacaggtgcccaccaccatgccaagctaatttttgttttgttttgttttgttttgtttttgagatggagtcttgctctatcccccaggttggagtggtgcagtggcacgatctcggctcactgcaacctctgcctcccaggttcaagcaattctcctgcctcaggcccaggctagagtacagtggcgtgatctgggctcactgcaacctctgcctcccagatccaaacgattctcccgcctcagcctcctgagtagctgggactacaggtgcccaccaccatgccaagctaatttttgttttgttttgttttgtttttgagatggagtcttgctctatcccccaggctggagtgcagtggcacgatctcagctcactgcaacctctgcctcccaggttcaagcaattctcctgcctcaggctcccaagtagctgggactacaggtgcatgccaccgtgcccggctaattttttgtattttagtagagaccgggtttcactgtgttgcccaggctggtctcgaactcctgagctcagacaatccacccgcctcggcctcccaaagcgctacaattacaggcgtgagccaccgcgcctggcctaatttttgtatttttagtagagacggggtttcaccatcttggccaggctggtctcgaactcctgacctcaggtgatccgccctcctcagcctcccaaagtggtgggattacaggcatgagccactgcccctggcctaatttttgtttttagtagagatggggtttcaccatgttgggcaggctggtctcgaactcctgacctcaggtgatccgccttcctccgcctcccaaaatggtgggattacaggcatgagccactgcccctggcctaatttttgtttttagtagagatggggtttcaccatgttgggcaggctggtctcgaactcctgacctcaggtgatccgccctcctcagcctcccaaagtggtgggattacaggcatgagccactgcccccggccttttttttttttttttttaagtgaggtttgttgagatataatttacatccaataaaataaactcttttcaggacatttgtgttgacaaatgacagggccagctaaccataatgaagataaaccctatttccatcactcaaaacagctcccttgtagtctgtccccccaccgccggcccttgagactgccaatctgccctctgccctgtagctctggaaactcggctctgtggacccacacagtgcctgggcttttgagtctgtgccttggccttagcctggatgaatcccaccagcaccctgctgtgtgcgtccatggtgcctcctttctcccattgctcgaagaccccatcgggtctcttcttgatttcagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacaggtcagagcctgaggaggtcggccttcacccactagtgatgctggaggccagcatcctgaaccctggggtccccggggtgggagctctgggtccttctgttgcttgcttcctagtgccctcgggccctgggcttcggtgctggctcaggcctctctccacctggccttcctgtaagctcctgaagtcttcctctccctgtcttcccagctcctcgtggaggaatcttatttccctgctggtctccagtgaaggataccccccaacacctcgctcttgcaaatctcattccacagaacctcccttgctaaaaatgctctggggctgcacctgggcagctgtcctccctctcaccctgcaggctgcaccctcctccatctgtcccttcagtccatgttcctgacctttctttggggacaggcagtgctgctttttaacaaatgcccatctttctagaattgttaggccagcttcacagggaggttcctgggaggtttgtgagcaggtctgtaaggcagcgtgatcctgagcctggggttttccttctcagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacggtgagctagccccagagtgcctccgtccccgtacctcctcactgtgcccctttcctccagccccaaagacagttgtgagtcccatgtgtttcttttctcagaagctcctggactatgaggtggacagtgatgaggagtgggaagaagaggagcctggggagtccctgtcccacagtgagggggtaaggatgtgccccagctgtcttcactcacagacggcttgtgtttgagtctctgtcccacagtgaggggctaaggatgcagcccagctgtgttcactcactgacagctggtgtttgacctgctgtgtggtctgaaacctgaacgcacctcaacatccagacttccagcttctctcgaaaaatctcatctggtgacactcgcccacgtggctgctggggatgggatcccgtccgcatctgcaccgtggccccacagccccctcttgcctcctgcgggcctgctgcacaccatttcctcctgactgcccagctgctgtgacctagtgggctttctgccgatgctcaccgtgtctgtcgggaggccatgcaaagcagatgttcacagctttacatttttttgtttctttaagatggagtctcactctatcactcaggctggagtgcagtggcgcgatttcggctcactgcaacctctgcctcccaggctcaagtgatagtcctgccccagcctccctagtagctgggattataggtgcgtgccaccatgcccagccaagatttgtatttttagtagagacagagttttaccatgttggccaggctggtctcaaactcctgacttcagatgatccgcccacctcagcctcccaaagtgctgggattagaggtgtgagccactgcgcctggcctactttgtttttaataaggcacacactctgcttttctatctgatgaactcttttttttttctccttttgaggatgatgatgacgacatgggagaggatgaagatgaggacgatggtttctttgtgccccatgggtacctgtctgaggacgaaggtgtgacagaggtgagggagtgaagggggaggtcaccggctcagcaaaagttcatttctggactggtgctcagtggcctgacctgggagggtgacgggggtcccagcccaaccatacgagatttggactgcattccaagcacgcaagctcactcgtgggaacagctgggcctgaacttggtattacctgggagggtggcagacgtaggaggagcttgcaagcgaggggagccataggagcagacaccctggtgagggagcgtggccatggtctgtgggttagaaggctggaaaccacccgagctgacatacagtcagcatgcagcaagacatgtgcattgtaagtgttgagtttgatgacgtaacaatcaagtgaatgtgggcaaccaccgcccgaaataaaacagaacttccctatctctccagaagattgcccacgtctctgcaggcgaacctgcctgccacccctttccagattccataaggttgtggaactgtctttttttttttttttcttgagacggattctcattctgttacccaggctggagtgcaatggcccggtgttggctcactgcaacctctgcctcccgggttcaagcaattctcctgcctcggcctcccaagtagctgggactacaggcgtgtgccaccacacctggctaatttttgtatttttagtagagacgggagttcattatgttggccaggctggtcttgaactcctgacctccagtgatccacccgcctcggcctcccagagtgctgggattacaggcatgagccaccgagcccggcaggaacttgctttcaagcaagttgtttttggtcctgttttgttttgaaggcctgtcgtttgggaagtggggatttggtgggactgtctcatggttggactggaggcctaggcattccttgtgcatatctgaccaccgaggcctgaactgtcagtcagagagtggtctcaggccctgcatgtgtctgccagatgcctgggccatgtgggtagacacccaaccctgttaaacggctccacgatcacacattcaccagaaaattcagaggggtgttaaaagaggcctcatgggtgagttcagaaatatctgtgacgctcccaaaggagaccaggtgtgaattattccatctggaagaggggcagccagcgcatggtgtgctctgccctggccctgacactgtgggaagttttgtgcccctgtcctttcctcttgctccccagctggctggggactggttcctcaaaagagtgcccgggcataggggagcaagaaccccaaataaacttctgctttctaaaccacaaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagagtgagtgtgggcggggccaggccacccacctgttcctgggcccagctaattccagggctgagggcaagagtcacaggctagtgggtccgtgatgcaaatgttctttccacaaataacagaggccagcccttttcctgtacatgtccgtacgttcaatgatgtccctagcagcaggacgaggcaggtcccttaattggcttgttttatcaaccaggacacaggcacagagagtgctggagtgggggctgtgctttctcaaaagccagggaggggccgggcacagtgcctcatgcctgtgatgccagcactttgggaggccaaggtgggaggatcgcttgagcctagtgcttcgacaccagcctgggcaacatggcaaaaccccatctctgcagaaaatgcaaaattacctgggtgtggtatcacgcacctgtgatcccagctactcaagaggctgaggtgggaggattgcttgagcctaggagtttcagaccacagtgagccatgatcctgccactgcactccagcctgggtgacagagcaagaccctgtctaaaaaaaaaaaaaaactcaaaaaactggggagggaccatggcacacaaggagagcagggcagtcatttgggtaggaacagcaggcatttgaagtcagccctggcaacacacgtgcccggccaaggctcacttctgggcaggtgcgtaggtgctaccctgtcttacacccgccctcatgaggccacctatccccgaagctggccatgccccaagcctcggtggcaatgagcttgtgtatgtgttttgttttttggcctgtggtgatgggtggctccccaagcctcatgcccacccatgttccctcctgccagtcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccaggtgaggtggggtgggcaggtgggggcctctgcagggcttttctttttttgtttgttttttgttgttttgtttttttttcgagatggagtcctgctctgtcacccaggctggagtgcagtggcgcaatctcagctcactgcaacctcctccctcctgggttcaagtgattctcctgccttagcctcctgagtagctgggattacaggtgtacgccaccatgcctggctaatttttgtatttttagtagagacggggtttcaccatgttggtcaggctggtctcgaactcctgacctcatgatccgtctgccttgtcctcccaaagtgctgggattacaggcgtgagccacctcgcctggtgtttttgtgttttttaaataaccttactcttagagcagttttagggtcacagcaaaatcgattggaaggtacagaaagttcccatacacctccttccccaaagccaagccaagccacccaacatcacctcccagaatggtgcattggttacaatcagtgcacctcaggccaggcactgtggctcacgcctgtagtctcagcactttgggaggctgaggcgggaggatcacttgagcccgggagttggagaccagcctgggcaacatggcaaaaccccatctctaagaaaaaatttttagattagccaagcggtggcatgcacctgtagtctcagctactcaggaggctaaggcgggaggattactggagcctaggagattgaggctgcagtgagctatgatcatgccactgcactgcaacctgggcgacagagcaagaccctgtctctaaaaataaatacataaaacgcaccttcgttgatttatcaccaccactagggtttgttgctggtgttgagggttctgtgatttgaatgaatgttggatgctgtgcgtctacctttattgttttaaacaaagaggcttctccccactgaaaggcccctgtgctctgcccgtccaatcccttggaaatcaccaacctctctatctccgtggatcagccttttccagattgccctgtagctggaatcgcatcgtgtgtggctcctttgacttggcagtatgcgttgacagttcctccgtgtctgtttgtggcttgatagctcttttttttttcacactgaataatattccatgtggtagcatttttatttttgttcaacggttcttgaattttgcattcaagcacagttattaagcacttactgtgctccaggcactctgatcggtctctcagacacaggtatatgcagaacaccgcccggtgtaaggcacagacaggagcctgtaaggggaatgaatggctgtgtgattccagccttatgggtgcctcggaggcacaagcgcatggagccctggggtgtgtgatgggggcactgtctggtcttaagaaactctcatgcccagagagccactggcccctggcacccacccctggccatagatcggctttgttaacgttcattgcatactttttgtccttaccacacagtgttcggaagtgagtttctcttttttcttttttttcctttttttttttttttttttttttgagacagtctcgcgctgttgcccgggctggagtgcagtggtgtgatctgggctcactgcaagctccgcctcccgggttcacaccattcttctggctcagcctcccgagtagctgggactacaggtgcccgccaccacgcccggctaattttttgtatttttagtagagacggggttttaccgtggtctcaatctcctgacctcgtgatccgcccgccttagccttccaaagtgctgtgattacaggcatgagccaccacgcctgtcctggcctttttttgagtcaggggtcttactctgttgcctagtctgtagtgcagtggcgtgatcaccactcactgcagccttgacctccccaggctcaggcgatcctcccaccttagcctcctcagtagctgagagggactacaggtgcatgccaccacacccagctaattttctgtagaaacagggtttcaccatgttgcccaggctggtccccaactcctgggcttaagcaatccccctgcctttgcctcccaaagtactgggattataggtatgagccaccgtgcctggctccctgagtttgatttctaatatctacacttaacgcagacctatctgtccctgtgaaccttgggctttccttcaaggccacgatctgatggagttacaggttttcagagacttgggacaaggagcaagacagtggataacccccggccccagcttgcatcctcttctctgatgttaaaggtggtcgttggctgggcacagtggctcacgcctataatcccatcactttgggaggccaaggcgggcagatcacctgaagtcaggagttcgagaccatcctggccaacatggtgaaaccctgtctctactaaaaatacaaaaattagctgggcatggtggcaggtgcctgtaatctcagctactcgggaggttgaggcaggagaatcgcttgaacccaggaggtggaggttgcagtgagccgagaccacaccattgtactcgagcctgggcaacacagcaagattctagtcccccaaaaaaaaaagaaaagaaaaggtggtcgttaggggcagggaggcgagagaaatggctcctgagatgatgctcagccatctccctgctgccagcacacagccatgggccttaatatgctgtgaatctccctcagctgtcacagcaggaggggccatcataacatcccaaagggtccagggctacgactgaaactgttcctggcactccctagagcctctgtccctgtacagtgtgtcatgtgcatagttcccctggctctgtggaggcggcttggcgccgtgggaagctcagtgcattggagctggggccacaggaggcccccacacagagctttgctggatgcattctttgttcaagccctgtgtgagcagtgcctttccctggtcacctgagcagccttagagggaaccggagctccccagcctgaaaatgatcggggcgggaaggtactatctggttgtgtcactatgcaagcagttttccagggcctttgctgatcagccctcccctgggaacccctgtgtccctcagatgttcctttggggtctcctcatgctccacacagtagtccaggccctggacggcctccttccccacccctctccactgatttgatgcagcagctgcctctcccagctggggtgcagtgccccgcccctggtcctcccaaacactgctcttgctccctgtcaacatgtggaacccatgtttccccacccggaaaatagcgccctgagccccatgtgcccagcaccacatcagagttactgtgcttcgggggcagtgagtgcctgtttatcatccctaaccacaaggaaagaagggtgcacccagtttaactagagtgggtcagagaggttgggtgggccttggagttagcaaaacacagcatctcacctgctaatggatggcagtggtggccacatgcgcgtgattggtggcctctgctgcgtggcacaggtgagggcctcctggggctcagcagtgcagcggacgcacgaaggtcacacgtgaaggaatggagacccaggcccagcttgatgcttaacccccacccctgaacctcctgcagtttgggacataaacgtccctggggagcagggtctggtcctgtgttttttttcagagcttgtgtggggaggggcacacaggtgggacccaaaggtggggctgtggaagcacatgagcccggatgggacatgtgccctggcatcctctgtttttttttgacagggtctcactctgttacctaggccggagtgcaatggtgcagtcacagctcaccgcagcctccactcctgggcgcaagtgatcctcctgcctcagcttcctaaggagctgggagtatagaggcacgtgccaccatgcccaactaattttcaaatattctgtagagacagggtctatgttgcccaggctggtctccaactcctgagctctagcgatcctctctccagcctcctggcatttaataaagctgctgactgatgcttctgcacccaaggggagggataagccattcatctgcaagtggtgtacatccatattttttactcggttacactttttttcccaatttgaaagttttcatcttttttattttattttattttattttgacggagtctcgctctgtcgcccaggctggagtgcagtggtgcgatctcagctcactgcaagctccacctcctgggttcacgccattctcctgcctcagcctcccaagtaggtgggactacaggcgcccaccaccacgcccagctaattttttgtatttttttagtagagacggggtttcactgtgttagccaggatggtcccgatctcctgaccttgtgatctgcccgcctcggcctcccaaagtgctaggattacaggcgtgagacaccacgcccggcatcttttcttgttgttaaattagaaacagggtcttgccctgttgccctttattattttaggttcaggggtacatgtgcaggttggcaaactcatgtcacgggggtttggtgtatagatgatttattgggtactaaggtattttttctgaatttctccctcccaccgtcacataggctccagtgtctgttgttcccctctttgtgtccacatgttcttataagtgagagcatgtgatatttggttttctgtgcctgcgttagtttgctgaggataatggttcccagcttcatccatgttcatgcaagaagaggtttttttgttttgttttgttttgttttgtagatattgggtcctgctgtgttgcccaggctggtctttgaacttgtgggctcaagcaatccacctgcctcggcctcccaaagtactgggattacagacctgagccagggagtctttaaatctttttacttagagctcaaaagagatattcttaaggcattctgacctagtggggtgaagtgccatgtatctgtgaagccctaggacacctcaactcttcgggcctccgttttatttaaaaattttaaaatacaaggaaggatgtgtttgcccttgccaacaaaacattatgtgatcaaaataaaactaaagaagcatagatggccgggtgtggtggctcatgcctgtaatcccagcactttgggaggccgaggtgggtggctcacaaggtcaggagattgagaccatcctggctaacatggtgaaacccgtctctactaaaaatacaaaaaattagccaggcgtggtggcggctgcctgtagtcccagctactcgggaggctgaggcaggagaatggcatgaacctgggaggcggagcttgcggtgagccgagatcgcgccactgcactccagcctgggcaacagagcgggattctgtctcaaaaaaaaagcatagatggctgggtgcagtggctcacgcttgtaatcacaaaactttaggagaccgaggcaggcggatcacttgagaggccaggagttcaagaccagcctggccgacatggtgaaaccccatctctaaaaatgcaaaaattagctgagcatggtggtgcacgcctgtaatcccagctactcaggaagccgaggcaggagaatcacttgaactcaggaggtggaggttgcagttgagccgagattgtgccactgcactccagcctgggcaacagagcaagtctgcgtctcagaaaaaaaaaaaaaagacaaaaaggcacaaatgttagtgacaccatcttcatcccatgtagtcgttaaacgttttcctgactcctgttttccgtagtctgcgctcctccgtgtctgtgtttagcacttgcagtgctgctggcgagatgacagctgtccccgtgaagcaagctgccggcagctcagcacagtgggactcggtgttatgtgttaaatcctgtcttcagcctagagggtgaagagtggtgattgctctgaaaaattttggatccaagaaaagcctaatgtgtcaacgcgtctcctgtgtggagggagggcccagtgacttgaggtggctctgaagaaattggcatgttcttttgtttaacgtccccagacacctccagatcagaatgtccctcctcagcagcgtctacaggggactcttagactcttctttgcttaactattctttcaaaaaggtagttgaaaatggccgtaggccaggctcagtggctcatgcctgtaatcccagcactttgggaggctgaggcaggaggatcacttgagaccaggagttgaagggtgcagttacctgtgattgcaccactgcaccacagcctgggtgacagagcaagatgtttctcctgtgtcctcacagggtcaacccatgctgcctggggagagggacagcctgggctcccagccactgaagagaggatccaggaggggagcccctacccaggaattgatgaggctacggtaggaacccagtctgcctggccaggcactgtgctcttacatgacagcccatgaaaccagtctatggcctgaccgttgtgttgctgtgcggtcacttttctaggtttttgtagaggaagaattcctggaattttttgaggactatcctccctactgaaataagtgtggctgtctgtcctgggatgggcttgtgttcatgcacagagagggtaagcactgacgtggaggctcatggtggcctctacgcatcctgtctttctcctttggtgaaagcaaatggaaacagctcaggaatcttactagggtcaggtgcggtggctcacaccttgtcatcccagcactttaggaggccgaggtggaaggatggcttgagcccaggttgagaccagcctgggcaacatagtgacacccccttgtctctacttaaaaaaaaaaaaattagctgggcgtgatggcgggtgcctgtagtcccatcttctcaggaggctgaggcaggagaatggtgtgaacccaggaagtggaatttgcagtgagtcgaggtctaaaaaaataataataataattcacaagtcacagtcatcacttcacatcagggacgtgttctgagaggtgtcctcaggcaatttcatggttgggtggggctaggttgctcttacacatcctagatggacagcctgccacacgcctgggccgtgtggtacatagcccagggctcctgagctgtggacctgtgcagcaggtgactgactgctccatcctgcaggcacttgtaacccagtggtatatgtgtctttaacatagaaaaggcacagcagaggccaggtgcggtggctcatgcctgtaatcccagcactttgggaggctgacgtgggcgaatcctgaggtcaggagttcgagaccagcctggccaacatggcgaaacccccgtctgtactaaaaatacaaaagattagctgggcgtagtggcgggcacctgttaaaaaaaaaaaaaaaggcacagcaaaaatatcgttgcggctggggcagtggctcacgcctgtaatcccagcactttgggaggccaaggcaggcggatcacttcaggtcaagagttcgagaccagcctggcaacatggtgaaaccccatctctactaaaaatacaaaaattagccgggtgtggtggcaggtggctgtaatcccagctactcaggaggccgaggcaggagaatcacttgaacctgggagtcagaagttgcagtgagccaagatcgcaccactgcactccagcctggatatatggcaagactctgtctcaagatttatatatattaaataaaaatacagttgtctgtaatcccaggactttgggaggctgaggtgggtagatcataaggtcaggagtttgagaccagcttgaccaacatggtgaaaccccgtctctactaaaaatacaaaaattagctgggcgtgatggcatacacctgtaatcccagctactcaggaggctgaagaacgagaatcgcttgaacccgggtggcggaggttgcagtgagctgagattgtgccactgcactccagcctcagtgacagagtgaaactcccgtctcaaaaataaaaaataaaggccaggcatggtggctcacacctgtaatcccagcactttgggaggctgaggcgggcggatcacgaggtcaggagatcaagaccatccggataacacgatgaaaccccgtctctactaaaaatacaaactgggcgtggtgtcaggcgcctgtagtcccagctactcaggaggctgaggcaggagaatggcgtgaatccgggaggcggagcttgcagtgagtcgagatcgcgccactgcactccagcctgggcaacagagcgagactccgtctcaaaaaaaaataaaaataaataaatacagttgtaatctgatggggccactatcaggtatgcggcctgtcactgactggaaattattctgcagttggcaatgatggctgtttttggagatctgaatccagttcatttgagggaacccccaaggttctctggttgtggcctcttgaataaacctctcacatttggacagtttgttaccaaattgggttctggatgttggtttccttccgtgttgggggtgggaggaaggtgtcacacctgtggagttccccccgctaccgcactggcaccagggtggctgctgcctgcagtgctgatggccgtgtaccctgtctgtccagattggtgctgaagacatggacggcttccaggcagacacggaggaggaggaagaggaggagggcgactgtatgatcgtggatgtcccggatgctgcgggtgagaagggctgtagatagcagaacgcactggtgaggtgggcgctggaggtaaacctcaacagagaagggatggggctgcctaagactagctccactgtgagcagccaggagggcttgcagctggaagtggctcctgccctgccacatcctcgggcgggctgggccgtgggtgctgaccatgccaggcatcgttctggccgcagagccacaagggcctatgctgggagtctcaggtggttgtgacgttagatgggggtcagggaaggctgcactgaggcagcaagggagggccaggtggatttctggagcactcgccaaagaggaagtacagaggccctgcagcaggctgcgtgggaggagtgtgcccgggtggtggggggcaggcagggtcaacctgagagcaggtgagcaggtcacctctagaagaggcacaacgccccagcctctgcctgtccccactgtcaggtggagggtcccgccctggggttgttgcaggccccatgaggcagcagggtggggtcttcccccagggagcccagagggcccagccagctcaagaccctccctctcttgccctgcagaggtccaagccccgtgtggagccgcttccggagctgggggtggtgtgggggtggacaccggcaaggccaccctgacctcgagcccactgggtgcatcctgagagcaggggtgacgtatgtagaatgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcctattggggaagcctgcgggcacaggagcaggcgtggaatccaatacttgtaaatgaattgaagcgtcaggaccacccgcctggccacgtgcgcgggcccctggacctaacgaggcagtgtataaacttattctctagccctgagctgctctgtctgtcttttccgaaaacattgtgtttctctgagagtgcaccttgcccatggcccggccccatgtggtgcctggtgtctggggccagccttgtgccctgcaacagcaccgtcccatctgtttgtcactaagtcaccctcataccaggctgacctgggtcaaggtgcgggtttttccgcacgtgcttctgtccggcgatccctcctgccctgggttggggggttaggagagggtgttcccagagacctgctagggtcacctccctgaacccggagctgctgggagccgagtttggcttcgagtctgaggctttgtgagagcccaccccaggtcaggtgcatcttttgcgagtgctggagctagaaggtgacctcctccccgccccaggttgagtgggctttatccacactgtccgagggaggacaggcgacagccgctgtggtactgagcagctcagagcacacgcagccacggggagggtcacgctcgccagtcctgctcttcccagccacaccccacctgaagtcctaagcttcccttcagggaaccctatgtgggaaaagtgtcagctacctccatccacccagtcagggacggcagggcgcccgggccaggccttcctgctgggaagcaggattcagctgtgcctgaagcagaggctgcccctgtgccacacctttgatgagctttacaggggctcccgacaacccggaatcaggtcctggggcctgcaggacgcaggactggagtgacagcctccattctcaacaggccgggtgcccacaccagctggggcagtgccgggggcgagggagggaccaatgcaaggtcaggggcacgagcataggccccgggcacctcccccaggtgcagacctgcatccccaagtcagcagtggggccggggcacacatgccttccacactgcagggcagagtccctgtgtctcctggggctgctgtaccacaaacctggtggcttaaagcaagtcaccatctcacagcttgggggtcagagtgcacacatgccccgccaggctaacatcaagctgtgggcaggaccaggccctcctggagagtttcccagtgctcggaggcgctgcatccctcagctcggggtcccttcctccaccttcacagccatgcgcagcctcttccagtctctctctgattcaccctcctgccacctcttgtgaggacactgggtcccggaccacccaggatcatctcccagctcaagacctttcatcatacccaagcccctcttgccaggtgaagttgcgcatctgcaggttccaggaataggatgtggccgtctcaggacaccctgtccctctggccacagggaagccaggcctgtgacagcactcgcctcccctgcagggactgggcctttgtgggcacagcacagcctcccctagcgcacgggacttcctccccaggtgggtggctcatcgggcacttgtggccaggtgctggcctgagaacaggtatccacatggtcccaccttgacagggagccacacccagcccccaagccatccgctcttcagcaggtgggcctgccctgtgtcccacggtttcaacggagaaccaagaaactatattcaaacaa

SEQ ID NO: 667 - DNA, 13155 bp, Homo sapiens
cctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcctggctcccccagcaagacccgggggcagatccaggtgcgggggccagccctgcgcgtggctggggatgaggtggtcgtggtgatagcctgtgtccaggcatccgcgcagggcgggccctcaaatgacctcaccttctctcctaggtgattctcgggccgatgttctcaggaaaaaggtaatggcttcgcggggctggggtggagctccttcctcttctccggggaccccttgtcccgtccctcccctccccttccctcccctcccctcccctccccttcccttccctccccttcccttcccctagaaggaccagcacagcctcctacagctcccgcctggggtgctcctcccttgaattcagtccaggaggaagtctctgccctcttctgcccaggccaagcccctcgtcctgtgtggacgccactccctcctggagctggtgacagctgcttacagcttagctgtcttccccaccaagtcctctgagaaggtggcaaccagttgtgtcccctgtaggccaggcctttttgtacacccctattcaatgtggctgtttccttctaaggccaaggaaacgtagtcgctttctaaaccaaggagtctgaagccgtggagcctctgctctcctgaggtgatagaaccattccctgacccgggtggggctagtgagtttcttgagtaaactacccacgcaccattctttttgttttgtttttgttcttctagaggtaggatcttgctatgttgcccaggctggtctcaaactcctgggctcaagcaattctctcacctcagcctcccaagtagctgggactacaggcgtgcacccccccgcctccacccagctaattttattttatttttatagagctggggtcttgctatgttgcccaagctggtcttgaactcctggtctcaagcaatcctcctacttcagcatcccaaagtgctgggattacagatgttagccaccatgccctgccccaacattcttttatggccctggggatcacttcagctcaaaccccttgctcaggaagatgtggctcagagttggacttcttggacccagaagcaagtgcttttgacgctgcacacaaagactttctgaaattaatttagaaaagctgtatgccaggtgtggtggcccacgcctttaatcccagcgctttggaaggctgaggtgcgttgatcacttgaggttaggagtttgagaccaccctggtcaacgtggtaaaaccccatctctactgaaaaaaaaaaccaaaaattatctgggcatggtggcagcctcctgtaatcccagctactcgggaggttgaggcaggagaatctcttgaacccggaaggcaggggttgcagtgagctgagatcgctccactgcactctaacctaggcaacagagcgagactccaccccaaaaagaaagaaagaaaaactctgaactctgggaacaactctgggatgaggttactttggaatgcagtcgcaggttccctctacatgtagcctttgcttctgccttccccactacatcttggagaaggttactcctcccacacttcctgggaccacctgagtaccattcctggacctcttccccatagagaattctgacttccaaccctctttgtagggatattataccctgcctgctctgccctgctcttttctggctgtggtgggctcagtctgcataccactagggacaatgaggagccaggcttgttggggaggggtctccttctcccactcctcccgccgtggacctcacctgaccctctctcctcttgcagcacagagttgatgagacgcgtccgtcgcttccagattgctcagtacaagtgcctggtgatcaagtatgccaaagacactcgctacagcagcagcttctgcacacatgaccggtcagtccctgccccctgcagtcctgtccagtggaaaatcacaaggcacaggacacactgttaggactctctttaatggggatggttaatcatttgaacattgaatgattcaaatcagcacactttccaaggtgcttggcaaggtagcgcacactctccactccctgggctggagccagtggttctccactgagggtgattttgccgccagggtccatttgacaatgtttgaagacatttctagttgttgcaactggaggggggaggggatgcttttgggctttaatgtgtagaaatcagggacactgctgctaagggtcctatggtgcagaggacggcccccatgcaagaacgagctggccccaaatgtcaggagcctgccagtgttcagaaactctgccgtagggtttcagcttcacacaggctgcagactggtttggtttggcctgcacgttgatttttgtttaattttttagttgtccgttgttggctggctcccccgtcacctggcagccttcacgcttccctgttttatgtgtagctgtttgagctcgctggacatttccgcctgcaacctcagtttgggagttaaattcacttccttggcagcagatgtgggcctgatgtttctgagcctgagacgctttgcttggtcctctggacttgtccacctgggcacccagtggcaaagccatgctgtgccacacattatagggcttcagcctcagagccctggctgggagctgtatccgagagttgctatggctgtgcagagaacagatccacccggcgtgtggccttcggtgggagctgaggggctcctgaagccagatgctggtggagtggagggtgcttggggcttggagttgcatgtgggaatttaaccgcacttcgtgaccatgctgtctgatgtaggtcatttacttttccaaatttgcttcctcattcctaagatgcgatgtccacggcacagggtggtgttacacctggtggggacagggaaagcagaggaggtcacttcgttccagctgttggaagtacaacttctggagtcagtcagatccgggattaaatatgagttctgcccgtgtgtcacaagtcatctctaacacgggccacagaggccaaggctgggccagcagcattgatggctcgagaggctgcccttgcaggggccacagctggcctcccacctgccctcactttgtctttctctgtttagggagggaagagggaatttaaaatgcccaaaatactgtttcacacattctttccagaactcgaagtaggattatagcaaggtaataacgaaacaatagttgtaaagtatgtttttttgtttgtttgttgtttgtttttgggacagggtctctctctgtcacccaggctggagtgcagtggctcaatcatagcttactgttacgtgaccccaaacccttgggctcaagtgatcgtcccacctcagccccctgagcaggtgggactacaggcgcacaccaccacacccagttaatttttacatttttttcacacagtgtctcgctgtgttacccaggctggtctcgaactcctgagttcaagtgatcctcccgtcttggcctccccaaagattacgggcatgagctgctgtgtctggccagaatacaggattttaaaaatttatgttttgcaacataattaatataaagacaaatataacccaggcccagttctagttattcattcttctgaattttaaaaggaaacatttggctggcccctaatggtatcatgggccctggtacctgatgaagttggcctagtctgcccccagctcctgaacagtggaagagtttttagtctcattgagctttgtactggacattactaatttctaatccaaagcatcaagtgaagtggcttgtataaataactggttttcctctgggaggctaaggcgggtggatcacttaaaagttaggagtctgagaccagcctggccaacatggtgaaaccccatgtctgctaaaaatacaaaaattagctgggtgtgatggtgtgtgccagtagtcccagctactcttgtggctgaggtgggagaatcgcttgagacccttgagaattgggaggtagagattgcagggagccgagatggcgccactgcactccagcctgggtgacagagcaagactctgtttcataaaaaataaataaataactggttttctggacgagggcctttcccataggtgctaacttctcaaagcccggctgggtgaacactgagcctgctttgcaggtagcaggtggtcacgacagtgccattccctggcccctgcattgtggcttctggcctccctggccctgctcacgctctggctttctcttcccaggaacaccatggaggcactgcccgcctgcctgctccgagacgtggcccaggaggccctgggcgtggctgtcataggcatcgacgaggggcagtttgtaagttggcttgtcttggcatcactcttcctgccagcttccgctctgtcctcccgttttccctcgctgacttggaagttatctgatcttttagtaaaataacaaggttaaatagctacaactagtgttggaataccctctgaaggcccctttctagtttccctgtcatagtgtcatagtcttgtaggattcgttttacttttttttttttttttttgagacggagttttgctcttgttgcccaggccggagtacgatggcacaatctcaccgcaaactttgcttcctgggttcaagcaattctctcctgtctcagcctcccgagtagctgggattacaggcatgcgccaccacgcccagctaattttatatttttagtagagatggggtttctccatgttggtcaagctggtctcaaactcccaacctcaggtgatccgccccgccttgaactcccaaagcgctgggattacaggcatgagctaccacacctggccattgtacctttttaaaaatacatatatctatttactggcaagatgcagtgactcacacctgtaatctcagcctgtgggaggccaaggtggacagatcacttgagcccaggagttggagactcacctgggcaacatagtaaaaccccatctctaccaaaaaaaaaaagaaattagccagtcatagcagcgcacacctgtggtccctgctactcaggaggctgaggcagaaggatggagcctgggaggtcgaggctgcagtgagtggtgatagcaccactgcactccagcccgggcgacaaggccagaccctgtctcaaaaaaaaaagggggaggtggggagtaatgtttggtttgcctcatggttccttttgcttgtttcttatacgtttattttcttgttgttgaagtaccttttttagtagtttttgcagccaggaggtatagatgggaagctgccagtctttgtatggaaatctttcttttgtcatctagtttaagctgggcagcaagaggtaggttgatcttgtgtgggtttgggttttttttttttttttgagacggagtcttactctgtcgcccaggctggagtgcaatggcgtgatctcggctcactgcaacctctgccacccggattcaagcgattttcccacctcgcctcccaagtaggtgggattacaggcacccaccatcatgcctggctaatttttgtagagacaagggttcaccatgttggctaggctggtcttgaactcctgacctcaggtgatccacccgccttggcttcccaaagtgttggaattacaggcatgagccgccgtgcccggcctttttaatttttattttttttgagatggagtcttgctctgttgccctggctggagtggagtgacgtgatcttagctcacagcaacctccgccttttgggttcaagcagttctgcctcatccttccgggtagctgggatcacaggtgcgtgccaccatgcgtagctcatttatgtatttttaatagagatggggtttcaccatgttggccagctggtctggaactcctgacctcaggtgatccgcatgcctcagctcccaaagtgctgggattacaggcgtgagccaccacgcctggtcttgatcttgttgctttgaaaagtagcagcgctggtcattgtgtttttgctcagaggaaggccgccatctctctaatgttacctctggtcaggtattctatctgttctctctcagcacaatgtgtgtaggggaagctttgtttcatttatcctgctttatagctggtgtgccttttcatttctggggaaggaatgaagccattatcacttcaggtatttctctcctcatccatctctgaggtgttctgggttccatcttccagagtgtgttttgtttcagtgactatttttacatctgctgctctaattcatcatgctccgttttgtttgacaagttactgttgggttatttttaaatttatgctgttccttccattatgttcctgaaaatcttttcttagacttttccagatttttctatttcctcaggaacatattctgtggttgagtttctgggttattttctgttatcttagttttctttcctctgctttggagattttatttttgttagtttatcacaaagaatgaaactgaaactctctccaaggggtttagcagacttgacctcttaggtacttttagggttgcctcgaagtacacaatgtggtggtttgatataaacataacaggaatttatttctcgctcacagaccccctacgtggttccaggccggttgatggggaggccgcccacgaggcggcttaggtcgccctggctggctgtatacagacacggaggggaagagacgtggcggagcccctgggtgtgaggttttcatgggcctgaccagaagctgcaaacgtcacttctgctgatctttcaaagactagaacctgggcacagggccacctatacgtttagtatacttagtccagttcgttttttgtttgtttttaaaaacagtcttgctctgtggcccaggctggagtgcagtggcgcagtctcggctcactataacctccatctcccaggttcaagtgattctcccgcctcagcctcctgagtagctgggattacaggcttctgccaccatgcccagctaaccttttgtatttttagtagagacggggtttcatcatgttgaccgggctggtctggaactcctaacctcaggtgatctgcctgcctcagcctcccaaagtgctgggattacaggcgtgagccaccacgcctggccacacttagtctagttctataccctggaggaagaataaatgagttggtttggtgagtgcttcgaggtctctacccgccctgcctcccagcacagagccaggccgctctggcctgaataccctgcccggacgtcacagggcctgtcccctcaaaaggccagtcctgccttcctggttctgttcttgcccaacattctgtatgagtcacagctgcaaattccattcccgtggggaggctgacgggtcccttcccctgtgcggggcatctgccctgtggagttgaggctgccagtgtccgctctgggttcccgaccacccggcagctggcatctcctccccgcttgggtatggccattccgtttctgaccttcagaggtgcgcccctgagcacccccatgcctctgcgtacgtggagacgtcgttgttgctgccccgtgcttgagggactcctggcgagaaagtgagcccaggctgggaatagggctgcagctgttctcttttgctcccaaactgtggcctcagaatgcatccagggattttgcatcagctttggggacatggccctctcagaacaaggaagcttcagctttggcaaggctctccctccttcagacctgccgctgtgagttgttcaatagctctgttctcctggctctgcgtaaaccttgttgacagaggctgacccagacccccgaggcagaaacctttcccttctccttcctcgacatccaaatgccctgagtcaggagccagcgtatgaagtcctgtcccctgttcagcctataggagggatttctcggtctacttcctccctggccagcaagtaaaacttgagttcattcagtgagtatttattacaccctacccagacatcagcattctgccctggcctctgtgtgcccttgttctcttcaagaagttccgggtcaccagcctgaccaacatggagaaactccgtctctactaaaaatacaaaaattagccaggcgtggtggcgcatgcctgtaatcccagctacttgggaggctgaggcaggagaatcgcttgaacccggtaggcgaaggttgcagtgagccaagatcgccccattgcactccaagcctgggcaacaacaagagcaaaactcagtctcaaaacaaaacaaaacaaaagaagttcagggtcttcccattgcaagcagttctagatcgaggagaggggttcctagcatgggacccagcagaaggactgtccttcgctccttcattgtctacgtggacagtggatgaagcccagccgaacctgccttgttcccgttttctgggtcagcagggaaagcctttcacagagtagccaccgtgccatcctgaggaaggccctgggtcagaagcttctgtgcttctttgtaccccgggcgagacacacaggtgctcacactgctctgtagaaactgttggcatccaagagagactcacctggaaatctctggaaaacctgaagctcctagctgggggtgctgtgcttcagatgctggtggtgggtgggcacccttgcatcaacagctgcacagtgtgtggtgggcttgcagggtcgcttggcaatagtaggagctctgatttatttttttaaactttttttctggctgggcacggtggctcacacctgtaatcccagcactttggaaggcctaggcgggcggatcacttgaggtcaggagtttgagaccagccaggccaacatggtgaaaccccatctctactaaaaatacaaaaattagccaagcgtggtggcacacacctgtaattccagctacttgggaggcagaggcacaagaattgcttgaacctgggaggcagaggttgcagtgagccaagattatgccactgcactccagcctggatgacagagcgagactctgtctcaaaaaaaatagacaaagccaggcgcagtggctcatgcctgtaatcccaacactttgggaggccgaggtgggtgaatcacgaggtcaggagatcgagaccatcctggctaacacggtgaaaccccgtctctactgaaaatacaaaaaaattagccaggcgtggtggcgggcacctgtagtctcagctactcgggaggctgaggcaggagagtggcgtgaacccaggaggcggagcttgcagtgagctgagatcacgccactgcactccagcctgggcgacagagcgagactccgtctcaaaaaaaaaaaaaaaatagacctttttgtgttttctgttctactacacaagtaatacaggttgagtattccttaacctaaatgcctgggaccagaagtgtttcggatttcaggttttcgaatatttgcatgttcataatataatgagaccttgggaatgagccccaagtgtaaacacaaaatccatttatgttttatagacatcttaggcacatagcctgagagtaattttatgtatttagtaatttggacgtgagccacagtttttgactgtgacctgtcccatgaggtcaggtgtggaattttccacttgtggtgggcgctcaaaaagtttcagattttggagcctttcaggttagagacatgcaatctataataagtttaatctaggaaaagttagggtctggcacagaggctcacgtctgtgatcccagcactttgggaggctgaggcaggcagatcactggaagtgctggacgggtggggaagtgccgggtgcaagaaccaagctctttgactatggacctcagcctgaggttggtcaagaggtggagtgagtgggggctgaggaccttcatcctgaaaccctgatgcaggagagtctggggtctgccttctaccctcatgtggcgggtgaaggagcaaggttctcaactcaggagggttcttcccctctccattcccacccaggggacatctcacaacaactagaaacaattttgtcgcagctggggggtgggaggtgtgttcctggcatctatctaatgggtgggggcgagggacgcagcccaacaccctacactgcacaggacacagcgagatccggcctcaaatggcagccatggcagcgtcagccctccagggggcgcgcccctggcgcaggtggtgtgccggcccacagctccttgcaggctgggagctgcattttcgtgacatgtcatgagtcctcagagaaaaagagggaacgagtgcatggtggggaggggccctggcgtgctggagtctctgggtttccttctccagagacccctgcagtcagctgagcgcaatcagtcacgttgggctttgcttggatctcactggaatttttcgagccaccccttagtcctcaccttgctaagccctcacgtctcaataacctcaaacctcagtacctgggctgagaaagcctgagtggccctgggagagagaccctgcacccaaggacaaggacatccctgcttcacccaacccaaaggccagtctggacatatgaactcaaccagctaagagtgatatgattgattgatgagaatcaccagagcacttgccagagtttcagcttctccctgggccaaagtgaagtttgctttacacagtaaatgtgctctgtgcaggtcctgaatttagaaggctgtgctgtgtcatcctgctctgtaaatggccagtaggacccccgccccttctcaaggcacattacccgtttaaaacgggggaggcaagagcacaaagcgcccacctattcaccgaagagcatgtatataacttagggccttccatccttaaacaacaggaccttccttgctcttaaggaaaaggaaacaggttcagagacgttaattcattgccaaggtcacacagataatgggtccagcgaagagtggtgtccgagcccaaggcagcaggcctttggccactgcagtgttaaacagcacagctggtgtggaagtccggtgctgagtcctgggtacctggactcggagggaagctggctgcagggggaaggggctgcgcagttgtggatgtacctgtcgtctgctggggggcgtgcgggtggacacagtcccccggcctggggagcctcgtgggagaattaagagttactccgggccaaatggccggagttgtcagatctggcagcgtcttcgctggggctccagggagctgctgctggggtggaagctctcacactctttctccacgtgccctttccagttccctgacatcgtggagttctgcgaggccatggccaacgccgggaagaccgtaattgtggctgcactggatgggaccttccagaggaaggtaaggcgtctgatccaggtctggagctgggattgaggagggcaagaggcttctggatgggcacagagacaccagctctgggtgaccagggctcagccaccacagggttacggccgagctgctcaggccttggctgagccaagggactccatggtctgtgcagactgcgtgccatctgttgcggcaggtgctttgaattggcaaagggacagagccgggcatggtgctctgggggttgggggaaggactaaggtcagagcaaactctcctggcttcagtgcttgtgaatcagagggtttaaaagaaaaacccacctggtaaggtggctgagcgccctctgtctttccatgggagcgcagccatttggggccatcctgaacctggtgccgctggccgagagcgtggtgaagctgacggcggtgtgcatggagtgcttccgggaagccgcctataccaagaggctcggcacagagaaggaggtagctccacctgccttccctgcaggccggcggggtgggggtatggctctgcctccttcctgtcctggcccttcacccatcccctgtccctgcggccaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactggttggtgga

SEQ ID NO: 668 - DNA, 11250 bp, Homo sapiens
aggacacggctccagtggcggcgcggcccagggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccgggtgggtgcgcgcggcggggggtgcgccgcggccttcggtgcctctgccttcccaggggctctttgctccgcttcgttgtctgcggctggcgtgctgtgaactgtgcggtttttattttgaaagacgggctttccctgtgtcgcccaggctggagtgcagtggcgccatctcggcccacggcagcctggacctcccgggctcaagcgatcctcccgcctcagcctcccgggtagccgggaacataggcgcgcgccaccgcgcccggtccacgctgcgtgtctttaagtgcggggtatggtgatgactgacgtgtaaacccgcgcgaaaccgtggtgtctcccccaaaagtctcctccagctcttttgtaatccatgtctcgtttttgtgggtttttctggtgttgtgttttgtttgatggctgttcgcgctttcaggggttttatagcatatatttaaaagttttcaagtgaagcattgaccttaatctttggccacccagtccacaaattttataaatgctttctttgaagtctctactttctacccgagttcttttttcctaaagcatttttcatcccagcttgtttgcagattgctgttattgctcagagaaattcctttggcttccgcagaagatccaagcctgtctagagatttagtaaagtaaaattcaacgtgagacttgagtccgggagaaattcagtccaaactatattgtaatatagagggaaagcctgatctcacttgcattttgtgtgtttctctttttttctagaaagatcaactgaaatcggcaaacttctgagttcctacttgcaaaagaaaagtgacgtggaggatcactcggtgcacctgcttttttctgcaaatcgctgggaacaagtgtaaaaaccattgcacactgctccctctgcccttgccactttccttcctcctgagattcagtgaacgcagcactcgattctgaatgacagtgacagtagtgctgggcctgatgttcttctgtttagcagtcctgtgggcagaggtggtgaagcgccctagttcccaaagggcgctaatgaatgctgtttcgtcctcctgctccccacaccccataactaatagacttcagtttttcgggtttttttagacggagttccgctctgtcgccaggcagaggtgtgatctcggctcactgcaacctccgcctcccaggttcaagcgattctcctgcgtcagcctcccgagtagctgggactacaggcgcgccccagcatgctcagctaatttttgcaattttaatttactttatttttaaatttaatttttgtatttttagtagagacagggtttcaccatgttggccaggatggtctctcttgaccttgtgatccactcgcctcggcctcccaaagttctgggattacgcaggtgtgagccaccgtacctggcccttttttttttatttttaagacaaggtattgctctgtggcccaggctggagtgcagtggcacccgatcatggctcactgcagcctcaacttcctaggctcaagcagtcctcccacctcagcatcctgagtagcttagggccataggggcatgctaccaagcccggctaatttttttttttttttttaatgtagagtcaaggtctcaccatatcacgcccaggctggtctcaaacccctggcctcatagacttaatgttttaaagatagctttaggtatatagaaaaactgatcaaaaagtagagtatgtagagcgctccctacatactacccctgccttccccccttccccattatttatgtgctgtgttatgttacatttgttaaaattgataaccaatattgatacattagtaactgagtttatatgaactctcctaccacctttttttgttttacatcattgtagtaggtttcctcttcattcaacacttaatgttgatgtgtgttctttcaatgtttttatttacatttatatacatatgtagaaactactatagttagaattttgttttttaacataaatgaggtcataccatacaaattatttggcagctttctttctaactctgccttacagatttctgcacttacagatcccctaactctgcccttctcattctctttaattgtcgtcgcattgtctctagaaccacggtacgtgtagccagttccctgctggtgaatcttcagtggttcctcatcatccgtgttacatgaaacactgcattactctcctccggcttagctttgtgtcttgcttggaaaggctgtccccactccaagtcttaaatgaaaatgagaccatttttaataatctttttaacacatctagaatttatggaggcaattgttcttctgattttgctttttgtggctttgtagaaaagtgatgaaacacgtatatgcccaatttaaaatgaagaataatcctgattttactttttagataataatcttatcccaggtacccagggctacgtctcttgtgtccatctattctcctacaggttacttgtttccctaatagatatttaagtttcctctatgtctaactgtggcttgatagtttttttttgttgttttgttttggttttttttgagacaagagtctcgttgtgttgctcaggttggagtgcagtggctcagtctcggctcactgcaaccgccgcctcccgggttcaagcatttctcctgcctcagcctcctgagtagctgggattacaggcgcgtacgaccatgcacagctaatttttatgttttagtagagacagggtttcaccatgttggccagggtggtcttgaactcctgacctcaagtgatcctcccacgtcggcctcccacagtgctgggattacaggcatgagccaccatgcccgaccaatagttcatgtcttttttgccctaattaatagtcccttgtttggatgtaccatagttcattacctactaaaggacatctttgttgcttccaagttttggcagttataaatctgttataaacatcctggtgcaggattttgtgtggtcataagctttcacttcttttgggtaaatgccagggagcaccactgctttaatatgtggtaagactattaatttttgtgaagaactgctaaaccatgggtatccagtcttttggcttccctgggccacattggaagaaatgtcttgggccacgcataaaatacactaacaattgctgatgagcttaaaaaaaaaaatctcgtaacgttttgagaaagcttaacaaatttgtgttgggctgcatgcagcctgcgggccttgggttggacaagcttgtggtgaactgtcttccaaagtggctgcagcatcttgcattctcaccagcagtgaacaagggttgctattgctccagaccctcaccagcatttggtgttgtcagtgtttggatgtttgccattctgataggtgtgtgtggcatctcattgttctagtttgcatttccctgctgacatatgatgtggagtatcttttcatatgcttgtttgccatctgtgtatctggtttcgtaagggatctgttgagtgctttggcccactcttttttttgggacagggtctcaaccaggctagagtacagtggcacggtcttggctcactgcagcctctacttcccaggctcaagcgatcctcctgccttagcctcccaagtagctgggactacaggtgcatgccaccatgctaagttttgtatttcttttttgttttcctcgagacagtttcattcttgtcgcccagactggagtgcaatggggcgatcttggctcactgcaacctacgcctcgcaggttcaagcgattctcctgcctcagcctctcaagtagctgtgatcacaggtgcccaccaccacgcccggctaatttttctattttttagttagtgatggggtttcgtcatgttggccaggctggtcttgaactcctgacctcaggtgatccacctgctttagcctcccaaagtgctgggattacaggcacgagccaccatgcccggccaattttgtattttttgaggaaatgtggtttcaccatgtttcccaggttggactcaaattcctgggctcaagtgatgagcctgcctccgcctcccaaagtgttgggaatataggcatgagccattacgcccagccttggcccactttttaagggggttggttgatttcttatttttgagttttaagaattctttgtatgctttagataacagtcctttataaaatgtgtcttttatacatattttctcctaggctgtggtttgccttttctgttttctcactctctttctctcttttctttttttagacagggtctctgtgtcatgcaggctgagtgcagtgcgcaatcacagcttactgcagcctcgacctcccgggttcaagtgatcttcccacctcagcctcccaagtagctgcaactataggcacgttaacacacctggctaatttttgtaaaattttttgtagcgatggagtctcactattgttgcccaggctggtcttgaactcctggacccaagcagtcctcctgccttggtttcccaaagtgctgtgattagaggcatgagccaccctgcctggccttatttttttttaggagaaatgtcttgctctgttgcccaggctggaatgttgtggcatgatcacagcttactgcagccttaaactcctgggttcaagtgatcctcctgcctcagcctctggagtagctaggactacaggtgcgtgccactatccctggctaatttttacattttttgtagagatggggtctcactattgttactcaggctggtctcaaacacctggcctcaagggatccatcccgccaaatggcttccaaaagtgctgggctcacaggcatgagccaccacgtccggctgtcctttccttctcttgacagtgtctctcacaaagcacaaagttattattttcgtgaagtccatcttaatcaattctctcatgggctgtgcctttggttttgtatctaaacagtctgccaaaccccaggtgatctaagttttctcctgtgttactgtctaggagttgcatagttttgcattttacatttgggtctgtgattcattttgtcttttttttcccccactttttgtggagaacggggtctcactatattgcccaggcaggtctcgagctcctgggctcaagcaatcctcctgcctctgcctccttgaaagctgggattacaggcgtgagccaccgtgccaggcctgtgattcattttgaatttatgttcgtggagggtatacggtctggtctagatttattctctttcatgaggatgtccagttgttccagcagcgtttattgaggaaaatgcctttgcaccattgcatccctctgctgctttgtcagaggccagttgactccttatgtgggtgcccctgtgatttgaaggccccagtgagactggctgagtcgaatgaatcggacttttctttctctgtcttgagcagtgcttctcactagtgtcaggccccgtgtctttgtacatctgtgatcttggcagctgtagggatgatggtggacttgtggtatttggctgagaacatccttgcagtccaggctaggggtcatgagcatggatgagtcacctgctggctgtgcccacgcttcccccgccaccatcctctgctctcttctttgcctgtgctttcttcttcctcgacagggtagagctggcctctctgaccaagacagctgacagtgcatctcctttcccctgccgtgtttctggaacattgaactttaccagttgtgtttgttactatttagtaaggttatcttctccatgttgggttttgctggaggtgtgggtatggcatcttctagagaagatccagacctttttggattaaaagtaaggttacaaatcactgtgctgtacttgttgtcatatgagatttctgagttgtattgttgggataattttctttttctttttttgagatggagtctcgctgtgtcacccaggctggaatgcagtggtgtgatctcggctcactgcaacctccacctcctgggttcaagcaattctcctgcctcagcctcccgagtagctgggattacaggtgcctgccaccatgtccagctaatattttgtattagtagagacagggtttcaccatgttagccaggatggtctcgatctcctgaccttgtgatccgcccgcctcagcctcccaaagcgctgggattataggggtgagccactgcgcacagcctgttgggataatttaagcttgacagttcaaggcctatgaaacaggaccagggctcaggagcatcctctttttcaggccgttaattaaggaaaagttgagccagggcgtgaccctcgtcgtggacagatacgcattttctggtgtggccttcaccggtgccaaggaggtgagtgccacttggcctcctgtcaggcgagcacagatgtgtggacccaggactgcccttgaatgcgagtacgagtgacatgcctcagattactctgcagagtttcgtgattcttatattccttttatctctttgctagattaatttggttttatcaataagaagagcaaacatttatgtagctagagattgtttcacagatagaaccatagttggtatttggattatattttccacacgcttttttttttttttttggggagacagtctctcattctgtcacccaggctggagtgcagtggcacgatctcagctcattgcaacctctgcctcctgagttcaagcgattatcctgcctcagtctcccgagtatctgggattataggcatgcaccaccgtgcccagctaattttcatacttttagtagagacggggttttaccatgttggccaggctggtctcaaactcctgacctcaagtgatccactcatctcagcctcccaaagtgctaggattacaggcatgagccactgcacccagcctccagatgcattttcaaagatggttcatttgtagtacttttttcccccgttttttgaaagagggcgtctccctctgttgcccaggctggagtacagtggaacaagcaaagctcgctataacaactcttgggcccaagtgatcctcccgcttcagcctcccaaagtgctgggattacaggcgcgagccaccgtgcccggccacgccctcactttttaattctgccatttcttcatgtgttagcttgagtccttcccctctgaagtattacgttgtataataaggaggacaagactcatgattcctttgcttcttcctgctgtgcggatcagctgacagagccgcaggctctgtgggaggttctcgtggacgccttccctcagctcattgtgctgttgtgtgatgtgtggcctgcagtcacagcctttctggtcctacctttcctccggaaacaggacagcatttggagggagatgggatgagtaagggagggagagagggtgctggcacagccctggcaagaagggccagtggatgagactaggctggcacataacaggctctaggagtgcctgtcttcttcctgctcttccacgggagaggagaccctggcgtgtgtgtggcagaaaagacactgccaaggacctcgtgcctgtgtccggacccagctgctctgtgctgcaggcgttctaggccgggggtctccaggggttctgtacatagactgtttgctcctggccagcaggcctgtagctgtgctgggagggcctccatggggcctgggctgtgggtggcggggactggcagccgttctatctacctacttttctgtccacttgtctgtttacaaaggaaaaacaaaggtgacactggagaaaccgacacgtttgaggttctaaaaattaaacgagccacaatataaacagtctcacatcttggtacctcaccaaatgtcccctcattttttcctgtttttacgactttcgaaacaaaaacctagactacactaagctttaactgttgggttctttcttggcagaatttttccctagattggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaaggtgagaatcccagaattgcacactaggaagcgtggagaagtggctcaggatgacaccgtggtggctggcacagttgtgtcagcaaagctgctgccgtttccgtctggtcctcccagatgtggagccccgggagtagtcgttcaggggttctcggtgccagcaaattcttttttttttgagacagaatcttgctctgggtgccaacccaggctggagtgcaatggcacgatctcagctcactgcaacctccgcttcttgggttcaagtgattctcctgcctcagcctcccgagtagctgggattacaggcacgtgccatcatgcctggctaattttttttgtagagatggggtttctccacgttggtcaggctggtctccaactcctgacctcaggtgatctgcccacctcggcctcccaaagtgctgggattataggcatgagccatcgcgcccggccagtgccagcaaattctaacccgatgagttttgctaaatgttgacatttggcgctttgtctggtgggtcaggtgagagtctgcgcaatcctccacatcctcagcccctcttcagacacgagcgccagcctgttcctgccactgtgtcctctggtgcggcctctcgctgggcatgggccctgcagcagcacctggccatctaagttcaggagggtgctgtgtgctgcctctcccttcagtcctgcctccttcaatctcagcagtcccaggtctggctctgctcccaggacgctggactctcccctcccagtggactcgcaggctggccgcctctgctcctcccgaccgcagcccctacctctctcccagactccagtcgcccgtgcccaccgctgcccacgtggcctctttccaggcggcagccagggcttctggcacgtcgggcgccagcactgtcgcttgtggccacggcccgcggagcttcagtcccttgagctcctcctccagagcagggccgagggtctcgccccagcccgactggctgtgcctgcagatgatgctggtcacgcagcttttcgtttcccggaacgcaggtgggatagcagtgcccttttctggcagtgcggcattctctctggcagtcattccgcccggagaggctcatcttgggcggttctgggcgacagctgtgtggctgcacagtggccagtgagaggcatctgggaaggtggcccttgtgtagggagtcactctccttccgtcacggtcacacctcatgaaatggttagattcttccaagtgccttctacgcccctggcagattttctagaatttgctgtcccagaagcttgagaagggtccggtgccacccgacagcagaagccgggatgccgctgagatgccagcgcttctgagtccctctcactgcctgccttctggtggagagaaggctgtcctgcgggcttatgccctccccacgctcctcgcaccgttcacgccattgtgcagcacagctgttaggaccaaattcatcttccccgcaaggacgagtcaggcccagtgttgcactggtcctgctgtctggcttctgctgcggaacttcctcaccttccaggcagggcccaggagccacaggagcgtgggcagggcagggtctgccctctgtgcttccgactcgccgcttgcgagctggagggacagtcacctcgacctggtgggctgggtgggtctggctgtgctgtgggctgtgcctcactcctgcaagtgggcactcagcggggttggggtcacgaggctgaggtcggcttaaagcaggagtgggcagttggcacatcatgtttctcctgcatcagggctgtggcaggaatgccgggtgactaccgtagacacttgtcaaggttgaggttcagagaaaggtgtggggtatcccggaggtcaccacagtgtgccaggaggttcaggttggccttccagagcccggcctgtgtgaaatccccacgagcacagaggacagaacgaaacatggtgttgttttgaaacagggtgttactgtgtcacccaggctggagtagagtggtgccacattttttgtagagacggggtgtccctgtgtagcccaggctggtcttgaactcctgggtacaagcagtcctccctcgtgggcctcccaaagtgctgggattacaggcgtgggctcccgtgaccagcctggaacgtgctgatgagcctctttttctcctgaaaccccggtgggaacagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcagagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaattgtt

SEQ ID NO: 669 - DNA, 56771 bp, Homo sapiens
gattgggccgctgtcaggtgtcgctgcctgcaggttcggctgcgcgagcggagggaggcgggtgagtgaaggccgggggcggtgggggagtggctggggctgggggcggtatcggaccgggtgggcgcggtagagtgggcttggtgggttcccagggctggggttcgttccgggtgggctccgctttgggaagaggcccagcggaggggccttagtgtcagcgtagggagagtgaggcggcgaaggcgggggcgggcaaaggctagtggagtcgggatgcgagggcggtattcgtgacccggagctgtgcgaggagagtaccgaggagggggtcggcgggagaggagataggtatgtgggggtctgcgtgaggaagagggggtcctgtgggaggatggaggagcggagtcgtacaggggagaggatcaaggtggaagggatctgcgccaggaggggtggggctggagtccaggaggaagggggtagcttgaggaatgggttgcggctgagagaagacagcctggagggaggggtgatgtgaggaaagaatggatggcaggtcgtcattgtggggggtcactgaggggtcaatataaagatgttaccaagtatgatgactcgtgcgagagggtgaaggagtttaatactgggcaatcagtgagtgcgaggattagttggattaatggaattagttgaccaatgatgcggggtgggatggggaggctgcagtcagtattggggcaagagtcatagcaagttggggaaagaaggcgaaacgaagcagctgatactgagaacagggagaggagcacagttgatcagagtcggaatgaggagtgtgtctgaagaattaaaaattgcattaagaaggaagtgaggcgtccactgttcaaggtgggcagaaaatagtgttggtggcctgaggagtttttctgtgttggaagtattcctgcctggaatttgtattgatatttcctcttcgctaccaatggagtccaccatcaagtgcatagtgatttaggaaattagatgactatgcaaggagccctaaattctaagggttaaagaagttacaccgtttaccctcccttctaccccttctccagatctaacatagatgttcctgagaagattgcctgcctgcccctccctcgttaccttactcgcctatctccttgcttctttccttccattcacattgattcctgtcagagtaagactgccctttagcccagtgtggagtgtgaagttttcttttctttcacaacaaagcttgggggagaggcggatggggagaagagcatggaaaacagggaagcggctctgggaacaccacattaaagcccatcttctcccagaggtgcatctaaataaatcctggcttatttcatagctatttctgtcaggcttctatttttgctttgttaactgggaatttagacctttcgtctctcttcagccacatatttgtaaacagtctcttccctattctattagttaccatgccccgttatgtagttgcagtagaatttcaagaacatgagtgtacattcagtggaaaacgaggaaggactcaatggaagaaagggcaaagggttaggaatcttagagttgagagaaagtcccggcttcagagcgaagataaagaatgcaacaaaattctacttgctcaaactatacagggaccttgggaatgtcccaagtcagggaaattgggtcaggtcactgaaaaggaattcaaaaaaatagcgtttttatcaggggtaagagtgtgtgtgtgagacctgcagtgcacaacaagaaatattaagcctaaggagaatgtcgcacccccgtggcagttgagaaataaagacagcagataatgaaaactggaaaggtcgagaggtcgaggtctatataaaggtccgctagaactttctttctgtttatttttttttttgagacaggattttcactcttgttgcccaggctggagtgcagtggcgtgatctcggctcactgcaacctctgcctcctggtttcaagcgattctccagccccagcctcctgagtagctgggattacaggcgtgcgccaccccacccggctaattttttgtatttttagtagaggcggggtttcgccatgttggccaggctgttcttgaactcctgacctcaagtgatctgcctgccttggcctcccaaaatgctgagattacaggtgtgagccactgtgcctggtggtcagctagaactttctagtcaaaactgcaaaccccagttgtaatgaaagagtttgaaataaagatagagaaaataattgttcaagactgttttcaaaatctatgagactaattacatatataagatattatttctgtaagacaagttcatttacttaaggagtttgtggctttcactagagtcattggtcagtgtttctgagaacttttggagaccacggaaaattgctgatgtgtgactcaatttttatttttggaaaataataacagatattcatatccttacaattcataggaacaaatgttaacctgtgtatttgcttcagatcttttttacaattgaaataaacattgtagataaggttgtggagtaccatttgaatcctcagttccattctcccttctcaaaggtaaccactatcatgaatttgatgtctttctttccagtccctgtttttatacttctactaattatatatgcagtcataaaccatatgtaacatttgtatttatacaatagcgatgtactgcaggtatatttctgcagtttgtatttggaaactgtccatttattacatatagcttttatttttacattgctattagtctatcatttctatatatgacattatatttatggattctacttgtaacctctgaactgttttcagtttttctcattaccaacagagagatgaagaggattaagaagttcctcacaaaagtcttatgtaggagaatttctctacagcagggtttctctacctcagcactactgagatttaaggctggataattcttggttgtgaggagatatcttatgcattttagaatgtttggcagtatccctggcttctactcactagacgccaatagtacctttccaattgtgacaaccaaaaatgtctcctgccaaaagtcccctgtgtagcaaaatcacagctggttgagaacaactacattacttgtgtgtacacagaagtggaactgctggttcaagttaaagtcttaagatattcttactggtacagttttaggcaggatttttttttttttcactgtagctcctggtgtgagggaccttggcctagactagcactggttctatagtaccaggggacactagagagaacattgagatttcagtttgagagtgggctggagactactgtatggatgcctgtattctcaacctcccaaccacactagacctctttccctgaacaggttttctgaacttgggcatttgtcttctattattattattattattattattattattattattattattatcatcattatttgaggcagggttttgctctcacccaggctggagtgcagtggcacgatcacagctcactgcagccttgacctcttgggcttaaacaaaccttccacctcagtctattgagtagctgggaccacaggcttgtgccactcactatgcctggctaatttttaaaaactttttggccgggtatggcggttcacgcctgtaatcccagcactttgggaggccgaggcaggtggatcatgaggtcaggagttcgagactagcctggaccgcatggtgaaaccccgtctctactaaaaaaaaaaaatacaaaaattggccaggcatggtggggtgtgcctgtggtcccagctactcgggaggctgaggcagaattgcttgaacccgggaggtggaggttgcagtgagctgaggtcatgccactgctctccagcctgggcaagagagcgagactccatctcaagaaaagaaattttttttttttccttttgaaacggtattttttttttttttgagacggagtcttgctcttttgcccaggctggagtgcagtgacatgatctccactcactgcaagctccgcctcccgggttcacaccattttcctgcctcagcctccccagtagctaggactacaggagccggccaccatgcccggctaattttttttgtgtatttttagtagagacggggtttcaccgtgttagccaggatggtctcgatctcctgacctcgtgatcacccgcctcggcgtcccaaagtgctgggattacaggcgtgagccaccgtgcctggccgaaacagggtatttttgtgtcgcccaggctggagtgcagtggtacaatcacgggtcattgcagtcccgacctcttgggcttaaacagtcctcccagcttaacctcccaagtagctgggaccacaggcaacgtgccaccatgcatggctaatttaagaaaaagcttttgtaaaggtcaggtctacctatattgcccaggctggtctcaaactccgaggctcaagcagtcatcctggttcagcctccgaaagtgctgggattacacgcatgaaccactgcacccagccttaaaatttttttgtagagatgaggtcttgctatgttgccctggccggtcttaaacccctaagcccgagcgatcctcttgcctcagcctcccaaaatgctggaattacagggatgaaccatggtatctggctgtgcaactgtcttttaaggtggagtagatgaaggagagagagagcatgggggttttattattttttaaatttttggtttgagagagggtctcactctgtcacccaggctggagtgcaatggcgtgatctcagctcactgcaacgtctgcatcctgggctcaaatgatcctcttgcctcagcctcccaagtagttgggactacaggcatgcaccaccatgcctgcctaatttttgaatgtttttgtagaaactgggttttgacatgttgcctggctggtcttgaactcctggactcaagtgatccaccctcctcagcctcccaaagcgccgagattataggtgtaagccagtgtgcctggccttaatgttctgatataatgcttagaatgtagggtgccctcaataaatattttttgagttaatctttgggaagaatgaagaagaggtttaaggggaaaggcagctgagctctctcattcctctgcctttgaattaaattactgaattcaacactactgtgaggaggtggaaaagggctaggaacattgtgaaatgagtccaaagtttgaaatgtcactctaaccttctcttctggtaggactcaagagtagccttcctcgaggacctgcctttcccatttgctgcctgaagttaatgtttcttgctggccaaatcagggacatgccggcattgtaagggctgattatctgatcctcttactaatttattggttggggtggggtgagcagggaggaaaagggataccttgcttttcttttatggctcttttagcatctcaagtcatagcccatatgcctcctttcttgttgatccttcttcctatagctttgttttgtttccccttatagttccctcttatgcttttcatctccatccccagccccacccacagccagggggcttgggttctgagctgatggggtacccccctctgcagagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtggtaagaatggggaaaatgatgtaacttggggttggagcctctgtcctaaagagttaagattctattggttagagatacctctctgttctttccgaatgcatagactccctgtcataaacaggccctatcctagtttaggggaggggcagtagagattggtaggttgcctctcttagaaatccctgccctggccgggcgtgggtaatcccagcactttggaaggccaaggcggccagatcatttgaggtcaggaattcaaaagcagcctgtccaacatggtgaaaccctgtctctactaaaaatacaaaaattagctgggtgtggtggtgggcgcctgtaatcccagctactcgggaggtctaggcaggagaatcgcttgagcccgggagttggaggttgcagtgagcagaaatcgtgccactgcatgccagcctgggcgacagagtgagactctatctccaaaaaaaaaaaaaaagaaacccctgcccttaggatcttcctgtcgtctcatggttgttggttctctagctctcctgcttgagcacatatttcctactgtggaaaggctcctattctgtaggcagttggaatccctagctgtgcctcaacctcgatcaaagttaggaggcaccctttatcccataggtccagagtcctggcaagaaactctgtgccctaagaagataagacagtgttcccagaagggggtgatattggtgggaagttcttgagtttctgatagcacttcctctctgtagcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggttggggtctatgaaggaaaatgggagggaatggtggtgggaatactggttcgggaaatgaggttcttattgtcttatttccttagtaaagagccgtcagctacttgtgacacactagagaatggtgccaaggagtttgctttccctgcatcttggaggagttgccgggggtttaaagcctatagtctaacctcaggacaactctaagtgtcttaggatctctgacagaattgggtctctggaaggactgtaaaaataacttctgttttactttttcttgataaatatcctagacttggggagctgggaagaagaataagtgatgggttgaatgggtagaggagctcagtggcagctaatagctttaatatgtctttgtatctctcttgctcttttctcgttctctttctctcccttcctttggtctctttatttcctgtctccatcccaggctttcctctggacaaagctgttgcttactccaagcttcgaaacccctttcttatcaatgatctggccatgcagtattacatccaagataggtataacttcctgttgaccagtgagatgggtggctttgggatcatgcgtgttcggggaacccactgtgagaggggcagagtcaaaccaacatgcctaatttttgtaccataattttgtgccctggtgtcttttaatcctgtgcaaatgaaatccccagcctctccccttagttactcccacctctcccagctattttatttgggggtgacaggagggaggtgtaccggatcctgcaggaagagggtattgatctgcctcgatatgctgtgctcaaccgtgatcctgcccggcctgagggtgagtacctggcctgagggagggttagtcctgcctttccttgctttctatgacttagccacgtttccatcttctagacatctcctgtataccacctatctatgtggggttttggttattggattatgggtggggttagagccatgagtcttcggacagagggttggacctgttatatagagattttacctcatctattacaaagatatagtcataaaaatttgagggttatagagatgaaaacctggggaaatgagaattagtaatattccacaaccttaggccataggaatgactacacatccacctttcagaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaaggtaggggggatatttgagcatctggggagtcagagaggtgcaagggcaaggatgaggttgtggggaaggaagatggagaatttggggacagaacagagagttgaggcaacattgctttttcttctttttttctcttgaagattggcagccgaagcagtgtttactctcctgagagcagcgtccgaaagacggggtcgtacatctatgaggagtttatgccaacagatggcacagatgtcaaggttatggtggatatagggatttaagaggttacaaatgtgtgggtggggatggggtacttgggaagcaggtggaagtatatggggaggaggtcctagaaaataacatgatgtgaatgtgattggctttcatattcaggtgaagataatgagtggaggatacagacattcacattttcactatcagagcaagggcaaggctgacttagaaaaatggtataatgtttgtaaattattttttaataaggactacctgacagtagtggagtcccgaggagaaattcataatgatacttcagtaaggctcagtaggaaaaatgttggtcagtctccttaatgctcaggatttgttttgtttttgttgttgttgttttactctgaaactcgtctacagacctagtgctcatattgtcttctcatatacagggtgagctgtgggcatactcagtgatgctatgtacctgcaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaaggtagaggagggcccagggaggttgtgaaatgaaggagaaaggaaggaacaggggtccgggaagagtaactgtcttgttctcatctttcttcttttccttgcagcaaacagtttgtggatttgaccttcttcgtgccaatggtcattcctttgtgtgtgatgtcaatggctttagttttgtcaagaactcgatgaaatactacgatgactgtgccaagattctggggtaagagacatagtggtctgcgctggggagaatgggcttacagaagaatatttgaaagtttttgctttattttaaatatcacaaatatgatttaaaagtgaaaaagcaggccaggcgcgatggctcatgcctataaactcagcactttgagaggctgaggcgggtgggtcacctgaggtcaggagttagagaccagcctggtcaacatggtgaaaccctgtttctactaaagatacaaccttagccaggcatggtggagcatgcctgtaatcccagctactagggaggctgcggcaggagaatcgcttgaacgcaggaggtgaaggttgcagtgagctgagatagtgccattgcactccagcctgggtgacaagagcaaaactgcgtcccaataaataaataaattaattaattaattaaattaaaaaataaaaataagaaaggaagggctcctcaggctccttgcctttctaacactgcccctcccagagaccattgttgttaacagttttagacataacaatttatctttttctgccatatccaaactgtatttcttttactaaatgtggtcatactataatactgctctgcaacttgactttccaagaaattcgtcacgtaatgtataaaccattcagaaatatatgaggaatgatgactatagtgagcatctatgtattcaccacctagcttaagaaataaaatattaggaatataggtcgggtgcggtagctcacgcctgtaatcctggcactttgggaggccgaggcgggtagatcacctgaggtcaggagtttgagaccagcctgaccaacatggtgaaacctcgtttctactacaaatacaaaaaattggccaggctcagtggcttccgcctgtaatcccagcactttgggaggccagggtgcgtggatcacctgaggtcaggacttcgagaccagcctggccaacatggtgaaaccccatctctactaaaaatacaaaaaaaaaatgagccaggcatattggtggacgcctgtaatcccagctacttgggaggctgagacaggagaatcacttgaacccgggaggaagagattgcagtgagccgagatcatgccgctgtactccagcctgggtgacaagagtgagactccatctcaaaaaaaaaaacccaaaaaaaaaaaaaattagtcagccgtggtggtggttccctataatctcagctgcttgggaggctgaggcagtagaatcacttgatcccaggaggtggaggttgcagtgagctgagatcatgccattgtactccagcctgggcaacaagagtgaaactctatctcaaaaaaaaaaaaaaaaaaaaaaaaaatatatatatatatatatatatacacacacacacacacacacacacacacacacacgtacacatatatgtatatatgtgtatatatgtacgtatatatgtatatatacacatacatatgtgcatctatatacacatatgtgcatctatatacacatatgtgtgtatctatatgcgcatacatgtgtgtatatacacaaactgtacacatacgtgtgtgtatgtacacatacgtgtgtgtgtgtgtgtgtgtgtgtgtgtgtgtgtgtgtgtatataatcgaagcccctatgtactcctccctagtaacatcccctccccatccccagagggaaccacaatccataatttggtgtttgtcattccttgtatttatttatatttgtactacataaatatgggtatttgtttgtatgtttttagactttatattaaggtattcttctgcctgcagcctgcttgtttttgtgagcttcattcctctgagtagttctggtttattcatttttacagggcttctttgtttctctttctaggaacaccataatgcgggagcttgccccacagttccagattccatggtccatccccacggaggctgaggacattcccattgttcccaccacatctggcactatgtaagcaaaagcaaaaaatctggagtaacctacttaagacccatgggattccttaagccaggctaatggttacttcctgaccccacactatctgactaacggagcctaggcctcttatacacagtcttcttaactccacttatattcccccgccgttttttttgttttgttgtgtttgtttttgagacagagtctagctctgttgcccaggctggagtgcagtggcatgatctcggcccacagcaacctccacctcctgggttcaggtgagcacatctggctaatttttgtgtttttagtagagatggggtttcatcatgtgaccaggctgatcttgaactcctgacgtcaagtgatccacccgcctcggccttccaacgagctgggattacaggcatgagccaccatgcccagcctccatttatattcctaatctcagttcccttttctttttctttcttttttttttttttttttttttttgcgacaggatctggctctgtctcccaggctggagtgcagtggtgcactcatggttcactgcagcctctatctcctgggctcaagtgatgctcccacctcagcctcccaaatagctgggaccacaggcgtgtggcaccatgcctggataattttttttcttttaactttttttatagagacagactcaccctatgttgctcatgctcaccctatgtttctcctgggcctgagtgatcctcccacctcagcctcccaaagtgctgagatcacaggcctgagccctgctcagcccctctgtttttttgacatgtcaagtaatgtgatgacagcaggtgggatgggggtgtgggagaggctctgataacatttatgatcttaggatggaacttcgttgtgtcattgcaattattcgtcatggggatcgtactcccaagcagaagatgaagatggaagtgaaacacccaaggtcagaagagtgtcctaatttacataaataggtttttgtgaggaagactgcatggggggcaagtcctggaggctttgactgtctcatgccacactgaagcttctcgttacttcttcaggttttttgctctgtttgaaaaacatggtggctacaagacagggaaattaaaactcaagcgacctgagcagctccaggtaaggtagtgaatctgaccaggaggaacagtgccatgagagagatagaggatatggcattgggagtcttgataaaagactaggatggaaaggtaactgtctaggacttggccttctgcatggataccttattatttcctctaggaggtgctggatatcacaaggctgttgttggctgaactggagaaagaaccaggtggtgagatcgaggagaagactggaaaactagagcagctgaagtctgtactggagatgtgagaaaggggatagcaaaagggagccaataacagtgagaattggggtgctggaacagaacataaactgtgactttatcctgcaggtatggtcacttctcaggtataaaccggaaggtacaattgacttactaccctcatggagtaaaagcttctaatgaggggcaaggtaagatgtagtcccccttaccactacctctcagatcttgtgttctttttatgttttttgtccatcttctttccccacaagatctctttttcttgagcctatagatgacctttaccccaaattacatctctggtctcctcagaagacctaaggtttagatgttcccactatttttcttagatctagaccattcactgcctcttattccttcagatccacagagggaaactctggccccatctctgttgctggtactgaagtggggtggagaactgactcctgctggccgtgttcaggctgaggagctggggcgagcttttcgctgcatgtaccctggaggacagggtgagtgttttggggagtgaacgcatagcagggccaggataaaatgattagagagtaagttggggaaaatgaagggacagagacagtgggggaatgaatattttttcttccacgagtatttatagcagtccatttgtggtcccccacctttgtccccaggtgactatgctggcttccctggttgtgggctgcttcgtctccatagcactttccgccacgatctcaagatctatgcctctgatgagggtcgtgttcagatgactgctgctgccttcgccaaggtgcatactacagttctgtagtcccagtttccattaggtagagaagcagagagtttggagaaccagttggagcatttcagggtgcttgtaggccaactcagagaagtttctgcatgtatcggacccattctgtactaccgagaatgagctgagaataattagtgagggtaggccccatctcttcaaccagctcccgttcgatccctgggaccatctaggcctagggatgctaacctgcaagggaaacaaatagaccttgtgctttctctttagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcaggtcaggctcaaaaatagcctggatccccaattcctagaattctaaatagtagggatcaataataacagtatttactgcatgccaggcactgttttagttattttacacatatattatttaatccttacagcaaccctttgagataagtacaggtccacaatctcttatgcataattttgaaaattaaaaagatttttttcttgacattgagattcatttggcagctaaacctgacacgaactgtcataagacttttataatccttagttttcccacttagtgtaaatagtcgtgcattttgtggcagaaatattaatgtgtttggttatgccatgggccctgatggaggtattatatacatatggcatatgtactgtattaacttctaaagtcccacagattctcagttccaaagcacagctctgatcccaaggatcctgaacaaaagaacgtttcagttatccattgttgcataataaactaccccaaaacgtagtaacctaaaacagcaaccattttattatctctcacagttctgggctcatctgatcttgcttggagtctctcctgaaattgcagtcagatattgactggagctggaaccatctggaagttcagctgggactgtgggatggctggctctctccctcttcatgctctccctgtaacctcagtgcctcttttctccacatggttcttcatatggtttccgtagcatgatagccagaagtattaaatggtagctttagggatattcaaaagcagaagcttagaagctttcttaaagtgtaggcccagaaatagcacaacataactttgttattttttattggttaaacagttacagggccagccagatttaagggaagggaaggaaaggaagacaaagaattgatggtcatctttaaagcactacaaggactgtagaccacaaggactttcctcccattttacagatgaggaaacctaggctcagaagaatctaagcaattttcctcatgtcatccagctaatacaaaccgaaggggtctaactccaacgcccaggctgttacattgctttatagtattaatcccactatatgccattacccaatatggtcgttctttttcctgcatatctaggccacaaatgaccaggcagtggttttctactcttcccactcctcatttctgatatgttcttttaaaaaaatgtttaaaactttaaaattgtggtaccattttaaccatttttaagtttacagttcagtagcattacatgtatttacattgttgtgtaacatttctgattggttcttaaatgagttaagtagctaagcacattgctgtgagcccataggattttctgtgttctctgagtaggacttgataaggaacaggaccttgctcctttatttcccaatccattgctcactgtcaaactcaaaaaagctaaggcagctttcctttctgccttgccttcttttgcgagcaagaatgaaacttgtgaggacctaaacagaattgtgcattttcagccacagtcttgattctgcctccacatttctcattgactgttactgtcctacaagcctgagtcagaacccagttttgaggcagcatttctactctaggctcaggctagcatcttgtttagaggaagaagataatgttatctgtgatctctactcatgaaaacattctgtggagattttgagggattttggttcaatctttattctccagtattttccatgtgtattctagagccctcaagaaaagaacttaggtctgttttattttctctggactcttaaaatcaatccctcttagacgactatatgctagagcagtgcccttacctgaaggcctagaactgctagtatgcccagtaacctaagaatgctcactggagtgaaccaacatacagagctgtattgtgagtagtctctgtgtaataaactcacaggaatctgggcaattagtgccgagcctgtcttgcttttcttctctctattcttcatagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtaggtgggtatgaatactactatcttcccttcaaggtctcaggtatggatgggtttctcaggcattctggtgtcctctcctaaatgtcagagaccaggcctcctcctccctctggctgtacttcagagttgtcagggtcttttgttggaggtaaaatctttgattcttatctgattcctgcctttcttccagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggtgtgtcttgtataagggacctagcctggggatgagggtgttgggaaggaaagagagaaaaggtggaaaggaagggtgatttgagactagaggaaagcaactcagagaaggaataggttgagttgctacatttctcagggtccactctggctcttggtaagtacaggaggctaattcaggagacacctggaagagggggaatgtagtggatatgaaagaagccctagacgtgaggtgaagacaggcatgatcttggtcctgggaatatgaggcatgagaaaacaagatttattgaggtatttattcctggcctgtggcccctaggagtacgggatcagtcgggaggagaaactggaaattgctgtgggcttctgtcttccactgttgcggaagatactacttgacctgcagagaacccacgaggatgagtctgtcaacaagctgcatcccctgtgagggagggctgggaggggtgttggatggagggaggggcatgtcagggagccttgggggaatcaaagctgggacagcctggggaaccaagaatagacaagattttgggatggaaaggagagaagtctttgaggtgggaggagggagtttgcagaagggtgggaacagggttaactgactgtgtgagtgatttagctgttatctcaggtactcccgaggcgtgctctccccaggtcgccacgttcgaacgcgtctctatttcaccagtgagagccatgtccactccctgctcagtgtcttccgttatggaggacttcttgatgtaaggatcctccttcttctttagcctgtgaacagctttttcccagcattcttttactcttctcaaatgaaagctttctccattctcattggctccctgctcattctctgactcccatttccttaagcaatggcttacctctttttgcatttggtaggagacccaggatgcacaatggcagcgagctttggattatcttagtgccatctcagagcttaactacatgacccagattgtcatcatgctttatgaggacaacacacaggtgaggagctagcaggtgggagatgagaggaaggccccttcttttgaattctattaaaaaaaaaaaacttgcttatccttataatttggagaatccagctaggtgtggcacttacgcacagcatgacacagagcatccaggaggttcctactggaatggaaaatatgttctgggatgttgttgagccagagaggtaacctagaacacagctctggcattagaagagtatggaatttgggacaatgttatgagtcttatttcctcaaacatggttatacatataccttctgcatacggctccacaatgatacttttttttttttttttttttttttgagacaaggtctcactctgtcacccgcgctggagtgcagtgctacaatctgagctcactgcagccttgcaacctctgcctcctgggctcaagtgatcctctcacatcagcctcccaagtagctgggatgacagacatgtgccaccatgcccggctaattttttgtagagatagggtctcaacatgttgcccagggtggtgtcaaactcctggactcaagtgatctgcctgtcccagcctcccaaggtgctaggattacaggtgtgagccactgctcctggcccacaaggtatctttaaatgttctgctatatgcaccacagccaagctgagttattgtggaaggtgatgggaagcgttgtaaagctggaagttcagaagtcatgtgcaatggtgaaatcacaaatggtagagatgagggaatgaggatcctgtaagagacaatatatagttgaaaggaagctataacaggtcagccccggagtgggacaagaccctgaattcctgggaggatgaatccccttgagttcctctctacttccaccacaatatccagcttctcccaacttccccctcttgtggttatgctccataggatcccttatcagaggaacggttccatgtggagctacacttcagccccggagtgaaaggtgttgaggaagaaggcagtgccccggctggctgtggattccgtccagcctcttctgaggtgggtcagagtgctgggatttgggactgaaggacttaggaaccaagtggtgggaagcagtacagggagaagtaaaagggctaggtagtctgggattaggattttggaggccattaacacctctcttatctgccttttgttgtatagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtaatgagagggccttgggaagaaatgaaggggtggcagtgctcataggactatatccacagatccactagatccccttggggggtctcttgggacttgaagcagagtcctcctgctctgattgatatgttttacttaatctctctttcacagctggtctcccagtagtgcttctttaactggttgctacttctcagattaaagagttgccattgagggatgcctgagagataagggtttaaagagataagattaaggaggaggcctctggatgaatttgaaaaggtagttctttaaaaggaaatctagtggaaacagcttgaactccgggccaaaatcccagtgtaatacttggaagctgtgtgactttggctgggtaacttctctacatttctctgaccttaacttctctaagcctcaattttttttcacctctaaaatgtgagtagtatccactttatagatgctcaacaagcagtaatatattaacaatgcaattgatattaaaggtccagccctctccagctcttggtcaccttgggtaaaaattatagctcagataggagcaaatacctggcactttatctgtactgtcattccagaaagtgggtcagtcaagagctctgtctgtcttcctcttgttctaatgaggatctttatcagcatgggcctatattctgctgttcttggaggttgtttctagttctggttctagctctctagcctaaaggcagtaagtgttattaatctcatattgtgtccagctaaccatctgaggtttttgttttggtctttttcctggaaaaactgtttctgtctttggcctaattatatcctttttttttttcccctatcttgctctttctgtatcacttacattcattttgacaccacaatttatccctgtctcagagactttgactgtctgatttagattctgctctgtcctaatgaccgtgttcaccctggctcggtgccaggtctctatcttagaggaattggtttttccattttagggatatatcagaagaatctataacaagctgacctaggttcagcaaaagttttgcaattcagattttggagaaagctgagaagatgaactgcagtctcttcttttgattcatcctttacttcctgattattttaaggtgaaattgccattggtaatatgcagagtttctttaggtaggatatacattattttctctttgaggtgtaggtgtcggttggtatccgtagtactctattaccctttatactcacatccaatagatcacatggatagaatgatacataatcttccatcaataaactgatcctccaaatgtctttcctattcacatggtctgctagtctctcctggtgctgttgtgcctgaaccgcgtcccccatcccccaaccatttttttctggtttatgcagtcataagacatagacagctgcgtgtggtggatcacacctgtaatcccaacactttgggaagcctaagtgggagaatcatttgaggccaggagttcaaaaccagcctgggcaacatggcaagatcctgtctctacaaaaaattttaaaacattataagatggaaaaaaaaaaaaggcacaggtaaaggaaagctctgtgtatcatctctcagacttgataagattgacttctttcaggcctatgggaagcttcctattgtaatcacaggctttcttttcaattactagtgctgcttagaccctggcttatccagggtgatggttgtccaggatattttcctcagctttgcaagaaaatcatctctctgctccttggtcacaaagccttatgatactaatgttaatgtttatcttccttgctctataaatataggcatacaacttatccttccctccatcccttcttctcctcttgtcatctcatactttttaactattttagattataaaacttacgacctttatagcagctatgccctagctggtcatcctctctagccctgtaactagctctgccctgtgggccctggggcttttgggagcctggggtttaaaggagccgtgaccggctttccacccggtctgattgcaggtcatgaacatgcagtgcacggggaacctggacctcatccccttgcggggacggcgctgcaggaggtcgggagacctcccccagccttccctagccattggcctacagccccgggctgtgtccaccactcacctggcatcctgcacacaggtgtccctccctacctcaccttcctgtcttgccttctgtctttgccttttgggatctaggggctcagacactatctgggtgggatgtgtgtgttttgggggttgtgtgattgggcccttgtgggcattgtaaaaattctgtttcatgtttctaggggtgagacagtggaggggtgggcttcttggttctaacaaggaatgtagtatggttgcagtagccacagctctcccatgcaaagaagagagggtggccagactcttatctgtggctgagccattgtgattggctttctgagtctgtggggggatagatacaattaggaaactctgctctgctgagaactaggaatgggttgaataatgatttctcaaactcagattgggaatgggagggctgtggggaaaggcatcttgaaaatagaagtgccttctagtatagaaagatgccccggacagttccctccataaagtacattctctgttcccttttcatccctcttcccctataaatcctttggtacttccaaactttctaacattgcttggctttgtagggacaggaatccaggacctgagttttatactttggggttgaggtggcaaaatgattaatatagagtcctttttctgcaggtactttctgagacttcatcctcgaggcctggtggctaccggctcttttcatcttcacggccacccacagaaatgaagcagagtggcctaggtatggttttgccagcatttctcacctattgttggaaaagttgtctgtctgttcttcagagttttattgtgggaaacctttgtcatgggatttgggaccgtccaatcagtggaatatcatcaggtggaggtagggaggatgaagtgggagaagccatagttagatgtgaacttggatctcagatgattattccatcccaggaaggtgtttatctcttggttttctataccaaccacatttccctggccaaagggcgtttttctggctttccctctcattccttatctgtccctccagtctagcccagaccttaaggggccatggagactctgaaccttcagagttatcaaagacagagctataaatagaggtacttgcaaccctcataaatgtcgtattcctcatttgaagaaatgtgccacgtcttcccctgaaacctgtgtttttcacatccccgctcttgcccttcttaccaccttgccctttcctccatcatctcctaatcctgtaactttttccccttccttctggaaaattgaccagtctgagactggtgtagtggcagaggcatctctcaggactttgaggaaatgtctcttgatttttggatccctggaaaggggtagagaacatcactcagctttttctaagagcacagacggcaggaaggaccaagcctcagagggtattgtattctttgggtggggggcagtccttgggaggaactatctctgagcacagtgccttgtgagccagtaattagaactggaggtcagacatggttgtgtggggtctggtcttggtcctctggctgtttctgtcttgtcctattattctctctatttagcgcctctaattgttctgttgcctttgtccttggcagccattttcttggccccaaaatggtcagcttttggactagcaagggggagaaaggttttggtaactttccaggctaattttatgagaataagttgccttctagattcctgaaatgaggaagatggtatggggcatgagaaataaatgacaagtgtgtagatctggccaggcgcagtggctcatgcctataatcccagcattttgggaggccaaagaaggcagatcacttgaggtcaggagttctgagactagcctggccaacatagtgaaaccccatctctactaaaaatacaaaaattagctgagcatggtgacgcatgcctgtaatcccagctacttgggaggttgagacacgagaattgcttgaacccagaagatggaggttgcagtgagctgagactgtgccactgtactccaacctgggtgacagagtgacactctgtctcaaaaaaaaaaaaaaaacccgaaacaacaatagtgtagatctaagaaatgaacctctcttcccagaagtcccagtaaagaataggtttcagacagactagaaaagaggataggtgtgtctgtcccagttaagtgggccgtgggaatgctttcaagagcaaggcagaggtatggacatggaactggttggcagatggtggtggtaaggtagagaccaccctctgagatgatctgaggactgggcagaacagagttggcatgactgcaccagaaaagtattcagtggaggaagtgtatgtaggacaaagcttggggtggtctgggatagagccagctagttttagcttctctgaagaaaagcagtcatatttagcaactgttattactctctggaatctcattccagagcctgtttgaacatgaaaggtggaggaagttgctgtataggggagaggtcctgaattccagggtgggaatcatcaggcatctgaacttcctgattgctctggtgaccccgaaatcctgggacccctgaaaccatggtcccttcttggtggcctcaagggaattgaactcctttccactccatccatttcccctatgaatgttaagtcccaagccaaacccagggtcttggctaagatggatttggaagtagagaggcaaatcctgagaacttgggtatcagtcttgtttcttcttgaccactctgtccttataggctatagtaggagaagggaccgtggagtcctaaccctcctctagatcagctgttggggacagtgactggtctgatttatttcatacttcagagattattcagattttatttaatcctctcattggcaatggaattctctttgttttcttagaatttatatgtgtgggcaactggctttgagcataggcttacatgataatacacttttgcaagcagaacaaacatgtctttttgttgttatttcctgtattccttcttagtagggtgctcctcacataataggcatgctctacatataatcaactgattcttcacatgcccttcaatttgtgtccatcttgactttagaaactgctggttcctaaaaaaaaatagttatttattttctaacaatacagttggtcctcagagtcaggagacctggattctagtccagcttagcttctaaaaaactatgtgaccttgagcaaaggaggtcccttttggatctcagtttcttcatctctaaaataagaaagttggactggatgatctatgagtcccttctagcttaaaaaattcaatgaggcagggggctgtggctcacaccaataatcccagcactatgggaggccaaggtgggaggatcacttgagctcaggagttagagaccaacctgggcaacatagtgagacctcatttctactaaaaataaaaaaattgtccaggcatgatggtgtgtacttgcaatcccagctacttgggaagctaagatgggaggatcacttgagcttgggagaccaaggctgcagtgagctatgattgtgccactgcactgcagcctgggcaacagagtgagaccctgtcttaaaaaaaaaaaaaaattgtgagcctcatactttcattcttgggaaaggtcaaaaggcctgaagggaggggatgttggatgaaaaacttaggaaggattggaagggtgccagctgagtgttcagaatatagtctctagcttcagtcaaagccttttcctttcaaatatacaaggactagatttctgggtttctcaagctatatatccagggtaaggggtgccgaattaaatctgaggggaatctagagggacctacctgttattttggcatttctgagagccacctgaagagcacagtctatcccttccagtagctttgaatcccctaatatgactaaccctgcatttgtagtggcctgttgtttctgccatgtagctcttcagaagaatcccccttttgcttgcccactgtgactatggagaagtgtaaagccatttgtggttatgtggaatggccacatggtggtggctctgaatggctgcatgtgtgtcttgatgttatcatgtgaagttgtgtatagttctgtgtgatagttgtggctttacgtggctactaacgcactcccggccttgcaggctcacagtgcacagggctgttcagcaccacagtgctgggtggctcctccagtgccccgaatcttcaggactacgcccgcagccatggcaaaaagctaccacctgccagtctgaagcaccgagatggtatgtgggtgggttttgggggataactccttttttcacttgtctctcagcaaggacatagctcaagaactattcatgcttaagatgacactggccttataacaagttttcttcatcagtaatagatgggagaaggaaccaggacccctttcacccctccatttgcatttcctcttgccataaaaatactacttatttatgcttatcccttcataatctcccacatacagtcctgctgcatcagtttgtactctttcctggattctggcctgtaggggtaaggaccaaggaggatgatgcatagttgggaagaaagtggtggaacctcgattaaaatccagcaaattgggtttagggaagggaatgttactcaaccaagggagaaaagataatgtggaaagagactaggggaagggatgaatatttctgtgaagattttatttccaaatgaccagaaagaagacacagtggtaaaattagggttgtttgtaggggtgtattgtggtagagatgacacattgattcctaagagatttatcaaaggaaaagagattgacgtgtgttagttagaaatccaagggatggggaggggagcaggtcagataactaactttaaagaacagaatatcttgcgggcaaactccagagcagagggtggggacaagggtgggtataatccccatgatgtcttttctccccagagctcttgtttgtcccggccgtaaaacgattttctgtgtcgtttgcaaagcatccgactaacggtacgtttgcttctgactcaatgtcattcctcctcaccatgtcacctctagacacttaactctgagtttcgacactgactttgcctctccttccactgtgttgacaccctgctgtctctgaatgagtcactcactaagtgtccctcctgggatggtttccttgtgacagccttagtcttggctgcagcctggctgccccatccctgcaactcagggtcttaattccatagtcaccatcatcaccattatgtcacttttgtcagcatcaccaccaaaacactgattaaacctctccctttcctatcacatgactgccaggctgtgtacagatatgatggttccccttcttaggatgggaatagtgtttcctagattgattccatttcttctcttcccccatacccccaattcctcagctgatataactttgatctttctgtgttttctccaactcttgttggggtggatgtggatgactagtttgttcctctttcggagcaatgctgcagttcccagctcctaagcctacttatatgggtgttagtcttgagtatatagtttcccatctccgtatttctttctcctgtcattatgtgtattttgtgtggctcttgtgctcctgacatttgctttatgttactactaacctattgcctgggcctagaaaacaagagcccaggttgctttgggataaaaataaaaagaaaggagtaggaggtagtaggtaaaagaaaaaggactgtaccttgagtttttaagtgtagtttccatgtggcaccagcctacctatgataaagctattgcagagaagtttgaagagtggagatgtctgctggggattctgggggagcttaggaaggaataatattttaagaacattgaagaactgggtctgcccacactaaggtgggagagcttggagatctctgtaaaccataaattgaagggtatggtctctttgtagggtatagcaggagaacccaggctcactctctttcaaagttttatccttggtatccttatttgtctctctgtattatattttgtcttcagggtaaatctaggttttttaggtatggttttcttctattcaagagctaagactctctgagggaagtaaaactaggctggcttcctgactagaaaacctctacgtgctaatctcctattggctagcaagtgacagctgctagattttagcccagtcaggttgtacatcttcacaaggcactgctgaaatctctccctaggttgaccagcctatgctggctcagtttatccctgcccccaggctcccaattgtgcctgtggcaggagttcccgttcagagcctcatgggtgtgccggctcatttagcttcaagctcttctggccttcatgtgccacagccatctccagaatagaacctgatgcatgaatagcatagcctgggacttggacttagggtccacaatatagtacaaggaacgtgggctcctgaaatcagagctaaatcacgtatctcctagttcttaagtgccatgagaaaagacccaagtccattaaacagaccctcagacgtatgtacctccaattccccgaagtactgttcagcagcctcacccgttgaagaagatttaattctgctaaaaggagttgaggaaaaaagagctggaaaatgcaggtgttgtgcaggaaaacaaatttaagatctccaatgccctgcacacttcctcaggggccttgtggcctcctttgtttttcttgtgctggagcttggaggctaacatgcttaagaagccagaatctgggctctacctgttgacaataggagaaatttggagctgtatgtcacttgctgaggaagattatctagattcaatttgaccctcaagaaatatgaaggctcttctccatggccaagatcttgcttgactgaccagcaattacaaagtggatgttttgtctgtagttgcaggtaagtcacagcagctccgtcatcaccatctccttgccatgatatctggctttgaaacagcagctggaaatactggacctggctttggaaaagaggcaaggcagtgtgtcttcacactttgatgggagagcagccctcagcctttctctgcctttgttcctaataagctgctcttatatcctgtaactatatccagcacacaagtatagcctgttactaagctgcacactgaattcaccaaagtaaattaataaagtgggaaagactgtggctcacgctcatccagaatgtcagggtgtgaccactggatttgtcaagcccgttatcttctagggacccatataactatgtgaccattggtatatacagttagtgctcacaagactagcctaggtagagctgaaatctgtcctgacatccaagctaaggtctctgaagaccacagtctcatgggatcaccttgtggagccagttctggtctgggagttttgagcagtcatcctgagctgccttgtttctaccttctctataccaacatcctgtactcaagttcttgtccatcctcacatcatgtcttaagatcccatatcttttctctaagatcttttcactattgttcctcttacacccctctccacatggctttgactgccttcaaccttttgtagctgaattacatcatccacaaagtttgccaagtagctaaaatgaggggttcagaatcaaagcttttccactcaccagctgaaaaaagtgcagttagactcaccagcagtgggaagaaaatataaaattatctaactttcagcttgtgtaatggatacagtatctctaagtccggagttttagtgtactttttttttttaactgattgtttaaacaacagtaaggtacaggatggttagtcaatattggtattttcacatactgattccattttccacacataccgttttaaaggagttctacacctggtttcctgccagtctcctgtgccaactgcctaataccattcctgtcttcagctatcttagagtgtggtccagaaggcctgccctaaaagagagcctttttagcttgactgtcttgatacacaataccatcactttttcatttttatccctactacataaatccattcacctgagaatgcaggccctaagtagggttcatccaatgatgagggatcctgaagctgcagtcaagactcccagccgcaaaactgccagctcacccctgttcacaatgatgtgactgatgtctacaagcactgacggaattatgctcaaggagcaaggggaaggcattgctgtatgatgagatctcacttatcccttctttcagactcattgtatgatgacaccactgttcttccctgcaagagatgcccagtggctctgaccatctctgcttctctcttagctcaccttggatctgagtgcccccacctcccagtaatgcttgtgctagtcagtgcccccctcattgtctctccctcttctctttctctatctttgtgcttcctgccgtggtcccctcaccccgtccagagctgctggatgaccagcaccctgtggtccggttgctgcgcagtttttcctctgactgtacagggggccggccagtctccttggatgccacgctggcgcatcacctgcaccagtgctcctaccacctgcgcctcttccggaactggctgcgctcaggccaggatgaccccgagtgcctctacggtaccccctgccaccaaactggctgctgccactaccctggctgggtctgactgctttgcttattgcacttctggcaggagagcccacctatttctttctcctatttgccctaagtttatgtaacttgcatttagtcacttggatgggattggggccagactgcctggtagctgtagcattggctgctcatccccttcctattctcctttctcaccaccccctaatgttactcattccccagttctgttcaatacaggagtaatctcttgccttggaatctgttcttatcactctaaccctctactaccaccatcttcaaatccaaatgtttttctagccactctgaggagctagagacagtaactttcctgccctcctgccactagatcatgggagaaattgaggcacagaagcctcaattgtatccttggggcaaagtccagagcttcgaagatggtcaggctataatccttttgagttacgggctttagtcactggtgaacaggaagctgtcttgcatagacttcgttgtcccgtgtatccttagtccctttaaggagatgttgaagaggcataggaaagactggggactgagatagtggtttggatgtgtttttcttcatcctccaatggggacattttttccatcaccagtccctagtattagggttacatatttatgtttatccttgaccctacccagactgatagacctacattggaattcttgggtttagagcagagaatcagtactttttcttttttctagggcatttgcctcatttttctgatgaagtagaaagaccctagcaagtctggggttttccagtagatcagaagagtgaagctttgatgtgatggaaattaccaagaaagaactcccatccccatcctgttcatgcatgtggttttcctgggctgagcttcatgtgtattgcatgccctccagtttgcatccaagtattctagcctttctgccgacatcctaaatttgcatgaaccccttctcagattccatgtccttctccttaatctggttctcttattcatgatacccaaaatctgctgtttcttcccagctccctgacctccctatctcatgttagatctgcagtttcaccccttacctctggatccttgttttattcccctagaaagtgtgagaacaacgttggtgcctaccctactgggattctgtttatttttccatgagacattgcaagctctccataggtagcatgaaaggtgatttgattcaccttgaggccttagcaggtagatgttttaggaaatctgaaggtgagaaaaacagactccctaggggctctaaagagttccctctcctaagagtcttggatacccaacactccaaaagccacggactctcctgatggctctcagggactctccatgcttccttggccagttggggtatatctggcaggagtaacattgactttgcccatctcttttcaaacagggtttgaagggtgttccatggtgcctaccatctaccctctggaaacactgcataatgccctttccctacgtcaagtgagtgaattcttgagtagagtctgccagcgccacactgatgcccaggcacaggcatctgcaggtagggatattcttatttttttacccttctctctgcccccatgcccatgcttcctagaatataagaaagtagtaaattagaaagctagttaggcaatccacaaagacacaaaagtacacttaaaaatgtataattgctggctgggcgcagtggttcatgtctgttatcccagcactttgggaggccgaggcaggtggatcacctgaggtcaggagtttgagacaagcctggccaagatggcgatacctgtctctactgaaaaaaaataaggccgggcgcagtggctcatgcctgtaatcccagcactttgggagggctaggcgggtggatcacgaggtcaagtgatggagaccatcctggccaatatggtgaaaccctgcctctactaaaaataccaaaattagctgggtgcggtggtgtgcgcctgcagtcccagctacccaggaggctgaggcaggagaatcgcttgaacctgggaggcagaggttgcagggagccgagatcacaccactacactccggcctggcaacagagtgagactccatctcaaaaaaaaaaaaaaatacaaacattagctgagcatgttggtgtgtgcctgtagtcccagctgcttgggaggctaggagaactgcttgagcccaggaggcggagattgctatgagccaagatcgcaccactgcactccagcctgggtgacagagcgagactccatctcaaaaaaaaaaaaaaggataattgcataggccaactaaacatcatagaaatatcactcctgaattctaaagttttcattgaaaaatacacaaccaagaacagtgaagaatgagtggggtgcagtggctcacatatgtaatcccagcaactctagaggctgaggcaggaggattgttgagtccaggagttcaagactagcctgtgcaacatagtgagacccccatctctccagaaaaaaaaaaaaaaaaaaaggctatgcatggtggtgtgtgcctgtagtctcatctacttgggatgttgaaacgggaggatcacttgaacccaggagttcaaggctgcagtgagctatgatcacgccactgcgctccagcctgggtggacagagcaagatgttaccacaaaagagagagagagagagagagaaagagaagagagagagaaaaaaccctgaaaagaagagcagtgagcaaatactagccctaccacattttaaatcattctataaaatctcattttagttttgatttttgcagtcgtagcttattgcagcccagaactcctgggctcaaacgatcctcctgccttggcctctcaaagcactggcattacaggtgtgacacaaagactttttttgagacagagtctcactctgtcacccaggctggagtgcagtggcaggatctcagctgactacaacctccatctcctgggttcaagcagttctccctgcctcagcctcctgagtagctgggattacagggacaagccaccatgcctggctaatttttgtatttttagtagagatggggttttgccatgttgcccaggctggtcttgaactcctgacctcaggtgatccacccccccttgggttcccacagtgctgggattacaggtgtgagccaccacacccagccagaaagacttttcagtaaatggacggggggtaaattgaataggcatttgacaaaaattgaaattgaacccacactgtataccaggataaactccatatggatcggaaatctaaacgtaaaaattaaatcatgtgttaagtaggtagctccaagggcttgttcatccacagaaacaccaaaaagtaagaaaaaactgctagaaccaacattgtgagaactctggagaatagtaaaagattttcagtaaccaggaaaatgctgaatccagaaagaggcaacctaaaaatggcagaaaagctttgcagcatttttactcactcttgccccaccctgcctccctggctttgttgtgctcttgaagatgacagcccacgttctcaatgtaggaccctggttcctggttccagagggagcggagaagaccttattctcaaagaattttctctgttctaatttgttggtgggctacttgaaggattgacacaaagtgcctacatttgttttgcctaactctaacttattcagggcagaaaagtggctgtgcagagagcattccttaaaaacattgtaaggcaaatgaacaacctgtgcctggcctcagaatgcattttttttttttttttgagatggagtttcattctgtcacccaggctggagtgccaccatgcccggctaatttttgaatttttagtagagacaggatttcgccatgttggccaggctggtcttggactcctgaccttgggtgatccacccacctcggccttccaaaggtgctagggttacaggtgtgagccacaacacctggccagaatgcactttttttttctttttttctgttttttgagatggagtctcactctgttgccaggctggagtgcagtggcacgattttggctaaccgcaacctctgccttccaggttcaagtgattcttctgcctcagcctcccgaatagctgggactacaggtgcgcaccaccacgcacagctaatttttgtatttttttagtagagacagggtttcaccacgttggccaggatggtcttaatctcttgacctcgtgatccgcctgacttgatctcccaaagtgctgggattacaggcatgagtcactgcgcccggcccagaatgcactttttaaagtgtccacaagagactctatttatttatttagtgttgaattggtttattttctaatttgctgttcttaaatatttttatagaaaatagaatattacttaaagtaaaaattttaaggccaggcatggtggctcacgcctgtaatcctaacactttgagaggccaaggagggtggattgcccaagcttagaagttcgagaccagcctgggtgatacggtgaaacctcgtctctactaaaatacaaaaaattagccgggcatggtggcatgcacctgtagtcccagctacttgggaggccgaggcaggagaattgctagaactggggaggcagaagttgcgtgagctgagatcgtgccactgtactccagcctgggcaacacagcgagactccatctctaaaaaatggtaataataaaaacaaacaaacaaaaattcagccaggcatggtggctcacacctgtaatcccagctctttgggaggctgaggctggcagatcacttgagttcaagagttcaagatcagcctgggcaacatggcaaaaccccacctctacaaaaaaataaaaataaaaataaaattagccaggtatggtggcatgtacctggggtcccagctatttgggaggctgaggtgggaggatcacctgagcctgggaggtgaaggttgcagtgagccgagattgtgccaccacactccagcctgggtgatagactgagaccgtgtctcaaaacataaataaataaataaaaatagaaaactccaacagttttctaattgaaagactattataataaggtgagcagaagaaaagcaatcaagatttaggaaaatataatagtgttttgtgtttttaatttattaatttatagtttatacttttaacgcctgggcatggtggctcacgcctgtaatcccagcactttgggaggccaaggagggtggaccacttgaggtcaggagttcaagaccagcctggccaacatggggaaaccttgtctctactaaaaaatacacaaatcagcgaggcatggtggcaggcacctgtaatcccagctactcaggaggctgaggtaggagaattgcttgaacttgggaggtggagcttgtagtgagccaagatcgtgctactggcctccagcgtagatggcaagagagaaactccatctgaaaaaaaaaaattattatttactctaacaatgtcaatatttaattataattataatatcaattataattataaacaaatgaaaagtctaataagacagacttccaacttataccttgaactgtaattttagtaatattctctcatgttgttttgttttctaacagattccacctttccttgtgcgtgcctgcgtgtgtgtgtgtgtgtgtgtgtgtgtctgtgtgtgtgtgtatgccaggtgtcttatatttgagaagagtctcacattaggtccgaagacacaaataggttgaaagtaaaaggatagaaaaacatattctgtgcaaatagtaaccaaaagagagctgaagtagctataccagtattagacaaaatagtctttaagtaaaaaaattgttacaagaggagcggtgcagaggtgcatacctgcagtcttagttacttgggaggctgaagtgggaggattgcttgagcccagcagtactccaactggggaacatagcaagaccctgtctctttaaaaaaagttgttacaagtaagagaaagtcatatattgataatgaggtcaatttattggaagataaaacaattataaacacataccaaataacggagccccaaaatacatgacacaaacattgacagaattgaaggaagaattctacaatagtagttgcagacttcaaaacctacttttatttattttatttttagagacagagtcttgctctgttgcccaggctggagtggtgtgatcatagttcactgcagccttgacctcctagatttaagtgatcctcctgcctcggccaaaatgctgttgttgcaggcatgagccactgtgcccagccaatactcacttttaataatggacagaacaactcgtcggaatattagtaaggaagtggccaggcgaggtggctcacacctgtaatcccagcactttgggaggctgaggcgggtggatcacaaggtcaggagattgagaccatcctggctaacatggtgaaactccatctctactaaaaatacaaaaaaattagccgggcgtggtggcgggcacctgtagtcccacctactcgggaggctgaggcaggagaatggcatgaacccgggaggtggagcttgcaataagccgagatcgcgccactgcactcaagcctggacaacagagtgatactccgtctcaaaaaaaaaaaaaaaacacacagaaaattagtaaggaaatcccagcactttgggaggacaagaaaggataagcaggagtgtcgcttaagcccaggaatctgagaccagtctgggtaacatagtgagaccctgtctctacaaaaaattaaaaatttaattgggcatggtggcacatgcctgtagtcccagctatccgaggggctaaggtgagaggactccttgagcccaggaagttaaggctgttgtagtgtgttgtgattgtgccactgtactccagcctgggtgacagagtgagatcctgtctctattaaaaaaaaaaaaagaagaagaaaattagtaaggaaatagaacactacaaaccaactcgacctaacagacatatgtagaccattccatccaacaactgcagaatgcagatgcttctcacatgtacatgaaatatcctccaggatagaccatatgttaggccacaaaacaagtatctataaattttaaaaagttgaagtcatacaaaagaccttctccaaccacaatggaatgatgctagaattaataacagaagagaaaactggaaaattcacaagtatagaaattaaacaacatattctttttcttttttatttttttgaaacagattctcactctgtcgtccaggctggagtgcagtggcatgatctcagctcactgcaacctcctgcattcaagcgattccccacctcagcctcctgagtagctgggactacaggcacgtgccaccatccccaactaatttttgtatttttagtagcgacgaggtttcaccatgttggccaggctggtctcaaactcctgacctcaggtgatccacctgccttggcctcccaaagttctaggattataggtgtgagccaccacgcctggactccttttttatttttaatttttgtgggtgaaacaacatactttttttttttgttttttttgagacagggtctcactctgtcacccaggctggcgtgcagtggtacgatcatggctcagtgcaacctcgacctccagctactcaccccctgagtagctggactacaggcacacaccaccacacccagctaatttttgcttttttcttttttttttctttttttttttttttttatagagacagagtttcaccatgttgcccaggctgagctcaagagatctgctggcttcggtctcccaaaatgctaggattacaggcatgagccactgcgcccagccaacaacatactcttaaatgacaaatgagtcgaagaagaactcacaagggaaattagattatactttgagatgaatgaaaatgaaaacatgccagatggtatgggatgcagcaaaattagtgctcagagagaactttatagctataaatatttaaatttaaaaaaagaagggccaggtgtagtggctcacatttgtaatctcaacactttgggaggccaaagtgggaggattgcttgagcccaagagttcaagacctgtctgggcaatatagtgagacttcatctctacagaaaaactttaaaattagccaagtgcggtggtgcaaacctgtaatcccaggtgcttgggagtctgaggtgggaggagagcttatgcctggaagggagaggttgcagtgagctgagattgtaccattgcattccagcctgtctcaaaaaaaaaaaaaatctgaaatcaataatctaatttatactttatgacactagaaaaagaagagtaaactaaactcaaaaagcaaaaggagccgggcgtggtggctcacgcctgtaatcccagcactttgggaggtcgagatgggcggatcacgaggtcaggagatcgagactatcccggctaaaacggtgaaaccccgtctctactaaaaatacaaaaaaattagccaggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaactgaatcaagaagtagaaagtctaaacacacctgtaacaaggaaaaaattaaattattattattattattgtgggttttttttttttttgagacagagtcttgctctgttgcctaggctggagtgcagtggcatcatctcagctcactgcaatctctgcctcctacattcaaacgattctcctgcctcagcctcccaagtagctgggattacaggcactgcccaccacacccagctaatttttgtatttttagtagagacggggtttcgccgtgttggccaggctagtcttgaactcctggcctcaagtgattcacccgccttggcctcccaaagtgctgggattactggtgtaagccactgcgtccagccaaaaaagattagtaacaaaaacctccaaaaaacaaaaagtctaaaaccagatggcttcactggtgaactctaccacatatttaaagaagtaactcagtctactcacgctcttccaaaaaaattgaagagaaggaaacattttcttgaggtcagataacacatttcagatgacaccataggagaagaaaccaatatcccttaattatagaggcaaaagtcccgaacaaaatgctagcaaaccaaatccgacagcacaataaaagaattatacaccagggctgatgagatttatctcaggaatgcaagagtgattcaatacaagaaaactggtcattgtaatacactacattattagaaagagagaaaaaaacacagtcatctaagttgacacagaaaaacatttgacaaaatccaacaccctttcatgataaaaacactcagcaaactaggaatagaagggaacttaatgaacatgataaagggcatttatgaaagccaaagcacacatcatactcagtagtgtaacactgaaggctttccctctaagatttggaacaagacaagaatgccggcttcaaccactgctattcaacattcgtaccaggagttttaggcaaggaaaaaaaaatatccaaattggaaaagaaaaaataaaagtatttctgttcacagaggacatggtcccaaatataaaatcacaaagaagtctcaaaagaaaacaacaataaaaaagcggctattaaagctaacgaacaaatttagcagagttgcaggttacaggatgaactcagactgggcgcagtggctcacgcctgtgttcccagcattttgggaagctgaggtggcaggatcacttgagccctggagtttgagacaagcctggacaacatagggagacactctctctacaaaaaaaataaataaataaataaattagccaggcatgttggtgcgcacctgtagtcccagctaattgagaggctgagggaggaggatggcttgagcataggaggtcaaggtggcagtgactggtgatcgcatcactgtactttagcctgggtgatagagcaacaccctgtctcaaaaaaaaaagaaagaaaaaagaaagatcaactcacaaaaatcttgtgggccgggctcagtggcttgtacctgtaatcctggcactttgagaggctaaggcgggaggatcatttgaggccaggagttcaagaccagtgtggtcaacatagcaagaccttgtctctataaagtaattttttgctgagatagggtcttattctgtcacccaggcttgagtgtagttgtgccatcatggctcactgcagccttgacctcctgtgctggagcaatccttccacctcagcctcccaaatagctggggctataggcatataccaccacatccagctaatttttgtattttttgtagagatggggttttgccatgttgcccaggctggtctcgaattcctggaatcaagtgatcctcctacctcagcctcccaaagtgctggggttataggcatgagcccaggcttacaaaataaattttttaaaatttgtataaagattttttttttaagacaggttgttgctctgttgcccaggctggagtgcactggcatgatctcagctcactgaaacctctgcctcccaggctcaagtgatcctcccacctgaacctcccaagtaggtaggaccacaggcatgtgccaccacggctggctaattttttgtagagatgtggtattgccatattgcctaggctgttcttgaactggcttcaagtgatcctgccacctcggcctcccaaagtgctgggattacaggcatgagccacggtgtctggcccaattgtgtttatatacaccagcaatgaacaactgaaaaaggaaataataaaaacaattctattttccatagcattcaaaagaataaaatgcctgggaacaaatttaaccaagaagttgaaagatttgtacaccaaaaactacaaaacattgctgaaagaaattaaggaaggccaggtacagtggttcatgcctgtgattccagcactttgggaggctgaggcagaaggattgcttgagccaagaagttcaagaccagcctaggcaacataaggccctgtctctacaaattatatatatgtatatatatatatatatatatatattttttttttttttttttttttttttttttgagatggagtctcactctgtcacccaggcttgggtgcagtggcgcaatgtccactcactggaacctccgccttccaggttcaagcgattctcctgtctcagcctcccgagtagctgggattacaggtgcttgccatcatgcccagctaatttttttctaattttagtagagacagggtttcaccatgttggcaaggctgctctcgaactcctgacctcaggtgatccaccgccttggcatcccaaagtgttgggattacaggcgtgagccactgcacccggggtctacaaataatttttaagaaaacttaactgggtgtggtcgcatgtgcctcttattcctagctacttgggaggctgaggcaggaggatcacctgaacctggaaggtcaagactgcagtgagccatgattgcaccactgtactccagcctgggcaacagagtgaaaccctgtcttgcttaaaaaaaaaaaaaacaacgcagggtgcggtggctcacacctgtaatcccaacactttgggaggccaaggcaggcagattgcttaagctcacaagttcaagaccagcctgatcagcatggagaaaccctgtctctacaaaaaattaaaagaaaaaaaaaaagcctgggtgtggtggctcatgcctgtaatcccaacactttgggaggctgaagcaggaagatcataaggtcaggagttcaagaccagcctgtccaacatgatgaaaccctgtctctattaaaaaataataataataaaaaaaatagccaggcacagtggcgggtgcctgtagtcccagctactcaggaggctgaggcaggagaattgcttgaacccgggaggcggaggttgcagtgagccaagatcgcgccagtgcactccagcctgggtgacagagcaagactccatcttgaaaaaaaaaattagctgggtgtggtgatgcatgcctgtagcccagctaccagcactctagcctgggtgacaaagtgagaccctgtctcaataaagaaaaaattaaagaggacctatataaatggaaaggcatttcatgttcatgttgaagacatgatattgttaagatggcagtattccccaaagcgatctatggatttaatgcaatccctatcagaattttaatgtcttttcttcagaaatggaaaagctgactcctctaattcatagggaactgtaagagggcctgaacagccaaaagaatcttgaaaaagcaaaacaaaactggaggactcaaacttcctaatttccaaatgtattgcaaagctatagtaatcaaaacagtgtggtattgctgtaagtataaacatatagaccactagaatagaatcaagagtccagaattaaacatctatggccagttgattttcaacaaggatgtcaaaactattcaatggagaaagaatagtctcttcgataagtggtgctgaaaccactaggtattcacattgcaaaagaactcattcacccctacctcatatcatatgaaaatattaactcaaaatggatcaatgacctaagtataagagttaaaattataaatctcttagaagaagtcgtagagtaaatcttaatgaccttaaatttggcaatggatttgtagaacaaaagcataagcaacaaaagaaaaaataattagacttcaccaaaactaaaaatatttgtgcatcaaaggatattatcaaaaagtaaaataacaactacagaaagggagaaaatatttacaaatattatatctaatacgtacagatgataacaacaacaaaaagacaacacagtttaaaaaggagcaaaggacttgaattgacattctccaaagaagacatgtaaatagctaagaagcacatgaaaagatgctaactctcattagtttagggatatacaaatctaaaccacagtgacataccacttcatacccaccggatagccattaaaaataaagaaaagaaagtgttagttaggatgtggacaaactggaactctcatacagtgctaatggaagtataaaatagtacagctactgtggaaaacagtttgttcctcaaaaaattaaacataggctgggcacagtggctcatgcctgtaatcccagctctttgggaggccaaggtgggcggatcacttgagcacaggagttcaagaccagcctgggcaacatggtgaaaccttgtctccacaaaaaaatacagaaagttacctgggcatggtggtgcacacctgtagtcccagctactcaggagactgaggtggaagaatcacctgagccccagaggttgagactgtaataagccaagttcatgccactgcactccagcctgggtgtcagagtgagactcaaaaaaaaaaaaaaaaaaaaaaaaaattgaaaacaggtactcaaacaaatacacacagatgttcatggcaacactattcacaataatcaaagctgaggatgatggctcacacctgtaatcccagctctttgttaggccaaggcaggaggattgcttaagaccaggcgttcaagaccagcctggacaacatatctctacaaaataggaaataaaaaaattagccagtcatggtggtgtgcacctgtagtcttagctactctggaggctgaggcgggaggatcacttgaacccaggaattcaaggttacagtgagctacgatcacaccactgcacttcagccttgatgaaagagcaagaccctttctcaaaaagtcaaaaggtaaaaacaactgaaatgtcaatgaatagataaaatgtagtatgtacatacaatggaatattactgagctataaaaaggaatgaagtaccgatacatattaaaatgtggatgaaccttaaaaacattatgccaaatgcaagaaaccaaacacaaaaagtcacatattgtatgattttatttatatgaaatatccagaataagtaaatccatagagacggaaagcagattggtggtttccagggtttgggagtaggatggaatggagattgacttctttttttttttttccccataaagtgaaagcaagtttattaagaaagtaaaggaataaaagaatggctgctccataggcagagcagccgggattgacttcttaatggatatggggtttcttctggggtgacgaaaatgttttggaactagatagaggtggtggttgcacagcactgtgggtgtactaaatgccacagaattatacaatttaagatggctaacttttatgttatgtggatttcacctcaataaaaaaaattaaaccatgcaagtactaaaagtaagcagggtgttagtggtaaattcctttatcatctgaaagtaaggaaagcctaattctgactcaaagtcaaacttgtgaagcaaaaaaaagattgacaaattaggccaggtgcagtgactcatgcctgtaatagcagcactttgggaggccaaggcagaaggatcactggagcccaggagttcgaggatggagtgagctgtgattgtgctactacacaatcagctactactacctgaacaaccccatcactaaaaaaaaaaaaaaaaaaaagaagtgtacagagaaagaaatgcagatagccattgtacatatgaaattatgcttaaccttccataagaggtatgcaaattaaaactacactgagatattatttctcacctgttagattggaaaaaatccaaaagtttgacaatatactctcttggcaagtctggtgaaactagaaatcctgtacattgttggtgggggtacaaaatggtacaatctctatggaggtacattttgtagtatctcacagaattatagttaacctctgatccaataatccacttttttttttttttttatgagacggactcttgctctgtcgcccaggctagagtgcagtagtgccatctcggctcactgcaagctctgcctcctgggttcacgtcattctcttgcctcagcctcctgagtagctgggactacaggcgcccaccactacacccggctaattatttgtatttttagtagggacggggtttcactgtgttagccaggatggtctcgatctcctgacctcgtgatctgcccacctctgcctcccaaagtgctgtaattacaggcgtgagccaccacgcccggccccaataatccacttttaagaatctattctgaagccatttctatgcaaagttgaaataacatttgcttatttatgtgtttttttagagacagggtcttgctctgtcacctaggctggagtactgtggtatgatcatgcctggagaacagtggcatgatcactgaaggctggaatcctgtgttcaagtgatcctcctgcctcagcctcccaaatagctgggactacaggcatgtgccaccatgcccagataatttttaaaattttttgtagagacaagagtctcactttattgcccaggctggtcttgaactcctggcctcaatgactctcctgcttaagcctcccaaagtgctgggattatggatgtaagccactgctcccagcctgaaataacatttatatacagttattcattgggacattatttaaagtggcaaaatattggaaatgactcagaagttctttagtgcaagagtagttgaaaaagctgtggtgtgtccactcaattgaatactatgcatctgttaaaactaatgaggaagctctatatgatctaatatgaaataatcaccaggatatattattaagtgaaaaaaacaagatgtagaatagtgttaatagtatgttacctatattgtaagtagagaggggaaataaagaaaaaatacatatatatttacaaaaaatacttgctagaagtataaaccagaaacaaaatttattacctcagatttaacaatagggaatggggctgaagggcatgaaggaaatgcagtttctctgagtgtgcctttttgtatagctttgacttgtgagcctgtaaatgtttttcaaaatataaagttaagaaaagaaacaaaacctaaaattgcaaaaaaagaaagaaatgaccctaactgtatatcaaaatagtaacataaccacatgggtaaaataatttttcaataactttagaatactttatcagttctttggtgggacaaaaagaactataattgtaatccttattcagtagtttaattgttaatagtgatattgatactacagtgatattgatactatgtatatagtgtgtgaatatatattttatatatatatatatatgcattacagagtagcaaataaggaattatgttcctgttattaggaacgaggattttcaaagtaagataaattagatgaaagtataaattcaaaagacttttaaaatactgtaatgataaatatgaattggcaatatcaatatgaattctggtttttaagtgctttttctagtactatgcattggcaaatgtagcatgagctcctttagcaactagattttggtctctatgtaccattatccactaaaagtaaccaggattccatggggaaataacttgatttttggtctagagcagggtttttttaaagctttgtagaaattactctccatcccaggagttttttttttgttttgtttgtttgtttgtttgtttgtttattatactttaagttttagggtacatgtgtacaacgtgcaggtttgttacatatgtatacatgtgccacgctggtgtgctgcacccattaacttgtcatttagcattaggtatatctcctaatgctatccctgccccctccccccacccaaccagcagtttgtttagaattttttttcctaattacctcctaccacatgaaattttaacaccacagatatatcatatatctgtttatgtattgtgaccatttaccattggaatagctaagattttgttacccccaccaagaaccaattttgtttggaatgcatggctgagggcaaagaaagcccaggatgatcttgcagcatgttgtaaaggaaagcaaggaaacaatcaagcccaaagaggctcccagtgaccaaaattgggacaatttgggcattaaaaagaataattatgtagttgattgaagtacactgaatgtagctactcaggaggctgaagtgggagtatcgcttgagcctaggaatttagaccagcctgggcaacatagctagatcttatctctaagaaaattaaaaagttagccaggcatgatggcacacacctatagtcctagttactcagtgggctgatgttggaggattgcttgagcccaggagtttgaggctgcagtgaactgtgctagcatcactgcattccagccactgacagagtaagagcctgtctctaaaacacacacacacacacacacacacacacacacacacacacacacacacactgaatatatataataaaaatccacaagctcataatgaatgaaaacaagagctgggtgctaggtgaggtagctcatgcacctgtaatcccagcactttcgaaggccaaggcaggggaatcacttgagttcaggagttcgagaccagcctgggcaacatggtgaaaccccatctctacaaaaatacagaaatgagctaggcattgtgctatgcgcctgtagtctgagctactcaggaagctgaggttggaggatcgcttgaacctgggagtttgaggctgcagtgagctgtgatcgtaccacagcactctagcatgggtgacagagcaagactctgccccccccccccgccaaaattaagtaaataagacaaattaatactcatccagcactattggaaaatatttttcactaactctctactctgaaaaccaattaaagggaaataaacattctgccttttcagtgagaactgtagttcagtataatcaaatagtcccatttgcagaaggaaagctcttctttacagagaatatgccagttgatggtggagaactagacattcctcaaaggatcacccctaatcagaaggggaaagcttcacaatgagatcttgttggtgccaccttaacctagttagtaaacttagccttacttataatgggacaatgaggcaatatgcctccagtatgatgcaatatacagcacatgggatcacctcttaaagtattcttaacaaaattatttaacataaatcagttaagttagatcaatttccagttaataggaaatacaagggatagtgaaataagttaaatgattctatgtggaaacaattagacaagtccagaatgtgggacatgaccttctgcaaagacaactggcctgttcttttctcttttctctctttttttttttttcttttttgagatggagtcttgctttgttgcccaggctggagtgtagtggcatgatcttggcttactgcaacctctgcctcccgggttcaaggttcaagtgattctcctgcttcagcctcccaagtagctgagattacaggcgcccaccaccacgcctggctagtttttgtattttttgtagaaatggaatttctccatattggccaggctggtcttgaattcctgacctcaggtgatctacccgcctcggcctcccaaagtgctgggattacaggcatgagccaccgtgcctgaccttcttttcaaaaagttactatgggctggggatggtggctcacgcctgtaatcctaacactttggaaggctgaggcgggcacattgcttgagcccaggagttcaagatcagcctaggcagcatggtaaaagcccatctctactaaaatacaaaaaattagccaggagtggtgatatgtgcctgtagtcccagctactcaaggtgctgaggtgtgatgatcgcttgagccaggaggtcaagacggcagtgagctgtgatcacaccactgcactccagcctgggtgacagcgagaccctgtctcaaaaaagttactatgaaaaaaggagaggctgcactattctagattaaaagacacttcaaagacataacgagatgcagtgcatggttcatgtttggatgcttttataaaagacatttgggggaataattgggaaaatttgaatatggactgggtattgaatgatactaggcaataatttttaattttgtttagcttgttaatggtgtttggctatgttggaaaaatttctttatatatatcttttctcttctcttttttttttttttttttttgagacagagtctctctctgtcgcccatggtagagtgcagtggcacaatctctgctcactgtgcaacctctgcctcctgggttcaagtgattctcatgcctcagcctcccaaatagctgggattacagtcatgtaccaccacacccagctaattttttttttttttgagacagagtcttgctctgtcgcccaggctggagtgcaatgatgcgatctcggctcactgcaacctctgtttcctgggttcaagcaattctcctgcctcagcctcctaaatagctgggattacaggcatgtgccactacacccggctaatttttgtatttttagtagagacggggtttcaccatgttggtcaggctggtcttgaactcctgacctcgtgatctgcctgccccggcctcctaaagtgctgggattacagacgtgagccactgtgcccggccttaatttttacatttttagtagacggggtttctccatgttgaccaggcttgtcttgagcttctggcctcaagtgatccacccaccttggcctcccaaagtgctggtttacaggcatgagccaccacacccagctggaaaaatatcttatattttattattattattgagacagagtttcactctgccaccaggctggagtgcagtggtgcgatctcagctcactgcaacctctgcctcccaagttcaagcgattctcaagcctcagccttccaaatagctgggattacaggcatgtgccaccatgccggctcatttttgtatttttagtagaaatggggttttgctgtgttggccaggctggtcttgaactcctggcctcaagtgatccacctgcctcgacctcctaaagtgttaggattacaggcatgagccactgcacccagccatttcttatattttagagatgcattttgaagtatttagaggtgacatgtttcataatgtctgtcatttattttaaaacactttagcatgcagaaatagatgaaacaagtatggcaaaaatgtcagtgtgttaaatctaggagacgggtatatgggcattgactgcagcagtctttcaactactttttaaaaatatatgtttgaaaatgttcataatataacgtttaaaaaattgaaaatggtttggttgaagggtccccaggaaatgctacttctcagccaaggaagggtaagttggctttgacttatgttgagaacgtgtggctcctggattcttcctcatatgtctttttttcttccctctcccttcaccctacctcctttccagccctctttgattccatgcacagcagccaggcctcagataacccattttctccaccacgtactcttcattcacctcccctgcaactccagcagcgctctgagaagcccccttggtgtaagtaatccttttggaactgcctagacaaaagtcatgaagactggagtgattggtgaatgaggggcctgttgcatgaggtcaaagaaggtggggcttgaaagaccaggaatatccattctgggaagcagtctcatctgccatttctaagatgaaaggagaatctgtttattctctctctttacctctttacctctgttctccatgttccttctatttcattggagagaaggttttctgcagtattaggaataattgttttttttttttgagagacagagtttcgctcttattgcccaggcacgatcttggctcactgcaacgtctgcctccctggttcaagcgattctcctgcctcagcctcccaagtagctgggattacaggcatgcaccaccacgcccagctaaattttgtatttttagtagagacggggtttctccatgttggtcaggctggtctcaaactcccgacctcaggtgacccgcctgcctcagaggaataatttctaatttggagagaagttcttcctcaaagcgctctttggggaagaaagaatggagacttcattcccctttcatccctatttgatctctacagttttctccagtaaagatgactagcagacaacctagatatttagaaaagctgggagcaggaggccgggcatgatggctcacgcctgtaatcccagcactttgggaggccgaggcgggcagatcacgaggtcaggagattgagaccatcctggctaacacggtgaaacccctgtctctactaaaaatacaaaaaattagccgagcgtggtggtgggtgcctgtagtcccagctactcggaaggctgaggcaggagaatggcagagcttgcagtgagctgagatggcgccaatgcactccagcctgggcaacaaagtgagactccgtctcaaaaacaagcaaacaaaaaaggctgggagcaggagagactagaatctgctacttatttctacataacccttctctctgttgcctgttttcaatttttagtttaagttgagatgctgctttttcccatcttgtttattatctctaatctatcactagttatttttggtaacaatgtgaacagtggagccacacagagttgttagagtgactatagagaggaggagctactggtggtaattggaggtgggaatatgggccagaggcactggtgaagtatcatcctgcctccggggaataactgaaatcaaatatgcctttcattattttatttggataggaccgaagtaaagattcttacttcattcagcattggacttaacagttgtagaatttttgccctttttctggcatcctgtttgaggaagaaactttcctctctgacaccaagaattcctcccctgaatttcagattatcctacactctttgtagggccattgccctttttacctgtttcctggagtgtttatgatttctgtgcccctggaaatcttacccttctccctcttctgtttctgtttgacctttttgatttgcctgaatcagaccactagcaggatattaaggctacttctttacttgggtaaagctcagcttacatcttttctttttctttttttccatctagtatcagatttttgactcagtatcaggtgtgtagcctcactggtaaacgtcttctttagggtctgtatgtctgcatcagaaataggctccacatctcttaaagccttgttggttcaaaaccatgatcttctctctctctctctctctctctctttttttttttttttttttgagatggagtcttgctccgtcacccaggctggagtacagtggcgcgatctcggctcactgcaacctccacatcccaggctcaagtgattctcctacctcagcctcctgagtaactgggattacaggcacgtgccaccatacctggctaatttttgtatttttagtagagacggggttttgccatgttggccaggctggtttcgaactcctgatctcaagtgatgcacccacctcagcctcccaaagtgttgggattacaggcatgagccaccgcgtctggcttctttttctgcttgaagcatgcctcctttgattcttttttttttttttttttttttttttttgaggtggagtcttgctctgtcatccaggctggagtgcaatggtgcaatctcggctcactgcaacctccgcctcctgggttcaagtgattcttctgcctcagcctcctgagtagctgtagctgggattacaggcatgcgccaccatgcctggctaatttttttttgtatttttagtagaggaggagtttcactatgttggtcaggctggtctcgaactcctgaccttgtgatctgcccacctcggcctcccaaagtgctgggattacaagtatgagccaccgtgtccagcccctcctttgattgtttacagaagagagataactagcataccttcaactcaatgatggattgagcctttgtaggctcaggtttaccaacttttcaaggttttcttcaatggcaatatgttctgatgttcccttttcccagaatctgtcattattgataccatagtgctttaatatatcgttataatattatcaacaaaaatgatgtttaccaagggaaaagtaggttagtcaagtactagagggcgatgaagcagtagaggatggagtaggaatcatcccacagtgtaattgaagactctgaggtctttattacactactgtcaggatgtaggaaatcagtttttaaatgttttccgtgtatataatatgcacaagcctgtaacattgtatgtcccaagacttacaagcgtcttaactctggatccatagatgtggtttcagggtagggtctgtgagcttcaggaatcacatgtaaagattagtgtgaatattcttatatagatttttcctggaagatatctgacttagtacctcaaaggggccactgacccctagaaaggttaagaactgccatgtagaaattccatggccatcttccatttttgggtaaactattttctttttttttttttttctgagacagagtcttgctttgttgcccaggctggagtatagtggcacaatttcggctcactgcaacctccacctctggggttcaagtgattcacctgcctcagcctcctgagtagctgggattacagacagccgccactacgcctggctaatttttgtatttttagtagagacaaggttttgccatgttggccaggctggtttagagctcctgacctcaagtgatctgcctgcctcggcctcccaaagtgctgggattacaggcgtgagccaccgcacccagccaggtaaaccattttctttcctattgttctgatttacatggtttttctacattcttctgccaacttatcatttgggctataaataatgattacctctgccccagaaatacattgattgctttaaagaatgattcttaacagaaggtgtacatcagattcaaatgagagtgttccaacaaaattatattgccttcttcctcctccctcctccaaactacacctttacgctaaacctatagaattagaatctctggagttgaaaactggaaattagtattttaaaaaattttttcatgattttgtttatgaaccactgggctaaagtattcatatgcttccaaagtaggaatgagaggccttgggaacttggaattgggatgggagtgtatttgtgaaagaaccagatgaagtgggtcttagcactctctcctgaagtcttagatgtaccttattgttactctcaaagtatacattaggccagggtgacagttcctgaggtaagcaaacttaggagtctctgcttaacttaggaagaatttggacactcttccctcaagacataagtagcataggccaacaattctagcatttgaactatctgcacagggtagagcctactcttccagcttctctaacttgatctcttgactttgctttacagacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaatggtggtgatgga

SEQ ID NO: 670 - DNA, 4649 bp, Homo sapiens
cttggatttcttaagaaacagccaagtctttgtgtctgcttctctggacccaccgcagccctggccagaggcaggcatggggcgccacgttgagagagcttcctagaggactcaccgttggccggtgcaggctgcaaaatgtgcgcagtggcggagagacgctcctccagccatgtgcacggcgacaatcccaggtagagctggaatgcaggctgccccgagatccccacctgctgacgcttccccggcaggaatcggttaaacggaacctctagtcatctcggttttagagcggtcttcacgccacagccctccgcgcccaggtcctccgaagttgggacaccgcccacgtttcccccgtgacgcgggcgcgggggctcgggagttgtagtctcgggcagggcgcgggcaccgaggccggggctgcgcggactccacgtcccggcgggcggcgcggcgaggcctggggcctccaggggcggggccgctcggccctttaaacctttcagggctgctccgagggccgcagctagagtcggcgccacgagggggccgagcagggtgcggcggcggcggggcgctccggggaggtgcgtactgggctccttcccttcctccgggcttccaggaatcacctggggactctcgcgtcccgggtcctggggggtcgccggccgcagggtccggccccagccggggtccccgcgcccaggcgagcgggggccgggccgggctgggctttccgcgtgaacccgcccctcgcccagggcgccgatggtcaggtggttgcctgcgcgccgccgactcgccaccgctccactgggccggcacccagcctctccttggcgtggcctcttcggttgtccagcccttctcccagccctggtccctcagaaggagggtaactcccttccagatgttacggtccgcctgcgtctctcagcacgccggtggcatttgggttgaccgcggaggcccccagtgccagagggtgttcacgttctgccgtgggctcagcccaaactttggacgctcagagacccaacgggagcgctggataaggtgttgacccccttcccctcccccttcccggccagttacccactcctggactttgatctctctccaccaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtgagtaaaggggggtgcccggggggcaacaggagcttgatgacgcacacaaagtctcttgtcctgtcatagccacggtggtacccagggtcactctgggtgtctcaaaagcctgacttggtgcctgggcacacagccccttgggacaagctggcaccactgctgtccagcagggtggccctgacaaatatacttctagccagggcaatttccagagggcctgtagctgggggcatgctgcaggtgctggtgtggcatcaagccttagggacctcaacttgagtccccagcaacaataatgaggctgaatggggccagaaatcaaggttgaagagaagggtcatggggtgggttgagtggggctcgggaaggctgccagggtgacagttctgttcccacaggtatgccatggctgtgatgaaccaccatgtatgccctgtggagaactggtatgaaggactctgcagacaaccttgctctaaagcttccttcatctctgtcccctcttgggcctgaggctgccacgagccagactgcaaccctgagcctcactgctcttctctgaaattggtccccaggcatggcttcttgccacctacccacttcccactatccctttgcccctttggttactgcttcaggcgggcactggggagtgggatcttctgtccctgtaggggaggtctgggagagagtcctctttgaggcctgaggctataggccaagggcctgggggcagtcccttcccccagtctactccctgtcctgcctgccaggtcctacaacgagtcctgccctcctgaccctgctgagcaagggggtcccaagacctgctgcaccctggacgatgtccccctcatcaggtaaggcctggacattgggccggtcagggagatctaagggcctcccagacagcccctcaagcaaagagctgtccttgggtctcaggaacaataagtatcctaagagccacttaataacaacactacttgacagttactgtggggcaggcactctgctgagtgctttatatgcattgtctcttttcatcctcccaggagtgaggcaggtattgttttcaccattttataggtgaggaaacaggctcagtcttcctcatccaggtcacacagctaataagcggaggcacctggatttaagctggagccctcagattgcccagcccgtgttctggctcaaggatagccaaaccagccgcagggctcagcaaagagtgtcagggttgcccgaacactcctgggcactcccttctctctcacacacatgagctctgctttgggggcccagcctggaaccagttgttcatgagggaccctggatcttcacataaatcagtggcctgcctgctaaggagcaggtgcaggtaaagcaggggagagccagtgagccaaaatgggggccccccgggcctcctgcacccctcttactctgtccttccccctcctcgcagcaagtgtggctcctatcccccagaaagctgcctcttcagcctcattggcaacatgggtgctttcatgggtgagttgtacccttagccctgaccctgcgtgcccagcccagtgatccccacacagaaaggcccaggaagcccttctgtgcagccctccccaccaagggctaaggcaatagaggcagcttctccccttccttgaaggccaaaagctgactcccacacagccaccctgctggctggagcctgaggaaacctagttcaccacccgcctgtctgttcctttctgcccctcagaaggggcaggagcaccacagcgtctgggggaagctgacaggctcgctgggcagggccagggctggaggaaggcctcaactgtgctctcctcccccagtggccctgatctgcctcctgcgctacgggcagctcctggagcagagtcggcactcttgggttaacaccacggcactcatcacaggctgcaccaacgctgcgggcctcttggtggttggcaactttcaggtgcttccccttctcccctgcaaaccttaaactttacctaacaaggcctggctgcctgcagtgtggcacctcaaggttggggctggaaagagggagaggaaggaagagggagagaggagattcattgaaggaggggtggagaggtggggccatggccacatcaccaactggcccttctctgggcccaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtatcctttcaggacggggcagccaggaactcatcctctagctcaacctttctccctcccaagaggatggggggtggaggcctaacactgccatgtgggggagaggactaacacctctccctttggagaggtgaggcctgagactgcagaaggggtgttgccaggtttccgtatgtcctactgaacatttccttagcctcgttttaggtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgc

SEQ ID NO: 671 - DNA, 37246 bp, Homo sapiens
atgcacttgggtagaagaaccagctgtgcagtgtcaagacccttccctcagagaccttatcagtaaaatggcgggtggactcggggatgcccgaagacttttccggaccacgattttccgatgctggacacatatttaaacatgaaggaatagacttgcgacttttaagcgcaaacaatgggtggaaatggacagaaactgcctccgtgcccacttgcagcggactacgtagccctggcagacaggcaattgcttcaaacaagcgccctccaagggcgtaagctagaggggcccgggcgggcgctttcccgtggaccctcccacctcgcgggtagaggaagtccttcagttcaggcacaaccctgagcgtcccccgcagtctccaactccggcgccagtcaggttgtggggtgggggcggcggagggcggagagcgcaggcgcagagtccgcgcggcggcgcccctctccctccgcagtactccgggcagcgcccgcctcgattttcccaggcgagggcacgcccgcgtcagtcgcctccggggcaccttcctcgccacgacacgcaggtaaccgggccccgggagccggtcggcggcggcggactgggaccttgatcctgcctgcccggccgcccgacaagggaatgagagcggaccccgaactccacacacccgcgtttagccgccacacctaaggggcacaacagtctttttgggtaagggccgggctgggggcgacgcgccccgcccgctttgcagacttcggggtgctctgcacgacgcctgaaaggccgcggggcccgcatttctctgtgctgccctcctggagaaccgggacacggggacgggagggccagcatcggctacggcccggtttcccgtttctttccgctgtcgcgtgtctgggccctcctgcagcgtccatgatgaaggccaggggctgttgctttcctctcgcccagtagccaacccaagcaaggggtgagtcactgtggcgtcatatgggatcaatttcaaatacaagttttaaaaaaggctggatgattttagaaatatggccaagaatttgtattttccattactctcttgtctcatgtccatgactcttgaacgccagtctgtgggcgctgagattttcgtggtacatcgacggtttgtagacatcttttcccaagggaagacgagggcaagggttagtggaggaagggcctcgtcacggccgagagtggcggagaaggctcagggcaagtccgcacagcctccagcagccacggggaggaaaaggcgaatctttcctcacagtgctctgggcgctgtagaatttctacgccacgtgcacccatttggcctcatttgagaggaggagagggaagaagggtcgcgcgggccggcaggaaagagactcgtgttgcggcggatgaaggctcagcgcggacctgcatctcgggccaggttttctttcacccggctccgcgaggagcgaggcggaaagctcgggtccgagtgttgatcgaggacctggagatagtaaccccccacgtccagagtgctgggggtgggtccagagggctgggggtaggtccagagggctgggggtagctccggaggagcgatcttcctccgcgggaaaggacttggctcaggcttgcctatgtccgtggtgctgaagtgcctcgcgcgccctcgtcgactgacttcctgggccgcggcctgcgttgcccttctactctgcacctttgccaaaaatagcccatctccatggctggtggccagagtggagcaggcccaacactgaaactcttttcagacaagttgaggctggtttcctgaacataacccgaaagcaaatgtggcttgccttggaggtacagataagcatatgcataacagattttattacctatgagaaagtacacaccatgagcgtaaacaggaattctcacatatacttatgaaagatacaggtatgtgcatttacgcacaaacctaacacacatgcaaatacactcatcccttttgaaaaccattacacactacaagccacacattttttagagcttttgtaatccatctttattttttgacacttctagtaaatgtgaactctgcagagccatttattttcataatcatctgttccaaaggcacagagcctgtggattgaagtgtttggtatttggctgagcaattaagtatttatactcatttacattccagaacaaaagtctaggaagatgtaaaattgatattgataccaaaaaaattccttaaagaaagcttaaggaaaatgaattaatgtaaattttaataagaacaacatataaataatcatagaaatttataatcttaacatatgactaaaatgtatcataatgcagacaattttaaatatattggtggtatgtggtttgtgtgaagttcttaaagtttacatttgtatttttcaaaaacattggtattgttttttccttaaaaaatatatgctcattataagaattttaggtaatagagaaatgcataaacatagaaaaccattgtaaacagattttcatttagatgaacatgcatacattttaaatggaccaatcctctattggttgcgtttttgctatataatttataattaatgtctttcatcataaaactaggtcatcattattaagggttgcataatattgatctgtgtggatagaatgtaagttttttaaacaatcccataatgaacatttatgtccaattttttagacttaaaaaaattattgtggaaagaatatgtaacatgagatctatcctctgaacaaaaaaaaaatttttttttgagacattgtcttgcttgttgcccagactggagtgcagtgacgtgctctccgctcactgcaacctctgcctcccgggttcaagggattctcctgcctcagcctcttgagtagctggccaccgcacccagctagtttttatatttttagtagagacagggttttaccatgttggccaggctggtcttgaactcctgtcctcaggttatctgcctgccttggcttcccaaagtgccaggattacaggcgtatgccactgcacccgggcctgccttcttaacaaaattttacgtgtataatacattattgttgatatgtattgttgataggtgcaatgctgtatagcagatctttagagcttatgcatcttgcttgactgagactttatgcctgttgattaataactcctgattttcccctgccctccagtccctggaaaccaccattctactcctcgattctatgactttgactacttcatttttatttctatttatattaatttttaatttttgttggtacataggtatatatatatttacggggtacatgagatgttttgatatagggatgcaacatgtttaataatcatatcatggtaaatggggtatccatccccttgagcatttatcctttgtttttataaacaatccagctgtactcttctaatgattttaaaatgtaccattaaattattattgactatagtcatccttttgtgctatcaaatactaggtgttattcattctttctactttttgtatccattaaccatccccagttttccccacacccccaactctctctcactacccttcccagctctggtaaccaccatccttctactctttttctttttttgagattgagtcttgctcttgttgcccaggctggaagctggagtgcagtggcatgatcacagctcactgcaacctctgccttctgggttcaagtgactctcctgccttagcctcccaagtagctaggattacaggtgcccgccaccacacccagctaatttttgtatttttagtagagatggggtttcaccacgtttgccaagctggtctcgaactcctgacctcaggtgatctggctgcctcagcctcccaaagtgctgggattacaggcgtgagccactgcgcccagcgtactctctatctccatgagttcaatttttttgatttttagatcccacagataagtgaaaacacgtgaagtttgtctttctgtgcctggcttatttcacttaacatgatgactttcagttccatctgtgttgttgcacataacaggatctcattcttttttatgcctaaatagtactccattgtatgtaaatatctgttgatggacacttacgttgcttccagatcttggctattgtgaacagtgcggcaacaaacatgggaatgcagataactcttccatatactgatttcctttcttttggttatgtacccagcagtgggattgctggattgtatggtagctctatttttatttttttgaggcacctccaaactgttcttcatagaagttgaactaattaataatctcaccaacaatgtgtgagagttccctttctccacatccttgccagcttttgttattgcctggcttttggataaaagccattttaactggagtgagatgatatctcattgtagttttgatttgcatttttctgatgatcaatgatgttgagcagcttttcatatacctgtttgctatttgtatgtcttcttttgagaaatgtctattcagatcttttgcccatttaaaaattggatcattagatttattctgatagttatttgccattccttatgtattctgattattaatcccttgtcagatgggtagtttgcaaatattttctcccattctgtgggttgtcttttcactttgctgactgtttcctttgctgtgcagaagcttttaaacttgatgtgacaccatttattcatttttgctttggttgcctatgctggtgtggcattactcaagaaattttagcccagaacaatgtcctggagagtctccccaagttttcttgaagtagttttatagttcgaagacttatatttaagtctttattccattttgatttgatttttctttttcttttttttctttttgagatggagtctccctctgtcactcaggctggagtgcagtgagtgcagtggcttgatctctgctcactgcaaccgccgcctcccaggttcaaacgattctcctgcctcagcctcctgagtagctgggattacaggcgcgcgccaccacacctggctaatttttttttttttttgtatttttagtagagatggggtttcagcatgttggttaggctggtctcgaactcctgaccttgtgatccacccacctcagcctcccaaagtgctgggattacaggctgatttgatttttctatgtggtgagtgataggggtctagtttcattattctgcatatggatgttgttttcccggtatcatttattgaagagactgtcctttctccagtgtatgttcctggcacctttgtggaaaatgagtttactgtagctgtatggatttatttctgggttctctattctgtgtcatgggtctatgtatctgtttttatgccagtaccatgctgttttggttactatagctctgtagtataatttgaagtcacgtaatgtgattcttccagttttgttctttttgttcaggataactttggctattctgggtcttttgtggttccatataaattttaggatttttttttctatttctgtgaagaatgtcattgctatttaaacaggaatttcattaaatctatagattgctttgggtagtatagacagtttaacaatattgattcttccaatccatgaacatgaaatatttttccattttttggtgtcctcttaaatttctttcacaaatgttttatagttttctttgtagagatctttcacgtctttggttaagttaatgcttaggtatttaatttgatttgtggctattgtaaatgggttacttttttgatttccctttcagatcgttcactgttggcatatagaaatgctgctgacttttgtatgttgattttgtgtcctgcaactttactgaatttgtttatctgtaaacagtagtttactaatgaattctaaagttctagcagttttttgccagagtctctaggtttttccaaatataagatcatatcatttgcaaacaaggataatttgtcatctgcttttccagtttggatgtcctttatttcttgcttttttaaaaaaattatactttttaagttctagggtacatatgcacaacgtccaggtttgttacataggtatacatgtgccatgtttctttgctgcacccatcaactcgtcatttacattagatatttctcctaatgttatccctaccccagcccctgactccccacctaccagccctggtatgtgatgttcctcaccctgtgtccatgtgttctcattgttcagctcccacctatgagtgaaaacatgcggtgtttggttttctgaccttgtgatagtttgcttagaatgatggtttccatcttcatctatgtccctgcaaacgtggatgtcctttatttctttatattatctgattgctgtagctaggacttccagtactgtcttgaataacagtggtgaaagtggccatcctttttctagatcttgaaggaaaggctttcagtttttccccattcaatatgatactagctgtgggtctatcgtatataactttttttttttttttttgagacagagccttgctctgttgttctggctggcgtgcagtggtgccatcttggctcactgtaacctctccctcccaggttcaagcaattctcatgcttcagcctcccaagcagctgggactacaggcatgcaccaccataccaaggctaattttttgtatttttagtagaggcaaggttttgccgtgttggccaggctggtctcaaactcctggactcaagtgacccgccccctcagcctcccaaagtgctgggattacaggcatgagccaccttgcccagccatatatggcttttattatgctgggatatgttccttctgtgcccagttttttgaggatttttatcatgaagggatgttgaattttatcaagtgctttctcagcattaattgaaatgattatatgatttttgttctttattctgttgatataatttatcacattgattgattcacacatgttgaaccatccttgcatccctgggataaatcccacttggtcatgatgaatgactgttttaatgtattgttgaatttgctttactagtattttgttgaggatttttgcatcagtattcattagagatattggcctgtagttttctttctttgatgcgtctttgttagttttggtatcagagtaatactggcctcatagagtgagttcggaagtattctctcctctatttttgggaacagtttgaataggattagaatgcttccttaaatgtttggtagaattcagccatcaggtcctgggcttttcttttctttattttattttattttattttttaagacacagtctcacactgtcgcccagcctggagtacagtggcgcgatcttggctcactgcaagctccaccttctgagttcacgccattctccttcctcagcctcccaagtagctgggactacaggtgcccgccacaatgcccggctaattttttgcatttttagtagagacaggggtttcactgtgttagtcaggatggtcttgatctcctgacctcgtgatccgcctgtctcggcctcccaaagtgctgggattacaggcatgagccaccacgaggtcctgggcttttctttatggggaggaaaagaactttagaattcagtaaagttgcaggatacaaaatcaacatacaaaaatcagtagtattttattatgactttgatcttgttacttgttattggtctgtctaggtttcaaatttcttcatggatcaatcttggtgttttatatgtgtctaggaatttatccatttcctttggattttccaatttattggcatatagttgctcatagtagccgcaaatgatcctttgaatttctgtggtatcagttgtaatgtctcctttttcatctctaattttattttattatttatttatttttttgagatgtggtctgtcacctaggctggagtgcagtggtgcagtcgtgatgcactgcaacctctgtctcccctggctcaagcaatcctcccacctcagcctcccaggtagctgggaccacaggcatgcaccaccacacctggctaattttttatatttttggtagagatgaggtttcaccatgttgcccaggctggtctcaaactcctgagctcaagtgcctgcctcaccctcccaaagtgctaggattataggcatgagctaccttgtccagctgcctctgattttatttatttggatcttctctcttttttcttttttttttttttagtatttattgatcattcttgggtgtttctcggagagggggatttggcagggtcataggacaatagtggagggaaggtcctctctttttcttagtctgactaaaggtttgtcaactttgtgtatcttttaaaaaaacccaactttttgtttgagtgaccttatgtattttcatttcaatttcatttatttctgctctaatctttattatttattttcttctactaagttttttttttttccttttaaacagagtcttgctctgtcatgcaggccggagcacagggacatgattatagttcactacagcctcaacctcctggtgcccaagtgatctttctacctcagactcctgagtagctgggactacaggtgtgcaccaccacgcctggctaagttttgtattttttatagcgatgaggttttgccatgttgccaaggctggtctcaaattactgggctcaagcaatctgccggcctcagcctctcaaattgctggcctcttctactaattttgggtttggtttgctcttgcttttctaattctttaagatgtgttattaggttacgtatttgaagtttttcctctttttttgatgtaggcatttatagccgtaagtttctgtcttagtactgctttcactgtatctcatagcttttggtgtgttgtgtttccattatcatttgtttcatgaaatttctcaatttccttaatttcttcattgacctattggtcattcaggagcatattgcttaatttccatgtgtttgtatagtttccaaaattcttcttgttattgatttctagtttacttgtggtcagagaagatacttggtatcatttcagggtttttgtttttttttttttgagacagggtcttgctctgtctgaagtgcagtggcatgatctcggctcactgcaacttccacctcctgggttcaagcgattttcctgcctcagcctcccaagtagctgggactacaggtgcacgccaccatgcccagctaatttttgcattttcagtagagatggggtttcgccatgtttgccaggctgatctcaaactcctgacctcaggtgatctgcccacctcagcctcccaaagggttgggattacaggcgtgagccaccgcacccaacctttttaatgttttaagacttgttttgtgacttaacatgtgttctatccttgagaatcatccatgtgatgagaagaatatgtattctgcagcagttggatgaaatgttctgtaaatatctattaggtccatttgttctatattgcagattaactccaatgtttctttgttgattttctgtctgcacgatctgtccaatgctgaaagtggggtgttgaagtctccagctattattgtattgaggtctctctctttccctgtaatgtttaatttatatatctgggtgcaccagcactgggtacatatttatttatagttgttatagcctcttgaagaattgacccttttattattatataatgaccttttttgtctcttcttacagtttttgtcttgaaatctattttgtctgatattagtataactacttttgtccttgtttggttttcattggcgtggaatatctttgtccatccctttattatttttggtctatgtgtctctttataggtgaagtgtgtttcttgtaggaaacagattcactgggtcttgctttttaatccattcagccagtctgtgtctttggattggagaatttagtctgtttacattcaatgttatcaataagtaaggacttctgccattttgttacttgttttctggttgttttgtggtcttctcttcctttttaccttccttcttgtcttttggtaaagatgattttctcttgtggcatatttaatttcttgctttgtgtgtgtgtgtatctgttgtatgttttttgacttgaggttaccatgaggcttgcaaatactgtcttataacccactattttaaactgatgacaacaaagattgcataaacatgcaaaaaagaaaactaataaaaactctacactttaactttatctctctgctttttaactttttgttgtttctctttacatctattgtactgtctacgtcttgaaaatttatttttgattggcttatcatttagtctttctacataagagcagtttacacaccacaattatagtgttataatattctatgtttttctatgtgcttactatcaccagtgagttttgtacctttagatgactttttttttttttagatggagtcttgctctggcaccaggctggagtgcagtggcgccatcttggctcactgcaacctccgcctcccgggttcaagcgattctcctgcctcagcctcccaagtagctgggacttcaggcggccgccactatgcccggctaatttttgtagtttttgtagagacggggtttcactatattggccaggctggttttgaactcctgaccttgtgatctgcccgcctcagcctcccaaagtgctgggattacaggtgtgagccaccgcacctggactcctttagattatttttcattgctgattaatgttcttttctttcagattgaagaactccctctagcatttcttgtagaaaaggtctggtgttgatgaaatccctcaacttttatttgtctgggaaactatttctccttcatgcttgaaggatatttgcaccagctatactactctagggtaaattttttttttcccccttggcactttaaatatgtcttgccactatctcctggcttgtaaggtttccactgaaaagtctactggcagacatatgggagctccattatatgttatttgtttcttttctcttgctgcttttaggatcctttctttatccttgatctttgggagtttgattattaaatgccttgaagtagtcttctttgggttaaacctgcttggtgttctatagccttcttgtacttgaacgttgatctctttctctaggtttgggaagttctcatattatttctttgaataaactttctacctctatctctttcactatctcctctttaaggccaataactctgagatttgcccttttgaggctgtttctagattttttagacatacattatttctttttttttttttttttttttttgagacggagtctccctctgtcaccaggctggggtgcagtggcgcgatctcagctcactgcaatctccgcctcccaggttcaagcgattctcctgcctcagcctcctgagtagctgggattacaggcacacaccaccatgcccagctactttttgtattattattattttttttgagacagagtcttgctctatcgcccgagctggagtgcagtggcgccatctcggctcactgcaagctccgcctcccaggttcacaccattctcctgcctcagcctcccgaatagctgggactacaggcgcccgccaccacgcccagctaatgtttttgtatttttaatagagacagggtttcaccgcgttagccaggatggtctcaatctcctgacctcatgatctgcctgccttggcctcccaaagtgctgggattacaggcatgagccaccgcgcctggcctactttttgtatttttagtagagatggagtttcaccatgttggccaggatggtctcgatctgacctggtgatccgcccacctcagcctcccaaagtgctgggattacaagcatgaatcactgtacacagcccacatcatttctttttattcttttttctttttgctcttctgacagtgtattttcaaatggcctgtctttaatctcagtaattttttttcttctgccttatcaattctgctattaagagactctaatgcattcttcagtatgtcaattgcatttttcaacttaacactatttcatagttataattatatgtgaactcaatccacatacctgccatctttactaaattttgtttaatcattttctgactgcataaaaatcacttgctttgtatctctcttttatttaagaccccaaagtatcagcaactttactgaactcttttactttaggaactcaatggaggaaaggagaaatattaggtgatttaatttcccatttattttgcctctggtttctgtgtaactctggctggccactgttgtaaatgggagtgaagaccctgaaaaatgaatgaggctgctgaggagggtggtggacaacagctagatactcacattgctttttggattcccttactttacagttaggagatacaagatagagttaggttgcagaattgtgacaaccaaagctctgcactacaactaattagatccagaattagaggtgcttggttaagaaggtgactttctccaaagcatatcagctaagccagaggactcattcatttttccagcatttgttgagtcttacactgagctaggggttggagatgtttagaagaaagataaagacataatgccttttcttggagtggtaacactttatcaggggatactggtacataggcacctcacaatgatacagtatgtcaaggatgatgacagagccctgtagaaagtgttctagaatccagagaatgaaccagattgttcagtgagaggtttttcaagtaggtcaccaggaaagttgaaggcatgtgggtgggaatttgccagaaattgctttgttgggcattaagtagctgataatctcaagttgtaaacaaatggtttggaatgtgacagcctgggtttgaagcctgactgcactatttaggaccttggtaagcttgggcaagtcaccaaaccttgctgagcttcgtttaagttttttgaaaaaaggagtaatagtacctaccttgttggacttgtgggtttaagtgagataatacatgtaaagtgcttgagtctagtcttttttttttttgcctatttaaaaaattgcatgtaaatcactctgcacaaataattattcctgttagagctctcaggggttaacaaactgtaaactctttgtgtcttctgcatttgtgtgatcattcttcatttttttttttgagatggagtctagctctgtcgcccaggctggagtgcagtggcacgatctcggctcactgcaagctctgcctcccgggttcatgccattctcctgcctcagcctcccgagtagctgggactacaagtgcccgccaccaggcctggctaatttttttgtatttttagtagagatggggtttcacagtgttagccaggatggtcttgatcttctgacctcgtgatccacctgccttggcctcccaaaatgctgggattacaggtgtgagccaccatgcccagctcattcttctaatctagaagtttctcttttagtgtagtttaaatctcaaactgctcctttttaccaattcttatgctatcccaaaacaaattagttctaggctgaaattgtcattacttttgctttgttcacccatattctgatgttaaagcaaatctatagttaattgtataatttccttcctttaatgtgcatagtacttgttgtgtctgatatcttttctcacccattaacatttaagttccttaagagaaagcttatgccttcttggtcttgtctctcataatgtcttagcatggtgccttccacatcataggcactcataaatactgactgaataaaggaataatcatgaatgcatgagattgccagatagctgatgtgatgtcagactgccttcatagaaacaaaatccccctgaacaggacaaagtatagaaactgaggagagtggttaagatggtggaaggactgaggccgggtgtggtggctcacgcctgtaatcccagcactttgggaggccgaggcaggtggatcacgaggtcaggagatcgacaccatcctggctaacatggggaaaccccgtctctactaaaaatacaaaaaaattagccaggcatggtggcgggcgcctgtagtcccagctacttgggaggctgaggcaggagaatggcatgaacctgggaggcggagcttgcagtgagctgagatcgcgccactgcactccagcctgggtgacaacagcgagactctgtctcaaaaaaaaaaaaaaaaaaaagaataaaacataagatggtgaaaggactgaaaaccatgattatacatggaataattgaaaacccaggggctattcagtttggagaagaggaaacttacagtgggagaatttagatgaggagggtagggaatagtagttcacgttattgaaatgttgttaagtggaagagggaatcaatttgtgacctcagaagacatatagtagcagcctctggaaattacatggagaaagattttgactcattgttaaaaagtaactttctaacaatcaggaatgacttccaactggctgttttgagaaggagtgtttctagtcattgtaggtggtcaatcagaaactgtactatttgatggggatgctgtagagcagtcatccccaacctttttggcaccagggactggtttcatggaagacagtttttccatggaaggagtcggcgggtggggggtgtgttcacgaatggtttcagaatgaagcggttccacttcagatcatcaggcattagagtctcataaggaacatgcaacctagatccctcacatgcacagttcacaatagggtttgtgctcctgtgagatataatgttgccgttgatctgacaggaggtagaactcaggcagtaatgctcgcttgctctccactcacctcctgttgtgtggcctagttcctaacaggccacagactagtactagttcatgcactgagggttgggcacccctgctgtagagagaagatatacttactctcaaaggaattggagtagatgatccccaaaatcttttaaactctcatggtctttaattctatgtattgtaatatatattaatgtatatatttaataaaggttaatcatatacaatgctactgtatatggtattgtatagtaaccgtaaacaatagcattgtacatgatttacctttattaaatatatgttaatatatgtatatatttatgtattgcatattctcattatcaccagattgcctaaattaatgaaaggtgaaaatggctttttaaaaatttgatcttggattatttaaaaaaatattactaacatgtcttttgcttggggacactagtgtataaaacattatatgaacagtgtttaaattgcaataaacaaatttacattgttgttagcatgtcagatgcaagtaaatactattttaatttctttgttaaatctaaaaggagaaaagtgagccagagtcaactcatcccaattcagatgaattgtgtgtttattatttatttatttttgagacggagtttcactcttgtggctgaggctgcagtgcagtggcgtgattttggcttactgcaacctctgcctcccgggttcaagcgattctcatgcctcagaagagtagctgggattataggcacctgccaccacacccagctaagttttgtatttttagtagaggaggaatttcaccatgttggccaggctggtcttgaactcctgacctcaggtgatcagcccgccttggcctctgaaagttctgggattacaggtatgagccactgcacctgtgtgtttaaaattcaggacttcatcatcaccaccaccactgtctcactatcaccatcattgctaacatatatatatagcatttattatgtgtctagctctgttgtaaacataccacacatattaactcatgtacttttccccaaaatccaacgaattaaatactggtattgccatttttgtaacttattttgtagtaatttcaaacttacataaaagttgcaaatataatacaacaaactcctgggtaaaagataactctcttattattcttcacccaagttctccaattgtaaacattttacatttgttttgccattcattttctttttctgaaccaatcgaaggtaagttgcagaggtgatatccaattatccctaactacttaagtgttttcctttaagacaaggaccctctcctgcataaccacagtgttatcaccaaaatcagaaatttcacattgatataattccactatctaatccacacaccacattcaaaatttgtcatttgtcctaacaatttcctttttgaaaaagtatttcttacttttggtctagaatcaaagtcaggattatgaattacatttagttgttatgtctctttaatctttaatttgtgacatttcctcaatccttccttatctttagtgaccttgacatttttgagttcaggcctttttcttttttttttttttttgtagagttcctcattttaggtttgtctgatgtttcttcttgattagattcaggtgatacatttttttttggcaggaatgtgatagaagtgaaattgtattcttccaaatgtatcatattaaaaggcacataatattgtttttttgttggtgatgttaactttgatggcttaaggtgataatttctccactgttaagttattctctttccctttgaattaataagtattttgtaggaagacactttgaggctatgtaaacatctggtttcttaacaaagtttcacttgcttattttatgattcttgcataaactgttactaggatgattgccaaattgtagtttttctaattacaatatttgttttccatttactagttgggattctattgtacagaagttttttcctctcccttcttattggcttatttccatcagcgtggacttgtggatttctattttatccaatagattataagccattactatcactattggttttgatgctgaaaatgctccagttccagccattgggatacccttcaagccagctcctgtgtccttttggcatctctgtatcattctgagagtacttttttggggtgcaagacatttcaggctcttctggtattttttctgccacaatcattgcagttatttcatcagctgtttctccactgagctctggttccttttacttgagaatggatttttagaaccaagatctggatgctaggtgtggtcattgctactggagtgttactgtttttaggccattttagcagacagagctaggaaattcacacacacacacccacacacacacccctatatctatttatatatctttctgtccatttatattaaaactcatgaatttactccaatatctctagctctactccaacactacagggttcattctagtcttcacccttattctatttgtaacttccttctctcttggtaaaaaaatctggcttccattatcctcgatatatttaactatttactcattcttcttttatgtaaccaatctcctgacctcacaggccacctccttggccccaattcttcctcagattcaggcctgcttatcgaccagtctcttcccgacataaattaaacaactagaaggttgtggagcagaaattcaaacctcagtgctgtaattacttgatagagagccctttattaggtcttcaacaccaatggagttgatttgtgaaacagcttctgtgaaaatgctcatggaaaaaaggcccttggactaatgagatgaagatttatccacacagagtgtcagccccagagatgtgccttccataagaaacttgggagcatcaagccaaatgctctacctgccaagaaccacagcaaggggattctccaaaattggtgaggttcagggaccagacagccagcaccaccagtgctataaatatcacactgtgttttatcatatcaagagtacatttcattaagatgtaaacatattactttgctatatttctgtagagggaaatactgcttttattacagattcttagattgaaattctaggagctggatgatggtgtcttctcttttagtgctgacttcatttcctggtccagaagatcagaaatctgttcatgttttagagaacagcatgaggtccatctgttcaggtcagatttttccaaattaacataaagatttatggggtggtaacttatgtaagaaaagccaaaggtaattatattctttgctgccatttggaacttacattatgtttttggttagtaatgaaaatatactagtatgtatctacacacacacaacacacacacacacacacacagaattctttcaaacactatgataaagtcatcctcttcagtttgtataatatttcacctctgttttggtttaggcaccagacaccatccattcaaattttctctgtaatgtggtctgtttatgtacagttttccttccaacagaaggcacagaaataaaagagctacaattggcttcttgggtgactattttagtgtgactgaaatacagagtaatgatttttttcctctgatgaaaatagcttgatttttttctgatttcaaaggaaatatatacatatatgaaaaacaaacagaaaagagagaaaataccatataattgaatttccaccatttgcaaggataaatagaatcacatcatgaatactcattgacatctttctttttactcagcaatatgacatgagggttttcttatgtaaatatatatacatataaattacccttttagatggctgcatattacagtaatgattttctttaaccagcatcccattaatgagaagtttatttccaatttttcattgtataaagaaagccatgatgaatatttttgcatgcacatccttatatactttgctggtgatgatcttaggatatatccctgaaaatagcattgctgggtcaaagagttcacatattttaaattttgacaccacatgttcctggtacaattaactcttttttttttttttgaaacaaggtcttgctctgtcacccagggcggagtgcactggtacaatcttggctcactgcaacctctgctacctggctcaagcaatcctccagcctcagcctcccatgtatacagctgggactacaggcgggagtcaccacgcccagctcatttttgtatttttctgtagagatgggtttttgccacgttgcccaggctggtctcaaatctcctgagctcaaagtgatctgcctcccgaagtgttaggattacaggtgtgagccactgtgcccggccataaaattaactcttgatgaggtgaattacagtatgtatattctttatatataatgtccctgtcaatgacagaacttggtaaagtctcttcaattttgcagtagcatatacatatatatatatatatatatatatatatatatatataaatgcacacacaacgtgtgtgtgcttgtgcatgcatgttctcctacagacattaaaggagtgtagtgattttaataaatctaggtatgctacttaaccaatcagatgttgttaggtttattcaaaatttgacatatggtttggtctgaaacgatggcatctggtaaccatttcttatcttacattgattttaatgaaatatggtatatgggaagaggtgactgagttgtaattttagtgagtggtatctatagtgtgaagaatcaacggtgtcaatagtatgaagaatcagttatgattaagccaaaccaaatttgtaaaattttgaactgattcatttggtatatttttaagttttggcctcaagaaggagttcaggcttggcttttttgtggataaatagtagcaaaaataggacaaatgtgagcatgtggtgcatgtagtgtttgaaggatttgatagtagcttctgttgatcctggggtgttctttttttgttcaggaactgatgcatatcctgggcagttggaagccttctttaaactcagctgggctgctctgatgatctctcaagagttaggtaaattacaaacaaccaagaagtacaactttaacatgcatattggaacagcccagtaattttacatttaattagcatctaacctaattgggtatttaaccatttaaacagaaacataaaaaatcatggaaatagaaaagatcattttattcctgcttctcccccttctagtgatggctccttcctacccttaacagcttcacccagcacagctgaatttaaagctgctgactcacaggaaggtgattctgctttttttttttttttaacagaaggaaagttaagtggtagatgataaatgtgttcattgaggatggcatattttatgcaaattgataaatccactgattcaaagattagaaaggctctttcctggaaaggaagtgtcgattataaatggtgaagacttgcatacttgcattctagcaagttcttagctgccagccaacacattcatcaccaagtgccagaatggattttaaaatgtcacaacacaaattgctctgctcaaaatcaggcaccatcatagtcacacaagccaaaccaacctgcttgtttaaaagtgccacataaagtttttttttcaacctcagttaaccttttcctttcctggtatgcctggttcattgcagtctcctaaagtcatgaaccttgactgagtagagagaggccaggcttctccctttgactttgcctgtacagcaactaactggtccaggtgcttttaaactgatggtaagactaaatgtttagcccagctctaaccagactgataactctcacccctaccttttcccctataccttctgctcttatttatttcttttgtttttctcaatcttttccctcccagagccagctgttgacttctagaagctactgcatagctgataagcccctgactattccttccctaattttctgctttagaactgtcagtggagtgtccagctcaaacctgggctagccctcctgtttgatgcttctcttagcagcccctacctcaataccatcagatctgtcttcttacctcccctcatctccaagtcccttagttgtaatttccacccacttctataacccagactgacacagcccagcaaaatcctcaggtctgtctaccattctcctatagcctagctcagcccaaaatttcttagtccctttaaatcacattctaccttgctcctcccaacattgcccactctggaatccagtatccattacttttcctagtccaactaagcagccttcatccccagtctaattggttggggggactgccacaccttcagcttcagtgtatcttccctcttgggaagcttctgcttttcaacccaaaataagggttctcttgtacccaggtagccctcttttaagctgattttggctagcatgccaaggagcttatcattcaccctagtgtgcccagatttttttctagcctgaaataagtgagctgtcatccagttctggcacttttgtgcttccgttagtactgcagggagtcatcctcaaagagcattatcaccactgacctgtcaccagaaaggcacagtgatgatgataaatttggactgattcatccatattcttcccctggttgttgcccttcttttctttcttcctcctcctcttcctcccctccctcccttcctctctctctccctccctccctctctcccttccttctctttttctctcttttccttccttctttcctccctccctccgtctctttctcttctttctctccctctcttttttcttttcttttcttttgacagagtctcactctgtcatccaggctgaagtgcagtggcgtgatcttggctcactgcaacctctgcctccctggttcaagtgattctcctgcctcagcctccctggtagctgggactataggcgcattccaccatgcctggctaattttttatttttagtagaaatggggtttcaccatgttggtcaggctggtctcgaactcctgacctcaggtgatctgcccgtctgagcctcccaaagtgctgggattacagacgtgagccactgtgcctggcccttttttttttttttttttttcttttgagatagggtctcactctgtttcccaggctggagtatagtgatgcgattttgtttttttttttaagggacggtttcgccattttgcccaggctggtcttgaactcctgagctcaaagtgatctgcccgcttcagcctcccaaagtgctgggattgcaggcatgaaccaccatgccccacccctcccctggttcttctaagcaagaggatgtatttgcaagatggttggcagggtcaggagtgcagtcagtggctatggaaataaaagttagttgttgctatggtaaaacagagctgcaccctatctaaaggatggacacaacaccaaaactagattccggaatgtaacaaacttatcattcctcagactctcaaagtaaatttttttctcaagaataacaagctcatggatagaatgaaggatttcatatcctactaatttttgagtcagatatcagttccctactggccaataatgtgaatataaatatcagagtccagccggacatggtggctcatgcctgtaatcccagcactttgggaggccgaggtgggtgaatcacctgaggtcgggagttcgagaccagcctgactaacatggagaaaccccgtctctactaaaaatataaaaaaattagccgggcgtggtggcgcatgcctgtaatctcagctactcaggaggctgaggcaggagaattgcttgaacccaggaggcggaggttgcggtgagccggcaaggtgccattgcactccagcctgggcaacaagagtgaaactccgcctcaaaataaataaataaataaataaataaataaataaataaataaatatcagagtccattcccaaggatccccaaaataacatttttagcataaatacctaagagtcaccatcagacagccatgtccacaaatcgtgtggaaaaaccccagtttatattcaattgaaagtctaaaattatatcctttttactctgaaaaatctaaaatgtggaagagaatcacttctgactagtataaacaaaaagtaataagcaatcattttaatacaggatttaataagttgtcttaatatttctgataaatattcagatgattactttgaagtattttgaaataaagatactttccatatttcataaagctacttttaatatattaacatttattgctcttgagttcaaagtatatcttattctagccaccaaaacatttagaaaatagaaaaaaaggtaaaaactaatttttttatctcttatatttcagacacttaatacccttaccccattcactgaatccaatttcattgctatttccttgttttgtccttttgagtggttcgggatctgcttcaaatgacaaagagatgtgagtaatagggttcaacgtctttcttattttcagatttaaagctcttcaatgatgtagctcaaaatgaaagttctttcaatccaacaactttgcagagatgctgatccctctcccaggtgaatcctggccaggcctttctgacaatcctgggataccctggggccagtatagagttcaagggcagaccagactgggggaggggttcctgagggacctggaaccagcatcaccagcacagtcagaattgcaacctagtggcaaagataactgtgagaacaatctcaaaggtggggccaggacagaaatggtagaataaatagcagagcttgtgatggttattataggatgggacaaaactcaaggagcagttgtagaatgcagttcaggaccaagtcattatttttgtttaatcaacttttattaaatgtgctctgggtgccaggaacgcaaatatgaatgagagctctcttgccattatggaattcacaaaggagactgtgacttggcatgttccctttagatggtgcctggatttgttggaggagtggacatggcagcttaaatgagccctcttgggctgtgcacaacccagaaatttcgaggtgtgccagtgtgtctgtctagtatcattgtgggaggatgtagagtcattctatgattgtttctgacatctctgtagctctgagtcttcttagaaggagcactttaaaaatcagagttctgggccaggcatggtggctcatgcctgtaatcccagcactttgggaggccaaggtgggcggatcatgaggtcaggagatcaagaccatcctggctaacacggtgaaaccccgtctctactaaaaatacaaaaaattagccaggtgtggtggtggccgcctgtagtcccagctactcgggaggctgaggcaggagaatggcgtgaacccgggaggcggagcttgcagtgagccgagatcgcgccactgcactccaggctgggtgacagtgcgagactctgtctcaaaaaaaaaaaaaaaaaaaaaaaaaaaaatcagggttctggcagggtgtggtagctcaggtgtgtaatcccagcacttagggaggctgaggtgggcagttcacttgaggccaggagttcgagaccagcttggccaatgtggcaaaaccctgtctctactaaaaaaatacaaaaattagccgggtgtggtggcacacacctataatcccagctacgtgggaggttgaggcaggagaatcccttgagcccaggaggtggaggttgcagtgagctgagattgctccattgcactccagcctgggcgacagagtgagaccctgtttcaaaaaggctgggcgcagtggctcaaggctgtaatcccagcactttgggaggccaaggcgggaggatcacctgaggtcacaagttcgagaccagcctggccaacatggcaaaaccctatctctacttaaaaataaaaaaattagctgggcatggtgacgcacccctgtagtcccagctactgaggaagctgaggcaggagaatcccttgaacccaggaggtggaggttgtggtgagctgagattgccccactgcactctaacctgggtggcagagtgggactctgtctcaaaacaaaacaaaaaaatcagagttctgagtgaattttactacttaccctttgcccttagcctagctgagcctagatgaaggtttgagtagaagtgattgggaggtggacaggctgtgcaagttataagaaaacaaatttgctggccgggcacggagagaatcaaggagaattgcttgaacccgggaagcggaggttgcagtgagccgagatttcgccactgcactccagcctggcgacagagtgagactccgtctcaaaaagaagaaaaaaacagccaggcgcggtggctcacaccggtaatcccagcactttgggaggccgaggcgggcggatcatgaggtaaggagatcgagaccatcctggctaacacagtgaaaccctgtctctactaaaaatataaaaaattagctgggtgtggtggcacgcgcctgtagttccagctactcgggaggctgaggcaggagaattgcttgaacctgggaggcagaggttgcagtgagctgagattgcgccactgtactccagcctgggagacagagcgagactccgtctcaaaaaaaaaaaaaaacaacaaatttgttgactgggcgtggtggctcacacatgtaatcccagcactttgggaggcccaggctgactgattgcatgaggccgtgagtttgagaccagcctggccaacatggcaaaaatcctgtctctacagaaaatacaaaaattagctgggcatggtggctaacacctgtagtcccagctactcgtgaggctgaggcacgaattgcttgaacctgggaggtggaagttgtagtgagcagagattgggccactgcactccagcctgggcgacagcaagactctctgtctcaaaaaaaaaaaaaaaaaaaaaaaaagaaaacaagacaaaacattctttcatgtacattcaatggaaaaacttcaaaattgttatctgtttattttcacatatgtggcatttcctgtgattgttatgaacctaatcctgtataagggtagtttgtcatcccatttgcctttcagctttcagagagctgaagttaatgtgttcaaagcccttgttggttccatattaactagccattaaaagtgatattatgtaatttttaatgacatggaaatgtttacaatgtattgtaaaatggggaagttataaaataggatataatgtttgatatcatttttgtaagaaaaatcttactggaagggtctgtagttgtctctgaatggtaggattatgagtgatttttattttctttgttttcccacatttctaaatgttctataatgaacatatattgcttttgtaataggaataaacaaaatgttatttatttagagatctgatggtggtaaataagctcttgggtgagaagtttattctgagcaagctcagatatggaaccactgggaatttcctgatgtggaatcactgtggatttgctggtgatgggacttacttgactgggccaaaatgtgaggcatgcactgggaaactagcaggaaactagcacttgaaactcagcctgaagatgctgaaagacatgtatttccagcaccctttagaattgattgagaatagtttaattctctagtggtttaaagcagatacaaattacttaaggaacagctgcagttatgccctaaaaatttaatttttttttttttgagacagagtctcgctctgtcgccaggctggagtcagtggcgcgatctcggctcactgcaatatccgcctcccaggttcaggcaattctcctgcctcagccttccaattaggtgggactataggtgcgcgccatcacgtctagctaatttttgtatttttagtagagacggggtttcaccatgttggccaggatggtcttgatctcttgaccttgtgatctgcccgcctcggcctcccaaagtgctgggatgacgggcgtgagccaccgcacccggccgtaaaaaaaaaaaaaaaaattatggttacttttatgtgtccacttggctggtcaaacattattctggatgtttctgtgagagtgtttttggatgagatttacatttgaaagggtggactttggagaaagcaaattgccttccataatgtgggtgggcatcgtccaatcagttgaaagcctgaatagcacaaaagactgacctcctccaagcaagagggaattctttagccaacagactttggacttaaaccgcaatattggcacttctctggactagcctgctacccactctgcaaattttggacatgccgacgtgccagcctccataattctgtattacttttctcagccataggaatgaggtggtctcaggcctcatattctgggatctagcttgggaaatagttcctcttttggataaaaatagtcattttaagctctccacactggatgtgcccattgttcaagcagacaccaaactgtgcatacttttaattcatttgtatccactatttttggtggaaacatttgtagctaagcaggctagacttctggttctatttcatattccctctacttagctgagttgctctgcactgctgaagtagacacctctgccttagtgggcacttaccccatgtgaatccttgtcagaggaactggagccatgatactggtttagagcactcgtctctgaggaaggaggaaaagttgagttggcactttgatcagaatgacttagagcagattgtagaaagttacagtggctaaactacatagtggtcttgcattgggagagatatcaaaacactgtaagtatgaaatcattaaaaagacaaaccgattgtgaagacggttatgtcaaaagatccccaaaattatcatccaaaacactttctcttaagacagacaataattattactctagttggtggccaagccagaactcaaaatttctgagtcttaaatttcttatctctaaaataaaatttccggctgggcatggtggctcacacctgtaatcccagtactttgcgctaaggcgagtgaatcacctgaggtcaggagtttgagacaaacctagccaacatggtgaaaccccatttctactaaaaatacaaaaattagctgggcgtggtggtgcatgcctgtaatcccagctactctggaggctgagggaggctgaggcaggagaatcacttgaacctgggaggtggaggttgcagtgagccaagatcatgccactacattctagcctgggcgacagagtgagactgtctaaaaataaataaataaataataaataaataaataaataaaatttcctagtttcctggggccacgtgaatactgttagttcctgccaaggagagctgcctactaggcaagaagaccaaacagcaaaaatctgtggactctaagtcccaaaatgtaaggctctcccacataagggatttgtgtactgaggaggccctccagaatttacctgagataacttacatttggatgcttgcaaccaagagaattttggtggcctattagagttagcagaagacaacaagcaaggagagaattctaacgtatatcagaattaggagttaatttgaaacacagaaccagtaggggatttattataaagaactggcttcattgcactccagcctgggcaacaagagtgaaactccatctcaaaaagaaaaaaaaaattggcttatgttcttgtgggggctggataagcaagtctgaagtctgcaggcagtcattcaggaaggggagatttaagggccagctggggccgggagcagtggttcatgcctgtaatcccagcactttggaaggctgaggcagatggatcacttgaggtcaggagttcgagaccagcctggccaacatggcgaaaccccacctctactaaaatacaaaaattagctggatttggtggtggctgtggtgggtgcctgtaatcccaagtactcaggaggctgaggcaggagaattgcttgaacctgggaggcagaggttgcagtgagccgggattgcatcactacactccagcctgggcgacagagcaagactctgtctcaaaacaaacaaaaacaaaacaaaagagaaagaactggttagaaccccatgagcacaggataatgcttgttgtccacaggcagtaaagaaaaaatcatgaacaggctagaatcccaagggcataagctgtttggagtctctgaatttaagaaaggcctaagccctcacctttaaagggctccccttattaagtcaggcctacccaggataaagtcaacagattaggggctatttatttatcaacacatttacagcaaacaaaagggacttttatcacatctgcaaaatctcttcacaacagcaacttagatagattagtgtttgattaagtaaattggaaaatgtagttcagcatatcataggctgggtgtggtggcttatgcttataatcccagcactttgggaggctgaggttggtggatcacttgagcccaggagtttgagatcagcctgggcaacatggcgaaaacccatctctacaaaaaatacaaaaattaggtaggcgtgatggcaggcatctgaagccccagctacttaggaggctgaggtgggaggatcacttgagccagccatattcactgggtgacaaagtgaatctggggtgacaaaaagccatcatagtcataaaaaagaatgaaattatgtcctttgcagcaacatggatagagctagaggctattatcctaagtaaaataactcagaaacataaaatcaaatactgcatgttctgtcttacaagctcttattagtgggagctaaacaattacacataaagatggaaataatagaccctggagactctgaaacgggttagagtaggtgggaagagagggttaaaaaattacctattgggtgcaatgctcactatttgggtgatggatacaccagaatcctaaaccttaccattacataatatatacatgtaacgaaccgggcacggtggcctgtaatctcagcactttgggaggctgaggcaggcggatcacctgaggtagggagttcaagaccagcctgaccagcatggagaaaccctgtctctactaaaaatacaaaattagccgggcgtggtggcacatgcctgtaatcccagctatttgggaggctgaggcaggagagtcgcttgaatccggaggtggaggttgtagtgagccaagatcatgtcattacactccagcctgggcaacaagaacgaaactccgtctcaaaaaaaaaaaaagattatatatacacacacacacacgtaacgaatctgcacatgtactccctgaacctaaaaaaaaattatgcaattataatagtacctaatttttattgcgtgctaaatatacaagttatgccatttaatttatatatattttatcattatactttgtaataatcataggtaataagtataattatcttttatacatgtagaaactaaagtttatgaaaacgaaatcatgtacccaaagtcatgattaataagtaaagttgaacccaactttttttttttactttaaatcctgtgcttttatttatttttattttttatttttgagacaagttctctgtctcccaggctgaagtgcagtggtgcgatcttggctcactgcaacctccgcctcctgggttcaagtgattctggtgtcttagcctcccaagtagctgggactacaggcatgtgccaccactcccaactaattttctgtatttttagtagagacgaggttttaccatgttggccaggctggtctcaaacccctgacctcaagtgatccgcctgcctcagcctcccaaagtgctggaattacaggcatgagccactgcacctggcccattgttagtttttaaaaatacaggatttaggctgggcgtggtggctcatgcctgtgatcccagcacttcgggaagccgcggcgggcggatcacttgaggtcaggggtttgagaccagcctgaccaacatggtgaaaccccgtctctaccaaaaaaatacaaaaattagccaggcgtagtggcacatgcctatgatcccagctactgtggaggctgaggcaggagaatctcttgaagccgggaggtggaggttgcagtgagctgagatcatgccactgcactccagcctgggggacagagcgagactccgtctcaaaaataaataaataactaaaaacaaacaaaagctaaccatggaaaatgatattgatggatccaagtgatacagtttgtttcaacatattgagatattggatccttttaaattctttgtactgctcatgaccagttgccatacaccgcagaatgtcaattgcctacaaggtaaatttcacatcggtcgacttaccctcctgtcactcctgataatgcactcatggtttatgggttgttttagtagtatgtggtgaactataaactgttacaatgggaggagttttttttttaaacctcttaaaagttgatgtatatatatccttaccactaagcatatcttttcaattaggcatgtggcaattcctttcttgatgtttttagggaaaatgagccaaataatattttaaaaaatgtataagccaagctggtttctatcctttcttctattaaactcaggatcacacaagtaggcatgagtgtgcacaatatttatgccttgcattgttctgagaattagtaaaagaatatcttgaaagcatgatataactttgtatttgtatccaaaaatatacaaagttgttgaattaaaaaaaaaaaataatgcagctgggcgtggtggctcacgcctgtaatcccagcattttgagaggctgaggcatgcttattgcttgaacccaggagtttgagaccatcgtgggcaacatggcaaaaccctgtctctacagaaagtgtaaaaaacagccaggaggggtggtgtacaagtgtcttagctgaggctgaggtgggaggattgcttgagccctggaggtcgaggctgcagtgagcagtgatcacgccactgcactccagcctgcgcaacggagtgagaccctgtctcaaaataattattatttgacataccaaatttgggcacagtgactagaaacaaaattccactgagttgagacagctaggttacaaaattattagattacaaaatattaggttagaagtactactgcagatgtttaaacaaggaagaaaaatacacaagtggctagaggtgaggaaaggcctgtctctaaaagacagaatttgtactgggcctttaaagatgaacaatgttggccgggcgcggtggctcacgcctgtaatcccagcactttgggaggccgaggtgggcagatcacaaggtcaggagatcgagaccgtcctggctaatacggtgaaaccctgtctccactaaaaaaaatacaaaaaattagccgggcgtggtggcgggagcctgtagttcccagctactcgggaggctgaggcaggagaatggtgtgaacccgggaggtggagcttgcagtgagccgagattgtgccactgcgctccagcctgggcgaagagtgagactccgtctcaaaaaaaaaaaaaaaaaaaaaaaaagatgaacagtgtttacaaagttggagcagaagggaaactggtgagaataaaagcttagggtatatatggagaatgaggacagggaagacactggactgactgctcagagcaaggtaggcgtgttgaagacctaagtactgataggagctagattagccagggtattgagagcctggcagaggagttgaaatttgataaggtagagataggaaatcactgtaggttcttgaatggggaaagcttgagaagtttttgtttttgttttgagtcttttaaaggaagagcaatgtgacagtgggataatataaattttagagagggactgggattcaagggaggctagttaggatgctgttgcaatattctagatgggaattcacaataacccaaaccacaattataaaagttacatagaattggaggagaaagggaaaaacaggaatatttcaaagacaaaaacagtaagattagtgaccaaatgcaagtaagatggcagaaaagataattcacagtattccctgatttctagcttggggaactggaaaaattgtggtatcacagacataaatgaggacattagggaaaaaaatctatttgggagaacaagactattcagtttgggattgttgaagctatgatttgacatgtcctggcaaaagttggaaataaagaacagtcagattagcctgatagtggtgtgcaggaagaaggactgcaaatgggacatccaggctaggaaatagaagggtttggaggcacaggtgatatttttttcatgacttcttccagctgaaggtggtgccttttagaaaagaaaggagtaaataggaatagaacagttagctccccagatggtgtcgaagaacaaaatgagattttatttctgggccattgtttaagatcctggaaccgatgagtttttggcaagaaatcagggagtcacgaggaagaaaaaaaaagattttttttctttttctttttttttttttgagatggagtcttgctctgttgctgatgctggagtgcagtggcacaatcttggctcactgcaacctccgtctcctgggttcaagcagttctcctacctcagcctcctgagtagctgggattacaggcacctgccaccattcccagctaatttttgcatttttagtagagacaggattttaccatgttggccaggcaggtctcgaactcctgacctcaggtgatctgcctacctcggcctcccaaagtgctgggattacaggcatgagccagcgtgcctggtctcttttttgttttttaagcgggaggagaggatcattgggagggaaataggaaattgttgaaaggaaggaaagaaagaaccaagtgaaaaaataaaggtctaaaagaaataataatattgtagaagatacccagtgtttcataaagttgttataggtgaaaggaagccaaatttattgctaacatttattgagagtttactatatgccagcactgtggcaaattgtttatatgcattattttatttaattcttacagtaagttcaactttttttcccacttgacattatatagtggacatcgtttttgttttgttttgttttgagacagagtctcgctctgtcacccaggctggagtgcagtagcacaatcttggctcactgcaacctctgcttcctgaattcaagtgattctcatgcctcagcctcccgagtagctggaattacagacacataccaccaggcccggctaaatttagtatttttagtagaaatggcatttcaccatgttggccaggctggccaactcctctcaaacttctggcctcaagtgatccgcccgcctcagcctcccaaaatgctgggattacaggtgtgagccaccgtgcctacactgtcatttttaatagatagcatagtattccattgtatgaacattcattgtagtaagctacaatgaactctcctgtatgtacattttccccacattttttggtatattctttttcttaagtaacagataaacattttaattctatttttggataatatcacaattcaaaaataaaaatgtaaaaaaataaataacaaaaaggttttcttccattcttgttcctcctgtcacctgaaccaccattagttttcttggcatctttatataatttctttgttatgtaaacaaatataaatacgtattcttattcccccccttttttattcagaatgtaaaaagcatcttgtgatcatctctttagcataaaatcttaaaagtggtattgctgagtagaggatagttaaaatcttaatacatatggtccaactgttcacgagagaggttgtacaatttaacctttctaccaacaatgcatgagtgttactaaattcatgttatttatgttctaatttcagtgtatttttatatctcaaaacttatggggagtccagaataaatgtttaaaaatcactataatttataaggtgaattctggtattatacagaattgattatacaaaatactttggacttaactaataatttataacaggcaaatggacccaatgagaaggaaaggtttgacctaagttattatttatctttctgtgttttgcttgttggataggtggagaaacaggtaggaatgaaaagatggaaaaatccgtttgtggtataaagatagaagatagagctgaattaaacaagtaagcaaagagaaatggagacagacttcagatgagagtgaaaaaagggtaaacaattccagtaggtaccatacatctgataaggcatattgccagatcatctctaatttcttttttttctggactactgttacagcctctactttctatcattgaattgatgcatatgattataatagaaattaaattttcaatgaaatgaatgtctttttgtcaatttttttctttaaatagaattgattatctgaagaaatggatacttctccctccagaaaatatccagttaaaaaacgggtgaaaatacatcccaacacagtgatggtgaaatatacttctcattatccccagcctggcgatgatggatatgaagaaatcaatgaaggctatggaaattttatggaggaaaatccaaagaaaggtctgctgagtgaaatgaaaaaaaaagggagagctttctttggaaccatggataccctacctccaccaacagaagacccaatgatcaatgagattggacaattccagagctttgcagaaaaaaacatttttcaatcccgaaaaatgtggatagtgctgtttggatctgctttggctcatggatgtgtagctcttatcactaggcttgtttctgatcggtctaaagttccatctctagaactgatttttatccgttctgtttttcaggtcttatctgtgttagttgtgtgttactatcaggaggccccctttggacccagtggatacagattacgactcttcttttatggtgtatgcaatgtcatttctatcacttgtgcttatacatcattttcaatagttcctcccagcaatgggaccactatgtggagagccacaactacagtcttcagtgccattttggcttttttactcgtagatgagaaaatggcttatgttgacatggctacagttgtttgcagcatcttaggtgtttgtcttgtcatgatcccaaacattgttgatgaagacaattctttgttaaatgcctggaaagaagcctttgggtacaccatgactgtgatggctggactgaccactgctctctcaatgatagtatacagatccatcaaggagaagatcagcatgtggactgcactgtttacttttggttggactgggacaatttggggaatatctactatgtttattcttcaagaacccatcatcccattagatggagaaacctggagttatctcattgctatatgtgtctgttctactgcagcattcttaggagtttattatgccttggacaaattccatccagctttggttagcacagtacaacatttggagattgtggtagctatggtcttgcagcttctcgtgctgcacatatttcctagcatctatgatgtttttggaggggtaatcattatgattagtgtttttgtccttgctggctataaactttactggaggaatttaagaaagcaggactaccaggaaatactagactctcccattaaatgaatacctgattattattgtctcattaatgttcagttattatgtatactgccattttaatgtttacctatgaatgtcttttgtgttatataactgacagagtgctataaaatatataatatatacaaatgcagaaaatttattctagtctaatatattcaaatacaaatattaaatatatgaaatacgttatgaa

SEQ ID NO: 672 - DNA, 82809 bp, Homo sapiens
agactccgcccttgggcggggcctggatgcggccggagcggagcagtgctggagcgggagcctcagccctcaggcgccactgtgaggacctgaccggaccagaccatcccgcagcgccccgccccggccccctccgcgccctcccgacgccaggtcctgccgtcccgccgaccgtccgggagcgaacccgtcgtcccgcactcggagtccgcggtaaggggcgcggccccggcagcccgcccgcggaggatcagggaccgatccccggcgcggggcgctgggcaccgagagcgggcgccgagaaggagcgcggggcagcggaaggaagccgggggaggagcgagggagggggctccgcggcggcagaggtggggctcacctagggagggggcgccgagggggtctcccagacgttgggggcagccgggggagctccaagggcgggaggggagcaagaaagacggcgctggggctgggaggagagatggggggcaactggagggcagtgagggatcgctgggggaaacgggggcgtggggggcgggggagctgcgaggagggcggagtggggctgtgcggaaaggtggtaccgggcagccgaggggcagcgaagggggcggtgaagggagcggactgaggggagctagagcgggggtgcggggggaggcatggaggtgaggagctgaggggaggggactggctgggcgggggtcgtttggagctggaggggactgaggtgccgagggcaaggggcgctgggcagctggggagtgtctggttgggagagggtcgggggtggggatgtgggtatggatagctgggaaggagaaaggcagcagggcagtgtctggtcgaaagagggtcatttatgggggatgtgggtatggatagctggggtcggaggttgagcccggctggggaccggcgtgggggtaactgtagatggaagacgaggggtggggcttgggggcgggaagcttgggagaatggaagggtgagaggccaggttgggtctaccctgctgcagaggaagggggcagggagccggtggagacacagggaagtggccttggaaatggacacaggggcctacattctggtcaggagtggagaggaggctctggaatagagtagggtctggcggctgcaagtggaggaatcgtgggagaacttggagtgtatagatagggtggtggggcgctgggtcagcctggggaggaggccaggtgtgggtcgtggtgtaagggtggaaaggtaatgggggctggagtggtgtccacgcactagcggtgtctcggccactcaggagtccaaggaggggacccaggcactggaccttgttacacgggcaccggggatcacagaaaataagagaatcgtggacagaaaaagtcatccaactctgttctgtagtccaagcatggaagcaactttggggagggcagggcagcagcctttggaagctaagagagatgtggaggaggtgggagaaagatgggccctcaaaacacacacacacacacacacacacacacacacacacacacacacacacaaaacaagatgggccctcttcccccggcttcctggaatccagatggaaaggggtgggagacagtaaaaggagaggatgtgtgtgtgtgtgtgtgtgtgtgtgtgtgcgcgcgcacaggtgggtgtccacctgttctgtgcctataaacagaggaagacaatggaagccgtgaaaggccctatctatagaagtggaaagccctggtgccctgtgggagccagagaagaagcattttgggggaggtgggtgggttggggaagccttcctggtcatgaaggatttagctagcagtggaggaaagtgtgttcctatcagaggaaaccgtatgggaaaaggcaaaaatctaaaagcatctccagtccaagaaatagatcttcagtttcttaaagattatgacatgaagggaggcatcagtaacctatacaaaatatttaaatagatttcccctctaagcttgaagctcctagggtttctctccatctccctaaagtatagcacaggtcctggtgcatagtaggtgcttggtgaatgttgattgaatgaataattggtgctcctgcctcaatttcttcatccattcccaagaattgttgtgagaatcaaataggataatgtgggtgaaaagaactttgtaaactgtaaaacaatgtacaaagagagaggccactgatgttattctgcaggtgttcctgttttgtcagtggacacacccatggctatctctttccaatctggaggaggaaggaaatgaatatcaagcatctgttggtgcaagatggaatgctttgaaagcatcttgtagaatgctagacatttagtaggtgctcaataaatggtagctattgtgatattgtttctgtggctctaggagacctgggaaaacaatgagaaggtggtgatgggtcagcagtggggaatggtctaaagacagattgaattagaaaagtagagtatggcttaaaggaggatgaggtccacatttgcccaactcccttcttattctcactgaaatgctccaagtaggaagacagggaattacattattgagcccctgctatattgcatatacagttgacctttgaacagcatgggtttgaactgtgtaggttcacttatacctgaattttttttttcaaccaaacactgattaaaaaaaataccatggtgggtcaagcgcagtggctcaaacctggaatcccagctatttgggaggctgaggtaggaggatcgcttgagcccaggaacctgaagctacagtgagttatgatcaggccactgtactccatcctgggaaacagagtgacacccatctcttaaaaaagaagaaaaagagaagaaaatacagtagtgaagggaggtgaagtctgtatattcagaggaccaacttttagtctaggtgggttccactgggccaactgtggttcttgagtaggcgtggatttcggtatatatgggggtcctggagccaatcccttgcctataccaagaaattactgtactattctagatgtataacccacattacctataattttcccaacaacacttgttttatgaatgaggaaactgtcttaatcatgtaacatttcttgccaaggtctcataggtaataaatgatagacctggaaactgaatctagtttgtttgatttggagctccaaactatttccactacacaggatgacttgctagaagaaaccatgaagcacagagacaaacaaacaaacaaaataaggggttaataaaacaccctcccatatacaggttttaattcttgcaacagttttgccaggaagccattttatgagctccttttatagataaggaaactgaggccaggggtgtgatttgcctaagtttacaggatcactgaaagagccagggcttatctttcaaatgccaggtctcttggactcagtctcatgttctttgcaacaaaaggtaagttccttcattcacttcttcactccatttattgagctgatctcttctcgctggattttagggctctctcctcctcctccccgctctttcctggctgaagttggcttcttccttaggtgcttatttctgccgcctatcagactgaaagggttgtttttcacagccaccctttgaggagtcatttctttcccccagcctgggacagggacgacttcccagatggtccctgggccttcatctgtattgcttgtcacggagatagctctatcattttatgtgactgtcacaaaatagaggaaagatttgattgatgcttatcttacaaatgcaattctgcatgcaccactgtgcatgacctgtctgcttagatctgcctcaggcagctgcctgctgggatgctttttgcctgtcttccaaatgtctgagtagcccctggccgccccctcctaagaagatccccttgggggcttccatctgaatgagccttccaactgaactcagctctctgcctctccccgttctcacaccacctactgggaaagccatgctgtgtgtgcataagcagatgttaacagtgtggtatggcaagtacagtacggtagcaggacactcaggatgttgggtatgcttcttttttttaatttttatttttagagatagggtctcactctgtcacccaggttgggatacagtggtgcaatcatagctcactctaacctcgaacctctggactcaagtgattttccagcctcagcctcccaagtaccgaggactacaggtgcacaccaccacatccgactaatttaaactttttttggctgggcgcggtggctcacgcctgtaatcccagcactttgggaggccgaggcaggcggatcacaaggtcaggagaccgagaccatcctggctaacacggtgaaaccccatctctagtaaaaatacaaaaaattagccgggtatggtggcgggtgtctgtagtcccagctactcgggaggctgaggcaggagaatggcgtgaacccgggaggcggagcttgcagtgagctgagatcgcgccactgccctccagcctgggcgacagagtgagactctgcctcaaaaaaaaaaaaaaaaaaaaaattcgtagaaatggaatctcactatgtttcccaggctggttttgaactcctggcctcaagtgattttcccattttggcatcccaaagtgttgggattacaggcatgagccaccatgcccagccaggatgcttctttattcaccctaaaattgttgtggttttcgttttccttaatcccgtcaaacctggaagccattaggtaacagaagttccattcatgaccctccaactgacttgctgtgtgagcttggacaaatcacttgtctttgcagagcctcaattttttttttttttttttacctgtaagataaacggaggtagatcaggaactgaaacaattttttactcttgccatcacttcctagtctcctatctgtggcagtcacagctaataaaggcaggcaaatttctcactgattctacacgaggctacatgtatttttctcagcacagtgtatgaaacatacttatatacgttctcttatttaaaattcacagcacctcgtgaagtaagtattattgtcagatgaggacactgaggcatagaatttaagtaactaggccaagtttacacactgagttactgggaaagctgggcccagtagccaggctttttgttacaataaaaagctgctactccaaagtcccctctaattctagcagtttaagagtgtgaagctgggctacatcagaaaagtgaaaaccagtaatctgacatttacactgatagtctggcacttgaaaaatgctctatatgtgtttcttgaaagacataacaccctctaaggatttactgtaggtctagcgttgaccagatgtaaggatggataaagcccccttgaatccagaagagagagcaaacagttaattgtaaaacaggcccaaataatggagccacaatcagggagagggcagttgaacaagatttgcctgcagaagtgaattaaaggggccagtgaaataatatgtattcagtacctccatgggccgagaaactgtgtcagattgtttacgtatagtactactctttctatttgtaccaagctctgtgaagtaggtggtattttctctattttaaggtaaaagtgctgtggcttagagaggcaatatgacttacctaagaattcatctgagggtagagcattgattttaaactttttcataacactgcagggtactaagtctagtctcggctgttagctatgagatttgggcaaatccttttaatttctcattttcagtttccttcttgatcaaatggaaataataatccacgtctttccagctttatttcccaggtttatttagagataaaagaagataaaggatatgaaattgtggtaaagatcacatttatgttttagtagtgactctttgaccagcaattccacttcaaggaatctctctcaaggaagtaattaggaaaatgtacaaaaatttatgtaaagaaatgttcactgcagtttcatgtataataattaagagtagaaaaacaacttaaaaacaacttcctaaagagagtgacaacattaaataattgatctggctgggccaacatggtgaaaccccatctctattaaaaatacaaaaattagccggtgtgatggtgagcacctgtagtcccagctacttgggaggctgaggcaggagaatcgcttgaacccaggagttggaggttgcagtgagccaagattgtgccattgcactccagccagggtgacagagcaagactctgtctcaaaaaaaaaaaaaaaaaaaaagaattggtcttatgacacatctataggatggaatataatgtagtcaactgaaatgatgtttttttagagttttcaaagtctcgttcatgcttttttttttttttttttttttttttttttttttaattagagagtctccactgttgcctgggctggagtgcagtggcacaatctccgctcactgtaacctccgcctgccaggttcaagtgattctcctgcctcagcctccagagtagctgggattacaggcagccaccaccacgcccagcgaattttttgtatttttagtagagatggggtttcaccatgttggccagactggtctcgaactcctgacctcgtgattcacccgcctcagcctcccaaagtgctgggattacaggcatgagccaccgcgcccagcccttactttcttttctttttttttgagacagtgtcttgctctgtcacccagactggagtgtagttgtgcaatcttgactcactgcagcctccgcctcctgggttcaagcaatttttgtgcttcagcctcctgactagctggaattacaggtgtgcgccaccacacctggctaatttttatatttttagtagagactggatttcaccatgttggccaggctgatcttaaactcctgagctcaaatgatccgcctgcctcggcctcacaaagtcctgggattatgggcctgagccacggcacctggcctcaaaatctcatatttttgtagtacttttggtactactaaatttttgtagtatttaagtacagtcttgcattgctaatgacaaggatatgttctgagggatgtgtcattagccgatttcatagttgtatgaacatcatagagtatacttacacaaacctatatggtatatggtatagcttactatacacatagtctatatggaatagatagcctattgctcctaggctgcaaacctgtacagcatgttactgtattgaatgtagcaggcaattgtaacacagtggtaagtatttgtgtagctaaacacatctaaacatagaaaaggtacagtaaaaatatgatggtttttttttttgagaccaagtctggctctatcacccaagctggaatgcagtggtgcaatctcagctcactgcaacctcagcctcccgagtagctgggattacaggtatctgccaccatgcctggctaattttttgtattttaatagggatggagtttcatcatgttggccaggctggtctctatctcctgacctcaagtgatccacccaccttggcctcccaaagtgctgggattacaggtgtgagccactgcacccaggcataatatggtataagagataaaaaatggtacacctatataagacacttaaccatgaatggagcttgcagggccggcagttgctctgggggagtcagtgagtgagtggtgagtgaatgtgaaggcctaggacattaccatacactataggagactttataaacactctacacttaggctacactaaatttatttaaaaatatgtttctccaataataaattaactttggcttactataacttttaaaccttataaacttaaaaaatttttaaaacttcttagactcttttattttttatttattattattattattatttttttgagattgagtcttgctctgtcacccaggctggagtgcagtggatctctgctcactgcaacctccacctcccgagttcaagcaattcttgtgcctcagcctcctgagtagctgggattacaggtgcgcaccaccacgcctggctaatttttgtatttttagtagagatgaggtttcaccatgttggctaggctggtcttgaactcctgaccttaagtgatctgcctgcctcggcctcccaaagtctggggttacaggtctgagccaccatgcccagccatagactcttttataacaacacttaacttaaagcacaaatacaccgtatggccttttttgagatgaaggctcagtgtgtcacctggattggaatgcagtggtgcaatcatgggtcactgcagcctcaaactccttggcttgagcgatcctcccaccttggcctcccaaagtgttgggattataggtatgagccactgaacctggccttttctttcttttcttccttagtttttaaatttatgtttaaaattattttgttaaaaaggaagacacaaatacacacacctgagcttaggcctacacagggtccaggagcatcaatatcactgccttccatttccatgtcttgtcccactggaaggtcttcaggggcaataataggcatggagctgtcatctcttatggcaatatcttcttctggaatacctcctgaaggacctgcctgaggctgttttactgttaactttttaaaaaatattaaatataaatagaaaaagtacactctaaaataacaataaaaagtgtagtaagtaaatacagaagccagtaacatagtcatttattatcaatatcaagtattatgtatagcacataatcatatgtgctatacttttatacaactggcaatgcagtaggtttgtttacaccagcatcaacacaaatatgtgagtaatgtgttgtgctacaatgttaccatggctactatgtcactaggcaataggaatttttcagctccattataatcttatgggaccgccattgtacatgtggtctgtcattgactgaaatgttgttatgcagttcatgattgtacttttaaaatttaagtgatttgctaaatgataacataccatatattctagcctataccttgtacatatgatgtcagctattacaatatgcatagaaggtatagactagaatgcatggtatgttatttatatagaaataaaaagtataaataggtctctttgcttatatatgcaagggctatctctgaaggatatataaattgataacatgtatgcctctggggaggggaactggatcaggaatcagagatggaagcaagacttacttttcagtgtaaacctttaggtttcatattacttgtattttatgctaggaattaagaaaataatgcagctgggtgtggtggctctcgcctgtaattctagcactttgggaggccacggagggcagatcacttgatcccggtttaagaccagcctggacagcatggtgaaaccccatctctacaaaaagtacaaaaattagctgagcatggtggcacatgcctgtagtcccagctactcgggaggctgaggtaagaggattgcttgagcccaggagatcaagactgtagtgagccaagatagtgccattgcactccagcctgggcgacagagagagaccctgtctcaaaataaaataaaataaaataaaaataataataattgagctacagctggtaaaaaaggtaatacttgcaaataggatatgcttgaattattttccgtaagtatgtattaccttttaaattaacaaataaaacatagtattaaaatagatggcttttttttaaagtacaatttccattttatttttctccaggaaatagtccatcttcagtctttaaggactcagctccttacatgggctttggtgggggtcgtggggcagcacctacaggtctaaatcagggtgggggtgtttggtccttgcgggcttcatgagatcgattcctgactactttgctgtgaattgcacaactcgcatagtaatgtagcttcacatactgcttgggaagcacataggcatcgaagatgctcacttcagaaatgtccctgactgctgtggcctccactatgtttcaaatgacgaatttcttaatggccttgtccttgggcacacattgggcacagttcatccagtgaataggctgcaagtggctgcaggcctttttggcatgaccattgttccttcttttctttgtcatcttggaggcatggactggagagaggaggtttttttttttttttggtagagacagtcttgctctgttgcccaagctggagtgcagtggcacaatcatggtttactgcagcttcaaatttctgggctcaaataatactcctgcttcagcctcccaagcagctgggattatagatgtgtgccaccacggctggctaattttttactttttgtagaaatggggtctccctatgttgcccaggctggtcttgaactcctggcctgaagccatcctcccactttggcctcccaaagttctgggattacaggtgtgagccactgcacctggccttaggtggcactcttttgtatgaaaaaatattggaggaaatacagtaaaatgttaacagccatagtttctgagtgggtgggatgtcagttaattttttttttgggggggtggagtctcgctctgtcgcgtaggctgaagtgcagtggcctggatctcagctcactacaagctccgcctccctggttcacgccattttcctgcctcagcctcctgtagctgggactacaggcacccgccaccacccctggccaattttttgtatttttagtagagatggggtttcaccgtgttagccaggatggtctcgatctcctgacctcgtgatctgcctgcctcggcctcccaaagtgctgggattacaggcgtgagccaccgtgcccagccgtcagttaattttaaattctcttttttacacttttgcataatataattttcaaattttttataatgaatatattcatagtagaaattttctcttgtgaataaagaaagatgacttgcaggcagcagagcggaggatggtgtgaggttgttgtggttgcttcccttgtttttatgtagaaaaagcataatgtggccaggtgtggtggctcacgcctgtaatcctagcactttgggaggctgaggcaggtggatcacctgaggtcaggagttcgagaccagcctggccaacatggcaaaaccccgtctctactaaaaatacagaaattaactaggcatggtggcagatgcctgtaatcccagctacttgggaggctaaggcaggagaatcgcttgaactcagggggcagaggttgcagtgagccaaggctgcaccactgcactccagcctgggcgaaaagagcaagactccatctcagaaaaaaaaaaaaaaaaagcataatgcctttacatggcaagttcttgcaacagcctttgcacctagtaccatgaaaagctgaaaagttaaggctgtgagacagtttaagcagccaatggcaccctcccttccaacctcactttcttcctccatgtaagtgctatgcctcagtctccaagtgtcctgggcatgttccacacttgcctagtgagtcttgtcatggggcagattgatacagggatggaacttacagtctcagataaggattgagagctgggaacaaagggaaggaagaacagagaccacaggagtccagtggtgacatatgcaaggaacttttattaaaaggctgctaacaatcttacatatttgtctaacttttcttcaagagagctttaaacctacattaatcagctccttatccttacagctcatctgagaggcccaaagagccacacccaccagcctcatgccctttctttgcccttggggaaaaaaacaggaattcctaaaaagaatgaaaacccagacaccatcacacttgaatgctgtcctcccaccctcctctgaccactcatccagccatctgggtacccttgtgctgagaagaaggggagatttcaggtggagaagcagggtacctgaggcttccaagacataggagaagcaattaaagacttaaataagaccatgtgaccaagtgctgaattatggagttcagattcgggtgttctaggaaagcagatggtgacagaactgagaaggctggggtctcaggaaaggcctggcatgtattaaatatttgctgagtgaatgagtgaacaaataaaggacctaggctttgaaggctttggaataataaggacatatgttcacatctgtgtggaatttaccagttgataatggtttcatccattgttatctcatttgagtcctgtgatagccctgtgagaagagcagggtggaaattgttctccccattttccagatgaggagattgagccccagagtgatgaagtgactgtgatgaattcagcacacatttcctgagtgcttattatgtgctaggattcatgctggaagccagacatgtaggaatgaagtccattaaggcccagatgctcattccaacagtgctgaagtgatacaagggctgttacagtgttctgggagcacagggaagctggcacttgatctggatctccaaggatgggtaggagtcttttaggaggaaaagagaattctaggcagaaggaatacatgtaagggacaaaggcaaggaataatgtggcttatttggcataaagtgtgtaattagatctaagggaagcacaggttggtgaagagaaggggtatgggaagataaagtttagagaattgcctctttggttagttggttatttgtcaaattgaacagtttggacttgatctttagagctgtggaaagccatgaaagtttctatgttttatttattttattttttagagatgaggtcttgctctgctacccaggctggcattcagtggcatgatcatggctccctgcagcgtcgaactcctgggctcaagtgatcctcccacctcagcctcctgagtcataatagtttttgaagcaagagaatgatagccctttactgagtctttccttggatgtgcatgtgtttgctgttcttggctttttttttctttccccaaaatagctcaggagctgcttcctccaggagcctctccttgatcaccgggcctccaggctgaatgagatgcttctcatggacttcctcagccaggactcctctgtcttatcacttatctactgctttgttactctgtgttgacccaccttttattctagtttttgtccacctagaggtcaggcaccatgtctgactcatgtttgtaagccccatgcccagcacagggcttgccccagatcaatgtgctcagtaaatatttgctgaaggaatgaatgggaggagctgggttccacctcagtgctgagacaacatttggggcaggtgtagtgatggggtgattctgagtagtgtgcatttcctcagtggtgctggagtaaggagtgagtgtgtgaatggtggggtgaccattagaaggatggtgactcagggtgacaccgaaggtctgttcctgagtgactctaggtctctcttgcagatggcttcagtgacagatggtaaaactggagtcaaagatgcctctgaccagaattttgactacatgtttaaactgcttatcattggcaacagcagtgttggcaagacctccttcctcttccgctatgctgatgacacgttcaccccagccttcgttagcaccgtgggcatcgacttcaaggtgaagacagtctaccgtcacgagaagcgggtgaaactgcagatctgggtgagtcccgggaatcttgggcaggattttcctgagaagcggctggcctgccagtacaagggcttagaggtggggccagcttggaacttctgggccttacagcatcaggcattaatgctgtttcaggtgtggcccctgggctaccctctgctagttttatacaagtttgctctcctccaggggttcagttgcttctgctgtttaactatccaggaggttttatgttggcttgtctaaatgagtgaccaagaaactggggcttggagttagagacttgggttcaaattctgcttctaccacttactagtcatggaacttgactgaattgcttaacttctctggggcaccctttctcctttggggattgtaatagcatctacatcataaggctgttgggtccttaggtccttggcttagttcctggaacatagtaaatgcacactaaatgttagctaaggtatcagttatctactgtcgtataacaaatcacttcataagttcatagtgccagactgggcaacattgtgagacctcatctctcaaaaaaataaaacaaattagctgggcatggtggtgggctcctgtagtccccattacttgggaggctgaggtggaaggattgcttgagcccaggaggtcgaggctgcagtgagccatgatcatgccactgcactccagcctgtgcaacggagcgagactccatctcaaataaataaataaataaataaataaataaattggtagtgtcaaacaacaataataattcattatctcatagtttctgtggatcaaacatttgggagtggttggggcctctcatgaggtgtagccagatgttggcttggcttgcagtcatctgaaacatacactggagctggaggatcttttttttttttttaagacggagtcttgtcctgttgcccaggttggagtgcagtgacatgatctcagctcactgcaacttccgcctcccgggttcaagcgattctcctgcctcagcctcccgagtagctgggactacaggtgcccgccaccatgcccagttaatttttgtatttttagtagagatggtgtttcaccatgttggccaggctggtctcgaactcctgaccttgtgatccgcccacctcggcctcccaaagtgctgggattacaggtgtgagccaccgcgcttagcctggggctggaggatcttaagactgcacactcacatgtctggtgctagctgttggcagaaggccttacttcgttcccatttggcctcttagagtgtcttcacagagctgctgaagtgtctttatttgcatagcagctggcttttcccagagtgagagatgtaaaaggccagaggaagtggcaatgtctcttatgagttagccttagccttacagcgttctgttggtcactgattcagcatgggaggaaactacacaaaagtgtggatattgggaggaaagtatcactggggaccatcttggaagctggctgccacagctactattattattagtatctgccaatagtactaataaattatgcacatattttagatgatatagcaacatgtagatcatatagttttcaaaaatgaattagtacctggattggaaattttgaaaatttgtgatttaaagtatttaaaacatgtattattattattttattttatttttttcgagacagagtctcactctgtcacctgagctggagtgcagtggcactatcttggctcactgcaatttccacctcttgggttcaatcgattctgttgcttcagccccccaagtagcttcaattataggcgtgtgccaccacgcctggctaatttttgtatttttagtaaagatgggttttcaccatgttcaccaggctgatcttgaactcctgacctcaggtgatccacccgtgttggtttcccaaagtgctgggattacaggcgtgagccaccacgcccagccaaaacgtatgttatttattatctttctattctgcgtgttaaatgtacattaatacattatgcatatatcttattggggcagtctgtatgtagtacttttctttttacaaattatttcccatatactatctcacaattaacactatgaagtaggtactactttaatacactcctgttttgcaggataagaaactcagagattagttaacttgccttaggtcaacaacactgctataaagtgggatttcaacaagatcttctgattcaaaagtatgtgctcttttctctacactgtgcatctgaggtattatagagttcatatttcccttcatgataatgtcaaatattatatagggataaaagttcattttgttcatttgctctctattaaaggcattgaggagtcagagatcattagaaatagaagaagctatacgggtcgtctagttcactgattcccagacccatggcatcagcatcaccttggaatttgttagaaatgcaaattttcaggcccacctcagaactattgagtcagaaactctggtgggtgagtgacaaccatctgtgctataacaaattttccaggtggttttgtggctggctaacattgtagaaccacttagtttaactagcttgaggtgaaagtcaacatgcatttactaaaagcacctattaggtgccaggtgctttcacttgtgttatttgatatcatccttacagttccatgcacagggggatgtgagagcacagaatatttggggcatggtgagcaatacagtaaaactggatcaaggttgtgaaagagcagagagtgggtgctgagagaaatttgctggagaggctataggtggcagattgggggtcaaagagatcttccacagcaaacagaaagttcttgtcatcggtcagaggattcatgcttgatgattccttagggaactgaagaaattattagagcttacttttaatctttgaacataagatattttttactgatatttactatgtggattgacagaagtgtctttgtttgacccccatatcagatggtcagatagcctacactcaaaaaatcttgagataggaggaggcattgtgcccttctgaggggttgacagtggactgactcacttctttgtttatgttcagccaattgtgagcttttgtggttttcttgtgcctgggtaagtggatttattgattacatggtctagttttaactaaatgaaacctcataatggatatgtggcttttaaagagtcctataaagaaacctctgattgaagactatgctagaagattatagtgaatccaagtgagcataaagaaaatggctgaactggtgtttttccaactcccaacacaagttcattgtcagccacgtttcgaggtaaaatcaatgataatctaattagatacgacatagtcaatctcccatccaagtactaaccaggcccaacccctcttagcttccgagatcagatgagatcgggcgcgttcagggtggtatagccatagatgacatggtcaatctcattgcttttgctgaaggaaaattagcaaagggtttttatgtgtgtgtatgtgcttttatgcagcaaaaataaagttttctggactattcatgaatacattagattttaaacatttaaatattgtttattttaattttatatattttaatatcttgtgtatagaagtagacatatagatatataatctaaagaatacacatatactgtgtgtgctgtacctacatttttcttacttaaagggatgtaagttggagaccaccaccataggcactggggagccatagaagggtttaaacaagttagatttgcattttagaaaaattcctggcttcagtttgaagggtggatggaaatgaggcaaagaaaccagggttttggatccaaactcatcaaattgtatacattaaataagtgaatttttttgtgtatcaattatacctcataaaggctatctaaaaattaataaacaaatatagtagtgaccagctataaaagaaaggaagcaagcaagcaagcaaggacttgggtaaattatatggggctgaactaagtgtattattctgctctggctgccataacaaaatacaattgaaattaattttctcacagtctggagactggaagtctaagatcaaggtgccagtagggttgatgtctgatgagagctctcccctcgggctgccttcccactctgtgttcttgtggcctttccttggtgcatgggcatgggggagagatagtgcaaactctttggtgtctcttcttataatgatatgaattctgttggatcaggaactcactcttatgacatcatttaacttcgattacttcctttgaggcctcatctccaaatacaagcacactgagggatgagcaacactccaactcaaaaaaaaaaaaaaaaagaaaaaagaaaaaagcatagtgtatactgtataggattaggtactatctagggcttcaacatacacattttgggaggacatagacattcagtccataacgctaagagtgacaaaatgacataagggatggaaatgaagagagagatttggaactagaatttacagaatttgatgatcaattgctgtcccctcttatccttggtttcactttccaagatttcagttacctggggccctctagatctgaacatactaaacagaaaattctagaaataagctaataaattttaaattgcacactgcttttttttctttgagatagagtctcgctcggttgcccaggctggagtgcaatggcatgagctcagctcactgcaacctccacctcccgggttcaagcaattcttctgcttctggagcagctgagattacaggcgtacaccaccacgcctggctaatttttgtatttttagtagagatggggtttcaccatgttggccaggcttgtcttgaacttctgacctcaagtgatccacctacctcggcctcccgaagctctgggattacaggcgtgacccaccgtgcctggcctaaattgcacactgttttgagtagcatgatgaaatattgcactgtcttgctctgtcctgcccagggcgtgaatgatccctttatccagcatatccgtgctgtatttgctatctgcccattagccactcagtagccatcgtggttatgaaattgaaaaaacatagtgtggtctgggtgcagtggcccacgcctgtaatccggcactttgggaggctgaggtgggaggatcatgaggtcaggagttcgagactagcctggccaacatagtgaaaccccacctttactaaaaatacaaaaaattagctgggcgtggtggcaggctcctgtaatcccagatactcaggagggtgatgcagtagaattgcttgaacctgggaggcagaggtttcagtgagccaagattgcgccattgcactccagcctaggcgacagagcgagactccatctcaaaaaaaaaaaaaagaaaagaaaaaagaaaaagcatagtgtatactgtataggattaggtactatttgaggtttcaggcatccactgagggtcttggaacttatcccccaaggatagggggagactgctttcattgtaaagggaaagggggaacatttatgtgtgtttatacatatcacttctgtacacaaaagttttgtgatttttttttttttggttttgtgagctttgataaatcacttcatttttatgactagttaatgtcttcaactattaaagcctcataggtttgctggtggtgagggggcctaaatgtgataacataatactgtgtctggggaatgcaataaatattgggttccttcctttctctacctttgggtccacatggaaggggtcactgggttgctttctttctttttttttttttttttttttttgagacggagtctcgctctgtcacccaggctggagtgcagtggcacgatctcagctgactggaagttctgcctcctgggttcacgccattctcctgcctcagtctcccgagtagctggggctacaggtcccagccaccaagcccagctaattttttttttttgtatttttagtagagacggggtttcaccgtgttagccagggtggtcttgttctcctgacctcatgatctgcccgcctcggcctcccaaagtgctgggattataggtgtgagccaccgtgcccagccactgggttgctttctgaagttttccatctgtggttccagtgtaggaacagcatttagtgactcactagcacagtatgaagtgttcagttaaattcctccagcctatttgatctctcttaggggattccagacacaagaagaggaggttatgagcattgctgagcagggccacccacaataggaatttctgtcatctctgggggatgagggtcttgggagtgccttattgcctggagcccctcaccacaaaggtccctgagagctccctttgtttcctgagaagttaatgattgtggatcagagaagaaagtcttactggggaggtagggataggagagaagcctcattattagggagcgagagcatgcacaggtgtgagaggagacttggtaactccacagcaacggatccaactagaggccacttattgctgggtgctggttgccaagcaacccctggagaccttgtgggaatagaagagtggagggggcttccaccacctctatgtggggcccattgcagaggctgtctggtgctgatcaagagaacaatccagaggattgagctcacctaggactctgggtcctggattctagtttttgtttttttgtttgtttgtttgtttgttttttgttttttgggttttttttttttgagatagggtctaactctgtttcccaggctggagtacagtggtgcgatctcaggtcactggaacctctgcctcctggcttcaggtgatcctcccacctcagcctccctagtagctggaactacaggtgtgcctggctatgccatgcctgaataaattttgtatttcttgtagagactgagtgcaaccagcacccagcagtaagtggcctctagttggatctattgctgtgttggtgatgatttaaaagctcttagtgtaactaaagacatacatagataatgtgcataaagcactaacatagtgcatggcacagagtaaacactcaacaaatcgtagtttttattaaggttctagggagattgataaatagcattccttttcttccccacctaaacccattgagaaatagatgcaggagtcagagagatggggcgtaatggaaaaaaaaaagccttattactcattaaagcgaggatgaagccatggctaaagtcttccggcaagtgcagcttgctcatactttactctggagtcagaaagacacacaaacccagtcataggccaacgtgggccgctggctataattagcccgtacaccattcactcaaagtcaaagtccatgtggcccagatttactaatatttaaggcctaaagcattccactcaggtctgtaggagaagcctctgtctccatggacagccttcctcatagacagagaaaggagggtccctcctccaacagctcttttttaaattatcattttattcatgtatttaatgttgagacagggtgtccgaggctggagtgcagtggtatgctcatggtttactgcagcctcgacctcctgggcttaagcaatcctcccaccttagcctcaccagtagctgggactataggtgtgtgccacaccatgcctggctaagttttgtattttttgtagagacagggttttgtcatgttccccaggctggtctcaaactcctgagctcaagtgatctgcctgcctaggcctttcaaaagtgctgggattacaggtgtgagccactgctcctgcccaatagctcttactataattaaagacatagataagagtgaccatgggttccaaaggagggttagacagaatgacaaacaatgggacaaacaagaggagtcttaagagatttcctgggaatctgaattccacagtgatgtgagtaactcctcatataaacaggaactgagaacaaggtcaaggtgagatggggtgctgggcagtcagcaaggttcgcttatcagtcatctgccttatgtccacacagcagcctccatgaaatgttaggtcacaacatggctttggagtcatttataaatattaaagctagtgagtattaaatctgggaatgtcaaggatctgtatcttagggccagtaatataagaatagctgaaatgtaagggagtgtaggaatgtgggaaaggtaatcataccagaaacttggaagaaggaggattgtggctcttcagcagccatttaacaaatatttactgtgccagattctggggatagagatattaatataaatgtgacattccctgctctccaggaattaatgagactgaaattatgagcccaataaatgaataccatagctctcttgttctgattaggggaagaagaataggatatcaagagacttttccctagaatttaagaatgtacagtcatggattattatatgagattgggtagctgtctaataggcttctctattagtttcctgttgctgcactaaaattactacaaacttagtggcttaagacaacacaaacttactatctcacagttctggaggtcggaagtctaaggtgggtctcactgggttaaaatcaatttgttggctggtttcagtctgtgttctctctggagggcctcatctggggggcatctttaatttgccttttccagcttccagaggctgcctacatccctttgcttggggccccttcttccatccatcttcaaagctgcagtggaacatcttccaacctctctgaacctcctccttgtctcttataaaaacacttgtgattataatgggcccacctaggcattccaggtcaatcctgcattttcaagatccttaatttaatcccatttgcaaaaatcccttttgccatgtaaggtaacatattcacagattttagggattatatatttgggagactattattctgactactacagcatctgttagtaacatataaaagacctggttgggcgtggtggctcatgcctataatcctagcactttgggaggccaaggcaggaggatcacttgagctcaggagtgagaccagcaacatactgagaccttgtctctacaaaaaatttaaaaataagctgtgtgtgtggtggcatgtgcctgtagtcccagctactcatgaggctgaggccagaggatcacttgagcctgggaggtcaaggctgccttgagctataaccacaccactgcactccagcctgggtgacagagcaagatcctatctcaaaaaaaaaaaaaaaaaagaaaaagaaaagaaaagaaaaaggaaaatacctgatataaattccctcatcctttaagactctgaagcaggtaatgtccatgttttaagttcacactgctgattaagatttcctgttaccttgttaggtgtcaacaagcctgtgaatttagagcacatcacatctcagtctctcattttatttaatttaattaattaatttattttttgaggtggagttttgcttttgttgcccaggctggagtgccatggcataatcttggctcactgcaacctccacttcctgggttcaagcgattctcctgcctcagcctcccgaatagctgggattacaggcatgtaccaccatgcctggctgatttttctatttttagtagagacaggttttcaccacgttggccaggctggtttcaaactcctgacctcagttgatcctcctgcctcggcctcccaaagtgctgggattacgggcgtgagccactgtgcccagcctcagtctttcattttagacaggaggaggctgaggctcagagtgagatagggactttactgagggctcatggtgatgtcccttgacccattccagtgctcttcctgccaccttcaggaaggtgcaatctcgtcttgagtgtaagctggagacctgtggagagatcagcgggcagcacagaagagtctggaggctgaacagggaaactggggctctgacaagtctctgtggctccaggaatgtgaagacagttcctgagtacaccatcctgtgctcagctcttatgataatcagaattgatttttctaggcagcaagtttcctggtgtggctgcagaaacatgctgacacttttatctccccaaagcctgtaggaaccagctgctgaggaagtaagtttaatctgattttaaaaatcacaacaaagaccatggggagtcaaatcaggcttagttggcctctgtaattttcaaatgaattaacaagccatcctgattgactattgaaggggtctccaagacacactatttagggccacaaccccctttccttccatccaaactggcatgggagaaaaagaaataatctacaagccatttgtgtattcattaatccattcaataaacatgtgtcatgtacatattatatgcgaggcactgtcatgagagggcaaagaaacagctacaatgtgataaaagcgatgtaataaagggatgaagaaagtgttgtaagaacagctacctccacctgggaaaatcattgcaggtctcacaaaggaggggacatttgagcagggtcttgacaaatgagtctgatttttttcaggttaatgtagagtaagagctttacaggtggaagaaatgacatttgcaagagcataattgctttcaaggaccctttgtgtgcctagctgtgctaggctctgcagcgattggtgagacaacatccctgcctcttaggggcactcagtgaagcagaggagaagggggatatacaccaggcacgcacacattgaaatgcattgcagacattgagcagtggaatgacatgctctgtcttacattgttttaataaatttttaaatctttgggtaattttaggtttatagaaaagttgcagtgatagtgtagagttcccatgtgtcctttgcccagttgccctaatgttaacattttatataaccatgatacatttgtcaaaactaagaaattgacattggtacaatacgattaaactaccgtctttatttgaatttcactagttttttttccacaaatattctattaccattgcaggatccaatccaagataccgtattgcatttaataatattttttcaattgacatataccttatataccataaaattcaccttttttttttttttgagatggagccttgctctgttgcccaggctggagtgcagtggtacattctcggctcactgcaacctccgcttcccgggttcaagcgattctcctgcctcagcctcccgagtagctgggattacacgtgccccccaccgcacccggctaatttttgtacttttagtagagacggggttttgccatgttggccaggctggtctcgaactcctgacctcgtgatccacccacctcagcctcctaaagtgcttggattacaggcgtaagccaccgggccagccaaaattcacccttttaaacagtatagttcagtgatttttagtatatttacagacttatgcaactatcatcactaattccagaacattttaacattttagtgacttacatctttctttctttctttttttcgtttctttttttttttttgagacagaatttcactctgtcacccaggttggaagtgcagtggcgcaatctcggctcactgcaacctctgcctcccaggttcaagtaattctcgttcctcagccacctgagtggctgggattacaagtgtgtgccaccatgctaatttttgtatttttagtagagaccatgttggccaggctggtcttgaactcctggtcttaagtaatccaccagccttggcctcccaaagtgttgggattacaggcgtgagctactgcgcctggccaggtgacttacatcttaacacttaacaggatttctctgaggcagagttatgcctgtttcaagaataaattatgaagagcaaagtgcagaagcagggagaaccagttaggatttgtaacaattgaggctgggaatgatggtggcttgaactagggaggtagtagcggtagtagtgagagtagtcagattttgcatgtatgttgaaaatactgaatattgaattagatgtggagagagaaagaaggagagaagtcaaggatgttgctgagggtttgggctgagcgactagaagtttggagattcctctaactgagatggggaagactgcaggaagaacagggtttagagagagagagttggggattcagtttggttatgctaagttggagatacccgttagataaccaagtagagatatggaataagcagttggataaatgagtctgcatgtatatgttagcaagtagtattttaaatgatgagaccaaataagattaacaagggaaagagtgaaggcaggaagaagaaaaggttcacagactgagcccggagacattccaacaccaaggtgttgggaagatgagggagaatcgggaaaggagactgaaaaagagcaactgaaatgagaatgtgtggtgtcctggcagccaagtgaagatagtttttcagaggaaggagagatcaactgtgtcaaatatggctgctaggttatgaatatgggaactgaggattgactgctgtatttagcaacatagagtacattgataaccttgatacaagttgttttggtggagtaggaggggtgaaagcctggtaaaaatggcagaagagaaattggagacaccaagtatgacacagcactttgaaggatgtttgctctaaagaaaaggagacaattggggtggtagctgaaggtgaatggggaagtgaatcagaagaggtttttgtttttttaagatttgagaagtagcagcacgttcgtatggtggtagaacaattgaatagagatcaacaaagcaagccaacaaagaaacaaaaatacaaagctgatgatttggaaacaaaggagaactgctgggacaatatccttgaactggggagaggggataggattacatgcagagggtgagtccttggtaggagcacagactgtgcacctacattcccaggggagaaagcagagggtttgggcacaggtgcagcttggggttccatgtgctggttcgagttctcttaagtacaattttctgatgaagcaaggtcatcagtggagagtgaagatgagggaggaagtttggagagtcgaagagagaggagaatgtcatttaggaaggtgggagagtgaatagactgtggaaatgtaatttgattgctgattagcattaagacttcatttgaaattagtgatcataaatttaaattcatcagctcatgaatttgaagcatggttgtgtgtttttctccagccatgttttgctctgaggataaaggcatagaataggcaaagagttgactttaagtaaagtgtggttttgctgagtataacaaagcaagagggcctggggagtcaggggcatgtgaagggaggctgttgtcatgattgaccttagaattcaagttgggccaagagggaggtaacaacacaagggatgaaggacagtgaaaaggtggtagggaaagaagactgttgatgctgggaatctacaaggagtgagctggaaagagcatagtggtctgagtatgagaggcttgaaattactattggtaatgataaggtccaggatatgactgtgagagtgagttactgaggtggggtcagagatcaatatcactggaggagaagcattcaaggaaatgagagtccaaggtgatggaagcctcatctatgtggatattgaaatcaccaagaattatggagagagtaacagtgaagcagaagctgttcactggccagtagagggataagtgggtggtataatctcatgatattgaaagctggaggtgttttgttttgtttttttgaaggagggaaagagagtgatatgaaagcaggggtgagaagcaacaacatctatcccacctccagcccgctgattcaagggtgatgagagaggaagtgagcaacaatttagaggctttaggagaagccatgtcctcagggagagccgggctttgattacagcaaggaggtaaaagaaacgttcggatgagaggctgagcaaaaatagatttttctgatgactgactgaatttcagaagactcagagaaaggtttcagtggggaggggaggagacagtgttagaaaagatgatgatgtactgagctatatggcaattggagtccagtgatcagggatggctttggagacatgggcttcttgccataattgacatgaacagagggataaagagaatacaaaacaaattataaagcagacaggtggtcccaggacagacagtggttgtgtggcgtgtgtgggaggatccctgcttccttttgatccctgcatttagaggcccagagtctggcaaaagtgccattcttattctgaatgcctggcatccctcttgacttcacacatcaataattgtggcaatgaacagcagctttcatttagaccttcacctgtaaatgggactaatactatctcccacaaagctgatgtgagctgacagtggcacgggctttcatgccagcactgtgctcagtgcttttatgaactgatttcatcctgacactaaccctgtgaactaggtgctgttattatccccattttacagagaagtaaactgaggtccagaggagttagatggctgtctcaagttcacacaaatagtaagtggcagagtccagatttgaatcagggtctatctggcttcagtctgggtgcagtggttcatgcctgtaatcccagcactttgggaggccaaggcaagtggatcatttgaggtcaggtgtttgagaccggccttgccaacatggtgaaaccctgtctctactaaaaatacaaaaatttagcggggcttggtggctgacacctgtagtcccagccacttgggaggctgaggcaggagaatcacttaagttcaggaggcggaggttgcagtgagccgagatcgccccacttcactccagcctgggtgacagagcgagactgtctcaaaaaaaataaaaataaaaataaaggtctgactgtcttcaaaacccatgtatggagttttgaaccccttgttatatcttcacataggtaaagcactctgtaaatggtgaaattgttaataattacaatttttgggcagcaattacatactttacaggtgctttacttgcagtttttcccttataattatcacagtgatggtgcccagaacagatgaggaaactgagactcagagaagttaagggacttgaccaaatcttaccaagcctggaaaatagcacatctgggactcaaaattagggatgtttgccaccagagtgttcttttcacaccaaactgccttccccactctttccactgccctgtggtaccccagggacctcacaggtggttgagagtcaacgtcacagctaaaaatcagaacctccaaacaaacactctcagaaacggaggtgttatctgttgcaaactatcaccttttagttaccagctcccctccttttctaccagccctcctctctctctgtcccactacaacttcacaggggagtctaatgggcatccaagattgagcaacaccagtgtataggtatgtaattaagtgacttggcactgaatgtagtggtctctgaagaagctgctgcatgttctgggcatagggtgaaaggagtggttgggggcttaattacttcagctgtggtgtaggtggaatgaacacatggtaccagcagtgtgataagtaatgtctctgaacctctgtttcctcagctgtaaaatagaagaatattaatgcctacttcttagtgttgtagtaaagattgaatgagatcatatagggaaaggatctagcatggagcctgtaacatattaggtgctaaataaacttacccaaagtcatacagtgaaggggagagccaggattagctcatgaggtttctattatgctgtactactgtgactgatcttagggttaccaccactttaagattgcgagccacaggacttacaaggcggagtcatcaacagagaaattagttgtgagttgtggcccttttactcccattttcaatggatggagagagcagcagtgctctgcccctgaagacgtccagttgccatctaaggctggagattctcctagcctgcttggaacctgcctgatgtgttgctaaggacaggggtgggatgggggaggccattcaactgaggatttataatcccttccttctgcagaatcctccttcccccacaccgttgcccaacaccattgccccacaccttgggttgccaggcgacagctggaaactcttatcctgtctgtgctcctgtgcttctcaccttcctctgtgaagtctgtcagctctgtgctaatgacgcaggggctctgtgctgaggcccagatggctgggagggcaggtcccaggggatacagtgccccctctcttgagtgccccactactgcccccagctcaaaactaagggtcatcctttactcctctctgctcttgtcatattcatctgattgttcatgagaaatatccattctatttccccaatttctcttgaacgcatcccctggtcagttctgttccataaacatttattgagagcagactgtgagcctagctctctcctttgccctttcctaccttagattcctgttctcccccttggactgcagctgcccggtggcactccctgccctcaggcttgccctccataatcgctgtcactccagtgcctaaaatccaggggggctctcctgcatccccctcaacacattcttggccctttctgcctccccaaccccatcttcacccttcaggcagtccatgcaccacccacgtgtactctaaacccccaacccaaccacaggatgcagttttaaaaaaacaaaacctttattttttagaacagtttcagatttacagaattgcaaagatagtatggagagttcccatttacccgacacctggttttccctgttattaccatcgtacattagtatggtacatttgttataattaaccaatatcgatatactattattagctaacatccctagtttattccactttccttagattttacctactactccttttctgtcccaggatcccatctagaacacaactgatctgaattgtcgtgtctccttaggctcttctgggctgggagtcgggatgcactttttcactccttgccttgcccaggttgtttcctcctctctagagattccccctctacccacatttcctttttgtttctcttcctttttttggaatagggtcttgctttgtcagccaggctggagtgcagtggtgtgaacatggctcactgcagcctcgacctcctgggctcaagccgtcctcccaccacagcctccagagtggatgggaccctaggtatgtgccaccacacccggctaatttttttatagagacagggtctcagttttttgcacaggctgccttgaactcctgggctcaagtgatcctcctgccgaggcctcctaaagtgctgagattacaggcatgagccactgcacctggcctcctcccccattttctatcagcaaactcccatttgactttgaagactcagttcaagtatcatctcttctgggaaacctttgatgacccacctccccgcaactcagtggcagttaaggaccctccttaactttccatactaaccagctgtattgcatgtgtctggaactcacctgtcttcctcccagactgcatgctccctgagggcagggaccgggtctgactcgggtctacagctccagcaccaggcacagggccttgccaatagtaagggtttaacaaagactggcaaaatgaaagtgagtgctcaagctaaggctgtatacctctcaaagttgaggctatctcttctctctgcacttgcagtgcctgatctctctcttggcctcagatcaagttttgtgccacccccacccctatcagttctgcccctcagtggctgggaggtctgaggctcctcttgggttagcctctctagaatgagtaggccactttcttttcttttttttttttttgagactgagtttttgctcttgtcgcccaggctggagtgcaatggcgcaatctcggctcaccgcaacctccgcctcccgggttcaagtgattctcctgcctcagcctcccgagtaactgggattacaggcatgcgcctccacgcccggctaatgttgtatttttagtagagacagggtttctccatgttggtcaggctggtctcgaactcctgacctcaggtgatctgcccacctcggcctcccaaagtgctaggattacaggcatgagccaccgcgcccggccgagtatgccactttcttaccggctttcctctcagcaccactgtggacaccagtccagtctgatcatctgatacatatgagatctcatttgatcacaagaggaggtcttgtcatcctcattatacacttgaggaaactgaggcccagagggtaaagggttgtactttattaaagttgacaaatggactaagtgggccctgaatgcaggcttttgggactcattcccttgcctgggatcttcctactggaccctacttctgcatataaaaagtgacacctaacctcagtcaacaattaaatgctgtactagagccatcccaggacatcccagcctcctctgtgcctggctgaacccctcaggttcttcagctagaacatggggaggaagagataaggaaggtaagagagaagagaaagggaagatagagaaaattggtggcaattctgaggttggaccctgtgttcaggctgccacgaggtgccattttgtgaggagagaatatgtcctctcaggataccggcctcccccaccggtgtgttgccgtgtcaactgattgagcccaaaggctggcttggaaatttaccaccaacggaggcttaattagccctttaatttccttccagcggaagtttgctcaggtggttcctagccctgctttcttgggctcctccctcctctcactttcctacagctctagctcaccaggaatctgaggcccattctgggtgttgacaccagggggaagagcagcagattactgagggcaaacagtaaattaaatgaacacgactgtttatacagaactttaccaacacactgtcacaacacttatcttactttatcctcccaacaataccaagaaaaggatattattatgaaacctgttttgcagttaacagatctgcagctcagaaagtcaaagacagcaactggtccaaggtcacatgccaagaagtggcaaagctagaatttgcttgaccccaaaatccatactctttctgctgcccttcacactgtctgttcattaagtgcttacagtgtttaatgaaatgacacataagtgctgaaggaacactaaaattaaggggggaggatgagaatgagggtaattttaagaggcttcttggaggatgtgataaggacagaagtgggtgccaaagtgcagggaatattgttaaaatatatttttgtcttgttcccatagggatttaaagtggcaggaaaagatcgacagagtgagggcctgcaccgtttttttcttcctcctggtttggtcctgactctagcctaagttttccaccagttgtgctgctacagattatctcccagcagttcatttgatcactcaagaacaaacagacaaaaccatgaaaagagtttatatagactttacataaaaaccactagaagattttatagtctggtggaaagacaagcacgttggcaattcatatacacagtttcattggagagaggatagaagagaagttaggaaggctgtgaagtttgactttctggctcgggtcttttaccagctgtatggcttcaggcaaggtgtttaatctctgaatctcattactttatctgtaaaataagtatgaaaatgggacctcgctcagaaagttgtaagaattagcacagtgcctggcacagcccgtctaaacaaatggcagccagtcattatttctgcctgtgggtatgggaggaaatgcgagtcatacaggaggaagcatttgagctgaattggaatggtaattagcgactgccttggcagggaaggggaaaaggctgatccaggcagagggtgcagcatgagcaaagcactgagacttagaggaacacaatgtttggggcctatggagttgtccaggttggtcagaacctgaggagaaaagaatggagaggggtggcaagagctgaaggcagtgaaattgttaggttagaaaaccagggataagtttagcatcctagcaggcagtataacttaggggttaaactcccagctctgacatttgctaacctgggcaagtacttaacctccctgtgcctctcagtttatttgtcttactccaaagagctggttatgaagactgatgaagtagtgcatgaaaagtgcttgtcacagtgcttgacacttagtaagtactcaattcgtgttaacaattattattatttgattataacaattattactatttatcctgactccttagagctagaaggggccttaaaaaagtaatctagtctaatatccctatttaaagaggagaatccaaggcgcagggtgcacagtattcataagcccacaaagcaagttagtggtaggattaaaccatacccaggcctcctgcctcccagccttacagctgtgtggctcccttgccattcattgtcaggctgcctctgacaggctcttcctcgctcctcagatgtttgtcccctgtcccttgtaaataaatttcaaggcatttgctttgtggagatgagtgttgatcctatttttagaacactctgccacctgtatgcaaatgatcctcaggggactcgtctgctatggtgacttgggccaactcctgaaagaaagcagctatgagaccagagggaaaacagcccagggtaggatggggatcctggactcctgatttctctatctagttaagtctctgaactcctcttgcctgctctgtatatgttaactccttgtgtctccatttggaaatgagttcagaaataggtccctggggccaggcgcagtggcttatgcctgtaattctagcactctgggaggctgaggctggcggatcacttgaggtcgggagtttgagaccagcctggccaacatggtaaaaccctgtctctactaaaaacataaacattagctgggtagctgggtgtggtgacacatacctgtaatcgcagctactcaggaggctcaggcaggagaatcgcttgaacccgggaggcagagattgcagtgagccaagattgcgccactgcactccagcctgggagacagagggagactctgtctaagaaaaaaaagagtaagtaagagtaagtccctgggccaggtgccaagccaaggttttggctttggaatgtcatgtcagagggtgctgtagaacccagggctgtgggcattcacatcggctatggtgttggctcagcttctggagaaatatttattgttttcaggaaaatagaagtaattgggggattagagggagaaaaatcaccttaatatacaacccaatgattctgccctgcaaaacgggagagaactggaactcatgagatgacaagaaggagagggagggcaaggcctcaaacttcgctcataaaggtcaacgccccctggcctttggcagaagcagcagtgacctgatcctcagtggccttactatttagcacacactaactgaatgtcttccgggtgataggccctatgttggacacactaaacccttcagtggctttctgttctcgtcaggacgacatccaagcaccttgacctggcattcaagacctccgtgatctagctacagcctcacttcctacttcctctcctgtctactattttaagtactatgtttccaggaatctaagatgctatcaattctaagatacatccttttttaaagatattaaaatgtgaaaaagtggacatctgagaatctatgaaatatggtattttacaaaccattgaaaatggaactgcttgctttctccccagatgctgtgctgtttcaggcttctctatttttttaagctattttattatggaaaatttcaaacacacactcgagtagggagaataagtagtacatgaactctgtcctccagctacaacagtgatccactcatggttggttcacatgcttttcctatacttccttctccctggactggtaataataataagaatagcaactgccagtgcttactaaggatttagtttttttcttaaatgtataagttaatatatgcttatttaaaacatattttgaaatcacagccaagcataaagaagaaaatgttactgacatttgggttggtggttggttcctttccagtttcttctctatgaatttttaacatagttgaggtcagattatatattcaattttattaaacatagcattataacataagcgtagctaacattgttagaaaatctttatatgtttttgatgagttcattgtactttatacaaaagatgaaccatatccattcattcattcatccagcaatatttgttgcacttaccacgtgtcaggcactctcaacagtggtaaaagagtgaggcccattctctggcctctcaaagctcagtttccccccattgtttgacattcaactactttccaatttggagctgttatcaataatgttgcagtgattatccctgtgtgtaaaacttttcctaggtttcagatgatttcctttagacagattctcggtagtgaaattcctattttactttacctttgtgaacactgaatgttatcttaattttagtttagctaattcagtaggttaaaaaagtatctcataatttcaattgcatttctttgattatttatcgaataaatcatctgtatatttattaaccattaggtattttttagttttttgtttttaagatggagtcttgctgtgtcatccaggctggagtgcagtggcacgaccttggctcactgcaacctccacctcccagcttcaagtgattctcctacctcagcctcccaagaagctgggactacaggcgtgcgccactgcactcagctaatttttgtatttttagtagagacgtgttagtatgttggtcaggctggtctcgaactcctgaactcagatgatctgcccgccttggcctcccaaagtgctgggattacaggagcaagccaccgtgcctggcctaccattagtttttgtgaattgtcttttgacaagagtcttacttttatcacctgcaatttctcagcacaaggcctgactctgttcatttccttttgcttgctgtgatctggggatgtattaagtataatcatgtttcatgcttctttttttcctcctggctctcttccacctcacttctctccccacattttcctgtctcaaaggggagttgggtgagtcacataaagggtacagcaggtggcatatgaagtaaattccccagagagacttctcagaatgctgtgaatggtgctgatgtcaatttggaggcaaaaagagtgatgaggaaatggattggcaactctgatgctaaatttgtccatgccaaagcactgggatattatgaatgatggttcattctgcaggcatctttagaatactgctatatgcccagatgcgtgtggggtactcataagggcttaatagctggagaagacacaaatgaaataggtcataattaatagtcaaccatatacatgttggatggtttcaggctaagtggagatgcccagcagacagttggaaatttccatctgaaacttgaaagtgagggcccaggggaggataaggagccagtgtaggagacacagcaggaaccggcagagctgaagggagagaacaggggaagagaaacttcacagaagctgaggaaagagggagtttccagaaaaggggtgtgtttgggggtgatgtcatgtttttaatttagggcaacaaaaaggttatattacccatccttcttttattttcatttttcttcatttttatcttttttcttcatttattcattcctttgttcattcctttattcatttattcattcctttgttcattcagtatttatggagtaccttccaggtgccaagtattgcattagacactgagggtacagaaacaataaggcacagcccctcctccagtctaaatgagagatataggtgagagtggaagcaaattcctgatataggtgctatgatctattcattaaaaatatttattgaatacctaagatatgccacatacattgaggaacaatgcaaggaagccctatgaccttcagctaatccacttgaagtaaaaagtagtgcctttatcttggtggaaatcatggaaatcaatagctatatccatgagtgtttttgagtttagagtatttgagggctttgtgtgagagaccaatgccaaaaataagaatacagggcattcatctctctggggtcctgtttcccatctgtgaaatgggtatgtacacctctcataggattcacatgtgtctaactttcccactagactgtgagtgttctgaggatagggatcacacatggcacaggctaagatcagtgaatatatgtggaattaattactctcataagggctttctgtctttaatggcctgtgctctgctgtcactaaaataaaggtccaagtacattctgtggaaggccagaagcaatggtgatgaatttagacagggtcctgaaggacttcccaaaaaaggtgcactttgacctggacctcaaagattagataggattacagagggcagggaggcgctttagaatccttaatcctggattccagtgacttcttttctaccctctgccctcaaggacctaaccagttgctacctaagtgttcttggactccaatttacttatttatttttttgagacattgtcttgctctgtcacccaggctggagtgcagtggcatgtctatggctcactgcagcccccatctcctaggctcaagtgattcttccatctcaggctcctgagtagctgagggaccacaggtgtaggccaccatgcccagctaattttttgattttttgtagaaacacagtctcactttgttgcccaggctggtctccaactccagggctcaagcaattctcccacctcagctgggattacaggcatgagtgactgcacctggctgactccatttttattacctgtaaatcagtagtgacaatgacacatggtgggctagaaagagcactggatgtagagtcagaatatttgaatttgagtcctggttgagcctaaaaataaagagctatgtggccttgggaaagtcactgagtgtctaggtctcagtttttctatctgtaaaagaaaggagtcagactggatgaactttaagattgatttcttctggttctaaaatgtctgcattggggacaagggctgcaaaactgcccattgggtactatgctcattacctgggtaatgggatcagtcataccccaaacctcagcatcatgcagtatacccatgtaacaaacctatacatttacctcctgaacctaaaacaaaagttgaaattgttaaaaaaaaaaaaaaaagtctgcatcacagaatcattgtcaggctcctgtaagatgatgtaataaaagtacttgtaaactgtagggtgctctataatgtggtctatatggctgaggacggatagctataatattaagctagctccaaaggaccatttttaccactttcagtcctctgtgtctcccaagctctattgaactgctctttccttcctaaagagctctccccttccagtttccttccattcccatgggacataatgtctcagctctcagctgctgcagaaaaacaaagcacttggagctgagcagctgtgggtcggagggtagcgcatgggggaaagctagcttgaaagttctcattacctgcctccctggtgctcatcatccccatccactaatcttgcctggattgaagacgggaagagagaggagtctggctggaggaatgcacaggcaacagggcacgacccagggatgaagaccccagagataacctctcactttttgtgtgacctctcaagttgtcactgctctgggcctccctttgtctatgacatggaaagtgcccagaaaaaggaggtgatatgtatgagctcacagaccctattccaaccaatcctgaagttctaaatgagctttcccttttcagcacagtcagcccttgagtttcttttgctagcattcttttaagttcctagtatgtggcaggtgctatagttgagggcctaatagttagctaagtatgacttgattttagggtgctcatagcctgaaagaggagacagaaaaacaaactggtaactataacaaatgtgatgtgtacagtgatattgatagcagcaggaggcagacaaatgcctaggcagatagggacaggtccctgatgaaaccccaccttcaagccaaaaacagcctggactgctgctggttctggatgaaacccatgacccagagtgagaacttgtgttcctgtttgcccaccctttcctggttggttctttttgaataatgctttttaaccaattaaatgttgccttttccagtagtactcatggcccacccctcacctgtcctgtgcctaaaaataccccagactcagccacactgggagagatgacttgactttgggtgagagaccccacattcctgatccctctctactgagagctgtttcgtcactcaataaaattctccaccctcatcaccctacagttgtcaatgtgacctcattcttcttggatgtgggacaagagcttaggaccctctgaatgcaagtacccaaaaggctgtggcactgtggccccctgccctccactggtggaaggcagccaccccgtgcgacagaagcagtggtggggccaagccagtcccggagctgtgggctagagtggagcaaggagctgactgagctgttagcatgccactgtctgttgggctgctgctgatggggctgcaagagctaattagcacactgtaacacccctctggagctttggggttgcaggcacccctgcctgggcactgccaccttccccttggggtgacatgcctggtcaagccacaagcccctcacaaagcctgctctcatgtcagcactcggaatggctggctggaccctgcacttgctcactcacacatcccctccctccaggggccgaaggtgcggttgcagtggccacgggatttgtgctggaagcttgccctcagttgcagccctgagggccagagttgatggggtgtctccttctgtgagcctggcaaagtgactgagaaaaatcctgtgccggtgtaatggcaaacatttaaagggcaggggaggaattagtggggaaagaaagttagggaaaacttcagaggatgtgacctttgaatatgtttgtgaattatagaacgcaagggcattccaggcaaagatcagcatatgcaaaggcccaggggtgcgaaggagctgcgtgtttgggaaaccacaagtagttaaggcaaaaactggagctcactgtttcagttaaggaatgacaggaaaggaactagcagggaagcctgagctagatcctgaagggtctttatctactgagaagcttggactccatcttgtaggctttgggaggccagcagacggagatgggaaggtttggatttttccaaaggaccatctgacattctgtgtgctctatccaaattgttacagacacccccatacatttatcctttcaacaaatatttattggaacactctggccctgtgttccaggtgctgtggcatgcactggagatgcaatagtaagcaaaaccagacatcctgttcttgtggcactggtagtttggcaagggagacagaccttaatcaaataattacacaaataaatacaaaattacagtgggagtgagtggtacaaaggagaagctcatggtgccaggaaagcatataattggagcatgtgacttttccaggatggtcagcttctttgctgagctgagctctgaagagagagcattacctcagggaagggcactaggaaggctctctgggaatgggcctcttccgcttcagaacccccacccaatacatgtttacctcctatggtaacagacactgtagactttaagcaagtaccggcttgtattcatctgtttgtcttcaggacctaaccaatgcttggcacagaatcagtaccaagtgaagatttgaaagaaaggaaaagagaagtgcctttaggcactttaaatagttgaagatagcagtactatcccctcaatggctaaacatcttccttcacctggtttcaagttcccttcactcttctctggctgttctgctaatagtcaaggcccctgtgacaagagatttaaatcagtgaagtagccttgtgaaagaggatggtctgttgggagacagaagacctggttttatttaagcccgttttcatgatttcctgtcattcacctcttcaagcctaagttgccgtttttatagaacagagatattggtccttctctcacagggtttctcagggaataaactgagataataagaaaaaaacattgtaaactgtaagagttaaggaagtgtaaggatttgaatatttggagggctgccacatgagtaaagaattagatttattctttgtgtctccagagaacagtattaaatcagtgggtagaaattactgtatgtagatttcagctcaacgaaaggaagaaatgttctaataatcagaactgtccatcagtggaatggctgctttgtgagggggtgggtgtccaagttggaagcactcaatacaaggatgttgtggaaggaattcctattttaagtgagaggatggattgaatgacttctaaggtttccttttaaccctaaaatccaaaaatctgatggtcaagacaagcagagaagctgggagagggtgtattgtggcagagagtagcatgaacagagatatagagcagaaatgaatgtggcatgtgtgacgaccgtgtggaaaactttacgaagaaatgaagagtgtgtgttggatcacatgtgatttcatttaagctttctaggtgatttccaatcttatgctctggtggaggggagattgttggtccctggaagccttagacatggttagaggacttcctgtattgggaggctgcagaggatcttgggggctaaagagaatcaagaatacaaatcaggttggactttaggctgtgttgaaaatgcacaggctttggtcaagacagaatttgaatttttttttttttttgaggcaaggtcccactctgtcacccaggctgatgtgcagtgtgcaatctcagctcactgcaacctccacctcctggcctcaagtgatcctcccacattagcctcccaactagctgggactacaggagcatgccaccatgcccagctaatttttgtattttttgaagagacaaggtttcaccatattgcccaggctggtcttgaattcctgagctcaaatgatccgtctgcctcggcctcccaaagtgctgggattactggcatgagccaccgtgcctggccagaatttggattctgtctgcctccttattgtttgtgaccctagcaatttacttaacttccatgagcctcagttaattcatatatcaactggggactcaaacttgtcctccttcaagctgatataacaattaagagaaatgacgtaaacggcatcctggaaacagcacaagctttggaatcagacagaccaggtttgaatctcagtctgaaatgaactgactgcaagatcttaggcaagttatttaaaactttacctcatctgtaaatagagatagtagtatttcagaagggttttttgaaaataaaataaaataagaaaggtgcctactaacatgtgcctggcatgtagtaatgctcaactaacagtgttattttgttaccacaaataatgtaatgggtctcatatataaagcacttaccaaagtgctcagaacatagtgggtgttcagtaaacattagtccccttctgtcttgcccacatgtctgtctgccacactgagcaggctatgggagactagagcagtggtgctcactctcgtgtctgttctctggcataatcctctgcccatatgaagagctcaatgaatgtctgttgtgtagaagtgaactgatttctcttgatgacatggtctccttcctcaagtagccagtgagtcactcctctttctttctcctccttcccatctcctctgtgattctatttctgactctcatcagtaggaggagaatcaatgttcctcagtgtgatttttaaaaataaaagggagagattcaggagtgattctctgggctgctttccatagagcacaggatagtgagagctggagtgttgtgtttccaacctcgcttttctttaagtgaaataaaaatgtcaacaatatcaacagtaatagcagcacttactatgagctttattgagcacctaccatgtggccagtgctctgctaggctctacccctacattatctgtcattctcacacagtcacttcaaagtataatattattatcaccacctcacagttgaggaaactaaggctcaattacttaaaaaaattaatttaaaagttaaataataaatacttctatatttggatacctattataagccagacacttaaaaaatatcatattatgaaaaccctaccaagtaggcatttttatttccattccagatgtgaggaaactgaacctcagagagataaaataaccaactagtccaaaatcacattgctgatgaatggcagagctgggagttaggccaaggcctgctcaactcttaagttcacccattctctttctaacaggtcatgttgctactctttaagggaaacattatattgacactctggctggaggcagccctgggtaggtttgaatggaatgggaaatgacacatatagcatgagacccatccactctagcagggcagaccctgggaagctggccctgctcctggaactgcctttggaagtgcaaaaacaatagctgatgcctatgtggtatttactacacagcaggaactgttctaagcatttcgcatataataacattattaatcctcacaaaactctgaggtaggtacaggcatacctcggatatgttgcaggttcagttccagatcaccataataaagtaaatattgcaataaagcaagtaacatgaattttttggtttcccagtgcatataaaagccacgtttatactgtagtagtctattaaatgtgtagtaatattatgcctaaaacaatttacatacattaattaaaaaatactttaggccagatatggtggctcaggcctgtaatcctagcactttgggaggctgaggtgggaggatcactggagcccaggaggttgaggctgcagtaagctatgatctcgccactgcactccagcctgggcaacagagtgagaccctgtttcaaacaaaccaacaaaatactttattgctaaaaaatgctaacaatcatctgagccttcagtgagtgttaatctttttgccagtggagggtcttgccttgatgttcatgggtgctgactgatcaggttggtggttgctgaagactggggtggctgtggcaatttctgaaaatagggcaacagtgaagtttgctgcatcgattgattcttcttttcatgaaagatttctctgttgcatggtgatgctgtttgatagcattttacccatagtagaacttctttaaaaatttgagtcagtcctctcaaaccttgctactgctttatccaactatgtttatgtcatattctaaatcctttgttgtcatttcaaggatgttcacagcatcttcaccagagtagactccatctcaagaaaccattttcttcgctcatctgtaagaagcaactgcatccgttcaagttttatcatgagattgccacaattcagtcacatcttcaggtctcacttctaatcctagttctcctgctatttccacaagatcttagatctgcagttacttcatccactgacgtcttgaaccccataaagtcatccataattccaaagtttggaatcaatttatttcaaactgctattaatgttcatatttttatctcctcccatgaatcacgaatattcttaatggtagaatggtgaattccttccagaaagttttcaatttactttgcccaggtccaaataagccttgaaagtcaaaattactccttgatccatgggctgcagaatggatgttgtgttagcaggcatgaagacattaatctccttgtatatctccatcagatatcttgggtgaccaggcacattgtcaataagcaggaatattatgaaaggaatattttttcctgagagtgggtttcaacaatgggcttaaattattcagtaaaccatattgtaaacagatgtgttgtcatccaggcttagttgttcgatttctagagcacaggcagggtagatttagcatagttttgaggggcccttggattttcagaatggtcagttagcattgacttcaaattaaagtcaccagctgcattaacccctaacgagaaagtcagcctgttctttaagctttgaagtcaggcattgacttctctctagctatgaaagtcctagatggcatattcttccagtgctgttttgtctacattgaaaatcacttatttaatgtagccaccctaatcaatgatcttagcaggtcttctggataaccttgctgcagcttctacatcagcatttgctgcttcaccttgcacttttaggttatgaaaatagcttatttccttaaacttcatgaaccaacctccgctagcttcagacttttcttctgcagttccttcacctctctcagccttcatagaattgaagagagttaaggccttgctctgaattaggctttggcttaaggaaagattgtggctagtttgatcttctatccagaaaccactaaaactttctacatattgccaataaggttgttttgctttcttatcacttatgtgttcgcaagagtagcactcttaatttccttcaataaatttacatttgcatttacaatttggctaacgtttggtacaagaggcctagctttcggcccatctcagttcttggcatgccttcctcactaagcttaattatttctagcttttgatttaaagcaagagatgtgtaactcatcctttcacttgaacacttagaggccattgtggtgttgttgttgttgttgttgttgttgttgttattattattttgagatggagtcttgctctgtcacccaggctggagtgcagtggtgtgatcttgactcactgcagcctccgcctcctgggttcaagtgattctcctgcctcagcctcctgagtaactgggattataggcatctgccaccatgcctggctaatttttgtatttttagtagagacaggatttcgccatgttgaccaggctggtctcaacctcctgacctcaagtggtccacctgcctcggcctcccaaagtgctatgattacaggcatgagccaccacgctgggcccattgtagggttattaattggcctaattttaatactgttgtgtctcaaggcatagggagtcctgaagagagggagagatgggggaatggctggttggtggagcattcagaacacacacaacattaagttcactgccttaatatgggtgtggttcatggcaccccaaagcaattacaatagtaacatcaaagatcactgatcacagataaacatgacagatataataataatgaaaagacttgaaatattgtgagaaataccaaaatgtgacacagagacatgaagtgagcacatactgttggaaaaatagctctgatagacctgcttgagatagggtcaccacaaacattcaatctgtaaaaaatgcaatatctgcaaagtgtaataagttgaagtgcaataaaatgaagtattattattattcccgcttcatagataaagaaactaaggctccaataggtaagttgcccaaagagaggattacacaaaagcatgaatatcaggagacattttagaagccattttagaggctgtgtactatagtcacatagtgagtaagtggtagaatagggattcacacccagaagcctaactccaaagatcacagtcttaacctcaagactatatggcctttttgtttaacaaacagtggttaaattgctactgtgtgcacagccctgtgctacgtactggtagtactgagataaaactgactccatgtccaaactcatttatggggtatataccagaatttctaattagttgggattcagttgggtgacaagactcttggagagcttgggcacagggctaggctccaggcagagatggaagactcgacactctcacagaataacagggcatagtttagggagactgaggagagctcaggcctgatggcagtgcaggcgctcagaaatcctgcctgggcttctagaccaggaagagtggcttaattccaaatcctgcaggacaggatttagggactgaagctacagatcagtgggaggtctattctttggagttggctctgaggagctcaggaagcagaggcaagggcataggaggagtggatcaaatactgcgtcaatgtttcttagtcacaaacacacagagctttgatgtggatatggcagatttctctcaataatgtctaagatttccagtgttaaatgttcagaacctcatttattcattcactcatttatccattcatctattcatttatcctcccactcactcatgagctggagaaaatatcttccagaactcatagggagaactgctgtatgtggtcagaaggaatactttgataagctgattgaggtggagagtaagatgcttaaagacattgctcaatgaaaagaagatggtgattcatatgctctccaaggagggtgagtatgttagatgcaggttttgttttatggagtaaggttatgcaagtctgggccagagctgaattgctgaggacatggagaagccaagccctgacagaaacaactgctatctttgtttttcttctcttcacatctaatctatcaccattccctataattttacctcttaaatacctcaatgaatctgttcttactctatgcctgttgttaccactctagctcagattcttatttagtctgacctgtactactgcaaagatcttctaaccagccttcctgcctcctatctcttctccttccagtccattctctacaccattgttagagtgatctttctaaatctcagatctaattacgttaatcccttggctcaaaatctttgatcttaaaaaatcaagtccataccccatagcatagtattcagagctctttctagcttcatcacctacctatgtcccatcccctaccgttcctgaagttcttcaggagtactcactgtcaaaaactctcccttctgccaaaataccactcctttacttttctgcttggaaaaggaaaattcttctttagaaaagttctccttatattgccaaataagcacactttcatgtgatgctcctgggctcggtgcagattccacccatgggaatcattatgccttctaccatatagtcccagttttcctcctcagcatatgatagtattgcactttcttaccccttgaaagttgggtgtgggtttgtgacttgctttggccagtgaaatgggaaaagtggaagttttaagagccaatacatgactcacatacttttttcccctctggtagttgctctgtcagtctttatcctggaataaagatgacaaaaagcagagcacccagccagtccttaatggatatgtaataataataaaaaataaaaccttgttgtttaagctactgacatttgggattgcttgttcctgaagaacccagcctatcctaaaggatatattatctccactttgacatcttccataactaccccaaaccaccatgtttctactttacctgaacttgtgtgactctttttttttttccttttgagacagtctcactctttcacccaggctggaatgcgatgatgccatctcagctccctgcgaccctgcctcctgggttcaagtgattctcgtgcctcagcctcccaagtagctgggattacaggtgtacaccactacacctggctaacttttgtatttttaatacagacaggatttcaccatattggccaggctggcctcaaactcctgacttcaaatgatctacctaccttggcctcccagagtgctgggattacaggcatgagccaccatgcccagccaactcatttttttttataccacttatctggtgctgatgacatattacctcatattgctaattatcaatttgctgttatatcttagccaccttcacaactctattgaggtttcctgagggcaggggtggtggttgttctatgttattatcacactaagtatagttcatggctaaggcaatatgttgtaatgggtgcaggagagagacagattagttctgaatgaatcttagtttcctcacctgtaagatgagagtaacaacatatattctccagggttttctagtatttgtggataacaggtgcaacctgtataaaaatagtggcatactgaaattatttttctccttatttatttttattataactatagatggtgttcagtagatgcttgtgaataaatcaatctttcattgatggagttgtggtggtacctgcattagacatggaatcagaagtcctggatttggctgggctttacaggctcatgcctttaatcccagcactttgggaggctgaggcaggaggatcacttgagttcaggtgttccagaccagccatggctacatagtaagaccttgtctctacaaaagtaaaaaaaattagccaggcatggtggcacatgcctgtggtcccagttacttgagaggctgaggtgggaggatcacttgagcctgggaatttgaggctgcagtgagctgtgatcatgcactcaggactggatgacagcgtgacatcctgtctcaaaacaaaaaaagctgggtacactggcgagcgcctgtagtcctagctattctgcaggctgaggtgggaggatcacttgagcctaggagttcaaggctgcagtgagctatgatgattgtgccactgctctctagcttgagtgacagagtgagaccctgtctcttaaaaaaaaaaagtcccagatttaaggcctacctttttgtcaccagctttatgaccttgaccttgggaaagtcacttgccctttctgcaatttttgcattctcaactataaagtgtaaataataatgacacctacctcactggaatctcatagaatttaaatgaggtaatatatgaggacatgttttatatatgcttaagcatcacacattctgagactgtaatgatatagagaagattggctggtccctcacacgaggactgtgtggaaaatttggaagcatcccaatgtgccctgataaccctttgctgttggtcttgtctttgttgcttgcttacgtgtttgtctttccaactagactatgagctacttgtgattaagaattgtcttaaagtcattttttgaaaaaatgtttatttctccttacataagagtaatatgtgctcattgtagagataataaaaatacatgaagaagtctgggcacagtggttcacacctgtaatcctagcactttgggaggctaaggtgggtggattgcttgagctctggagtttgagaccagcctgggcaacatggtaaaacgtcatctgtactaaaaatacaaaaattagccgggtgtggtggtgtgctactcaggaggctgaggtgggaggatcacttgagcccagggggtggagattgcagtgagccaagattgctccactgcactccagcctgggccacacagtgagaccctgtctcaaaaaaaaaaaaaaaattacatgaagaaaatcaaaatctcagtaattcttgtctcttattcagagaaaatctctattaaccttttgatgtgtttcttctatttttttctgtgcacatatagttataaaactaatacatcacacatacaagtattgtctcatatcgttaaatattcttacatacatgaacttacataaaaattcttacattttaaccattctcctattgttgaatatataagttgatgatatgttttcactgtctagataaagttttaacaaatgtgtttttgtacatacatatttgtctgattttctatttttatagggaaaatttttctaattttgtgggaaaaattcccagaaggaatatttctgggtcaaagagtatgaacatttttaatgctcttaagacttccaaattgattcccagaaaggctaaaccaagttccactcccacaagcaagatgtgaatttgtatatttcactgcatgcttatcaatcatgggaattattattaaaaataaggggctgggcacagtggcacaaaaccttaatcccagctactcggagactgaggtgggagcattgcttcagcccagaaattcaaacttgcagtgagctatgattgtgccagggctctcagcctgggcaacagagtaaggctttgtcttaaaaaaaaaaaaaaaaaaaaaaaagaaacaaaaataaggttaaaactttttatgtaataattacccactcaacatttcttatgtgcttgttcatgcctcttgtccacttttcctttaggattttaattattcttattaaattctatgagatttaaaaaatcattttaatctagtcagcaagcacaatacaagacacataatagatgctccttaaatatgccttgggttgggcgcggtggctcactcctgtaatcccagcactttgggaggccgaggcgggtggatcacctgaggtcaggagttcgagacctgcctgaccaacatggagaaaccctgtctctactaaaaatacaaaattagctgggcatggtggtgcatgcttgtaatcccagccactcgggaagctgaggcaggagaatcacttgaacctaggaggcagaggttgcagtgagctgagatcgcgccatggcactccagcctgggcaacaagagcaaaactccatctcaaaaaaaaaaaatgtcttgggttattagttaattgtcctggggactttttaggaaccaaagcagactttctaagagattgtttcttttcttttcctgcccaggacacagctgggcaggagcggtaccggaccatcacaacagcctattaccgtggggccatgggcttcattctgatgtatgacatcaccaatgaagagtccttcaatgctgtccaagactggtatgagacccatattcattcattcatttaacaaactgttcattaaaacctaacatgtgctaggtcctgtattgtgtgctggggaagcccagatgaatcagacatggttactggcctcaggagtttacagacgagagcagaagacagatccataagcaggaatgaaaatatcatgtgataggccgggtgcagtggctcacgcctgtaatcccagcactttgggaggccgaggcagccagatcacccgaggtcaggagtttgagaccagcctagccaacatggtgaaaccccgtctctactaaaaatacaaaaattagccaggcgtggtggcacgtgcctataatcccagctactcaggaggctaaggcaggagaattgcttgaacctgggaggcggaggttgcagtgagctgagatcacaccactgcactccagcctgggcaacagagtgagactctatcttaaaaaaaaaaaaagaaagaaaagaaaagaaaatgtgtgctaggtgcagtgatgaagcgaggcatcagggctgtgggaacccagcagagggctctctgacccagtttagggagtcagagaaagtgccctggagttgctgacacatatgctgcattttgtaagatgaacaggagttagcccgagggacaaatgaataaggatgttccagaaaatgagtacagatgtgcaaaggtgagaaggtaggtgcgagtgttgaagggcataggtcatgaagggttttgtgtgctgctataaggagtttggattctgtcccataggtgatgacgtatgaattagaaaccaacaggttcacatttgtgtttcaggaagattactgtagctccagtggagagtgaatccacatagcacttaaagtttatccctgggctgagccaggtgtccaggagcacatacagtccaagttcatcaaggctcaatatgcaatggaaatcagtacagcaccccagagttgcaacctctgagcaacttatagctttcttcctggggcacgattcccaggagaagggagcctgaggggaaggacacatgagagggagggccaggacccagtgtccctgctcagatgaggatgggggaaggtgggacatctgtgtggtggctgtccttcagaatcggagaggctgagcagaccaggcacacagcagcagtgctggccagtgctgggcttgtctccttctcccttttgcctaatggtgaccttcgaggacttcgcttctcccagggagcagttgtcataattgtgttggcttcacatacacagcttgagctgagagtgaccttgtgggctgcctgctgcactcccctgttctgaccagcagttcagggtgtcatcagcatgtctgtcattcctgggggtctgtgttctccttttctgcctcctggttatcctcttcttcctcctttctgtcccttccttttaaataactctttcttccctctaccttgggtctttctcctctccttcctctgttctcttccccttccctttactctctccactcatcattttcctcccttcctcccctctccctgctcctcctcttctctctcatcacatctcccctgaagtgtctccacgctgcccatttccctgttggccttgacccccttcccttcctccctcagtctctgttcattctgcctcaggaacacggtgactttaacacctggtgacgattcctccaagaataacctgagtttgttgctaacctgggagctgagaggaaatggggtgggagaagggaggaagatgaaagaaagagtagcatgggagataaggagagctggccccagttacctgccttgagtctgaagactgagggtctatctctcccaagccctggcctttgagttttgtctgtgggtaacttggtctcagtctcacccctacctgccatccaagccccagtgcccagaatggggcctggtttcctgtgggcccacaagaagtggtggttgagtgaattccatcctttgagggaatggcttctcaccataaatgagaaggttggtggtaagatcaactttaagagcagggtcagtagtaggttcaggttgcagttagggttgagttaggttgtcagtgtcagggtagagtcagattcaagatctgcttcaggactgaccattcactggctcgttcatttatcagcattcactgacaccttcttcgctgtgtgttctgtgctgggtattggcatcccaaagatgaataggccggtccttgccctcagggagagagacaaattcagccaagtgtaataggtgtcatggtgaacgtgcaggagaccaaaagaggaagtaatcatttctacctgatggggtctttggggaatgttaggcccatctccacaaaaagatgtcttcataatataagagagtccttttttatttcctcttaaaattttgtttttaattaaagaagtaatacatgctcacttttaaaaatgtgaaaagtacagaaatttgaaaaggtttttttttttttttttttttttgagatggagtctcgctctgtcacccaggctggagtgtagtgatgcgatcttggctcactgcaagctccacctcccgggttcacgccattctcctgcctcagcttcctgagtagctgggactacagacgcctgccaccatgcccagctaattttttttttttaatttttagtggagacggggtttcaccatgttagctaggatggtctcgatctcctgacctcgtggtccgcccacctcggcctcacaaagtgctgggattacaggcgtgggccagcgcacccggccaaaaagtattttttaaaagtcttataatcatcttatatgaaggtaaccactgctgacattttggttcctgcaaataatcataatccgaggcttcagggaaggtttatgaatcacataggaggaggtggaggctaagtggatctaggagaagcttgaagaggctcccctcaaggtgttgtgggatcagcactgggccctggaggatgagttagttgtggggaaggacttcccagtgtaggcaaaagcacaagccatggaagagcttttggggaatgagtaaaaaggttagggaggcaggagaatgggtaatgaggctggagagacacagcatgagtgatcttgaactgaggaatctggacttgatcacatagctagctgggggccagagaaggcttttaagaaaagattcattgtgatcaaatacctgttttagaaagacctctctgcccagtgaggagagggatggccagatatggtagaggtggacttcaaaaagatggatgaggtttgcagctagggcttaggagtcagcatctgtgacagccagcagggacaggtatctgtctgtcctcagctgaattaattggcaataacttggatgttgctagtcctgtggaagagaaaccatttcttcacacttcacagttttctttttgtcataggagggtatgtgtcttggtcagtttgggctgctataacaagaatactatagacttggtagcttaaataacggacatttctttctcacagttctggagctaggaagtccaagatcaaggtgccagcagctccagtatctggagacagccagcttcttgttgtatcctcccatggccaagagagaaagagggctctagcctctttctcttcttatatggacacatttattaggactctagcctcattgacataattacatcccgaagactccacctccaaataccattacattggggattaggcttcaacatgtaaatttggaggtggggacacagacattcagtctataggaatatgattaacatatctctttctatctcattttagggctactcagatcaagacctactcctgggacaatgcacaagttattctggtggggaacaagtgtgacatggaggaagagagggttgttcccactgagaagggccagctccttgcagagcagcttggtatgtacatgacacatgtatgtgcatgtgtgcatttgtacacatgctcatgagagtggggtaaacagggtacgagtgtgtttgtatttatgacattagtgttgtgattgtgaattatgtacctatgtgatctgtgtgtattgttttatatttgtatgaggtacatatgggctttgtgctgtgagttttagataattcatcatttttgatatgtatatattttgttatattgaatgtgtaaataaattttaaatttataaactctttttttttaccagttccttccacaaaggacttgagatatcttataaaaatggtcacaatacaacaataaaaataaataagtaagtgagaaaattggagcaaagggaaagcaagggtgagggaaaaataagaggaagctagggtaagtattaagttcttggacacctgcaagagttggggccaaaatgttgtctttgagcttcctagcaacctttgccaagagggaaacataatcagctacatggtttagagtgtcctagtataaaaacaaacccattattccagagaagcactactcttcatcatcaactgtagagcagactctgtatgctgaatgtgaccatgtcttgaatatcaaacatccttccagcactgagtatttatatgctgttcttacagtttatctcaatgcaaattcatgcttctcaccaaaacacaattcacaacaaaagtaatagtatgaaggaacaaaactatgtggtttgagtatgtagctcatcggtgtcctgactttttccaagcttaacatattttgatccttgtgctcctttgaggcctaggtgcccaggcatgtctcagtggccccaaagcagaactctacctacctttgcttaaaagaagagcttttattttatgtattggggtccagggtaaggttgccttacaaaaagagttccatgcctgtaggtttgaaagtttgaaatcttcctctagaatagatgtactgcttagcttttagacagtctccctaagtatatctcacatccttagtgttgtaagtattgaggagtggagagtttaaagtctctgacagtttctgaagaacagatatttgggcttataggtgggtaatctgtataaaatacaagtgtgaattgtgtgttttatatatttgtattatgagtatgtgggtgtgtgtgtgttgtatacttttttctccccaaggtgtcctgtaaactgtagcaaactataagtgcttaataaacagggaggttgggtcatcttgggccttgctgtctctacactatcacagaggttctcagagtccagaaagtgcctccatgtggtccattgaccaataagcaagtgatgaagcccacacctggtgaactttagacggtccctttaggctttcaacctgtagtctccctggaggctcccagcactctccctggactgactatatttcatctgcttggaatgctctcttctactccccatcttctaccctcatccagctggtgagaccccactcagctttcaaaacagcttacacttcacatcttctatgaaacctttcccagccccctgccagagctctttatttgttctctcaatgcaccccatacgtaaaagagtcacagtacccatcacagttggatgcactcatttacttgtctgtctcccgaaagttccctgcagacaggaaatgaatcttgtttgtctttgtgcctactgtgcctagcatatggccgggcacggaggatgcaaaaatatgttttggttaattttatgatgttaagtatttgggtacttcattttattgtccagtgaagacttcctgagtgcctactctgttctaggccctgagctgtgaaataggctacatttcctggtctgaataagctcgatccagtgagaaagcctacagtaacagtcatagtccaattggtcagggctgtgacagagggatgttgggggagcatagaggaggaacgtcattctcctgggatcagagaacatgatgcccaagtggagtcttgaagataagtaggaccagtccagtgaagaagaaagttaagggcattccaggcaggggcataaccctggcagaggcaaggagctgccttgtgggtcagggaaccataaatcactggatggtgtgagtctggagtagtgttgcccaaagaggggactcacgccactggaattgtgcaggatgattttctgtatttattttctaatacatatttggatatgtattagaaaaaaatataccagcatgccaagcccttctcactaagatttttttttttgagatggagtttcactcttgtcacccaggctggagtgcagtggggcgatctcggcttactgcaacctctgcctcccgggttcaagtgattctcctgcctcagcttcctgagtagctgggattataggcacccaccaccatgcctggctaattttttgtattttcagtagagacggggtttcatcatgttggccaggctggtctcgaactcctgacctcaggtgatctgcccacctcagcctcccaaagtgctgggattataggcatgagccaccttgtatggccattctaagattttttaaaggtgaattggttaaacatttattaggtgcttaccatgtgtcaggcactatttattctaagtgtttcaaagtattatgcatctaatttaatccctctaaaaccctccaagatatgttctttccttatctccacattttgtgtgtgtgtgttttttttaacagatgagaaaagtgaggcacagagaagttgagtaacttgccaaagtcacacagctagtaagagggtagaaccagtatttcaactcaggtggtagtctggctcccagagcctgtgctcctaaccacttaactttactacacagcaaatgtggtaatcatagctgatatatattgaacaaggcactatgtgaaatgtttagcattaattatctcatttaagtctctttataaaccttcaagctaggtactatagagcatgtccaatactctcaaaaatgaggttcagagaggttaaataacttgctcaagctataccattagcaagtggtggactcagtataaacctatcaaatttatttaggaacacagatagaacacctgagattaaatcttagtgccatgtttttaggaaggcacttgaagaagaccttaatgaattggttagatttgggcaggtcaaagtaacccatctctgcctaactcgactccctgagctttctgctattgatcaccagaacttgcctatttacatgtttatctctcctcctaggcttctactgcatggattgtgtctgatttgtttcattatcctaaggacccagcatagggtagatattcattaatacattttacttattcagtgaaaaacatttattgagcacgctgagccaagttctgccctggcacttaggatataatgaatgatgaacaaacagctgcaatccttactgtcatggaactaatggggaaagagacattaaataaatacttacacaaatattaattaaaaattgtgcaaataaatgggtgaattgtatggtatgtgaattatggctcaatacagctgttaaaattgtgataagttctacttgagttaggactcttgttattgcaagtgataaaattgcaaatcaaactagctttaataaaaaaaatagaattggctgggcgcagtggctcacacttgtaatcccagcactttgggaggctgaggtgggtggatcacttgaggtcagcctggtttgataccaacctggtcaacatggtgaaaccccatctctactaaaaatacaaaaattagccgagcatgtagtcccagctactcgggaggctgaagcaggagaatcctttgaatccaagaggcagaggttacagtgagctgagattgccccactgcactccagcctgggtgacagagcaagactccatctcaaaaagaaaaaaaaagggagagaatgtattagctcctgtaactgggaagtccacaagacccagggctcaattgcactctccatttctcagctttacttatcccctcagcctctttctatagccagactctctgcgtggggagttagagggatgatggcagattcatggcttcccaattcctgcaaaaagagaccttctctctcccaaccactatgaatcaatcccagagaatactatgattggtcacctgtgagtcatgtgcccatcccagtggctgggggaggcaagtatggcaacatagtcccaatataactgtttaaaatggtggtttcctaaaggagggaatgaagggggcagatagaagttaacataagtccaccacaagtgctatgaagaagtgcaagagagaaacctaattttaggctggagagttaaggttttctgagaaagtaacacttaaggtgagaacaaaaggatgagaaaaggctagccaggcaaagagtagagtgtagggaggggcatattccacatccagaatagtcccaatgtgggttaaagcatgaaatattcatgaaattgaaagaaggccatggcacagggactaaataatcaagggagagtagcatgagatgaggatggacagatggggagagatcagatgatgcaggatcttgtagaccacgttaagaattttgcaaggatatgatcagatctgggaacagtgaagggggatgttcagccttcctcaccctcacccagtgactacccctctgctgtctcaggtattaagtcagtttcagtggtatctttgccagtgcagtaatgccattctctgctttatgggatccctcctcaggattccctttcttgtagcttttctcagctctctcagtcaagactattgatatggccaacaattcgtgtttattaaagctgtgaggctgggcttggtggctcacgcctgtaatcccagcactctgggaggccgaggcaggtggatcacctgaggtcgggagttcgagaccagcctgaccaacatggagaaacctcatctctactaaaaatacaaaaattagccaggcgtggtggtgcatgcctgtaatcccagctactcgagaggctgaggcaggagaatcgcctgaaccggggaggcggaggttgcggtgagcagagatcgcaccattgcactccagcctgggcaacaagagcaaaactccatctaaaaaaagaaaaaaaaaagctgtgtgttgtgattggccttccatatcctcaaagttcctgggacttggttgagatcatatagatgctgaggcaggtgggtgtttggaacagtagaggagttttagggacttttatttcaagaagcatgaccttttagggttctgcctccatgtgctcctcggaaaggggcttcttgtccctttcctggatctgactggagatctgaccagaacccagggaggctagtaaaagggaaatatgcttctgcctacaaaggaaggagagaccatccacaatgtagttttttgttttattttgttttgaggcaagatcttgctctgtcatccaggctggagtgcagtgacacaatcttggctcactgcaaccttcacctacgggactcaagcaatcttcctgcctcagtctcctgatcccaaatagctgggattacaggcatgcaccaccatgcccagctaacttttatgtttcttgtttgtttgcttgcttttttggtagagacggggtttcactgtgtggcccaggctggtctcaaactgctgggctcaagtgatctgccagctttgatctcccaaagtgctgggattacaggcttgagccaccatgcccagcccaaaatgtagttttgaaacacacacataccagcatagtgtagtgggaaaagcacgcccagactaggaattaggagattcagagttttatcctgcttctgctactactttactatgtgactttgagcattgcatttgctgtctctgggtctctgtatttacctatctgtaaaacatgcagtttggattagttgagtaggaagatctgtttggccctatcccactttgattctgtgatttcagtttacccaattccgcattcatgactcagaccccacagactctcatacactgccttgcttattttaggtgctcaataaatctgtgtgtgtgtgtgtgttttctagattgagatgaaccaaggaaccttgtgtcattgagtctggttgcagagaaagaaaggcctagttggcattgataataactaacagtgacttaaaattcacaatatgctttcacgaaaatcctcttgtgacctttgttgtcacttctagcacagaaggctgcattatcatcagctattgtaatacagtatctgtattgctgtatagtacatagtatattatcaccagtacagtaaaccagtgattttcttgatgaagaagctgagtccagaccacttgcattttcttgcacacaatgagctgtgccacacttctgtgcctttattttcccactctaagattatgtaacttttctaagccatgtaagtagtagatggcaggccccgtactcaaactcagactttgacttaaaatcctaatgttctcatatcatccaatggtgttttcccaaaagcctgtcatagtttctcttcacatttccaccctcagccacaatattggtgagatttctttagattatgctgtggtaacacacagcctgagtcaggagaataagggtttctttctcactcattacataccagctacaagtcagctgcaactctgttccatgcattttcttactctggggtccgtttggaatggctaaaccacacaaagcctcttaaagcttccttgggacttggatcacatcacttctgcccacatccattggccaaagcaagtcacataatcaaactcgatgtcaatggagtggggagacgtattcttcccacaaggaggcactgcaagctagtggtaatgtggaggtataaaatctcttgcaggcagggcagttcacagtcactgaacacatcatggactctggggacacagaggtgaatgggttcccttccctcaagatgcacactgactagggaaacaaaattgcaaacagataattataaccttctttgggtcgatggctatgccagtcctcatcctacttgctattatttttcaccctctcctgttgtttttcctgcaaccccttctgagggtttgacctttgcaggctatgtttcccagcctcctgtgatggtagcttctggctgggactagccaaaggaagatattggcaggtgactggagatgcagcaaagggagaaatccaggtattttccccctgcctcagctggccccccagcaggggctgctcctctactgtgactcctgctctcatggttccagcatcttttagctctaatactagtattttttgcttttgataatctctgggtttcctcaatattctgtttagcttcttagttcttccatcacctatataagcaattccttctggtttaaagaatagttcccatttttctggttggaatctgactgaaacaatcacacaaagtgccatgagagtacaggggagagagacattatatgttctgagtggtagaggtgttgtggggaagaaaaagtgaagcttctctgggatcagtaattccacagatgaataatgaagatgattaggagtagtagctagagattaataacatgagcaatggcacaaaatcaggaagcactgatgtttctggagcatagtgtgagccaggaagatgaagctgggggagtagagaccaggccatgccaggtcttgggtgttcagccagtgaggctggatattgaattgatcagacctctttcaattccagtgacacaaatccaagtcaaaatagctcaagttatagggacaggtgaatagctgaagcaaaatggaagagaaggtccatccaaggtgccggatggattgtccacatgacactcaaagttccagagaatgaaaacaagccttgagtagaaaggaagacagtgagtcccactgagcccaaatcatcagtgaccagaggatgtgagttgaaggttgataaatgacagagatgaggtggtgtcagagcaggatggagaagggatctgaaccgtggaggagacatgttctggagcagtgttgggatgaggagaggtgagtttagctggttgcaagtttctgaatagaattctgaggtcgtattcagaagcaggcagtgtggatgcagtctatgggtctgtgacagctgcctttggacagagtagataaacgtgatcatttttggggggtggaggaacatctcagattcagttaagaattgagccccattaaaaacagcagaaatgtcattgttctgaagccaattaggagaagaaaaggactgggggctagtctggataattggttgtcatcttcctggcctcactagattctcagctcctaaaagtccttattaatgaacctgaagaaaaggttaccatatggacctactaatgaagaatatttcaggaatctgacagtaattgggtggggtgcatttggggttattctgctaagcaagagaggcccttgagctggctagacccatgagttggtaacttgagtcacagttctcacattccgggtacctttgagatgacagtaaagacatctctttggcatgacacaagagctccccctgtttggccccctgctgactcaactctcaccacttagggttttctgctctaaggataacaaactgctatggcccttttggcatagaccaaggctgattttgcccccttatctgtgctctattcatgctgtctcccctgcctgttgtgctatgctagacatgcctgtgctcacacatacactcacagtgacatgtctttgtctagctgatatctgcttaagcatcagcttctccaagaaaccgtccctggtctccaggcttggttagatgctttctctgtgccctgacaatcccctggcttccctccattccaacacttattgccctgtaatattgtcaatgtgtctatcttccataacacactaggggctcctcaaaggtaagggctgtgtctgattcaccttgctgtccccaatgcccagcaccgtgctcattgagctgagctttcatgacccacactatccgtatcccctcaaccacaccctccttgctcattcccacctccttaattcaactattcattccaccaacattcactaagcacctactcttccaggtggtgctggggctcagaatgacatagttcctgtttggggagctccctgtctatatggacttctgccatgcagggtaaaaagtgctatggcaggaggaagcacagaggagaatgaagataccatatgtaagctgagtcctgaagaatgagaagaagttaggtgaagagttttgtttaattatttttaatgtaatttatttgtgtattcatttatttatttatggtctcgaacaactggccttaagcaaccttcctgccttggcacccccaaagtactgggattccaggcttgagccactagcacctagccagttttgctcagttctgacttttttttttttttttttgagacagagtctcactctgtcgcccaggcaggagtgcagtggcgcaatctcagctcactgcaacatctgcctcccaggttcaagcaattcttctgcctcagcctcccgagtagctgggattacaggcagtgccaccacacccggttaatttttgtatttttagtagagacagggtttcaccatgttggccaggctggtctctaactcctgacctcaggtgatccacccacctcggcctcccaaactgcagggattacaggcgtgagccactgcacccagcctgagttctgactttaaaggctcacatcctcactaacttcaagaagcttcctcctcctctccttccctgccagcctctccctctcctgcatccctgcatggcctctggtttcctctacctgggttagaatgttacagcttgttctgttgctgttccaactgagcgtgagacaaggaggcataagggatagacccctggcccatctctgagtctcagttttcctgtctgcaaattacaagtgctaacccttgccttgccccaccccactcacatggttgttttcgtatttgtgaactgttaatgtgaactgcagatgggagagactgatgcctttattagcatgtcttttctacaactataattgatctccctgtgtctgtatctctaacactcaacacaagacatggcacaaggtcaatgctcaataaagacttggtgggccagtcactgtggctcatgcctgtaatcccagcactttgggagaccgaggcgggcagatcacctgaggttgggagttccagactagcctggccaacatggtgaaaccctgtctctactacaaatacaaaaattagccgggtgtggtggtgggtacctgtaatcccagctactcaggaggctgaggcaggaaaatcgcttgaacccgggaggcagaggttgcagtgagccgagattgtgccactgcactccagcctgggcgacagagcaagactctgtctctcaaaaaataaataaataaaaatgaaattaaaaaaaaaaagacctggcttattgattgaccctaagtgatgaagacaaagagatttccccaaaggccctggagacagtagaggtgcaaggaagctgggagtaaggtgggccaggaacatataggaaagagaattgccatgtattcacatgccaatcatgtcatatactttcatggatttaattttcattactatcctatggggtaggtagtattcgcctcattctatagatgaggaaacagagactgggagcaattaggcaacttgtccaagatcacacagctagtagctgccctctgtacaatgtggcatgtcctcccctcagtgccacttcctcacaagggatttgtgcccctggccttgaactgtgtcctcatcttcatctgagctgaaaacctatttacttacttactggtctgcctctttcccaaataaacaatacactccccgcacctccccaaacactgccacttgtgataaggcagtcaaagactggggagtccatttttgtgacgttcattaaggaaaaacgatatgctggagggtctctgaagctgactgggtttctatggcctgagtataatgagccagcagctgcctccttcttcatcacatgtccacaattagcaggcacttctgctgcttgtctttctcaggtcaggagatgggccacaggagaggctgtcagctggaggtgggctggcaggaatggcatgtgccttccagccaaaaggctgggaaaagagaggccttgtttatacctggggggcttcagccctctctatggatggtggaataatagggagaaagagggaggggggaaagagatccctcctttgttagagaagatgataaaagaggatgttagaaagatggagaggaggtgggaggaacaagttgaaagaacagaaggaaactgtctttataacaggccacttttttacagcaatgtattcatcatctcacacactcctcccacctgttcttggtaggaagacactgttgtttgtcttatttgacaacagggagtctgagaattggagaggttaagtgagcagagaggtgaagtgacttgcccagactcagatactgttagtcggattaaagcagaggaggccaaagagacttgtaaaggaagaaaaaggtataatcaggaaaaaaaaatgcaaagtgaaagagaaaagggggaagaaatgagaggcagagctgtgtgtggactttggagacagccaaacccaggtctaaatccagtttccgctaatacagccacatgactttgtgtgagttatgcagtctctcatattctcatttataaattggagatgatgttatttacccaactggttattgtgaggattaaagaagatgatatcagtaaagctcctagcatagtgtctggcatgtagtagttgccccaaagatattaggaatcccaaggagaaaatgcaagggacacaggggaaaggctccaaaagaagggaaagaggaaagcagacagacaacagaagtgggagagggctggggactgatggagagggccacttttgcttctaagggctgccaccaagctgaccaagattccttgggtggaaagcagccttttggaatcaggagggcctttgctgtgtctcttgggacaaccaagttcttttcatcacagaaagtgacgctaagggtctcaagatacaaaatagacaagaatgttgcatacctgagatgtagttttccctgggccttttgttgggtttgtggagggagggtgagatctattggatcgttttagtggaattcagggaggaggaaccccactgagtggaaataaaccagtgtggctatgggtggaaagggcaaagaagacttattcagtgtgaatcttgaggtgcctcctagagcccagactagagctggccagcctagggggaatgagaggcaggggaaagaggaggaaaatccctgcgaaaaagtccaaaacctgggcttctcatactggtgcttttccttatcttgggcaagctagcttacttctgtaagccagtgtttgtattagtgaagtggagaggatctgactgagactccttcctcaggggcaacatgaagatcaaataaaataatctatgtgataagtgctttggaaactgtaaggtgctgtggacacacgtttatgcatttgctctgtcagcaaacactaatgaccccctctgtgtcaggcacagggttatatatttcacatacattgtcttgcctgatccttgaaataattctatgaagtaggtaaaattatccctttttacaaaccaggaaattgatttgtaaagagaataaatgactcagcccggaattaaacagctgggcggtggtagagctaggatcagtctgactgaaagaccagtgcaggaaactcctgccctgtaccgtctccttgaagcagaatcccatgtccgtggaatttagcctctttgcttcactgctgagcactggacatattaatccagagtgcttgggctgagggcacagaagggttccagcagaagggatgggaaaagtccttatctgtatctctcctctttccagggtttgatttctttgaagccagtgcaaaggagaacatcagtgtaaggcaggcctttgagcgcctggtggatgccatttgtgacaagatgtctgattcgctggacacagacccgtcgatgctgggctcctccaagaacacgcgtctctcggacaccccaccgctgctgcagcagaactgctcatgctaggcaaggcccaccttcctgacctcccctcattgtggccccacacccagtctgcttctccctgttacacactgtccgctctcagcccactctccctgttacacactgcccacactcagagcaagatgagttgctgctattctttgcctgcccctggggttctctgcagatggtcccagtaatagatactcagcactagactaacataacaggtcactacacgggtgcagaatcactttacaaaagaagactctgttttacgaaggggattcactacagggacttagagaacagtctcttttctgcctttaaaatgagagttcctccatttaccaaaatttgacacgcacacattcttcaggggcatgccaattgcgtaaagtgaggctcgcctgcatagctaatcctgttaaagacaacttctcaaagcacaacgtgcttgtttcctatcgggctccctgcggggctttctctcactacaagtcaagcttgggctctcaaagccctgcgcctgttaccacggatgcccacagggcctgggcagttgctgtggcgacaggaagagctaatcttcagagagctcagactctctaatgatgctgaaggagcaaaggctgagtcagaaacacacttaagagaaaaggattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagagaaaaggattatcccctacaaaatgtcagaggttcctgctatatgaaagagcaagtaggtatgctcaagaaagacaaacagagaaaaagagaaacaggcaagatcaagaaacagatcatgagtttctgattttgctgctttccagttggttcttaactgtgggaacttagtgaaattggttattagttcttagactcctagaacctgaggattttagatttgacgggatgcccaaatttacctagtctgactagtcagttctaaccttcctttttctgacaagtgactgtcaagcctaacaatcaaatctctttcttttaaagcacaccttctaggcagggacaggagctcattttccacaccatctttgtcaactctcatagaaagttttccttgtatcgagctcaaatctgcctcctggaaattcttcttcttcttccctccctgttggtaccagctctgctgtcagagacttcacagtctgtgctccctctgccctgtgacgtcttcagactatttgagaacaggaatcatgactcctgggacttgccttttctctaggtcaaatacctctataattccatctgctgttcttcatagggtcttctccctatcctgcccttttcctccaatccatcttttaactgctcttgagcagtctaactgagaagtatgattcaaagcaaaataaatcttaaggtggcatgactctgaaaaaattgagaaaattgaactcagagatcccgatcccaacccctttctcctgggagtgaaaccttagtttctaccagagagtgtgggaaaccacttctggtggaagccccttaattaaatacctgaggaaaaaaataaaagaaactcagagaccagaataaattagctcattattctagcttgcttggccacagggacatattttgttttggctgaaataatgacatggaactggcagtgattccagaaaacctttcttctctatcatggcctgaatcctcagccacctcaaaagtcagcgggcaggaggagtctctcgccagttttcttttcatttcaaatgaggctcattgtcctagaaaagtaattaactagcaaccagtccaatgactaaataaaaggaccatccagctgtggctcacacctgtaatcccagcactttggaaagccaaggcaggaggaacacttgaggccaggagtttgagaccagcctgggcaatgtggtcaaattctatccctacaaaaaaaaaaattagccagatgtgatggtgcatgcctgtagtcccagctacttgggaggctgaggcaggaggattgcttgagcccaagaatttgaggttgcagtgagctgtaattatgccactgcattccagtctgggtgacagagtaagaataagaccctgtctctctgtctctctttctctctttttttttttaaaggagtcagctctacaaagatgttgctttctttgatgcaatgcagagagcagagctttggacttggaatcaggagacccggactctgtcattaaatcaactgtgactctgggccagttactttccacttttgagtcttgatttcctacttataaaatgagggagcttatttggatgatctttaaggtctcttttggcactaataactcggtgtctcttttttttcaccttcaccatttcagttgatccaccaaacaaacctgagagatcaggattggcatccaagagttgtctcggccaactctgatgtcatgcttactctgtactagacattgttccaagcattttacgtgcattaactcatttatcttcccaacatcttgtgagggaggcactatagtgagcctcatttgaagatgaggaaacaaaggtacaaagaggttctagctggacctctaaagtcacataataagtaagtggtagagctggagttcacatccaggcagtaggctccaaggtctgtgctcttaaccacattctgggctgcatcttttatagacaaactatgatccagagagattacgagacttggatcacataccaagagagtgttaaagccacattaggattcaattccagggccatcagattccaagtccactggagaaaagatgtatatctctaatctgttaacaaattgctcaactactcagactaatcccaggtgatggatgtctaatgctcaggaaaggcgagtcagtctctgaggcaacagatcccatgggcctgggtagaaaatgcccagtgcttcccagtcccaagtgctggctttccctgtatctgcctctgccaggcaacacttatcaggctcccaatcagcaggagcctccatgctccactttgaacagcctctatgctccagcaatggggcatttgtgaagagtgacttgattaacttttctgaccatgggtataatacagttgcttcagagggcagtggttctgggtgtgatttttacactgtaacattgtatacagtgtcatggataattactatttttttctggtcattaacactcacctactctagtactaggatttcagaccaaggtcctcatgacgcctggatattttagtatctatatccaataatcttttctctcctactgaatatccaggcaaagatgaaatcgttttctttaaaactgtcaaattctgtaaaactcaggagccagttcaagggaacaagcatcttcacaatagatggaatcaagagttaaatgttatagtggcaagcttgtctactgggcaacagacaaccagacctgcttgtgagatggcagctccccagccctgctctgtgacctcatttctgtcaaatgaaaggcagcagcttccagctgattgcagcatagtgttcatcaatcacagtaatagcgcaattagccaccaaggttcaagctgtgtaatatgtgttagtggcaacttgtcctggatttaatcttcctcaacaatccaaataaaatatttaaaaactcttgacttctggctgggcgcagcagctcatgcctgtaatcccagcactttgggaggccgaggtgggcagatcacctgaggtcaggagttcaagaccagcctgggcaacatggtgaaacccccatctctactaaaaatacaaaaattagccaggcgtggtggtgggcacctgaaatccctactcaggaggctgaggcagagaatcgcttgaacctgggaggcagaggttgcagtgagccgagatcgtgccactgcacttcagcctgggtgacagagcgagactccatctcaaaacaaaacaagcaaacaaacaacaacaacaaaaaacacctcttgacttctaaagacgcaaaagtggccaaaagtgcaatacagtattgtgtttatttacatctattttaaatgcatgtgtatctgtaaatacaaagtgattcgtgactcattgtctcctcagtctatagcattattaacttctaggagcagcagtggagtagagtgtactgaatggtcacagactcatcgattatcagatctggaaaggagcttagagaagatctgttccaggctcctattttatagaagggaaggttgacatccaaagaatggaaggaaatctcctaattattctgagagtatcacagtgatggagccaggactaggtcctggatcacctctaagaagacacttagctatttgactatcgactagggcctagcattattaagcactagataaatacagatgaaaaaaaaaatgatccctgcctgcaaggtcctatgatctaatggagatgctgtttctaaaatattattatcccaatttggcagtcaaggaaacagccctggaaaagttaacatgctcaagtcacccactagcatcatttgaaccctcctctgtctgactcatgctctttcaaatttttttcttcagattgtcttagcagaagggtagatgggatataccctctggtagtaccaggctcccaaggattcttagagttaaataacctcagttaattaaatagccacaattgcttggtgaccgaagccttataacatccacagaataagaccattctccagacctgactccccaactcatatcacctgctcctgccggccactaagctccttgcttggatatcgagttttctggagtatcctgaggaatgtttgtttgactttgtttgccaacagtttaggggaaggggaaagaactacaataaccagtgtcctgggatctcattgatttcagattccctgccccaagcctacacccaattacctgccatagttggggaatcaagtagcatcctgtggctggaagtaaatgcaaaacactagtccgtgagatataaatactgttaaatgatggttttttaaggtcctgatccattatatgaagtagacaaaattcaaatttatttattcatttattttctcaacaaatgaatatatattatgtgccaggatacaagtagtggcaaattagacacagttcttgctttcatgaaacgtatagcttcatgatttagtatagacattgtcaaatcatcacccaaatataattacaaagtactctaaaggaaaggcacgtgatgctgtgagaacactcaactgggaaaccggaatcacctttgagaaactgtttcaggggctcttggaagagtctactgctcccaaatatctctgctacccactggccattgctttacattcctcaactaagctttcaccttttagtactaacctttgatgactgatcaaatacaaatgccccaagaagactgaggataggagaaagaatatctctacctgtgaaacattgttagactgcctggctaggagttcattgttgttttctgaaggacgtaaccaaccactccaaaacttacaggcttaaaacaacaaacatgtatcatttcttatgattctgtgggttggctgggtggttcttctggctgaggcaggatggtctaggatagctacatccacatgtctggggtcccagctgagatgactggggctgttgaggcctttctccctgtggtgtcatcctccagaaggctgcccagatttgtccatatggtagcaggagtttcctcgaagcaagagagggcaagatccaacacagaagcacttttcaagctctgtttccatcacatttgccaatgtctcactgatgaacacaagttccatggccaagtccagttttaagaaatggagaaatagggcttggctcagtggctcatgtctgtaatcccagcactttgggaggccaaggcatgcggatcatttgaggtcaggagttccagaccagcctggccaacatggtgaaaacccatctctactaaaaatacaaaaattagctgggtgtggtggcgggcatctgtaatcccagctatttgggaggctgaagcacaagaattgcttgaacccaggaggaggaggttgcaatgagcctaaatcgcaccactgcacttcagcctgggcgatagagccagactcagtctcaaaaaaaaaaaaggggagggggaaatagatgccatctctttatgggaggagctacaaaatatggtgaccaatttttcaatctaccacaggaagcaccctcagtcctctgaaactaagtctggtagatgtcctggggtcttaaaacatggctccgatgatatcaccaaagacaagtggcaaaactgtatagggcagggcagtcttatcatttgtttaatagtgatccaaaggatttactttggaggaatcaagacactcgagatgaagaagttttgatgcttgttaaacagtccatttggatacctcttagctatccccgagggatgaatctgacttctcatttcacaggattcaccgtagataatggttgtaattcctaccggaagttcctggccagaagcccagcagaaagattcagtatatatagaaaagatggctccaagaacagttgggccttctgttctaactgtacttccttctttgatgtactcgtctagtcccgaggctttagatgccaagtctttgataataacgtgtatctaagtgcctactggacattttcatgtctcaaacttaacatgtccaaattgaaactcttgattctgcccccaaacttgtttgaaccccagtcttcacagaaaactcatccttaattctttgatttttctctttttctcagcctccttgtctaatctagcagcagatcctagggttttacttctaaatatatctcaaatctgatcatttttctccattttcattggcatgaccttggtccaggccaccattgttttctgccctagagagctaccacagagttcctaacatttccctacttacgtaattactccactctagtccattctgtctcacaggagtaacattttttatatatatatatatatatatatatatatatatatatatatatatatttttttttttttaatagagacggtcttgctatgttgcccaagctggtttcaaattctggcctcaagcgatcctcttgccttggcctcctgagtcactaggattgtacgtatgagccaccgcatccagcctcaatggcaatctcttaaaaatctaaataaatgaacggctcagtaacactgaggtttacttcacacaaaaacaatccaaaccttggcaagacggtgaaaccctgtctctacaaaaaatacaaaaaattaactgggcaaagtagcctgcacctatagtcccagctacttgggaggctgaggtgggaggatcgattgagccctggaggtcaagaatacagtgagccatagccatgattgtacactgtgccactccagcctgggtgacagagcaagaccctgtccccctctcaaaaaaaaaaaaaaaagaaagaaagaaagaaaaaaaagaagaaaaggaaagaaatgaagagaattcagagacttccattattattaatacctattttattgattctgtttctagccctgagtccgctcctaacttgctataggatctctggtaaatcatttcctgtaataagcagctgtcacctctctccttgtttcttccagaaatagtaatctcttctttagtagtactactactccctaacccaaaccaggtgattctagtgaagactgtcaataaacggagcatgtgatcaagcagggcccatcagaatccttccctaagatttttataaaaagctggacctattctttttccatttgagtggcaaatatttgaagatatgaggtctaaagctgtgatggcttattctccatccctgtgtaaattctggtctatagtaagcgaaaacaaggccattaggcagagggcagcagagacataaggtgagaaagagtgtggtctctggttttctagaccctgattctggtttggaggcttggctgatcacctcttcctttgattctgatagaaagctcaatgtatctttctaataaaacccccctttgctttgcttgttggagttaggttcttatcccttgcaaccaaaaatatattgtctcttcttttgttctcagttttctcatttatatatccttctagctccaaagcacagaaattctaaaacaaacaaacaaacaaacaaaaacaaacaaaaaaaacctgggtcattcagaaaatcccactgatatagactttctgatccagaatgtataatctgaaaagaagcctaccctcgtctccatcctctcttcttgtacctgaaggaacgaagaagagggatttctcaaggtgagaagcagttctccatggacactgatgacagcacaggcaaagtttcctatgactagggatcactgtccacacagagtctggcttcccaggtatccagcaggtagacaaaacagctaactccactgccactcctttctccacatccgttcctatttctcagccatctcagtgacatccgccatcttgagagtcaactactgactggactgagttgtgtggtatatgcttctgtttacttctcttctgtcttttttaagtggccaaatagcaaacgcttaaataggaaatctctgggagacttgaataaaagactttgcttggtagaaaatcatgtcacagaaaggctaatagacagcaaagtaaatcagcaagtccctgagcagtaggattaggattcctgtctcctttcagattcaaatgcatctgtttctggggttaacagtggactgttaagaggctgtgcagcttgggttaagtcattcttatctctgggcttcaggagcttagaccagatagtttctacaggctctcttggtgctgatgccttgggattctgtggctgttttctgtaagatctgcaagggggaaacaggattttggcagcaatcctttcattactaaagcttcctttcttttcgggtacagtgaaaagagccaaggctgtgtgaccccctcatcacttagccaggcgtatggtcctggtttctgaggctgccagaaagcatcttagcaatttgtgtttggatggtccatgcctgactattctaggctggaggttcctaaagagtaacaagaggaagagaaacaagaatctctgacacttgttgagaatagagcacagtcccatttgtttgaaaagagacaccaggcagccatgtttatgtgccagaaatgcattccacctcaaggaggacttaatttatggacccgtgtgtgccaggctgagctgggcaagatctttctcaggacaaactctgccatgcagctaaaagcctggaaactaaaggatttcatgtagtaaactatcttccaacccctgtagacatcagaccacaggatgaggtttcagaaggtcataaggcagaatagttaagcctacagggcttacagtctgacagacctgggttcagttcttgggtcttcatcactagttttgtgacttcgggaagatgactcccggagcctcagtgagcctcagttacttcatatgtaaatgaagtaatactatctacttcacaaggctgttgaaaggattaaatggagaatgggtgtaaaacccttagtgcagtgccgtgcacacacagtagatgccgaacgtgtgatgttggcactacacaatgtgtaatcccaatcaggcagagctaggcaggcaaatctaatccaggatctttgtaaggggactgagaaccagagactggagaaagccagtgtaaacaccatgagcaaaggagcaagagaaggggcattgtgtaagtaggagatggagcttgaacttactaagtggatcagggtagaagaatccagtcaggaccaagggaggagagtccaggaaaatgccatgagcagctctgtagcatgaccttgttgggctgggttaaagtagggtctgccaccagtcatgtgacagaaaggtacctcatgcacttcctccttcccccagaaatcagcctccaggagtgaggaatgagcccagaatgagagtttagagtgctccagagcctttgttagaggtgccctccgacattcagaaaaccaggattccagagacctgggtttgagtcctgactttgcagcatactaactgtgtgatcttgaaccaacatattttcacctaatgaggctgacaatcttccctacttcacaaaatagttatgagagtcaaataaaagtacattttagaaagtgaaatgctgtggacatttaaggtggagccactgtgagagtctagggggatagatggtattcgtctcagaatgaaacgaatacacccctctcagagccctttccaaggatcccctccttctttcagctccttccctccacctcaatacacactcctgtcccaggaacctaacctcatctagaaataccagggccagcatgccttacacctagaggtttggttggcttcagagaaacttctggaggctaaaagcagccaagaagaatcagccactacatgctgggcctggatgaacagagcagtgagctgtgatggggctggggctggggcccaggaggagcaggcaggagagtttgtatgcaccgtgattcaaatattataacaaaaatcatcgatcatgtgttaggcactttacagttcccaaagcactttcccatccatgccctgatgatctttgacacaacactgtgatgtgggttttattatttccagtacagatgaggaagactgaggcctgcatcagtgaagcaacctatccaagactacatagagaaggcagtaaatggcagggttagtctcagaacaggggagggtctgttccccccgcagtgggcagtcctaattctgaacttcacctatctgggggtgatagaggggaacaagaggaagcctgctgaagagaaaacctaaacatctgttttgtctacgtatgacttcctctgcttgtgggagagaaggaaggaaaggaacacattgttgtcagccccacaaccccaacagaattaaaccctggagcaggttgaacagcagaggcttccctcagatcaaggagccaggagcagatgatctatctctgtggccacacagagagatgtcaccttatgcaatttgcatatcatattcaattcccccaactgctctttctaatttattcaactggggaccaggctggtctcatgccaacctaggagatgtaccatagcagtatgagcagaattcctcaggaggaacaattagcaaaaactgcagttgcctctcgataggcctgagcagagagaggaacaatagctctcacgtctctcctcatcagattctaactaagcagatgttctcatgcttttttcttcttcctatgttctgtatactgacacctcttctcagtggcatatgaaatatgaaatgtcatgtgttgtgagtttgtataaatataaaggaatatatatacacagtagcaaaagagaagatctcatttacaaatatctatggtgtttccttgttctgtgttgatctgttttattgatacaaactgaattttcttaatgtatcttctatctctattatagtggcaatgatggtatatgcattaaagttcttctgaattgtg

SEQ ID NO: 673 - DNA, 501056 bp, Homo sapiens
attccctttcaggatgctcctacagcagctgcctaatactctcaggtaacattgaggatttgggttctggtggtgtagtcttagcatggtatatcaaatcttgtactgtaagatagcatttagcatgaatcagaataccttttactattgaaattaaaaactattttattcaagcatttcaaaatactttggtgtaaggactgtgtagtagaggatatggtaggagccagttatctaaaatgatagataaggctgggtgtggtggctcacgcctgtaatcccaccactttgggacaccaaggtggatgaatcacttgaggtcaggagttcaaggccagcctgggcaacatggtgaaaccctgtctctactaaaaatacaaaaattagcaaggagtggcagtgcatccctgtagtcccagatacttaggaggctgaggtgagaggatcacttaaacctgggaggtggaagttgcagtgagccgagatcgcaccactgcactccagcctgggtgacagagagagacaccatctcaattaaaaaaaaaaaagacaaaaaatttagctcgtgaatgttctcgttcttatatcatggatgtctgatctagaaatttacctaaaacaaaatcacttagtggggaccaagagagacattttgttctacattctgttaatgtatctctgaaatacacagcttttctctgattgaggtaagaattatagcccatggagcagggggtttggaagataattcatgtttcaaaggactctgtgacatacagagaatattgaaggaattgtgatgtcaacaaaactcagtttttttcttgaacacatatggaagtaaagtttctcccagagagaaggcaagtctacaaatctatctgctacagattttcctgggggagaatatgtggtaaagtacctgagttttaaaacatccttctgcttgaaaaagaaaaacaaagggaattaagagttggcaaagcaattattaagtagattatacagcgaagacatgaatagcaaaaaaacagatgtttacctagagcagtattacaatgcaagattcttttaggataaattgagtgatagatacttgccctctgattatgtagagttacctggaatttaatttccatgtgaaaatgttataaaatattttcagtctttttctagatatgaaactttgaaaatgacctatatacatttatgtgtatatgaacatgtgtggaaaaataaaatttatagaaatgccgataaataaaaaatgcatgtgtatatttaactctagaagtctgacaggatcagaaagaactctctcttcaagataacttgatgcttgtgaatttcagttaagaaagctgggcagagattcctggaggctcatgggagcagaaagtgaaagtgtgatgactagtttagcaggacaagtctgttgggaacttatttactgattttttttaaaagaatgatcattctagaccaggcaaagggaatgagcttcctataatttaaatagtgagtttacctcaaggttcagcaaagcttaaaatgatccctttattgaagagccagtggtagtcccaggaatttctgggcaagcatctattcacacatccatctcccagcacttctacagcccttagaattgttagaggagagcctatatcacagcatgaagaatggggaaactgctttctttggcccttcatttgatccaaggaggaacactggaaaagaaagaatgctttgtcaaagtatggagcaataggaaaatgagaatccgtgagttaatatcttattcaggtatacattcagcttgagtattctcaatgatttaccttgagattattaacaaaagctaaaagatggctcatgtctagtgactttgtttacttttatcttcaaaatattttaatatcagggtaatcctcttcttttttgagttgttgattattgaacatatagtctctaaaaagataattccagaagtccatttgggtaatatcaaagactccattatctcctttcatttagcatggcttagtaatactgtcttgtcagacttgtgttctttggatttttttttttttttgatcagcaataggtttgggaaattagagaaaataaatgtcattgaaaacaaaatatcaactgaacttgcatgtttaacgttaatatttacttatacaactttacaattttaagatacaattttcatcaaaatagcttgaagttatcacttgttgatttggtactcatgtattgttacagaaactggcttatggcagttaaaatgaataatatatgattgtcaaaggatgatggtctaatttgtagtattgttttattctttgtacttaattacttattaaaatatttcccataaatggaaaaatattttctctttggatgaatgcatcatgtaaaagtcatttctagtgaacaaacaatgactctctattggcacatgttgctttgtaagagaatctcatttagaagttgctagtgacactccctgctgtggatgagcacttgctggtaactacatactgggccttggggagcagctcagaattagtttcaggtgttgcatcaaaattatgtagttgctggcttggggagtagtataaagattaactgcttgaaaaaaaaaaggatactttattcagggctgacatacacacatgcaggattgagctcttttggtaaacgagatgtttaccagggctgctcaaacccaccccatgagattaattctttgcattaaggcaaagatatttcctgatagaaagtgaatatactttcaaaaaggataagatattcccactgccaggttaatatccttaaaactctgctctgatctcatctcttccctgctcatcaaatcccagtggttttccactatctacagcatgagtttagctgtcatagtctgacattcaaaactctcaaaacacttttccattttctatgttcaacagttgtcacctgccaccttcctgcccatatccttttaacacaattcaacagcactcctgcaatttctgaaactcacctcttattttttagatttcacactagtcacatcgttccctttatcctcgaatgctctaatagcacttcatcccttcctgcctctctccctccctcattcctttccctctctgctttctcccttccctccttaagggcttgatgtacaccagactcaaagttagacatagaagatacacaaagatgagacattgttccccatctccaggtgcttgccatcttttggggtgataggcaataaaccaattacactatgatgtgataaagctgtgattgtggcagcatagaggaaaggcagggcgagttaagatcaaggaaggcttcctgggtgaggtgtcacttgaacaaattccagaaggacaagaaagaactagccatattgagaggtgacagcatgctggcagccctgcagccctcgctcgctctcggtgcctcctcggccttggcgcccactctggccgtgcttgaggagcccttcagcccaccgctgcactgtgggagtccctttctgggctggccaaggccggagcctgctcccacagcttgtggggaggtgtggagggagaggcgcgggcgggaaccggggccgcgcgcggagcttgtgggccagcgcgagttccgggtgggcgtgggctcggcgggcccggcactcggagcggccagccggcctgcaagccccggggcagtgaggggcttagcacctgggccagcagctgctgtgcttgatttctcgctgggccttagctgcctccctgcggggcagggctggggacctgcagcccaccatgcctgagcctccccaaccccactgtgggctcctgcgtggcccgagcctccccgacaagtgctgccccctgctccacggcgcccagtcccatcgaccacccaagggctgaggagtgccggcgcacagcaggcagctccacctgcggccccggtgggagatccactgagtgaagccagctgggcgcctgagtctggtggggacttggagaacctttatgtctagctaagggattgtaaatacaacaatcggcactctgtgtctagctcaaggtttgtgaatgcaccaatcagcaccctgtgtctagctcagggtttgtgaatgcaccaactgacactctgtatctagctactctggtggggacttggagaacctttgtgtccacactctgtatctagctaatctattggggatgtggagaacttttgtgtctagctcagggattgtaagcgcaccaatcagcaccctgtcaaaacggaccaatcagctctgtgtgaaacagaccaatcggctttctgtaaaatggaccaatcagcaggatgtgggtggggccaggtaagagaataaaagcaggctgcctgagctagcagcggcaatgtgttggggtcgctttctacaccgtggacactttgctcatttgctctttgcaatgaatcttgctactgctcactctttgggtcaacactgcctttttgagctataacagcgactgcaaagatctgcagcttcactcctgaagctagcgagaccgcaaacctaccgggaggaacgaacaactccagacgtgctgccttaagagcccgtaacactcaccgctaaggtctgcagcttcactcctgagccagcgagaccacaaacccaccagaaggaataaactctgaacacatccgaatgtcaggagaaacaaactccagacacgccgcctttaagaactgtaacactcactgcgagggtccgcggcttcattcttgaagtcagtgagaccaagaacccaccaattcgggacacaatatgaaaggaagactaacgtttgcactccacctaacctactacttggagcatggtaagtgtcagcttcccatcctcttctgtttgttttgggattgtttttgtttgttttttgtttcccgcttccttttttaaaaaatgaagcattgtaggactttatctgtgactctttcatgtcactgaccattttctgccgcatactaggcttatttactttcctctcctgggtctacctctacattataaattatttcacgaagggaacttgaaatctatttaggtatgcatctatctgtcatctatccatctttctttgtggcctttacatatagaatataacttgcacttaattggcacctaatctttttatatgaaatttttttaaacttttaggttcaggggcatgcgtgcaggtttgttacataggtaaactcatgttgcaggggcttgttgtacagattgtttcatcacccaggtactaagcctagtacacaatagttactttttctgctcttctccctcctttcaccctccaccttcaaggaggccccagtgtctgttgttcccttatttttgtccatgagttctcatcatttagctcccacttgtaagtaagagcatgcagtatttggttttctgttcctgtgttaatttgctaaggttaatggtctccaactccatccatgttcctgcaaaagacatgatgtagtccttttttatggccacgtagtagtcagtggtatatatgtaccacattttctttatccagtctatcattgatgggcatttaggttgattccatgtctttgctgttgtgagtagtgatgcagtaaacatacgcatgcacgtgtctttgttatggaatgatttatattcctgtgggtatatacccagtaatgggattgctgagttgaatggtagtcctctttttagctcttcaaggaattgctacactgctttctgcaatacttaaactaacttatattcccaccaacagtatataagtgtttccttttctctgcaactttgccagcatctgttattttattttattaaattttaagttcaggggtacatgtgtaggtttgttatataggtaaacttgtgtcatgggggtttgttgcacagattattttgtcacccaggtattaagcctagtacccattagttatttttcctgatcctctcactcctcctacccttcactctccaacaggccctagtgtgtgttgttccgctctatatgtccatgtattctcatcatttattcccacttataagcgagaacatatattacttggttttctgttcttgtttcagtttgctgaggataatggcctccagctccattcatgttcctgcaaaagacatgatcttgttcttttttaggtctgcatactattccacagtgtgtatgtaccacttttttttttttttcttttccccgggtcacagaaccaattcattcacccggcggcaccactgctgtcatttcagcttctggccactgggaggcgctgctcgaaagggtttgccctgagactccgagaagaagctgcgggaaggacagcaggggtcctggggttttagtctctggcccaggatttatgtgtccataaccaaaggaagcacagtctgcacccagctctcatcccatcggagctgctgcgactcccgcaggttcttccggaactggtttagcttgccctcaggatcaggaaagtttgagaaaagcatctgcagctgagctgccagttcctctgagtcctcaaagaccaagctgttttcttcatgtttcaccagctcatgtaaacacttgaagttcacagcacacacaggcaaacagcacccgaacatgtccaccaccttcatgggcaggtccaggccactggaggacgtgtgcagacagacacccaggtccaccgaccctagaagcagggggtagtcctcggcctccagccagggggtgcagacctggatgtgctggaaatgcttctggtggatgaggtggctgtaatactccctcagaggccatttgcctgttatcacacagacgagagaaggaaggttgtgttcgtcaagagtcagttgctcaaacttttctaaagctgccagcaggatggagaagtcttcgtcctctcaagtgttccatgggtcgtgcagacctgtccagcctgtgctgctgaccagcagggctggccgctcatggagacgcatcaccagcccgctcccagcatcccgcttcatgaaggccgaccgctcctggctgggtcctcaggttctgagcgggccctgaacggagagtgcgtgctgcccagcttcatgaagagtcggtgctgcaggtccagaggtgtctcttgaaagaaagatgccggcttgtcatagatggtcacagcctcaggatagctgggttcttggccattcttgcagtggttttcaagggtgaaaaaaggagtttcagcaagacagctaacgtctggaggagtgagccaggaagtgtctgtaggcttcctctagagagcactctgggctggtgggcgtgaggactccagttttcatgtgcgtccgtgtgaagagaccaccaaacaggctttgtgtgagcaataaagctgtttctttcacatgggtgcaggccggctgagtcagatttaaaattggtgagatgttccttgggctggtgggtctgaggacctgaggttgtaagtggatcattttcatggagcaaagaacaggaggacatgggattgatctcccaagggaggtcccctgatccaagtcatggcaccaaatttcatgcatgtctgtgtgaagagaccaccaaacaggctttgtatgagcaacatggccgtttatttcacctgggtgcaggcgggctgagtctgaaaagagagtcagcctgtaccacttttttttaatccaatctatcattgatggacttttaggttaattccatgtctttgctattgtaaatagtgtgtaattaacacatgaatacatgtgtctttataatagaacaacttattttcctttgggtatatacccagtaatgggattgctgggtcaaatagcatttctatttttaggtctttgaggatttgccacagtgtcttccacaatggctgaactaatttacactcccaccaacagtgtataaacattcctttttctctaaacctctccagcatctcttattttttgacttttaaatagtagctattctgattggtgtgagatggtatcccattgtggttttgacttgcatttttctaatcagtgatgttgagttttctttcacgtttgttggctgcatgtagcttcttttgaaaaatgtctgttcatgtactttccccactttttaatggggttgtttgtctttttcttgtaaatttgtttaagttccttatagatgcttaataatagacctttgtgaaatgcatagtttgcaaaaatgttctcacattctgtaggttgtctgcttactctgttgacagtttcctttgctgtgaagaagctctgtggtttaattagatcccatttgtcaatttttacttttgttacaattgctttaggcatcttcataatgaaatctttgcctatgcctatgtcctgagtggtattgcctagattgtcttctagggtttttacagttttgggttttacatttaagtctttaatccatctcgggttaatttttatttatggtataaggaagggatcccgtttcaatcttatgcatatggctagccagttaatcccagcaccatttattgaatagggaatccttcccccattgcttgtttttgtctggtttgttgaagatcagatagttgtaggtgtgcagccttatttctgggttctctattctgttccattggtctatgtatctgtttttgtaccaattccatgctattttgattactgtagccctgttgtggcatagtttcaagtcaggtagtgtgatgcctccacctttgttctttttgtttaggattgccttggttatttgggctctttttttggttccatatgattttttttttttttttttttttttgagacggagtctcactctgttgccctagctggagtgcagtggtgtgatctcagctcaccgccgtctcagctcactgcaacctccgcctcttgggttcaagtgattctcctgcctcagcctcccaagtagctggaattacagtcgcccactaccacactcagctaatttttgtattttagtagagacagggtttcatcatgttggccaagctggtctctaacttctgacctcaagtgatccttctgcctcggcctcccaaagtgctgtgatcacaggcatgagccaccgtgcccagccccatatgaattttaaaagttttttccagtcctgtgaagaatcccagtggtagtttaatagaaatagcagtgaatctataaattgctttgtgcagtatggccatttttatattgattctttctattcatgagtatgaaatgcttttccatttgtttgtgttaatctctaatttatttgagaatgttttggagttctccttgtagagatcttttcccgccctagttagctgtattcctaggtattttattctttttgtggcagctgtgaatgggattgtgtccctaatttggctcccggcttgactgttgttggtgtataggaatgctagtaatttttacacattgattttgtattctgagacttcgctgaagttgtctatcagcttaagaggctttgggtgagactacagggttttctagacataggatcatgtcatctgcaaacagggatagtttgacttcctctcttcctacctggatgcctttattttattttcttccctgattgccctggacagaacttccaatattatgttgaataggaggacatccttaccttgtgcgagttctcaaggggaatggttctagcttttgcccattcagtgtgatgttggctgtgggtttgtcatagatggctcttattattttgaggtatgctccttcagtacttattttacagagagttttaaacatgaagccatgttgaattttaccaaaagccttttttttgcatttattgggataatcatgtggtttttgtcttcagttctgtttatgtgatgaatcatatttattgatttgtgtttgttgaactaaccttgcatctcagggttaaagcctacttgatcatggtggataagctttttcatgtgctgctaatttcagtttgccagtattttgttgaggatttttgcatcagtgttcaccaaggatttggggttaaagttttctttttcttttttgtatctctgccaggttttggtttcaggatgaggatttgttaattttttgactttttttttttttttttttttttttgagacagtctcactctgtcgcccaggctggagtgcaatgacgtgatctcaggtcactgcaatctctgcctcccgggttcaagccattctcctgcctcagcctcctgagtagctgggactacaggcgcccactaccacatccggctaatttttgtatttttagtagagatggggtttcaccacgttggtcaggcgggtctcgaactcctggcttcaggtgatccacccatctcagcctcccaaagtgctgggattacaggcgtaagccaccatgcctggcctttttttaatgatagccattctgactggtgtgagattgtaactcattgtggtttcgatttgcatttctgtaatgatcagtgatgttgaacttgttttcatatgcttgttggccacatgtatgtcttcttttgaaaagtgtctgttaggcggggtgtgatggctcacgcctgtaatcccagcagtttgggaggccgaggcgagtggatttcctgaggtcaggagttcgagaccagcctggcaacatggtgaaaccctgtctctactaaatatacaaaaattagctgggaatggtggtgggcacctgtaatcccagctacttgggaggctgagacagaagaatcgcttgaacctgggaggtggaggttgcagtgagccaagaccatgccattgcactccagcctgggcaagaagagcgaaactccatctcaaaaaataataaataaataaataaataaataaataaataaataaaagtgtctattcatgtcacctgcccactttttaatggggttgtttttgtttttttttcttgtaaatttgtttcagttccttgtaagatgctggatattagacctttgttggatgcatagtttgcaaaacttttctctcattctgcaggttttctgtttattctattgatagtttcgtttgctgtgcagaagctctttagtttaattaaatctcatttgtcaatttttccttttgctgcaattgcttttggcatctttgtcataaaatttttgtccgttcctatgttcaaaatggtgttgcctaggtggtacccaatctttttaatagatgatgaataaagttataaaaatagctaaccactcatgtagcaaggcatagggacaatgtgtcaacataagatgaggaagaaaggcttcgggtctggagcacagcagggatggaggaaggtgtaaagaacctgttttcaagatagtaggggctagcttcagagtaacaggcatttccattgaggaaagaggatggagagtggactaaaaagaaggaggccagttgaaatggaagagtgaagtcttgaaaagtttttccatcatattcatttaattattttcccataatattttctactccttatgtttgcatttttgaataaaaaagacttttctcattccccctactccgatctcccacacacagtgccctcacttttgagctgccattgtaaacagcagctctttcaaatatctacaggcagaataagtagctacaatttcaaagtagaattattaacaatttatctaaacaatcttgctaaaattcacatatttacgtttttaggggattattatttatttcccctgatagtttttggaaaaccaatttggatacaaaaaggataatgcgaaaatctaaatagaccagttatatttaaggcaggttaacttttggaacaaacaatctctaagtcttagaggcttagcaggtaacactttacacacactaagactaatgctggtgttactggtcaggctactttccttgacagccctcctctaggcagtgactcagggagtctgttggatgttgtctattcgccccttctctgccttcccctctctgttctatcacctctatggactgcatcacataaactcctttgcctgtagcttccagtgggttttgccaaagggaggcactaataggagactggaggtgagagaagagacccactcaggtctttgttgtttcactcatggctcatttctctatctgtggccactctcccatggctacagctcttactaggtgacatgtatgtgaatccctccccttctccttccagacttgggtgtgataacaccttcctactgttcctggccctgggtttttcaccatcctctgttaaatcctgtcactttgcccactcatttcaatagttccttctttaaactgtcttattttttgggtgccccagctatttactgctggcgtcctaactcatagagtgatccaaattattttcgttttatgatactgctgtccttgatgcaagccatacatagttcctgctaaaggggaagaggacccgtgaggtcgtctgaaatgaaagtgtgaagtcttggggaagagaacatgagcatgtaagatactcagccaccaaggcccataaagtgacacagatcatttttgttcacattctattggccagaagtcatcacatggcccctttttaaggcaagagagctggtaaatgtggcccctggttaagaagccatattcatcaacaattccatattatgaaaagggaacatgaatcttcagtgatcagttagccatccagagaataaaatcaaatagcctaaaatagacagcggtattcatagaaagttttaaataatgtacataaaaaataaggacatgtgacaattgaagacatagggagatatgtggaagattttggaaagatggcagcagtcatacagtcgttgaacctaccagaacaccactccccaatagagtaaccagaatagcaaggccaaaaccccatgaaaggtatttacatcatgactaggtgatacgatatccccatgtacacctacatgctaccaggtaggagcaaaagctacaagatctgtgtagtatcagaaatgatgtgggaggaagtagaaagaagttagaggtactcctgatactgtgagagcttggaaaaccccacagctgccatcaggcaatcactggaagctcagcaggccattctgagctcagcagcagaaaactgctgaaagaataggaaatagggtaaggctaaataaaaatgcaatgtcaattgtcactttaaaaagttacttgtggtattcactgaagaagaacatgtgtgtatattcacttccttggagtgaatttgctgagtcatggggtatatctgtctatctaccccatgactcagccaattcactccaaggaatatacctaactaaatatacctaactaaactatgcctgtatgtgtaccaaaaagatgaatactagaagatttgcagcagcattaaactactcagatgtccatcaacagtagaatggatcgataaactgacatatactcactcaatgcaatagtgtacagcaataagaatgaatgggctgctttgtagagaaaagagtatggggtggtaagattggaagccgggaagtgatttggaaattggtagtgattactgtcatctaggtaatagctcatgatggcttggctgggaacagagctctcaacaatttggggtgagtttaaccgtcacatcagatttgctggcatcctttagacatctgacacttgcacatttgaagcacatgttcaaataaaagggtacacattagaaagctacaaatttaaaaacctaacatcacttcccaaaataatcctatcgagagatgacaatgtgttagcagccctcgctcactctcagtgcctccttggccttggcgtctgctctggccacacttgaggagcccttcagcctgccagtgcactgtgggagcccctctctgggctggtggaggctggagccagctcccttggcttgcggggaggtgtggagggagaggcgctggtgggaactggggctgcgggcagtgctcgcaggccagcacgagttccgggtgggcgcaggctcagtgggccccacagtcagagcggccggcccctgggcagtgaggggcttagcacctgggccagcagctgcagagggtgcgccgggtcccccagcactgccagcccgccggcactgtgcttgaattctcactgggcctcagctgcctccccacggggcagggcttggttcctgtaccccaccatgttgtcccctctgcctagctcctctgcaccacctcccctgccccctctctcccccacttccctcttcccctctccccaccccccactcctgctctcccccctccccctgccccccacaacctccccctccccctccccctttttctttctctcccccccgccaccccaccctcctcccccgccaccccacctcctcccctgccaccccacccccaccctcccctccatgggctcccacacagctcgagcctacctgaccagcgccgccctctgctccacggcgcctggtcccatctaccacccaagggctgaggtgtgcaggtgcgtggtgtgggactggtgggcagctccatccatggcccaggcactggatccactaggcaaagccagctgggctcctgagtcgggtggggtcttggagaacttttatgtctagctggaggattgtatatgcaccaatcagcactctgtgtctagctcggggtttgtggatgcaccaatcagcactttgtgtctagctcaaggtttgtaaatgcaccaatcagcaccctgtgtctaactcaaggtttgtaaatgcaccaatcagtgctctgcatttagctaacctagtggggacttggacaacttttgtgtctagttaaaggattgtaaatgcaccaatcagtactctgtgtctagctcaaggtttgtaaatgcatcaatcagtgctctgtgtctagttaatctagtggggacttggagaacttttatgtctagctagaggattgtaaacacaccaatcagcaccctgtcaaaacagaccaatcagctctctgtaaaacggaccaatcagcaggatgtgggtggggtcagataagggaataaaagcaggctgccccagcctgcagcagaaacccattcgggttcctttccatgccatggaagctttgttctttcgccctttgcagtaaatcttgctgctgttcactctttgggtctgcacccacctttaagagctgtaacacttaccgcgaaggtctgcacgttcactcctgaagccagcaagaccacgaacccaccggaaggaacgaataactccagacgcgcagcctttaagagctgtaacacttaccgcgaaggtctgtggcttcactcctgaagtcagcaagaccatgaacctactagaaggaagaaactccggacacatctgaacatttgaaggaacaaactctggacacgccatctttaagaactgtaacactcactgtgagggtccacggcttcactcttgaagtcagtgagaccacaaacttatcaaaaggaagaaactctggacgcatctgaacatctgaaggaacaaactccggacacatctgaacatctgagggaacaaactccggacacaccatctttaagaactgtaacactcatgcgagggtccgcggcttcattcttgaagtcagcgagaccaagaacccaccaattccggacacactattacattgtactagcttctactgccctttgtatttctgattaataaggaaatcctttaacttgataaagccacctgggtagaaaatgattttgtcagtgattgcctgagcttgctagtagttgaaaaacataaataaaactttcttgcttcttctttcccatttaagtttagagtgagtaaacaaacctttttcctttctgtctttattttgtttagtagtgcttttacaagtgctgttggagaagacagccatattctaggaggtgtcaagagaataaaaatggatatgggatgcaaatgctgtttctgttctttaaaaagcaactagctaacccagaaaccattgcttggtacacatgtgtgtgaaacagacacaatctctttgggtcatttattgatatggtgagatgcaaagcaaagaaattagagttatcgcttaaccagcacctggccttttcttcctccctaaatcaaccttgatttctaatttttatctaactttatctttgaagtttctcttcatgatgctcccatttttggggtggagtatattgatttataggtcaagcacatgagtttcttaaggcaaagcacaaattacttactacttgattgttgttttgttgttgtttttgtctttgccttactaacttcagtttaaaagtaaatctttccacagtgtaaagtagactgacagactggccagcatcctcagtgatggtcttgattgggaagacaaacgcaaggtgatttagtgtcgtagtctcagaactggttggagaaggtagagcaaaatggctaataacaatgattttagaaaaacaatggcttggtgctgattgtgtactttcttgctgtgtaatctcaggtcaattactttacctctctaagcactaagcctggcacatagtaaacattcaacaactgttagctagttacactagttgtaacaaagagaatttaactattagctattagtattgttattagtagttgcacctatgtgtatttatcccagccccatggattgagcattttattttattatttgagacaaagtttcactttgttgcccaggctggagtgcagtggcacgatctcggctccctgcaacctctgcctccttggttcaagcaattctcgtgcctcagcctcctgagcagctgggattacaggtgcctgccaccaggcctggctgattttttatattttagtagatacagggtttcaccatgttgcccaggctggtctcgaactcctgagctcggggaatccacccagctcggcttcccaaagtgctaggattacaggcgtgagccgccgtggaactgggcattttaaaccccagtgggacaatgagcccttctttatttcctatgagtgttagtggcacttttggaccatatagttccagaaatcagaaacctgggaaccatcgttaacaattctttttccttccactgtcacctccattctccttccaaactccacatgtggcacatgcacaacagccagcgaattatctgctaattgctgtcaattccagctttgatttggctcccagactagctttttcctctttattcaccccacccatcagcaaccttggccccagcattgttgtttctcttatcttggttctctctctctctctctctctttgttttgtttttagaaacaaagtctcactctgtcacccaggctggagtgcagtggcacaatcatagctcattgcagccttgaactcctgggctgcagtgagctatgattgtgccactaagatgggagggctcaagtgatcctcctacctcagcctcctgagtagctgggactacaggcaattgccattgttcctggcttaccctggtactctctgtaacactcatctctctctattagatatacacattttaggccgggtgaggtggctcacgcctgtaatcccagcactttgggaggctgaggaaggtgggtcacgaagtcaggagatcgagaccatcctggctaacatgctgaaaccccatctctactaaacaaaatacaaaaagttagccagatgtggtggcgggcgcctgtagtcccagctacttgggaggctgagcaggaaaatggcatgaacccgggaggcggaggttgcagtaagccgagatcgtgccactgcactccagcctgggtgacagagtgagactccgtctcaaaaaaaaaaaaaaaaaaaaaaaagatatatacatttttttttctctactgtttactgctgtattcccagtacctagaatggtgcctggagaatgttaaatgcacttaaatattacctgttgaatgaaggaatgaatgtagagaggaaaggaatgaaagaataaatgccaaggctactcccctcttttaggccaatatcacatgcatttggatttctgcagtcatctcctaagggtctacctgtctccaggcttgctttctaccttttattttttgcactgtagccagagttgtctttctaagaggcatatctaattttgctacttcctggctaaattccctagcagcctttgaccactctgcccttgttccttatttatctttctttcctggcactcttctctgaccttttgtggcttcccttccctccagctacattatttaccattccctgaactcatctcctttgagaaaaggtggcttcttcttcctggaatattcctcctttccctgtgcctctttggtcagctaccttcctccagccattaaagactcaaggaacatatcacttctctgtggaagctttctgatcaacctctgttgactaagttggcattaggcacctttcttggtgttaccgtagcactctggctccattgatgacagcatttaccattttgtgttgtagtggcctttggaagggagcaccttgagctcagtgtgctctatattgtacgtctctgcatttcttattcctcgcggaaagactgacatgtgataagtgcttaaccaatgctttctgaatgtcactataccatatcaggtgactgctgaactgggaggtcagtgttttgggtcagtgtaatcaagatacagatggaactgtacacgattagtttttgttcatttttaaagtttctaggcagtactggcatggagttgtatattagtccgaggtggtggttttattgaagctttttcaaatatggccatgctgtctaataaatgccatataaaggctactttaaacaccattacagaatctgagataacttgcttctagagaaacagtctttagcctgtggacagagccaccataagccacagctccccaccatggtcaacacagcatgctgctggcttagagctttccatccactggtgcaggtcatgacaggtaaagctgacttaatgtaaccaccaagagccaaatgccttgcctaaccaccacagcacaaggttcatggacacatttcctggccctattgaatgcctctctgcctaaatattttgctctcccccaattccatgcctttgctcaatttttggtgtggaattttcaattccaaacccatgaaatgttgcagtcattgagaatgcaccaaacaaattatatccttcttttcctcctgggtgtataacaaaatagaacaaaagtcaaagattatcaaatgggaggccaaaacgccatctttattgtgataaacactgagttgaagctgtagcttattgtgagaatcaagtgggtttcctgaatctgatcccaagaatgaagtagcctcacccagtcagaggtgatgcaggactcggcaggtctcctcataatgaagatgggacgtcagaaagcaagggaacgctcccataccctgtgggcagctcacgtctgaagaaaatgctggacaaggtgtctggctcagctgtgtcactccacttccccttaggcgttggtaaagcagtggaggcaggccaaggttgttaccctacttgagctccctcactatggaaggagtgaagagtgggaagaagtgttcccaccctgcaccacacacataataagggctgaaatcacttttatgacttaatcaataaaacatagattaggaggtgctactgtcccacaataggatttgctcctttgagttcctatacttgcctgctgtactggaacacatatggatgataatttttcactagtaaagagaagactgggtgaatcatttatggatggcttataatgaactctaatgatggtcacataaaatgtctgctgtatttcttgcctgtattgtaatgctacccatcgcattacaaattgaagaaatagccattaaattgactcaatttattttcaaactgtaatccctttcagacttctaagttaaagtccagtaatggatacattactttgaccttaaggcattaatgttgcattttaaaagctggctaatatgggtccatgtgatgtctgtcagatttagaaggttgatcacttaataatgtcatggtccctatcactatacagtatcaaatgttctgctgaactggaggctggtgttttgggtcagtgtaaccaagatacagagagaagtgatgaggatagctgacctttcagaaagtcttaggatctgtgatgtaaaactgtgccagcttacaggtttacttacccacggctcccaaagaaagtacaggggtagtgaaaaagagggaaacaccatgcctctctatttgcctatttatggctggtggccatttccacagcagagtggcatataaaatctaaggttgggccaggtgactcctgaggtccattttggctgttaatggcaagcgttaggaggattccactgttgagtttaaaaagccaccaagtccttgctctgtgcttgatgtgacccagtggtgaagtctattgcctacctaaggaaggagaacggggaaaggaaaatggagagatgagagggtgtggaagaatgaggaaatggcctcatcttgaggagttcacatctaagctaaggaaacagacagatgcacacagtcatttgaagaagaccaaatgtttggtcagtaaaagagacagtttaaggacatataaaataccttggtcacagcacttaccatctctgagacttctttctgtatctctacatcctcatttgctatcaatacctatcttatggaattaagaaagggttatatgacatgatgcttacaagtttcttactgcagtggctggcccataataatacctttatgaatgctgggtttcaaaaataatactaccagacttgcatccttacattgctgtcaaacagtgtgcctggatcatgttttccttggtccttgaagaaaagttttattgcgttgacatttaatgttacaagcattttgtacagagttggcatgagagacatttactttccccaaaaacagggttttgcattcttctataaacacctgagcgataaattcttccaactctagaagtcaaagggaagaggatatgaaaaggaaactcacaaaagaaaaaatacaaacagctagtgaatacaggaaaaaagtaaagataacattagtgaataaaaactgaaacatcaatgagacatgattttcacggatcctattgtaaagattgaaatagtaattctcagtataaaagggagaaatgggccttcttatattggtttaggtaaaaattggttcaaactttctggaaaaaaaacttgatgatatgtatcaagtagtctaaggtttttcttggttctaatccaacaatttcaccaatagaaatttatcctttccctgagcttaggagttcgagaccagcctgggcaacatggtgaaaccccatctctactaaaatacaaaagaaaattagctagacgtggtggcgtgtgcctgtagtcccagctactcaggaggctgaggcaggagaattgtttgaacctgggaggaggaggttgtggtgagccgagatcgtgccactgcactccagcctgggcaacagagaaagactccatctcttcaaaacaaaacaaaacaaaaaacaagtcgtgtgtgtgaaaaaaacctgtcttcagcattgttcttatttgctgtttcctcccccaaacatgtttaaatctcaaagataggatgttcgttaaataaattatggtatgcaaatacagtgaaatactatacgtgtattttaagaactattcaatggtgaaatgctttcttgatatgttacatgaaaaagatcgaggggtaattgagatttcattaacagtctgtactggaaaatgacactcataattaagattccaattatgtggaaaaatgttcataatatgtcatgtagttacgaaaatgggttacacaatcacaggacaattgtaattttacataaaagtatattttctatgatactggaactatacacatcagatgtgaaaaatgattacttttggaagctggcattatgtatgatttaaatttcattatttgtgtttttctgtatttactgatttctcttttaaaatatggttttaattacacaagtaataacacatattctctgtaataaaatattgaaacaaaacagaagtacatactaaaaagtgaaagtctgtcttccgttgcacttcccctaagttccccaaacactgatgccctctttagagaaatgactatagttttgaggtatgtttccagaaccctttctagggagttcaggagcttcaagctgctgaacactctcagccatttatcctgggctcttttgcatgtagcactctactgaatgccgggctcctctgagaggctgtcagtgtcctctggctacactcagggaatagggactccctgggagttcttctgaccctctctacccttctttcccctccattttaatgaccctgagaacatctaattgtgtgcctgtttcttctctgtttctctcctcctctcagtcagccatactcctccttttgaattctctttacctttggattttgaaaatgttatgcttaacttgctgagccttggtttctaaggaatttttaggataatagaattcattctcaataaatcttggctttcaagacttttttccctccctccctccctccctttctccctccttccttccctccctgcctctctctgccttcctgcttcctctctttctgccatagactaaaacatctttatgtataagtcctctgcctaacactgactcctttcattttgtattttcactaaaacaactttcagcctctagctgaattgggagaaggtcaaatataaggagggcaaaagacagaaggatacagtaacatatttctaaaaatttcttatcaaactatagatttaaaaaagttacactgtacatgcagagtttttaggtcagatttattgaggtctgatttatggttagtaaaatttaccccttttaggtgtatagttgatgatcctggtcaaatacatacagctctgtaatcaagactacaaccaagatatagaacgtttcatcacccaaacccttccttagtgccactttgtagtgtctcttcccctaacccttgtctctggcaaccattgatgtgatctagtttcacttctagaatgttacataagttacagtgtgtaattttttgaatctggcttctttcacttagcacaatgcttttgagatatatccacattgtgtatcagtagttcaatctatcaccaagtagtatattttatgaacatacaacaatttgtttatccatttaccagctgatggacatttgggttgtttttagtttttggcaattatagataaagctactataaacattcatgtatagtcgtttttgtttttgtttttgtttttgagacaaggactcactttgttgcccaggcggaaaggcagtggcaggatcatagctcaatgcagcttcaaactcctgggctcaagtgatcatcctgcctcagccttctgagtagctgggactacaggtgagagacaacataccaggctcaacatttacatatattctttctccagacacatattttcatttctcttaagtaaatatctagaagtgggattgctggctagtataagtgtatgattcagttaaaaatatactaaatttttttttccatagtggttgtaccattttgcattaccactagcaatatgagagtttcagttactccacatttgaactagcccttggtattgtcagttttttctttcatttttcctttaaaaaaaaaaaatcctagcttttctactaagtgtgtagtggtatctcatggcagtattaatttgtacttctcttattttttatgatattgagcatcgtgttgtgtatttatctgtcattggtatcttttcttggtgaagtgtctgtttaaatcaatgcccactttaaaaattttgtttgtttcttataattgaattttaaaagttttaaaaatatattttagatacaagtcctttatgtgttttgtgaatattttcttccattcagtagcttgtctttcacttttttggcaatgctttccaaagagcagtagtccttaatattaatgaagtccaatttagtaaaattttttcgtttatagctcatgctttttgtatcatatctaagaaagctttgccttgcccgtggttgtgagcaattttttctcttcttctcttctcttcttctggtttctcctagaagctttatagttttagattttgcacttaggtgtatgaccatattgagttaatttttgtatctatgtggtaaagtttatgttcaagtttttgcatatagaggatcaatcgttcaagcactatttattgaagagacagtcttttctctattgtattaccttgggcctttgtcaaaatttgattgacatgtaggttaatttccagactctttattctgttctgttaatctacatgcccttgtgccaataccacattctcttgattattatagcattataagatgtcttgaaatcaggtggtgagagtcctcaaactttctttctccaaaaattgtattctaagtcctttgcttttctctacaaattttagtcatctagtcaatttctaccaaaaaagggctgaaatttttattgggattgcattaaattgataaatcacattgaagagaattgatcttttaacagtatattgggttatcctacctatgagcacataccttcatccatttatttaggtgttcttcaatttttttcatcattgttttgtgatttttagcattcaaagagtgcacatattttaagtttatccctaagtattttatgatttttaatgctattatagatggcattttatttaaaatttaagtttccaaatttttatggctaatttatagaaacaaaattgatttgtgttctgacttgtatttttcagctttgctaaacttataattctattagaattttttaaaaaattatactttaagtcctgggatacatgtacagaacatgtaggcttgttacatacatgtgccatggtggtttgctgcacccctcaacccgtcatctacattaggtgtttctcctaatgctatcactccccttgccctccacccccgacaggccctggtgtgtgatgttcccctccctgtgcacatatgttttcattgttcaactcccacttatgaatgagaatatgcggtgtttggttttctgttcctgtgttagtttgctgggaatgatggtttccagcttcatccacgtccctgcaaatgacatgaacttattcctttttatggctgcacagtattccatggtatgtatgtgccacgttttctttatccagtctaacattgatgggcattttggttggttccaagtctttgctattgtgaatagtgccacaataagcacatgtgttcatgtgtctttatagtagaatgatttataatcctttgggggtatataccagtaatgggatggctgtgtcaaatggtatttctagttctagatccttggggaatcgccacactgtcttccataatggttgaactaatttacactcccaaccaacagtgtaaaagcattcctatctctccatatcctctacagcatctgttgtttcctgactttttaatgatcatcattttaactggcgtgagatggtatctcattgtggttttgatttgcatttctctaataaccagtgatgatgagcttttttttcacatttgttagccacgtaaatgtcttcttttgaaaagtacctgttcattgggaggctgaggtaggcagatcatgaggtccggagattgagaccatcttggctaacagggtgaaaccccatctctactaaaaatacaaaacaaattagccaggcgtggtggcaggcacctgtagtcccagctacttgggaggctgaggcaggagaatggcgtgaacctgggaggtggagcttgcagtgagccaagccgagatcgtgtcactgtactccagcctgggcgacagagcaagactccgtctcaaaaaaaaaataataataaataaataaagtatctgttcatatccttcgcctgcttttagatggggttgtttgttttttttcttgtaaatttgtttaagttccttgtagattctggatgttagacctttgtcagatggatagattccaaaaattttctaccattctgtaggttgcctgttcactctgattatagtttcttttgctgtgcagaagctctttagtttaattagatctcattgtcaattttggcttttgttgccattgcttttggtgttttagtcatgaaatctttgcccatgcctatgtcctgaatggtattgcctaggttttcttctagggtttttatggtcttaggtcatacatttaaatctttaatccatcttgagttaatttttgtgtaagttgtaaagaaaaggtctagtttaaattttttctgcatatggctagccagttttcccaataccgtttcttaaatagggaatcctttccccaatgcttgcttttgtcaggtttgtcaaagatcagatggttgtagatgtataatgttatttccgaggcctctgttctgttccattggtctatatatccgttttggtaccagtaccatgctgttttggttactgtagccttgtagtacagtttgaagtcaggtagcatgatgcctcagggtttgttctttttgcttaggattgtcttggctatatgggctctttttgttttcatgtgaaatttaaagtagtttttcctaattctgtgaagaaagtcaatggtagattgatgggaatagcatcgaatctataaattattttgggcagtatggccattttgacgatattgacttttcctatccatgagcatggaatgttttctcatttgtttttgtcctctcttatttccttgagcagtggtttgtagttctccttgaagagggccttcacgtcccttgtaagttggattcctaggtattttattctctttgtagcaattgtgaattgggagttcattcatgatttggctctctgtttgtctgttattggtgtataggagtgcttgtgatgttcgcacattgattttgtatccagagactttgctgaagttgcttatcagcttaaggagattttgggctgagacgatggagttttctaaattacaatcatgtcatctgcagacagagacaatttcactgcctctcttcctatttgaataccctttatttctttctcttgcctgattgccctggccagaacttccaatactatgttgaataggagtggtgagagagggcagcttggcttgtgccagttttcaaagggaatgctcccagtttttgcccattcagtatgatattggcagtgggtttgtcataaatagctcttactattttgagatatgttccatcaataattattttattgagagtttttagcataaagggtgtggaattttatcaaaggccttttctgcatctattgggataatcatgtggtttttgtcattggttctgtttatgtaatagattatgtttattgatttgcatatgttggaccagccttgcatcccagggatgaagccaacttgatcgtggtgaataagctttttaatgtgctgctggattctgtttgccagtattttattgaggattttcacattgatgttcatcagggatattggcctgaaattttctttttgtgtctctgccaggttttggtatcaggatgatgctggcctcataaagtgagttagggagaattccctctttttctattgtttggaatagtttcagaaggagtggtaccagctcctctttgtacctctggtagaattcagatgtgaatctttctgggcctgggcttttttcggttggtaggctattaattactgcctcaatttcagaaattgttatttgtctattcaggggtccaacttcttcctggtttagtcttgggagggtgtatgtgtccaggaatttatccatttcttctaaattttctagtttatttgcatagaggtgtttatagtgttctctgatggtagtttgtatttctgtggaatcagtggtgatatcccctctatcattttttattgtgtctatttgattcttctctctttcctttattagtctggctagtggtgtatctattttgttaatctttaaaaaaaacagctcctggatttatggatttttgaagggtttttcatgcctctatctcctccagttctgctctaatcttagttacttcttgtcttctgctagctttagaacttgtttgctcttgtttctctatttcttataattgtggatgttagggtgttgattttagatctttcccactttctcctgtggagatttggtgctatatattttcttctaaacactggtttagctgtgtcccagacattctggtatgttgtgtctttgctcttactggcttcaaagaacttatttatttctgctttaattttgttatttactcagtagtcattcaggagcaggttgttcagtttccatgtagttgtgcggtttgagtgagtttcttaaacctgagttgtaatttgattgtactgtggtgtgagagattgtttgttatgatttctgttcttttgcatttgctgaggagtattttacttccaattatgtggtcaattttagtataagtgctatgtggtgctgagaaggatgtatattctgttgatttgaggtggagagttctgtagatgtctttgttaattttctgtcttgtttatctgtctaatattgacagtggggtgttaaagtctctcactattattgtgtgggagtctaagtcacactgttggtctctaagaacttgctttatgaatctgggtgctcctgtatttggtgcatatatatttaggatagttagctcttcttgttgcattgatccctttaccattatgtaatgcccttcttggtcttttttgatctttgttggcttaaagtctgttttatcagagactaggtttgcaaccactgctttttttttttttttttttgctttccatttgcttggtaaatattcctccattcctttattttgagcctgtgtgtgtctttgcatatgagatgggtctcctgactacagcacaccaatgggtcttgactatccaatttgccagttggtgccttttaattggaacattcagcccatttacatttaaggttaatattgttatttgtgaatttgatcctgtcattatgatgttagctagttattttgccctttagttgacgcagtttcttcatagtatcgatggtctttacattttggtttgttcttgcagtgtctggtactggtttttcctttccatatttagtggttccttcaggagctcttgtaagtcaggcctggtgatgacaaaatccctcaccatttgcttgtctggaaaggattttatttctccttcgcttatgaagcttagtttggctggatatgaaattctgggttgaaaattcttttctttaagaatgttgaatattggcctccactctcctctggcttgtaggctttctgccaagagatccactgttagtttgatgggcttccctttgtgggtaacctgacctttctctctggctgcccttaacgttgtttccttcatttcaacctcggtgaatctgacgattttatgtgtcttggagttgctcttcttgaggagtatttttgtggtgttctctgtatttcctgaatttgaatactggcctgtcttgctaggttggggaagttctcctggataataacctgaagtgtgttttccaacttggttccattctccccatcactttcaggtacaccagtcaaacatagatttggtcttttcacattgtcccatatttgttggaggctttgtttgttccttttcattctttttttctctaatcttgtcttcatgctttatttcattaagttgatcttcagtctctgatatcctttcttctgcttatcgattcagctattgatacttgtgtattcttcacgaagttcttgtgctatgtttttcagctccatcaggtcatttatgttcttctctaaactggttattctagttagcaattcttctaaccctttaccaaggttcttagcttccttgcattgggttagaacatgctcctttagctcggaggagtttgttattacccaccttctgaagcctacttctgtcaattcatcaaactcattgtctgtccagctttgttcccttgctggcaaggagtcgtgatcctttggaggagaagaagcattctggtttttgaaattttcagcctttttgcactggttttcctcatctttgtgatttatctacctttagtctttgctgttggtgaacttcagatggagtttttgcattgtcatcctttttgttgatgttgatgttattgttttcttcttgtcagttttccttctaacagtcaggcccttcttctgcaggtctgctaaagtttgctggggttccactccagaccctgtttgcctgggtatcaccagcggaggctgcagaacagcaaagattgctgcctgctccttcctctggaagcttcgtcccagaggggcacccgccagatgccagctgaagctctcctgtatgaggtgtctgtcgacccctgctgggaggtatctctttctcaggaggcatgggggtcagggacccatttgaggaggcaatctgtcccttagcagagctcgagcgctgtgctgggagatccactgctctctccagtggcaggcagaattgtttgagtctactgaaactgcacccacagccgcccctttcccccaggtgctctgtcccagggagatggagttttatctataagcccctgactggggctgctgcctttctttcagagatgccctgcccagagaggaggaatatagagaggcagtctggctacagtggctttgtggcactgccatttgttctgcccagtccaaacttcctggcagctttgtttacactgtgaagggaaaaccacctactcaagcctcattaatgctggacacttctccccacaccaagctcgagcatcccaggtccacttcagactactgtgctggcagcgagtatttcaagccaatggatcttatatgggggtgggatctgctgagcaaggccacttggctccctggcttcagccccgtttccagggggagtgaatggttctgcctcgctggggttccaggggccattgaggtgaaaaaacaaacaagcaaacaaacaaacaaacaaaaactcccacagctagctcagtgtcttcctaaactgccatccagttttgtgcttgaaacccagggcccttgtggtgtagtcatctgagggaatctggtctgtaggctgtgaatactgtgggaaaagcatagcatctgggccggagtgcaccatccctcatggcgtggtccctcacggcttcccttggctaggtgggtgagtttcccaaccccttgtgcttccttcctgggtgaggtgatgccctatcctgcttcaactcgccctccgtgggctgcacccactgtgtaactagtccccgtgagatgaactgggtccctcagttggcaatgcagaaataacatgcctccttccttggttttgctgggagctgcagaccggagctgttccttttcggtcatcttgcccggaaaatctcttatcagaaattttgtaggttgtttgggactttctttgtagacagtcattctttatttctaatcttttattttatctttttgctgtttcttactgatgaagccctttaatacaatatataataaatatacaataagagtagtaagagcagacatcctcaatatgactattattactcttttaaattattgtcactttatttatttatttatttatttatttatttatttattgagacagggtcttgctctgtcagccaggctgtagtgcagtggcatgatcatggctcactgcagccttgacttcctgggctcaagagatcctcccacttcaacctcctgcgtagctgggaccacaggcaagcaccaccatggctggctaattttttattgtttgtagagatagggtctccttatgttgcccaggctggtcttaaactcctggtttcaagtgatccttctgctttagccttcccaaatgctgggattacaggcatgaaccatgacgacgcccagctattgtcactttagtggatgaaaatggtgaattattgttagcatttgaatattcctggttactagtgaagttgaatatatgtattaaccatggtaatgcactgcataatgatgttttggtcaaggatgaactgtatattagacagtagccctgtaagattataatggatctgaaaagttccttttacctagtgacataatgtcttagtgcaacacattatcttttctatgtttagatacacaaatacttaccattatgttataattgcctacaatattcagtatagtaatatgctttccagatttgtagcctaggagcaataggctatgccctacagcctaagtgtacagtaggcaataccatctaggtttgtgtaagtatactctgtgagattcacacaataacaaaattgcctaatgacacatttcttacaatgtacccctgttgttaatgttactgaatatcagtggtttggtctaggtcctgctgctggctgcacagcaagccaatgactgagacaagtattgccaaggaagaaggctttattgggtgctgcagtcgaggagatgggagatcagtctcaaatccatctccctgaccgactaaaattagggctttatatagcagggaagaaatataacaatgtattggaaaacaggaactagagaagtgtaaggaaacaaaatgaggggtctggcatctcattggatgcagtgatctggtgagtttcagttctttgatactttttgagaagcctggggggtcctttcttgaggaaggaactcagataaaacaaacgtaagctttaagaccagagggtcagtttctatgtttatccaaaataactgtctgtgtgaggggtctccaactcccacactgtggaccagtaccagccattggcctgttaggaaccaggctgcacagtaggaggtgagcagaaggcaagccagtattactgcctgagctccacctcctgtcctgtcaacagtggcattagattctcataggagagaatctagcaaaccctattgtgaactgcacatgctaggggtctaggttgcttaatccttatgagaatctaaaaatacatttaatgtgcttgagtcatcctaaaaccatccctccacctccaccccaaccccttcaaccccccttcctgtctgtggaaagattgtcttccacaaaatcagtccctggtgctaaaaaggttggggactgctggtctatggtactattgaggttgttttcattaagcgataaatgactatatttgtattttttgataattacctccatatatcctttgtaaatttttacattggttatttagttgctcttatttgatttgtaagtaatctctaggtaatgaagttattaatcttgtgtatgttgcaactattttctcccagtatgttactcatcttaatttaatatggtgggcttcagggtatagaaattttaaatattgtagagtcacgtgtgtcaggttttttttcttttatgatttctgggtctgtagctcacttaagagggcctttttcactccaaggcaatacaaatattatattttttcttttatatttttgcttttcaacatttagttttttaatccatctggaattgctctttctgcatggtgtgtgaaagatgtagctttataattatataaatggcttaccagttgttccaacactcatttaattaaatctcatacttttttcacttctttgagatgccatatttatcttttaccaaatgttcatatattaatgatcatgtttttggatattgacttttgtccttttgagggacaggattcctcctgtggtggaattctactatggcagtttctgcagaggggctcgttcaacatttaatccagttcctttcaaatgtgagaaggctaaaagctacactgcacaacttctcttgcagttgcagttctgtttgagatttaatatttggaaggagaaaatggaacacagtgttttggaggctgctctttgccatctgctggcaagcacagaggaggatgcatttgagttttctatcacagctgtggcggaggtgcccttgtctggctccaccttgatacggattgtgacaaacgggaggcattatgcagccagtaacttcctgattcttcgaggcgcagctgctctcttggtggcctgattgaggctttgggagatgttcctggaaactcagcctaagttctgttttgttcgctttcccaatggttctggaactgtacttcatatctagaattattcttcttatgctaattagatagattctgttttctgaaaatgagcactgacacaatacatctgtcatcatgtttattttttgccagaaagttctgattaggctgggcacagtggctcatgcctgtaatctcagcactttgggaggccaaggcgagagaattgcttgaagccagaagtctgagagcagcctggccaatataatgagaccttgtctgtataaataaagtgaattaactgggaaagttgatgggcaactgtagtcccagctacttgggaggctgaggcaggaggattgcttgagcccaggagtttgaggctgcagtgagctatgattgtgccactgcactccaacctgggcaacagagcaagacctcatctcttaaaaaaattcttgttattctaaagtttttctaaactgataaatttttaaattatttagttaggttctattttaagaaatattgtttggtatttaagtgccattgcattacatttaagattaaatttgtggaactcatatccttcaagtagaaaaactttttacccaaaatatagtactgagaggtgacagcacgctggcagcccttgctcactctcggcgcctcctctgcctgggctcctgctttggcagcacttgaggagcccttcagcccgccactgcactgtgggagcccctttctgggctggtcaaggccagagtcggctccctcagcttgcagggaggtgtggagggagaggcgcgggcgggaaccggggctgcgggcggtgcttgcgggccagcgcaagttccaggtgagtgtgggttcagcgggcctgcactcagagtggctgactggccccgccggccccagttagtgaggggcttagcacctgggccagcagctgctgtgcttaatttcttgccgggccttagctgcctccccatggggcagggctggggacctgcagcccgccatgcctgagcctcccctccctgcgtgggctcctgcacagcctgagcctctctgacgagtgccgccccctgctccacggtgcccagtcccatcgaccacccaagggctgaggagtgtgggcacacggcgcgggactggcaggcagctccacctgtggccccgttgcgggatcactgggtaaagccagctgggctcctgactcgggtggggacttggaggagaacctttatgtttagctaagggattgtaaatacaccaatcagcaccctgtgtctagctcagggtttatgaatgcaccaatcgacactctgtatccagctactctggtggggacttggagaacctttatgtctagctaagggattgtaaatacaccaatcggcactctgtatctagctcagggtttgtaaacacaccaatcagcaccctgtgcctagctcagggtttgtgaatgcatcaatcgacactctgtatctagctactctggtggggacttggagaacctttgtgtccacactctgtatctagctaatctattggggacgtggagaacttttgtgtctagctcagggattgtaagcacaccaatcagcaccctgtcaaaacagaccactgggctctctgtaaaatggaccaatcggcaggatgtgggtggggccagataagataataaaagcaggctgctggagccagcagtgacaacccgcttgggtccccctccacactgtggaagctttgttctttcgctctttgcaataaatcttgctgctgctcactctttgggtccacactgcctttatgagctgtaacactcaccacaaaggtctgcagcttcactcctgaagccagcgagaccacgaacccaccgggaggaaagaacaactccagacacaccgccttaagagctgttaacactcaccgcgaaggtccacaggttcactcctgagccagtgagaccacaaaccccaccagaaggaagaaactccgaacacatccaaacatcagaaggaacaaactccggacacgccacctttaagaactgtaacactcactgtgagggtctgcggcttcattcttgaagtcagtgagaccaagaaccaccaattccggacacagtatgcctacttattaatgtctctacaacttcttcaacttcaaagtattataactttcttcatttgtgtcttgcacattttatgttgagtttattattaggtattttaaagctttggttattattgtgaacagcaatttttccttatatttttctaagtgatttttattaatatcttaattgaagttaaattggtataataaagagaccccaagtagaatgaaggatcaagtaaggtagaagtttattgctttttcacaaaacattctagctggcctaggaccaggttccatgaagctatttgtggacccaggttcctcccgtctttttgctctatcattttctagggtgttattctcattcacatggctaaatctgagttgctgctttgtgcattttaactccagtttagggattgaaatgcaccctaaaatgtccaagcccagttaaaaagtccagggccagacatgtctttttgattaaatgatatagaagtagcctgtataatttcctcttggaatccaatagtgagaaattaggcacatggccatagctagccataagagactttgggaattgtagtctgtagctgggttgctctcagcagttaaaattctattcatgggagaaatgaatggcgagaaataatttgagtggcaaccctcctagaaataatccctaagactaagacttgggtggggaagaggaacttatttgggaggagattccaggaggcaatgcgaagcaataggaaagaaacagagggtaggaaaccaatatgagtacatctgtgagtgggatactgcttagacagctggggctcacctcccttgggaacactctgataaactgtgtagaacacctctcagaattgatatacaaaggagaagaaaagctcaggtatttatccatgaactcccattccttactggttaaatgtggctcctggggcatcaacttctgtggcctgactggtccgtggcagagagcatcctaaggcagacaggcacaggaagccattggcattgtccagagcagtcaacagaggtcctcccgagagggccaagaggatgaggatagtgcaatagcagcatttgcgacagtcaatgggggcagcacacctttcctgtaaagggccagatagtattttaggctttgtaggccatatcgtttctgtcacaactactcaaatttgcaactgtagagtgaaagctgccatagacaatatgtaatataaataaacatggctgtgttctgattacactttatttctggacactaatatgttgatttcatatacttttcacaggtcacaaaatattattttgttttttatttttgtgcatacatagtacatgtatatatttatagggtacataagatacaagcatataatgtgtaataatcacatcacattagggtaaacaaaatatccatcacctcaagtattaatcctttctttgtgttacaaacaacctatttatactcttctagttatttaaaaatgtacaataaattgttgttgactgtagtcaccctgttgtgctatcaaatactaggtcttacttattctatctaactatatttctgtacccattaaccatccccagtctgcccccacccccaggctcactacccttaccagcctctggtaaccgtcattctatgctctatctccatgagttcaactgtaatttttagcttccacaaataagtgagaacatgtgaagcttgtctttctgtgcctggcttatttcgcttaacataatgacctctagttccatccatgttattgcaaatgacaggatctcattcttttttatggctgaatagtactccattgtgtatgtgtactacattttctttatctattcatctattgatagacacttaagttgcttccaaatattggctattgtgaatagtgctgcgataaacatgggagtgcagatatctccttgatatattgctttttaaaaatattttttccttttgagtatatacctagcagtgggattgctggatcacatggtagctctatttttagttatttgaggaaccttcaaactgttctccatagtggttgtacttacttatattcccaccaacaatgtatgagagtttccttttctccacattctcaccagcatttgttattgcctgtcttttcgataaaagccattctatgagatgatatctcattgcagttttgatttgcattttctgatgatcaatgatgttgagcaccctttcatatacttgcttgtcatttttatgtcttcttttgagaaatgtctattcagatcttttgcccattttttaaatgggattattagattttttcctatagagttgtttgagctcctcatatagtctggttattaatcccttctcagatgggtagtttgcaaatattttctcctattctgtaggttgtctcttcactttgttgattgtttcctttgctgtgcagagaagctttttaacttgatatgatcccatttgtctatttttgcattggttgcctgtacctgtgaggtattgctcaagaagtctttgctcactccagtgtcctggagagttccccccagtgttttcttttagtagtttcatagtttgagatcttagatttaagtctctaatccattttgattatatggcaagagataggggtctagtttcattgttctgcatatgcatatccagttttcccagcaccatttcttgaaaagattgtactttccctaatacatgttcttggagcctttgtcaaaaatgagttcactgtagatgtatgaattcatttctgggctctctattctgtttcactgacctatgtgtctgtttttatgccagtactatgccgttttggtcactgtagctctgtagtatgacttgaagtcaggtaatatgattccttcagttttgttctttttgcttaggattgttttagctattctgggtcttttgtggttccacataaattttaggattgttttttctgtttctgtgaagaatgtctttggtattttgatagagattgcattggtattttgattgtagattgctttggggagtatggacattttaacaatattggttcttccaatttatgaacatggaatatctttccattttttttgtgtcctcttcaatttcttgcatctatgttttatagtttgtgttgtagagttctttcacttctttggttaattcctaggtgtttaattttatttgcagctattgtaaatgggatgactttcttgatttctttttcagattgtttgctgtcggcatataaaaaatgctactgatttttatatgctgattttgtatcctgcaactttactaaatttatcacttctaatagtttttttgtagagtctttatattcttccaaatattaagtcatatcatttatgaacaaggataatttgactttttaatgtgttgctgaattcagtttgctagtatttggttgaggacttttgcataaatgttcatcagggatattggcctgtagtctttatttttatttttattttttaatgtttctttgtctggttttggtatcagggtcatactggcctcatagaataagtttgaaagtatgttctcctctgtttttcagaatagtttgagtaggattgatattagttctttaaatgtttggtaaaattcagcagtgaggccattaggtcctgggctcttctttgctgggagactttttattatggttcgatctcattatttgttattgatctgttcaggttttggatttcttcattgtttaatcttggtaggttgtatgtgtctaggaatttatccatttcttctaggttttccaatttattgatgtacagttgctcaaagtagcctctaatgatcctttgcatttctgtggtatcagttacaacatctccttttatgtctctgattttatgtattttggtcttctctcttttttttcttaattagtctggccaagggtgtgttgattttatcttttaaaaaaactaattgtttggggttggtcttttgtattgttttctttattttaatttcatttatttctgcactgatctttattatttcttttcttctattaattttgggtttggattgctcttccttttctagtactttaagatgcattgtgaggttgtttatttgaagttcttctactttttaaatattggcacttagtatctataacctttcctcttagttgtgcttttggtgtatcccatacattttggtgtcttttgtttccattattatttgtttcaagaaattttaaaatttccttcttgatttcttcattaacctactaatcattcaagagcatattgtttaattttcatttgttaatttccaaaattcctgttgttactgacttctagtttcattccgttgtggtcagagaagatacctgatataattttaatgatttttggattttttaaaggcttgttttgtgggctaacatatagcgtctatcctcgagaatgatccatgtgctgaggagaaaaatgtgtgttctgcagccattaaatgaaatgttctgtaaatatcgatcaggtctatttggtctatagtgcagattaagtctgatgtttctttgctgattttctgtctgggagatctgtccaatgctgaaagtgggatgctgcagtcttattgtattgtattgtattagggtctctctctctttaataatacttgctttgtgtatcttgctgctccggtgttgggtggagtgccatatactgacactcaagtcacaagacaaagtccttcgtacccttccctcccctttccagaagcagaggagtctctctatggctaccgccaaacaaggtgcacagctagttctacctgactattggttatgtccatttgattccccaaggctcttcagtcagcttgtggtgaatgctgccaggcctggggctctgttttctggccattaaactctcttctggccttggaccagaagaggtcctggaatcatggaccctaggagccctcttggtgctgtacccctctgtggctgagcttgtgcctaagctgtgagagaaagtcctcctgactcttctctctccttttatcaaggggaatgactccctctcatacatacaatatgtatgtattttatccatgtacaatacaacatacatatacaattatatgtatgttaaaattctagaagtaaaccttctgggtttatatcgtacactttaattttgaaaatatggccaaattcttctaaataaatattgtgcattttatgctactatcagcaatgtgttgatatatatatacaaaattatatatatatatatatatataagaaaagtcactgtagcattatttatgatagttaaagaattgtaaaccagccaaatacccatcatatttaaatattaataatttattatgtcagccatattgtggaatattatgtagctataaaaagagtaaaacagatccatgataataataaaaataacaagtggaatgtttgttaaaggacaaataaaaatggcatctgtttgtatctttcgggaggggaatttattggctggaggatagagtgggagaaagacgtaattattataatgtatacttttgtttcatcttttctaccaatgcatacattatctattttactactgttaataaaatctaagtccgtaaaacatctgtgagtgttgaaaattttaatgcagattttgtaaagagatttactagactagtctttgcatatttcttggtaagatttaagaagaatcctccaaagagactttggttctcctcccaaagttctttttcactgtcagttcccaaagcgttctttcacagacctttccccactggcctgtcttgccttctgaatctcttaatctcctctcctcttctcacatggtatttgattaaaatatttcaatattaaaatacttccagataaacccatagagagagtttttttggaaaaaataaaccatacaggtgtgctctgttttgagtaactggtgtttctcagcaaaggacttaaaactcaaagcagtagttggaaagcgttgcacatctcaaatttgcatgggaagacagagggctgagtcaccttgccttatgattaaagggagccgagtgattagctttctcaggacatttctatgccagttattaaaatattgtctttaagatccaaaactatcactttcaggtacaccaatcaaacgtagatttggtcttttcacatagtcccatatttcagaatgggagaaaatttttgcaatctatccatctgacaaagggctaatatccagaatctacaaggaacttaaacaaatttacaagaaaaaaacaaccccatcaaaaaatgggcaagggatatgaacagacatttctcaaaagaagacatttatgcagccaacaaacatgaaaaaatgctcatcatcactggtcattagagaaatgcaaatcaaaaccacaatgagataccatctcatgccagttagaatgatgatcatgaaaaagtcaggaaacaacagatgctggagaggttgtggaaaaataggaacgcttttacactgttggtgggagtgtaaattagtttaaccattgtagaagacagtgtggctattcctcaaggatctagaactggaaataccatttgacccagcaattccattactgggcttatacccaaaggattataaatcattctatgataaagacacatgtacatgtatgtttactgtggcactattcacaatagcaaagacttggaaacaacacaaatgtccatgaatgacagactggataaagaaaatgtggcacatatacaccatggaatactatgcagccataagaaaggatgagttcatgtactttgcaaggatgaagctggaaaccatcattctcagcaaactatcacaagatcagaaaaccaaacacggcatgttctcactcataagtgggagttgaacaatgagaacacatgggcacagggaggggaacatcagacacaggggcctgttagcgggtggggggctaggggagggataacattaggagaaatacctaatgtaggtgatgggttgatgggtgcagcaaaccaccagggcatgtgtatacttatgtaacaaaactgcatgttctgcacttgtaacccagaacttaaagtgtatatatatatgtataaatacatatatatacacacatatagagtgtatatatgtatgtgtatatatatgtgtatatatatgtatgtgtatgtgtatgtatatatgtatgtgtatatatatgtatgtgtatatatgtatgtatatatgtatgtgtatatatatgtatgtgtatatatgtatgtatatatgtatgtgtatatatgtgtgtgtgtgtatatatatatatatatgatcccaaaccatgcttgtttgctctatgacactggggctgggactgctaaccccatttctgctttgctagctggctttctgctagactctgtcattaggggatgcctggtagttggagaagggagaaagacttgctttcttgctttctgattctgagaacatcatcctagcaacacatctttaccctggcaaggagagtttattcccttagtagcagttgagttcagtttgcagtttttctaatacaagcaaacccagttttattttatgctctcagagacaccagtaccagctggctgatatccctaacttgagatctgggtgctgtgagtctcatctctgaactcaggggcactagcagcagccagcagtacttactcctcagaggcataaggctcagctccaagaagcccctcctctaatcgtctacatattaataattccaacctcttcccttcatacccttaaggcctccaggtggcagcttcttactgcgtttgcttcctttaagagtgcttgctttctctaaaacaatttttcagtatcgagttaacaatttttttttttttttttttgagacggagtctcgctctgtcgcccaggatggagtgcagtggcctgatctcggctcactgcaagctccaccttcctgggttcatgccattctcctgcctcagcctcctgagtagctgggactacaggcaccaggcaccacgcccagctaattttttgtatttttagtagagacgaggttcaccatgatggccttgatttcctgacctcatgatccacccgcctcggcctcccaaaatgctgggattacaggcgtgagccaacgcgcccggccgagttaacaattatttacattaaattctctctgctgaaataactagtgaaactagtccctcactggtacagcagtagtggtgtgtccaggatctgaaagtagaaaggatgaaatgtaggttctcactgtgttctgcaaatagtgtgaagaatcctatgtgaaacgtcctctccataaactgtgtatagttgacatagaaaggaacaaattccttaaagaagatagtgctgctgtttttgtaatgtctcactccattttagagataccacaattttctagttttcccaccatggcaggggtccctctctttcagtctgtgttgcagactcctctccactctccacaacctatagtggtggagtacttagcactaaaccactttctcttttctatgtattctgtttccttaggtgtttttatcctgttctgtggctttacgtaccatatgcataccagtatcacccaaatctgtatctttaaactctctagaattccggtaatagatatccatctacctacttagcatttccacttgcatgtgcagctaaacttttgcatgtccagaatatttctcttgacttccatcctctcaaaccctttgcccaccatcttttccttccaagtataattaccctgttgctcaagctaaaaactcatgtgtcattcttgattcctcttgttcatccacatcacacagccaattcatcagaaagttctgtctgtgatgtctctgaaacacatctgatatccagccccctctctccatcttacttgccgtcacctgagtccaaggcaccatgacctctattctggacagccacagtaaccttctgttggcatccctgctccattaatgtctcctaatagtctttcccatatagtagtctgagagctaatagcctactcatgccttctcttccttaaaacccttccacagcttctcaccactcacagaatcagatccaaacttttttctgtagcctaaaaagtcctcatgatctggactttgcccaacactttgtcttctcagatcattctctagtcgtttcttgtttcttaaatatgtcaactttattcttgcttttattctttgcatttgctcttcctgttcctgagatgttttttctccatcttttcccagggagaaaaatatctcatattttaggtttcaagtcaaatgtcattccctcagagtggccttccttaactactaagttacaatccttccccatcccaagggtttccagcatcctgctatttccttcataggaacttctatcctctgatattatgttgtttacttaagtatgttataattgtttccttatatatattcttatttttatgttgcctgtcttccctttaccagaaagaaggcagaatattgtctgccttgttcactattctatctccagcacctagaacaatgtctggcatataaaatgcacctaataaatatttaatgagttaataaatttagaccagaaaattggtagatttcaaatatcaaaaaagaccctcctaccacaaatccagacactatctttggggatttgcactaatcttacaaaagtagttattaattatcctacttttggatgagaaaatggagtctcaaaagacttaagtatctcaagtaacttacacaactttaccaatcttataaacaacagaattggggtttaaattctgtttctgactcctaaacctgggctctattccctctgccctataacaactatgatattttaaaggtgaagaagagtcattgacaaggtatatctattctgatgttacacaatgtataaactaagggtgtataattatgagggctaaacatttcttagaaatagtggtactataattttcatatagcaagtgaaaactaatagaaattggtgatgaaggatgctttattcactctgtgagaatgatcagcagcatgcattctggggagtcaggagacgtaggttctatttctggctccgaggctaattagctccatgactttgggtatgcccatgacctcaccgtatttcatttctcttgtctgtaaggtgagggagacagttttctgggacttctaacacacacacacacacacacacacacacacacacacaccacgcagaatgtagtattgtaatttggcaattctgtatatgatataaaaatgaaccaccttagcttatcccattcagacaatgggaatcgtctaaatataagtcaaataataaagaaatgaaggcatagactcactattcttccattaaaatgttagtattgccacacgaaagcctatttttataatttatgatgtgtgttctaaaaagaaatttgaaaaaaaaattaagtaatgtaacagtctttttttaaagcttgagctagctagcttgagggtgaaatgattccttaaggtctgttgtttaggaatgatttattattaacattgaaaaacagaggattctgttttcttttctgttacttgcataatggaaggagggcctattgggagattaacccaattaggtgaatgaagtaagacatcctgtttatttttccttgaattatttctaaaaggaagcacttgattaaatactctccattttgtggctttgtaattcagctattatttgggggagatattagaaagtttgagaaaaatgactcaatcagttaattaaaaggaatagtcacactaaaaattaaactctatgaaatctttgtgcattagttaagcttctgggggacccttgacattctcatggatttagggatccccaaaacctgtgactgctgtagaacacagatagtaaagatgctgcttctcttcccccaaggatgctacttctcccttccaccttcaagggagatagtggaagagagaagggcagaatttcagtagaaagggccctgggctgggacttggcagtcctgaattcctgttctacctttgccagggatctgctgttactttgggcaaatgaccacctttctctgggccttatctgtaaaaggaaaacgaaagcaaaatacccctgagactctggctgagtctactagtctatgattttagagacaaattttgaggacttgtgtggtccatagagactggataaaggtgagggtgtttgaaggagctgcctcaatagagggccatgatgagtgaggaatatttgaaactgaaaagatggagagcccaccactgtggagtcttctgatggctgtgcaaggtccccactcacacacaggcccacgctgcagggctacctttggttggctttgtgctccagatatataaggctgtctgcggtgattctaactgagacctgtctaggcttttccagggaagtcaagagagggttttaatctgacacaggctattggccaattggctttgcagatcttgttctgggagtagcagaacaagaaccagatctcccaggggcagagatactaatttttgaagcagttatatttaataacgtaagacctcctgggacagaatctgatacaagatgttatttattcctcttttacaatccaaagtatcacattgttctaggtcaaaacttgtctttattttcctcctgattttaatgcagatgatatctaatatttagtagtctttaagaatcctgcctatcaaggagagaaagagaaaaaaggactatacatagaacaccttagctcacacattttcaaattacatttttatgggggtgttgatgcagtgaaactaagtattcagataattataccatccattttagatttttaatacaattgttatagtatagttagttctgttgaagagtcctggaccttggggcctttcagagactttctaatccatggtatgctggcaagctggctctctaaaaacaaaagtccacatttatagcatctgctgatctctgtggtgtaaatactttcaccatagcaaatatcaaagtatcaatgtgacattactgaatgtggaattgggggaggagatgcacagaagtggctcttgtggtctggtaggagctggtttcagcacacccctaatcattgtcaatcaacagatacacagttgctgaggatgcgaggatgatgtaggcttattaatggaggatacctgaaaaccccacaggatttagggagtgggcagcttctaggaaaaggactgcaggaaaatacagaatcggaatgcaatcaaaatgaaagctgcaagactgagcaaacctgagtttctgggcctagacctgctaaataccatctcagctagtagacagatgaatggaatcaaccttctgagaaacagatgtcagtatgcatcatatttgacacaggatgaaggtggtgtcccaatcggtggaaaagaggcatatatattaatcccatattatacatatttataatatatgttgaatatacttaaatgtatatttatttatacctttcatattcacataccattatgtgacaattataataattaatatggcttgtaagtttctgttttctctgagaatagaaaatgtaatctggttactactaggtaattcagtcacttttcatataaactcaatctcttagggattttattccctctacttttccttcacactgggaccataaacttctctcaggcatgggcatggcctcgggggatagaggcccggatctaagctcatcctctgtcctgttggcttcattatgatggagtttgcactgccagtctgggtgattgatttatctgtccacagcatctgctccatgtgtccctggctgaggaagctatgctctgtcctcccagaaacagtgactcttccatgaggggtgctgtccctcttttgactcgggccagcctcactgcagccggcacccggcctggctgtccatcgcacagcccctgctgcaggccgcccttgccgtaacagcagcgagccctcagcaggcacgctggcctttgattctcagatcttttcagcacatccctcagaagccaatggaaggtaaccaaatctctttttcaccccatcaggagcatttgtgggggatgctatgcttaaactgacagtactgccatttctactctactgtggctgccccaagtggctctgggcactgcaaacctgaatccttggagagtttgctgtttgcagacttaagtaagcttctatctcgccactcatttttttttgaggtggagtttcactctccttgcccaggctggagtaaaatggcgtgatcttggctcactgcaacttccgcctcccgggttcaagtgattctcctgcctcagcctcccgagtagctgggattacaggcatgtgccaccacatctggctaattttgtatttttagtagagatggggtttcaccatgttggccgggctggtcccaaactcctgacctcaggtgatctgcccacctcggcctcccaaagtgctaggattacagaggcaagccaccatgcccggccatatcttgatactcttgtgattgtcttcgagctcctcccagttcagaaaaacttcctatttccatccttatgagatctctctggtgcttctctgctttctggttcatgatttaaaatcctgtgccccaagtctttcaggcttttgctctttgaacccaaagcttttacctcttgaaatattcagctcttaaaaaatctaaaggactttgccttcaagattgctgcttccactctgaatttatagagcttacttttgtattcaaagacaagaatttggatattttttatcattttgtttgtatttatctgttttgaaatcctttcttgcttggtgcagtaagccaacatgaattttaggtgtcaaaaaaaaaaaaaaactgtgcaaagcataaagatcacagaggtgatttaaaatgtttgatcccaggataagaaacggttttctaacttaaaagcaatagaaaaaaatcacaggaaaaatagcaatagttttgattacatcaaaactaaactttttagtgttaagaaagcacataatattgaactaaaaaaataataggctgggaagtccattacccaaatatgagagacaaatgattaatatacttaatatataaagattcataaaaatcagttataaacacaaatgccccataaaataaatatgcagagcacataaacataagaagagatactaatgactaataaaatcttaaatatgcaaattaggagaataaatatgttaaaaatatttaggtacattctcatattgctaaaatgtgtgcaaattgatataattctttctggaaggcaaattgaagccaggatctttgaaaaaattcaggccaggtacagtggctcacgtttgcaatcctagtattttgggaggccaaaatacttggcttgagccaaggagtttgagaccagcttgggcaacataatgagaccccatctctacgaaaaatagaaaaaattagctgggcatcgtggtgcttgcctgtaggtgcagttactcaggaagctgaggcaggaggatcgcttgatcctccccagggaagtcaaggctgtagtgagctgtgatttcaccactgcacaactccagcttgggtgacagagtgagaccctgtctcaaaaaaaaaaaaaattcaaactctttaattttggaattctacttctaggaatttggaagttaaaaaaaaagatggatataaggtaaaaataaaaagttggtgagataatagttcataaatatggaacattcatttgcagaatattatataactgttaacatatttctagagtttaaatgactacttttcggtagagaaaagaagaatgaatggtcatatattgcttttgtaattagaaaaaaagtattattaagctaaggacagacaactgtaccttttgggtaaactttgaagaagtttctataaaatgctattttctttcaatattctagtgattagactatttagctctctgtcaataagataacctctataatctataagcataaaataatacaagctgtgaacaatggtacttaaaattacatgggtgagaagatttcaaaaaatgttaaaaatgaacaccttttaaaatataaatctttgacatctgaaagaacggtctcaaatcttcagcaagctatcgagtgaccccatctatctgtcaaattgagcagcatttgtgttttgctttaccctttacaagacatgtgtgcgctcatggtatcatttctttgttaatcctcacaacactctggggcaggaataactgttatcattcttcaatgtaccagtagaaagctggctcaggggtcaagtaacttgtcaaaggaccaaaacacctcttaggtgtagaaacatgattcaaatcttagcctcctcgtagggaatccccagctcactccactgcaccatgtagcttctctacagctttccagtaacccagtagagtcctggcaacaaaacagaagtgttaaaaagaaacatttttacaagatttttcagatttgaagctccgttttaacttttgagaatgtgatgccatctggaagtggtatcccattttaaagctgagacagtgattcatgatttcctgacccatatatactgtttactagttttatttttccttcttccaagacattttctacagacaggagacagatggctgaaacactgtaacatccaaggctgcttcattgcacgactccaggagctcctttcacatcataaactgtgtgaagggcactgtctggaattgtgcagtgcctagcctgtgcagctgtacatggccctctgccttttgttgaggtactcagctcaggtagtgttagttctgaagatggtggccagcataggaatctgaatcatcacatcctgaatttcactccatctactatagccatagcaccctctctaaggcctaggtgatatatatagcacagaagatactctaagaaaacaaatatttgattattagccaagctacaactctcttcccctaactcagtggttttcaaccctgggcacactggcaatgtctagagacactttgggttgtcacaactgaggatcttgtaggtagaatccagggttgctactaaacattccaaagggcataggatagccccctcacaacaaagaattaactggatcaaactgtccttattaatgcagagccctaaatggacaccctttctgatgagttgggctgatccatgtgtgaaatcttgaggattttcttggttctttcagtcaggtctggaataggaacagcttaggggctcttttcccttaagtccacactcgatagtttcctcttgaaaattttccattccctttgtgagaaaaagaagtagaggtccttcctgcagagagcttatctaaatcattcacccaatgccttttttccctgtaaggtttgatgtagcaaactccttagggcagaaaaagcacatggctggagtagaagtgatggccttgagcatgccctgagagttctctctactttcatccctgaggcacttccgcagggggagaagaaggcatgcactcctgtaaggagatggagaacctgacctgaagcaggtccttgacatatctgttgctcctctagttttatctaaaaaatatatgtgaatttttattctagtctgtaatatatccatgttaacttttataaaattgttttaaattatcagatactttccacattttgtttctctaagcctttgaataaaatgaaaactccatgaacatgcatgtatttaccctgttgctttgcttgtataaccatctagagtttttctccatggcccttcttctgggggcttggcaaaaggtccttggaccttgaactcctaaaggatcctagttgtaagaatctgaggactcctagaccaagccaaagtggtgatcacaggcatagaggtgtcgagcacagatgaaggtctggcctgtgtatgtgtcttaaggaggatcaatttcagcatctctgctctgcatacaggagccatgaactagattgtgtatcatatgaaagagaggagcctgagagagccacttccaacaaggtctagccaacagacactcaggatgggactgagaagttttgacttcaatgattcctctggtcctgagaagtgggaggcaaactaaagtagaagctactagacaggggcaagggatgcagcttgtggaaagacatacagtttgtggcaagcattacagcactgggtaaagctacaggactgtgttccttttgaggtgttttcaagtacagctgctctattaggaatccatgatataaggagaatattataagcctcgtagtgacattccagggtctagactgagatagatatggatttgaattctgattctgccacttactggctctgcaacttcaagttattttgtgtcccacagactcagtttctcatctatagaatgtgaataatggtaatacgacatttctatttatttatttatttttatttatttattttttttgagacagagtcttgctctgttgaccaggctggagtgcaatggcgtgatcttgcctcactgtggcctctacctccctggttcaagtgattctcctgcctcagcctcccaaatagctgggattacaggcacccgccatcatgcctaatttttgtctttttgtagagactagagatgtatttttgtagagactagagatggggtttcatcatgttggccaggctgctcttgaactcctgacctcaggtgatctgcccacctcagcctcccaaagtgctgggattacaggcgtgaatcattgcgcctggctatatttcttaaggtgtttctccctatcactggtgggtaatgcttctcagatcttcttctcagctcttctctctgatatctcatttggaaactgatactttgatgacatatgttgggtgggcgcagttctgtcttttaaaaaatatctttattcaatccagatgatgaatttatctgcttggatcacgtaaaggggactgggtggtattcataatcaaagcttgaacatctctgtgggtctgcagccttctctcttcctggaaaggttagagaagaaacgaattcaaatttctaaatttaaatctgcctgtcctcattatagtgctgagtggtgagtgggtcatttcctcacagggtatcaatgtcaaatggctttttgaaagaacattgagagatttcttcttgagtagtctagtgtaaaatagactgatagtctatttttttataagtggacagactcttctatttgaacacctctcattcttttaaatatttggagtacaaactagacttacgtactttaatcaataacatgtcctttgaggttagtgattatacagaatgaagtttcattgtaccaatttttggattggagatcatgaagtcaatgagaagacacatcagcattccactcagtgctttctcactaaaatccagtttggaattcaccaaaaaagcttttctgaaataattataaatgactataaatacattaaggtgatgaaacaagctatctctttggaaaagagcaaagaataaattagtaaagaactatcttaaaatatcaacaaagagaattaaagtattatgcttctcattttcctttgcttttttttctccagtttttgtgattgtttaatgccttttcagctttagatacttcagattaaagaaattactgtctgtattatttcttctgattccttgacatatttctctgggtttcattccaggaatccttcattgtgaaaaggaaaatttgacactatcaaaacagaatatcaacaacattcatttaatttatttatctcaaattactaaacatttatgtggattcagagttgctttgttaaatttggtctctgaaatgtaatactggtctagggaatcagaagtttacaagaattgtgtaaacttcacatgtattaacacacttttgtcctctaaaaaggatccacatcaagttcccaagaatcaacagcagtggcccccaacctttttggcaccagggactggtttcttggaagataatttttccacagaccagggtggtggggatggtttcgggataattcaagcatattacatttattgtgcactttatttctgttattattacattgtaatatataatgaaataattatataactcaccataataaagaataaatgagaactctgagcttgttttcctgcaactagacagccatcaggggctgatgggagacagtgacagatcatcagacgttaggttctcataaggagcattcaacctagatcccttgcatgcgcaattcacaaaagggattgtgctcctatgcgaatgctgccactgctgatctgacaggaagcagagctgaggtggtaatgtgagcaatggggggcaactgtaaatacagatgaagcttcactggcttgcctgccgctcacctcctgctgtgtgacctcgttccttacaggccaggtactggttccagggggttggggacccctggtcaacggtagctgttgcctggctgctagagcaaaagtccggagtccagctcactcatgctttccttctgcatttgcaattttttttttctcctctttctctagcctatttaagccatcaccttctgcccaatgtcttagccttcaaaccttatagtagtaaacattgccttctgctttcctgtctttctaccaacccaattagtcaccaagcccagtgttaccatcaaatatctgtctaaataacaactatattagagaccattcctgtgaacaaaaagtttcaaagttccatattgcttacacaataatgacccaacttgtttgcctgacattgtgagatctccctttattcaccctagcctacctttggctttatgtctaatttactttatgctcccaggaaactaagattatagaggtttcctgattatatccactgctaactcgtgccaatttctaccgtttaatttaaattactttaaatttaaaaaactatacagcaacacatgatgattttagaaaacatggaaaatgtagatgagcaaaatgaaaaaaataaatcaaattccagagataatcattgccaacattttgctgtactctctttcagacttttatctatgcatactttatacatatgtagatttataaaaatagaattttactacatatactataatctgatgttcaatgactatatcattgaacataattccatccttatactttcctatcttgtctatcaaagtattgatgtgtaaagatatgatctcctattttggtcacttgtttttaatttactttttttataatttaaaataatgcttctataaactttcttgtagctaatcttttgcacacattcttaattaatatttttggataattcctactagtgagattgtttctctaatatctttaatgttttcttatcactcctattttcaaatcttaataatttctatttttcttctttgggccccttgtgacttcattccatttttatgaaagtttgaaaattaagctcagacctagtaatctaagaaaggattggaccagagttaaggacaagataggaatgactttccacctcttagagctcataatccttattaattttaaccagaattacacgagctaacaacaaaacttactttttagatggtttatattgagttggccctgcatctcctcatttctttttttttttcttattatattttaagttctggggtacatgtgcagaacgtgcaggtttgttacataggtatacacgtgccatggtggttttctgcacccatcaacccgtcatctacattaggtatttctcctaatgctatttctcccctagccccccaccccatgacaggccccagtgtgtgatgttcccctccctgtgtccatgtgttctcattgttcaactcccacttaggagtgagaacatgcggtgtttggttttctgatcttgtgttagtttgctgagaatgatggtctccagcttcatccatgtcccggcaaagaacatgaactcatccttttttatggctgcatagtattccatggtgtatatgtgccacattttctttatccaatctatcattcatggacatttgggctggttccaagtcctcgctattgtgaacagtgccgcaataaacatacctgtgcctgtatctttatagatttgtaatcctttgggtatataccctttttactgaatcagctcagtcactttccacagagctatggatcaagtttaagttttgttatggtgacataaactttatacatttaggtttgcctgggtagcttccagaggctgttttttcaaagagatatttggtctatcattcaggtaatcttccactgattggctgttaattttattctgtcctatgtaatgaaaaaacatttattaagcctcttcggtgtagatggctttgtgttaggtgatgaataggacggtttctcccgaggagctcatggtttagcaggggagatggacttgtaaatacccagattccttcactgtgacatgtgcagcaacagaatcatgtgcaaggtagaggagctagtaactctttctagaggggtcagggaagttgtcctagaagaggtaacaactgagttgtatttttgtaagataaacagggattccacaggtgattgtgcagcaggaagggtggggaagagagagcgcactattttcaaatgtgatggagcccagaaaaacatggtatatttaggaaaccatatgcagagtggtatgactagaaaatttgctatggggagaggaaaggagtgatgaacctggaggggaggatagtgattaggtcaggaatagccttgggctattgtgcccttagacttgactctggatgtgttaaacccctgacttgatgagatgggtgttttagaaagatatacagcaacggggtgcctggattacaggaggaagatattggaaacaaggagaccagttaggagaccattgtaattactcatgaaagaaattaagaagatggagacaggagagtgataatggcataaaagaagagatgcccagggtgctggaccaggtcaggggccttgggggttgaatggcacagggctgagagaggacttaaaaatacagaatgcttgaatgatccaagagagtttagtggaggaaccaaaactgagaaaactgagagtcagttattctaaaagaggcaccaacaggaaaaatatgagtagggagcaaaagctacatgagatacaacaggctaggccctaggaacagcaaagaatattccagagatatgaaaaaaatcaacagattttctaagtagagcaaacaaataacattaacagaatattcacaaatagaccacaaagtaaaattttcctccaacccgaaaatctggtaaaatcccagcaaaagagaagtcctggagggggaaaaaaaatgctgaattgatttcaagtaattatgaactgaatgtgaaaatctcatttagaataacatgttcaaatttcatgggcagctctaataggcactaaacacttcccctattttactggctttttgttcctggcagggaggaatgtgtatacttgtccatatcctttactggagaaagtaggcaaaaatgtgttatttatagatgctgaaaaccatccttctaagtaataatatttagcagttgttctctgtttgacaggaatcttttacctcctttggtttggactatgttctagttatgcaatgccatggaacaaatcacttcaagacttagtggctaaagacacccatattttacttatgaatctgtaactagccagggcttggggggagcaccctgtctctgagccacctgatatcagctttggcagctgaaggtgggggaatgaaattatttgaatgttccctactcatgtgtttggtggttgatgcaaacaaccgaggtctggaacaattggtgccctatggccatctctgtctatttctatatgatttccccagtagggtggcttcagagtagccagatttttttcacatgttgattggagactcccaagacatgtccttcaagagagagaaaaagctaggagggagctgtgttgcttttctaacctacctcagaagatactaagtgtctcttttgctacattcaagttattagaaatgatttgccaaagccagcccacatcaaggagggagaattagactccatcttctgtgggaagagtatcaaatgatttgttttaaaaccacagcagtctggatgaatagtttgcaggaagtcaaatgatccctctcctccaggagacctatcattgtagccatagtttggttgtatactctttattttagggatttctaccagagacctttttttgattccattctcttatttgattttcacctaatccaatcttcccaagttcaggtctctgtgacttttgatgggcccagagccacatggtatagtagaaagcagtggtgttcagagtcagaaggacctgattagtaacctcctgatctcaagtctgctgttgacttgctgtgatcaccttgtgactcagataagctttccacagcaggtggtattaattcagaccacaaatagtgtagtttttcttttaattaaaataaccataagatttatgtgtggaacagttaacaaactttattgagctcttcttacatgcaaaatgctatgctgggatctatggatgtacaaagactggcctgagggaaagtagaggctggtgtttagcaataagtggagacactttgtagacggaggtcaatagtatgcttagacctgggccaccagggcttttgccccaggctccatgccatccactgtccttcccccaaaccccagcctcagggactcctgtgctctgaagtctcttcgtcaaagttttctaagtgcctttctggtgcttagaacttgccagggctggcagtgccatctgggcagggtgctctgaacccaaatgaggcccagtgtaggccctggccttcctttctcaccttcagggtgctctctgactcttcacactctcacttctcctatttgtgcggttgaccagttgtctcacaggagcttcaggactcacacctatggggttatttccctccatttctcagttctagaagggcatcctggcaagcagatagcttccactggatggcatggtatctctcttataggacgccatgagatcaggccaccagaatgatgctgacatgttgattctgaggtctgataattttaatttctaacaagtttccaggcgatattgatgcttctggtcaggaaaacactttgagaaccgatgatttttttgtgaaactgtgtgtcttgtgaatggttgtattctttgtaatcctttgagatattttgttcttacattactgaaatattggtaaaatgcctagctcaagagcaatgcagatctaaagtttatcatctaaacaccaaatgtacacagtgatattgattcaggcattgagaggtgacagcgtgctggcagtcctcacagccctggctcgctctgggcgcctcctctgcctgggctcccactttggcggcacttgaggagcccttcagcccgccgctgcactgtgggagtccctttctgggctggccaaggccggagctggctccctcagcttgtgaggaggtgtggagggagaggcgtgggtaggaaccggggctgcgcgtggtgcttgcggtccagcgtgggttccgggtgggcgtgggctcggcggactccgcactcggagtggcggtgggccccaccggccccaggcagtgaggggcttagcacctgggccagcagctgctgtgctcaatttctcgcagggccttagctgccttcccgcggggcagggctcgggacctgcagcccgccatgcctgagcctcccccccactccgtgggctcctgtgcagcccgagcctcccggacgagcacagccccctgctccacggtgcccagtcccatcgaccacccaagggctgaggagtgcgggcgcacggcacgggactggcaggcagctccacctgcggccccggtgagggatccactgagtgaagccagctgggctcctgagtctggtggggacgtggagaacctttgtgtctagctcggggattgtaaatacaccaatcggcactctgtatctagccccaggtttgtaaacacaccaatcaacaccctgattcagggttcgtgaatgcaccaaccgacactctgtatctagctactctggtggggacttggagaacctttgtgtggacactctgtatctagctaatccggtggggttgtggagaacgtttgtttctagctcagggattgtaaatgcaccaatcagtgccctgtcagaccactcggctctaccaatcagcagcatgtgggtggggccagataagagaataaacgcaggctgatgagccagcagtggcaacctgctcgggtccccttccacactgtggaagctttgttcttttgctctttgcaatagatcttgctgctgctcactctttgggtccacactgcctttatgagatgtaacactcaccgcgaaggtctgcagcttcactcctgaagccagcgagaccacgaacccaccgggaggaaagaacaactccagacgtgccaccttaagagccataacactcaccgcgaaggtccgcagcttcactcctgagccagcgagaccacgaaccccaccagaaggaagaaactccgaacacatccaaacatcagaaggaacaaactccggacacgccacctttaagaactgtaacactcaccgtgagggtccgcggcttcattcttgaagtcagtaagaccaagaacccaccaattccggacacagcatcatcctctagaatacctttctgtaaatgccctaccggactaatctgtactgttggtcactacatagttaatgcaatggtttctcatccatgtggctcacatgaacaccaagaaggccatttggcttaaggagcagaaaggcaaatctatagctctggtactgcctaattcttactgtggctgaataccacaggagtgggtacgaatatcccttcctttatatattgttccaaaatctttggtgaaaatgaaatttaaaagagtaaaatctaatcccatgtttattgaaggaagtagttcttcagaggagaatataatggatattggggttgggggattgctttgggagtttggattttatagaggggactgattatggccaggattcctaaaggggcagagtctgaagtctcccaaagatgaccaataggccaaatgactcattaatagatttgggagtttctaaggacatttgtagtttccatgattgaagacagcaggagatccttaaaaatcaacatttactgcataaccggtgagtgacaagtccaccccaagatgtgggttttgcagaacgaataggcccccagggactcacattatagtatcccttttcctacatctcccataagccactaagaagcattgatgagcagggagggatctaaaaagggtgtcaaccaggcaccacagaaatcagagaagggagatgtgtgtaggaaaaaatattatagaacatggtaagcgctccgaaacattatcttagttggctcccaatttctatttgggagagaatatgattcctcctttaaaaatggggaaactaaagcgcagagacttgcccaaaattatgcagctagtatcacagagccaggatacaaataatctacacacatatgttgtatatagaaaggtatattaggaacaggtgatctgtgtcaaatcatcactcaatcatctactagctaaagtctagttactgaatttctctgagttcttagttaactcttacacaaaatagggctgtcttatagaaaccaggtttacgatgaagaagagataagaaacaaagttactagtttggtgttggtcacatagtagatgctaaaaagactgacttccttcccttcctgcctcatctcccccaagatggctccatgctggaggcacaaaacagatgtttctctcaaacaaattactttacttttccaagacttaatttcctcacttataaaataaagataatgggggctatctattttatagaattgttgtatcatttattttattttttattttttatttttttgagatagagtctcattctgccatccaggctggagtacagtggcgtgatctgtgcactgcatcctccgcctcctgggtttaagcgattctcctgcctcagcctcccaagtagctgagattacaggtgtgtgccaccacgcctggctaatttttgcatttttagtagagacagggtttcaccatgttagccgagctggtcttgaactcctgacctcaagtgatccacacaccttggcctcccaaagtacggggattacaggcatgagccatggtgcctggcctgttgtggcatttaaatgagatgatgcacattaagtacatagaataatgcatagcacatgcctagtgctcaataaatgttagctatcattaataataacagaaatgaacattcaagaatctagggttcttggagtcagagggacaatgtgcctactctttgattctgtgccttgcaactggcagccctttaaagctgagttggggaaggcccatgcccgggaggaagtctggaggccccagggggaaattgggctgtttggatcaccctgttttatctcctgtgcagggcatacagctcttgccaaggagatggcaggattttctttcaaataaaaccgaattttgcatagtcctcagaagaattttttcttctgttgctgaatagagcttctagagggctttttgcaggagtgaagagaatgaaatagttgacttctctatcccagctcctggtttaataattagacattccgggaataactgctttggcagaagtcagctacattttattttgacagggagagtcttttgttttcccttttcttcctgttccgtcatactcatggaagaaagtattcagaaatttggagtttttgtaacatatttcactgcttagggctataatgtatggtaaaatattccttaaaggtcacagtgagaaatattttatggtggagagattattggaaagaccagcttccagtataacccagacagtatctacttgggatatcttaaaattaaagctatattataacttcttcagatttttattctatctttggaatggggagctaacactgcagagtttaaaaaaggcaggagggtgcagggcgtggtggctcctgcctgtaacctcagcactttgggaggctgagatgggtgaattgcttgagcccaggagtctgacaccagcctgggcaacatggcaaaaccctgcctctacaaaaaaaaaaaaatgcaaaaaattagccgggcgtggtggtgtatgccttgcctgcagccccagctactccagaggctgaggcaggaaagtcctttgagccctggaggtcgagctacagtgagccgtgatcatgccactgtaccccagcctgggtgacagagcaagaccctctttcaaaaacaaacaaacaaacaaatgtgggagggcattgaagcagagagaccaaggcatgcattccaccttagccattaaattgtccctggcaagttattaaaaatctgtgatcctcgccatccccatctggaaaatggcagtagtaagcccaactttgcagggtggtttggagaatgaggggacatttgtaaagctcacaatgtggcacatggtgattgctcaatacatttagataaatattaggtcccttccccagcctcctccagtgctttatagttgagtgcccatgggcaagtctctgagacttactggtctcagtttacccatctgtaaaattaaggggcttagccagctcttcacacactgtaatttgtatcaggcctgaaaagtctctgagtctctgattctttatgttgtcgtcattcaatgacgctgaattgaattagctccaggtgaaaggtggaatgaccacaggtatctgggtggcgtgggcagagtgacttttgactgggcctgaggaactttcaagttagagggactcagggtaggtaacatcctgagtccttctggccaggagaacagcccagggagattcagcccaagccctacatggagttccgaataaccaaccagttccaggaccaagctaggcactggtgacagatccagactattgtattactcagcttccttttggtgagaagcagcagaaaccctacaaaaaccagttggaaccctgtaaaaatcagcataaaagggactttattgtctcattaatcttggcaatcaaagggctagatccatacactactggattgaggacctcaaatgatgttgtcagggcattttatctctacatctttttgttcttcttgtctgtctttttgaatgttggtcttatatttttcctcctgtttctgatagattttctccgcctgagagccaagctggatcttggcagacctaggcttgcagactttggcttacagtgccatagggatacaatacagtgcaatacagtagaatacaatacaatacgataagacacaatacaacaggaatagaggtcttctctctccccttgtccacatgtcagtcctgtggaagggctctgattggattttgttagctatgtgctcattccttgcatgagcatatggtagcatgtaaatggcatgctacagtgctcaaaatccaatgctccagtgtgaccgggagccaggtgggcattgtgatttatagtctgatgatatttgatgatatcttggtgaagctgccattcaccaacacaaaaagatgtgccagacaaaaaccaacacgacctgaagagatgctcatgacaggaggaggctcagcaatagaaataaatccctgttttggcccagtttcctgtccactcagagacgctgtgactctccagagaccgctgagaagcacagcagtgtacccccgggtctcacttccaggaatttgacttttttttctattagtagcttcctcttttcaatatcttattcacaaacattacatgtcattgtccatcactgatgtttatccagtgtcaaattcctcacctccactgtgctttcatttctcctgcctgcaaaactccaagtcagccaaaccgtcccatttctccaggcttacaattggacttctgggcactccaggaggtagtcacaggtctgcactggcaagtgccactataaattcatggcctccaacttcaggcaggctccattcccaggcagctctttcatccactgtggagacagtggccattttagaacatcctccacttgctgattattctgtttctcctgcagatccattctctacctatgtcttttctgtgccctgattgtccaacctctacagactatcatctggctcccttggcctctggcttcctgttgggcttggccaagggaagcaccagcagaagaatgagagggcaagaggagaggaaagttgagctgcttatgttctggcttcctccctgcctcacctcctgtttgccaagaataaaacatgttctatcaagctctgaatgggtagcatatctgtttaaaagatcatatcagccgagcgcagtggctcacgcctgtaatcccagcactttgggaggccgaggcaggcggatcatgaggtcaggagatcgagaccatcctggctaacacggtgaaaccccgtctctactaaaaatacaaaaaattagctgggcgtggtggtgggcacctgtagtcccagctacttgggaggctgaggcgggagaatggcgtgaatctggaaggtggagcttgcagtgagttgagatcaccccactgcactccagcctgggggacaaagcgagactccgtctcaaaaaaacaaaaaaaacttgaaaagttatatttcaggaagaaaatgaattaagaaactgattagtttgtcaaacattgttaatgccaacattccacagttactttttagttataactcacaaaagaaatcaatgggaaaatttaaatatggtacgtcagcacttaatagagtatgctgtggtcagaatggcatcaagacaaaggaaggcatgttccatgtaccattgaggcaggaagcagtgtcttaagaagctcaaggctagaagcaggtcttagggtttgagacaaggagaattcacatatagtcttattctattaatagaagagtctgtgctgcattatggggaaattacttgccctggtttgagttttatttccatccctactcccactctcccttcccccaacccacctgggacgatctgtactaatcctgctaaccactatttgtctggaggaaattttatatagaaaacatatgcatttgacaaaatcaggcacgtttagggtggtatggccgtagacaaagacatatgtattctttaacaggcatgcagctcaagtttgaagagttcctatttttcaagtaatgaaaattgtggaataatagtgaaagagcatggattttggaatcactcagggatagatgcacttagaaaagttactaaaactctgtaggtctcagtttcttctgtaccactcaaaaattatggcttcttcaccctgttcagccactccatacacacaataccccaatatgtgcaaactaaagcctcaaacttcgatgtgcatacgaatcaactgagacaccttattaaaatgcagatcctgaatcagtaggtctggggtgattctgtgttttgttttttttgttttttgtttttggtggagtctcactctgttacccaggctggagtgcagtggcacgatcttggctcctggcaacctccaccttccaggttcaagtgattctcctgcctcagcttcccaaagagctgggattacaggcatgcaccaccatgcctgctgatttttgtatttttagtagagacagggtttcaccatgttgtccgggctggtcttgcactcctgacctcaagcaatccgaccgcctcggccttccaaaatgctgggattacaggtgtgagccaccactcccggccaattctgcatttctaataagctcccaggtgctgcccaggcagctggttcttggagcacacttttgagaagcaaaaactccttgtatggataatctgagtgtgaaaagaaaatgagccagtgttttttttatagcaactgaaagttccacaatgtgccctagccttttccaggacttgttacaggaatggtggaagtgctgtgagcagctctgaggagtctgcagccccgcagatgcttgggtccctctggttgctttattcttagtgtggtcaggtctgctgcccctactggccctgtctcatgccttctcctaatttatgttgtaactaatcacagcaccttagccctcttattgtgccttaaatagttataggggaacctctatgcttccagtctccttaccgttaaccagcctgtgcaaagtgtatcctaaatcaggccactgacattttggaataaagagttccctggtgatatggcctaaacttcacaggtactgggtcatcactgtacaaatcagcttttagaagctggaaaaaaaattgggtcaaatgcttcaatgtgcattacatttaaataaaacgtgtggatgctttgacacattttaaaaacactctaggtgttaaaatggaaataatataacaatgaatgacaagatgtttcatttatcgcttactatgactagatgctttatattcaatatctgtaatcctcacagaaacattgaatctgtacttttgtgccagtggggacacaggaatgcggaaaggatcaattacttgcctggtttacacagctcatatgcagcatagcctgggtccacccgcctctgtctgatgcctgttaaacaccttctgcctctccagattaacagttctctcaggcacccttttcattagacaaccgcttccctgaacgcatgcattgttttagttttgctgtttactttctcattcccaatatttgtggtttttattaataaggttccccttaaggcaatgtgatcatcatgttggaaaatattagtgggaggtttctttgaaatatttagtcaagtttaaaccctacacaaaatgatattcttctatgtcaggaatgggtgacaaatgaagtaatttcttttttctaccaggtagcaaggcagtatcagtgtataaacggtgggaataatgcatccaaaatgtgggtcgttatttgttttttcactgtagggctgaagaaatatttaagtttgtactgagtcacacatagcctcagtgtgttatttttattgggagtgattgaatttttgagactgaatttatttgagtgattgaattatgaatgattgatcagtccctaggattgaaactaaggcaacattacataaacaagaaatggaccaaagtaatcacagcatcaaaactctgacaagggagaaacggatttagatattggacccccataatagtttttgtgaattagaaatgccctttgagtctattaataaagagcatttcaagttttgaaaaaagaactttgagaacattatagcaataaagggcactagttgggccaggcttactgatagtctgacatcccaaatgtttcctgtaagatcacaaaatgtcatcgattctggttgcctgatcattatcacaacttgtctacctttaaaaacaagaaaataatttcttcccattttacacactctctacttttcctttttgggatcatgctcagttctttttctcttccaaaggagaggaggtggtgaagaagcagatgatttctataagaggctgctaaaggctcacagagaatattatttttttcttgatgtttctttaaagcagtgatagcaaggacagcatagcctttagcacatattttgctgatggcttcagtgtgttttctttatttgccaaacacttaaatatttttagagagagttgctccatgctttataaatagcgatgttctaaaacttaccaagatgaactgtgttttctttcaatgatgatgttctaaaagaaatgtgtggcatatttatgcagcaaaaatgctgtaaaaatacaaagcaactccttacacagcgataggtttgtaaaaggcgataaagatgaccaacagtaattcatgtttagcaaattaacaggaaagaagaaatctttttttctttgcctgcaccagacgggtaaggaaaaaatccaaggcattagcggagcaaatagccagtgtgctatctaccaataccattaagtgagagtgaaaggaattgatctctcgaaacatagttaatgcacagagttctttcatggctggaaggattccatactcttcgtgtgggaaaatacccttctctatgcttttgggtggtggtccttgagtcagcagctgggggacctggaaggaatatatggacagtgaaacacagcatcagggtttgagtccctgaaagctgcttaaagtagagcaagtcatacaacctatttgggcttccatttcctcatctaaaaatggagaacgaaatgagaatacatgtaaaaatggttcagatcccaaactagatgggtattagttattgtgatcattattgctgttattctgactgtatgtagcagccctggtttgaacttctttgtgctgagatttggaggtctgtatcctcatgctcctcccgctaggctctgcccattatggtctatatctacaacctgcttgtctgaagatgtgtgtgttttacttacttgggaatagtctgatgttctactaagttcagaggatgcaggggacattggaaacaaatgtggatcatcttagaacgaaaattgaaataattttacattttacacatcatagtggccaggaatacaaaaacatcactcattcctcagtgtctagctcatgaaaccttaattcgcattgattacagaataaaaattctggcaattcaagataaacagtcacctttgaaggtaaactcagtcagttttggattctctcctcacctcccttctccataggggtgatctgtgatctaagccggggcagagcacctggtctgtgtgccatcctcagtcctcaggggcccacatgacagggctgctaatccatgcccccgggatgaaactttctcccctcacatctgtgggcctccagggccccatttgtgcacttcgtatccccttgatctcgaccccagctttcgcagctgctggcttcctcaggcattcctgcatgacttttgatggcagggaccgctgctagagaaacgtttggatgctgtcccacatcatgctggggggatgcgtaggatgattatacctcctggtttgcagaagactttgccagtttttgcctgttgtctctatgtgactattaatagccctcttcctgctcaaaagtgtcccagtttcgcagtacattctacaattgctcagggtacaagactcagggaggctgccctcaggcctacattgccataatcttccacttccctttcacgtagatgcttccttggacacagggtaggtcaggcccagtggcaactcaaaccttatccagtccactctgatcctttcatcctgcctcaagtttcttttttgcctaagggaaaggagagaaggaaagtaatacttacataatcaaatattattctccactccatgcctttacgctctaagctttctccttactattttttttgtggttattctactgttttaatagaaacatatctgttcaaactataagttacttctaatcattcagtctttcagggagcattagaaaaaaacatacatagtaacgaacactgagttcaggcccaggttcacatagtttgttttactttcaggaaatccagaacctctaggaaattattatattatgaagaagttaaattttataagctctttccctcaactttggctaaatgcaaccatttatatagctacatttagaaaactaaatgcagaaaactaaatgatcatgaagcagaaatgtaaaatggtagatttattttaatctttactcaagaatgatgtttaggggtggggtggctcacgcctgtaatcccagcactttgggaggccaaggcaggtggatcacctgaggtcaagagttcgagaccaacctggccaacatggtgaaaccccgtcgtctctaataaaaatacaaaaaattagctgggcatggtggagcacatgcctgcaatcccagctacttgggaggctgaggcaggagaattgcttgaacctgggaggcggaggttgcactgagccacgatggcgccattgcactccagcctgggcaacaagagcaaaactctgtctcaaaacaaaacaaaacaaaaagaataattatatttaaacaaagctcttaaaataacaacgtggttaaaaaacaagatgaatcagtgctgagaagtttcttacttacggagtcattctcaggaagcaatacttaaaatcttaaactgtaaacttttagcttgcaacgttttgatttttcctgtattttgcaaatttctcagtgccactaaatatattatctactatttcttcttaaagaactaatgttcataaaaaggatcatcatcgtcatcctcatctgattcaaaatcaacccctttcaatacttggctctgggacatgtttttgctggatgatgtgctggaccacttttgatgtgtctgtgaagtggtaggaaaaatgtcttcttccatatctgattcatctacctcaatcacctctgaataatttttagtgacattttgggaaggctgctgtcttgtagatttaaaggcttctgtaatagacatatttctagatgctggcaccatggtctttgagttcctgctatgagtagaagtctccagaccagggcctgctcttcctctttgagaccctcctctgatgctgaattctgtcctcttcctcctcttccacctcttcctcagcctctttgttggttgctgctgagatgttaacatcagagtcattagccatctgttctgctaaatctatactcataaggtcatcagcactaaaggcagaagcaggttcctctgattgagatctgagacctctggccctgttaatagcctcatggacgtcatcatcttcactagtatttttttgtctgttttctctgaatcgacatacttcctcattgattttatcttctagggcatcaatatgacgttcttaaagaaaatgctgtgttttttttttttgtttttttgtttttttttgtgtttttttgagacagagtctctctctgtcacccaggctggagtgcagtggtgcgatctcggctcactgcaagctccgcctctcaggttcacgccattctcctgcctcagcctcccgtgtagctggaagtacaggcgcctgccaccatgtccagctaattttttttctattttttagtagagatggcgtttcactgtgttagccaggatggtctcgatctcctgaccttgtgatccacccgcctcggcctcccaaagtgctgggattagagatgtgagcctccgcgcccagacgaaattgctgtgttttttacaactggcatttcattaattcctcaatggcatctttctcctccttgtccacaaattcttgtactgcttcacccatccctctttctgttagcagtgagagtggcacattcttctcttcagtttgaaaatactgttttacaagatcttctacccttaaagttgttccttctgaagaaggttttgcggtaagtttcccaaagttgatctcttcccctgttttttccttttgttctctatgcctgaaaaaatggataatgtcttttggattagctacccgatgtacaaatttctggctaaagcgaagaacgttgaaaggttcaaaacctccactatagtccactcgcagtggtataagagacttctctggctggcaagaattacctagatgttcccatttagcattttcaagcatttcttcaatcttcgccaaacagaagctttgtatggcttggtttactttaggattatctgggttaaaaaatggatgattagccagaacaacatcctctatgaaaaactaccgcactgtgtgaagaggaattttctgcatattcatttttcttcctttaatacacaggaaaccaacatgtttctttacagcttctcctggggaaagagaagtaaccactgagcttccaggttgtgaggtataaaatagttgttgttcatttttgttttttgttttttttagatggagtttcactcctgttgtccaggctatagcacaatggtgcgatcttggctcactgcaaccttcacctcccaggttcaagtgattctcctgcttcagcctcccacgtagctgggattacaggcatgtggcaccatgcccagctaattttgtatttttagtagagacggggttttaccatgttggtcaggctggtctcgaactcctgacctcatgtgatccacccaccttggcctcacaaagttctgggactacaggcatgagccattgcgcctgacctgttgttcatttttggttggagctattttacactcatgtgcatggccccagataacaagatcaatgaagtcatccaaaaattgttctggactgaagttagtacttagccatgtttacttctgtaatcacaaataatcacaaataagttaaaccaagagttctcatcttcttttgatctcaacattgttatttcttattgacaaacattcgagagagcctttcatctggaatggatcctaaatcatagagtgcaatgtttgtgcttcctttttgaagcaaaaccagactaatgtctatcttctccacggacattgaaagtccaaagtgatttacaaatccaacacaacttaaaatgtccagggcacagcgtgcatctgcccccatggggtcgtcatgattaccatgaatactaaacactggaattgaaatgttgagattgccatcttgatagttcacccatggaaacttactaaaaccaaagttgactgattgatcactgagaatttcaaactggacaggcctatcacccatacaacattttcttaataacttgaggcaggtatgtaatgttttccttgagggcttttttcatgaaaaagatcaccacctaacaaaataaaatccacttcattttcctgggcaagttttaaaatttcatcaagcgttacacatgtatcatttcctctgactacatctttctccataaatccaagatcaatatctgttgcaactaagattttaaacaagttttaatcatcaagtgcttctgcaggactcatttttatggtcagtcaagctcctctgggaccaagttcttctccaagaacccctgggtcctgtactcaaatgtcagaaaattcactcgattccaaattctagaaattcccactcctggcctcttcaaagccccacccatcaggacccaaggctgtcttctttccaggaagaaagggtgggatctgtgagaagaaaacagcatggtcggaacttgcctctgagaacccgcagggccataaacctgaattctctccttactatcttaacagaagtttctagaaatcaaaacaaaacctttctatttcaggtttctggttccaccaccggcctttaagatatcttgttgatgttaaggggagaaatccaacatcatgtcgaatgttgcttcaggatgctgaaggtgtgtgtgagaggtggactaagggcaagtgaaagggggcaaggcatacattaaaggaagcaaaataatccaagacagcagtagatgacttgttaccaagccgtgtgactgaggtgaccacattagttcagacagtaaagggatgagaatagcagtgaaggaaattcttcctccatactgtggtggcagaggaggccttatgatagcctggaatttcaatgagaaaactgtaaattgggtaggtagagtttttcatagggggaaaggaaaagaaatataaaaacaaggaggcataaaacaataggtactttaaacgaacaggaaacaaagcagaagtaaaccaaaatagttgaaactcattctttgtgcagaaaaacagttggatatggccgggcatggtggctcatgcttgtaatcacagcactttggtaggctgaggcaggcagatcacctaaggtcaagagttcgagaccagcctggacaatatggtgaaacctcgtctctactaaaaatacaaaaattagctgggcgtggtggcatgcttctgtaattccagctactcaggagagtgaggcaggagaatcgcttgaacccaggaggcggaggttgcagtgagccaagagccgagattgtgccactgcactccagcctggacaacacagtgagaccctgaaataaaaaaagaaataaagaaaagaaggaagggagggaggaaggaaggaagggaaaggaaaggaaggaaggaaggaaaccagttagatataaagttgacaaagtaggttggaggccttcaaaatcagtttggtggatttcaatattattcttgggtacaagggagccactgaaggactttgagcaagggaaagagacatatttagatttagatttccctcaccccattttttaaagggaaatatatgtgtcaggtaggtagattgaatacgattttggtataattagaaacggaaagaacagataaggattttaaagtgagcttttataactatgctcaatgaggtaaagaaaaatatacttgcagtgaatgaaagataagcaatcccatcggaataatggaaactgtagaaaataaccagatgacaattctagaactgattaatatattatctgaaaaatttttaaaagtcactgaatacacttaccagaatggagatgacagagtgagctcgaagacagatcaggtattatctaatctgaagaataaagaaacaagaatgaaaaagatgaacagaactccaggtacagagttgaaaaaagatatttttagataaagaagaatttgttgctcttagatatgtaatgctaagggaagttcttcagattgtggaaaatgataatagatggaaacttgtatcctcaggaagaaataaagagcgtgaaaacatggtgaatccgtgaacaaatacgaaataaccctttgattactccacacctacccagaaaaattcatcctcctgcatcttcccagtcctggcaagtggctcaggccacgatcctttgggtcattctcaactccccttattcttttgtattacttttcttgtaccaatcaaccaggaagtcctatcctttctacttgcaaactatatatacacattgaactccagtgttcaccaacctgttctaagccactctcatctccaccaagatcatcgcagtagccttcaaatcaccctccttcttcccttgactcccaatggcctggtctcagcgccgtagccagaatgattctttgaatacgtaactctgatcatttcactcctctgtcatagccttctaagaagctctccatctcatagctgggggtggatacatcatcatttttatatttatatttaaaaatgtatcattaacctagtattagatcagtagggttactatagtttacaataatgtattgtgtatttcaaaatagctggaagagaagaatttcaatggttctagcataaaggaaagacaaatatttaaggtgatggatgtcccacgtacactgatttgatctttacaaattaaatgaatgtattaaattatcacatgtaccctgaattgatgtacatctattatgcatcaataaaatatacatatatcattttaaaatgacacatcactgtgatttttatatatatttgagaagacattaaaagaactgaatgattttactataataagaaagttccatttttattatttatgtaaacaagattctcacaacatgtacctttaaaaatgaaaaaataaagggaatagaattaatgcttaatcctacctgtctcagtctcccaacaaataacatacctccatgaacacatgacctaattcagaaaatatatcgcagccctatacaagccattaaaagacagatttccaaaaaaattttattttttatgttaagcaaagtttatcaaaatttataaaatctgcatttgatcaattatgtctgattatagttgtcaagataacacgatccctaagatatctgataacaatcttatggtcataaaaaataatttaaatttttatttatattactttcattgcatcaaaattatttgacagggtcatctgtgagacattttcaagtatacaaatattatatattaaaattctgggtgagaaattgactggaaaaaaatagttcagggagaaaaaggaagaatgttaaatttccagctgctaaagaagagcttgttcatgaatttttaaaatggataatgatagatatcaaatagctatgggatttaaatttcattggatacatttaagatagtgatgtaaccactttatttaaaaatactagtatgtacaatatgctagacattgcatcctttgcaactacagtggtgcattccttaacaacagggttactttctgagaaatgcctccttaggcaatttcatacttgtgggaatatcatagaatgcacttacacaaacctagatggtatagcctattccatacctaggctatatggtagagcttattgctactaagctacaaacctttatagcatattgctgtactaaatattgtaggcaattataacacaatggtaagtatttgtgtatctaaatacagaaaaggtaatggttgtactacaacattatgataactatgatgtcactagtttataaaaatttttcagcaccattataatcttatgggaccaccatgatgtatgcagtatgtcatcgactgaaatgtcattatgtggctcatgactacttaatttatgatgaaaaatgttgtttgtatacctaaaagtgttgaagttaatacttagctttccaaatttttaaaagggaagcagaagcagaaagtttgcattctactgatgcaatggtttctaacctggagaataaatattaatacttattgaatgttaataatgctagacattgttctaagtctcacacatatattgttaaatgtttataataaagataaaagtaatgttcttattactattgtgcactataaaaaattccaaaacttaatggtggtaataaagcaaacattatatttagctcacaattttgtgggttaggaatttgggaagggtatgagttggtcattgtaatttgggatgtcttttacagttgcagtcagatgttggctgggaccacagtcatctaaggatactgctcaagctggctgttgtctggaaactcagctggggctactgatcagagcacctgcatgtggctgtccagcaaggcaatgttaaggtaatcaggttccttacagaatgaacatctcaagagtggtgggtgaaagctgcatggtctttctgacttaactgtgaatgttacatagcaccacttccaccacgttttacattgaagtagtgtgaagctcatccagattcaaggggctgagaaacaggccccacctctcaatgacaggagtgtcaaagaattagttttaaaactggcacaagtagataattatctctatttttatagatgaagaaaataaagcatatgggagttaagaaatttgtctaggatcacagcactggtacgtgatggagttaggatttgaacccaagcagtctgactccagagcagagctcttaaacacaacagcactgcaagccaaggacattgggaagccctctgtctctttggctgaatgagcatagtgccctttccacagttccattgcagagccccccattgaaacatctccaagaatattaaactggggtgattatctccagtctacacttcggggagtctagttgctatgcatataatgttgccagaactcctcaatgactcaagggatgggagcaaagagagtagttgaagaggctgtcgcctgctggtgctaaaagttcctaagaccccacagcatcagatgggactgaccctgctagttggtatcagttgcctcctttgatacatgcttcaggctgcacattacttggtggttacagttctaaccctagactatcctggacagtaatatcaaacaggtttcacccaaatgtgcaagagcccacatggctgttaattggttaatattgatattggttaattaacagccatagggatcctcaaagacctttggcaggtctttgagagtgacagtggactaagggcaagtgaaagggggcaaggcgtacattaaaggaagcaagataatccaagacagcagtagatgacttgttaccaagccatgtgaccgaggtgaccacattagttcagatagtaaagggatgagaatagcagtgaaggaaattcttcctccataccgtggtggcagaggaggccttatgacagcctattgacagactttccaaaagagctaactgcactttcctatctctttaagaaggcatgcttctttcctccttcctctcctgctcttctcagggactctaaggacttgctataactctacaatttttaacttacggttttgtcatggaaagaaaaatacatgcaccttcccaagttctttacatgcagcaggcactgagatagttgatccagaagagacttaagttgattgagggggagggtgcctggtgcttaacgggtcactaaacaactctgtgatagacccctaggtggacactgacatcattatctcctaaactaaaacagagtgagatccatgggtgtgtgtgggtcaaccccatgcatcttaaccatagggccatcagcttggctttctttgtttctcccaaactagttttcatgtacactgggcacacacatacacatccatgcacatacaggctcccaccattccctcccactcttctgttttttcacaccagttttggccttcaccttcccaattatcagatgattctcatggcttctatttgtcagaagtgctgggaggggcagttactgaatcggttatgagggattaccattctcacattaggaatgaaagagtgcctgacatacgttatgtggttcactgacattcaaagaaatataaaataaatttaaaatgttcaggtttgcacaagagaaataatctttcccttgcattgatactgttgaacttatttgaggaaattcacattaaaacttttaaaactccaaagggactctaatcaggaatggctaatgagcctccagaaatcttttataactctaacatgattatcgaatgtaatttaccaaacctatatgaccaaaagttcagagttgtcactattaaataaagcaaaagtcctaactttgcggaagaaacagccactgccaaacttcagtattacaaagttgttgggagttgtttttaaaatttccgtgttcgaagataccacaggtattggccagcttacctcttcactaggaaaggttagagatacattttcatcccaagccacagactgggctcaattacagctttgtggcaggataaggttaagagaggtggagtgggcagggacgagggagggaggcagaagcagaaaaatcaattcagattactttgatgacagtgacttccagtcttctctgaaagatctccacgatgctggcagcccggacaggggcagcggggagtcagatctcagaggagaacaccaagttaaggagacagtctgggttttctgtagcagggaaagacaaatctcccaagaaagcctcagaaaacgctaaagacagcagccttagtccctcaggggaaagccagctcagggcgcgtcaactggctctgctgcgcgaagtggagatgaactggtacctaaagctctgcgacctgtccagcgagcacaccaccgtctgcaccacaggcatgccgcacaggtaagctgcccctgctctgcgcgggctttgggagacgccgttcgaaggtgctctggagaatgctttgatttcttttcctctgcagctggaagtcttaacggctctaattgccttagagatgattggcacttcagaatgtgtaaccacaaagagcaggatcttggtgcaaatggcaaataatgttccctgcattgttattcagaaaagacctcttacaaggaggcagtagatgcttaggagctgacaggacaaaagagcattatgatttttcttaagtaaaaatcagaggagttaagagatggtaggaaagtgctcccttccaaaataactacaaaaaagagtttgcaatctttcagcatttcctttgctctgagaacttggggatgagggaagaacatttgttttgcctggttgaaaagtggagttgagtagtgtgaacttgttgaatgaggggtcaggctggccatagggatgcagaatgggacatattgaccaccaatatagggatctgagccccgtgtctaagacagataacatcaggagaaaaaggtaacttttaaaaaagagataaatgtaaggcaaatctctatgggttttctttctgttctttactcagcctcagcttcaaataaagcagaggaaggataatttcacaaatcccagtgttccaaggcaaaacgtactgagtaaaaagtgtctggagtcctgaaatttaaggatgcttattttctataatttgtgcaaaaaatctcttaggaattaaagataattttggaagaaaaaatactgtgaaaataatacctagaatagctatgttattaaatggtaataaaaattcctttgagatgaaaaatggttccaattacgtagtcaaagtatggaaaactccttttgtagagactgtatggtagcactgaaattctgcaatgcagcctgtatcaaagcatccagtgcactctgagctgcctttctgtctatatttctatttccaaaagacactacagaaaaacttatttagtaattgaattaacttgtgcatatagactaaaaacttgtaccgtacactttaaaactcctcaactaactttcattttctctttttcaaggcagcaataaatagatattttaaaacctaaactattattcaaaaatcaacatttaaaaattagcacaaaataaagcttctggaaatgttctatgaaatacatttggtattcatggccagagtggtttgtctgaagctcttgtatatgctgttgggcccacatttggggtacatgggaggaagaccaaaggaaaagtagtctcgtttaaagaaagtttgaatgagcttgttagtgttacatatctcatatttcaaactattacatatctcacatctacaaatcttaaagctattattaaagatcctctaggaaaaagagttaagtggcaaaggaaagcattgaaaatggttttcttccgtaacattttccttgacttgcgatataccagaaatttcctttaaagagtctaatacaagaccacagaattcttcattatctgacattggaacaacattgaacaagtcagagtggcatattagttaaggtaaccaggtttagcaagaaacttttggggaaaagcaaatatctgctcttttctgcttcacttaaacaataatattttgttctgtaatcagaaaagactagattagacatgatccagaattaatgtctcctgtgataatctgtggggtagtgttattaatcactgattgacaatagcatggtgtttcccttgtttagtaaaagggttgaaaaagagtgaagatatgtccaccttacatgatcaaaaattaaaaatttcccatcctcctttattattgcagcatgattatttccaggaagaaacgagtatgtgtagttggaactaactctatttataaattaaatacatttattacagagttcaatgtttgcaatagctcaggaaactaaggcagtttttctcatcgccagcaacttttttacctctcaaatgttggaactacattcctctgtcgagtccttgagattcctggacagtgacaatgtctgatggtgcaatctcttccaaatttaatgttagcgatagaatgtacgatcccccaagtcacccaaatttttctttcatttgtaaatgtcagccgttgagaagtcccagaaaattttcttggacttccaattgttctttcttccaataacatggcccatgagtgatatctccattagaaacttgtatgtagaagataaatatgattaacttataaaatattaacaaatttatccacctgtgaagcattacttacaagacagaatatgaaatgtattgaagagtccttgaagacattacacatttgctattggaaataattctgtgggtctttggttaatgttcatcagtaaggaattgctagcgaactcaaacttgtttcctttcttggaagatggaattaaaatattttacatcaggttaattctagttcctgaggaatttgaggattgctttatgtccatattctatggtaatttatatttgaaacaaagggtattattaaatgattggaagaaagcattagagttgggggagattcagcagtcctggtatatttaagaagtaaaattgcaggcagcaggatagggaatgcacattaggtttgtggtaagtagttctgactcctgctgtatttacatatgactatataatgaaacaatctaatatactttgcttaatacagatttattgttcatctagagttgactgataactctgtgatactgatttttttagaatgacagctcagggccctgcaccttgagggaggatggggcaggggccagagttctggagttgaaggcaaaagattggcttttcttcttactgcctgtaactgtgggcatgttttttaaaaaaagtattgtttttgaataaaattttttttctgtttacaaaagtaacatctgaactttgtagaaaagtttgaaaacaggaaaatataaagcagaaaaggctactgttgttaatattttgacatgctttccccagcattttgaatttgggtcatgggtaaaagtcagaatatgatcatatcattccttttttcacttaatattacaccaatctattttattatcttaaaaactatttaaaattttgtaaggactatatcttatgaccataatattgcttagccattcttcttttatatactatttatcattattagatataatattacaataaacatctttgtatcagattttaaaaaaccatatttctgcttattttcttaggatctatttcttttctttttttttttttctttttgagatggagtctcactctgttgcctaggctggagtgcagtggcgcaaactcagctcactgcaacctccgcctcctgggttcgagcgattcgcctgcctcagactcccaagtagctaggattacaggtgggtgccattacgcccagctaatttttgtatttttagtagagttggggtttcaccatgttggccaggctggtcttgaactcctgacctcaagtgatccgcccgccttagcctcccaaagagctggaattacaggtgtgagccaccgtgcctggccgaggctctatttctagaagtgcaattaatggatgaatgtattatatatgtgtatatttacacatatacacatatacagagatatgcaaatatatatttatttattcttaatgaatattatccagttgctttctggaaacatttttctcattataccttctcactggcaatattcaagaatgcctatcttattgctttctctgtactacacaatgtttatatggaatctttaacattgagttttatagttcaacaaaatgttgggttatttaatgaacttttccgggtctcaatttctttgactgcaaaagggtgctaacaccattataaagaatggtcgtaggccgggcatggtggctcatgcctgtaataccagcactttgggaggccgaggcaggtagatcacaaggtcaggagttcaagaccagcctggccaacatggtgaaaccttgtctctactaaaaatacaaaaattagctgggtgtggtggtgcatgcctgaggtcctagctactcaggaggctgaggcagaagaattgcttgaaccgaggaggcagaggttgcagtgagccgagattactccactgcactccagcctgggtgacagagcaacactccactcaaaaaaaaaaaagaaccattgcaaaacttaaatgagataatgtgcagtgatttgaaagaggaacgtgctttgttttcacactctgtaaaatagggcttgagatataacccatactgtacacggtgtatttaaggcctatgaagaaaattaaggatggatgactccaaaaatccccaacaaaagtatatacttcacctagcatcaagagctgagcatcccgctgtgctcaattaatattttataagagacctttgtgtgtcctcaccaaaagctttttaaggatttataggataccaccctcctgaggaaaagtgacttggagatagaatacaatgagcttttacatactatcagtattcacatttcaaacgatagttgactgaacctattaaattgaagttactaggaacatttagtagggcaaactgagatgtgagtgaaaatttagctatagcattttgatactgattttgaccaccttaatgaatgtttcttattatctaggacagtagttatactgagactcgctcctaatattttctctctctgctctcaaaactgcttgacttccaagaaagtgtttactcacacttgcttctagaaggctgaatgtggttctatgtgagaaaaggcagttagttttccaggtgagtttggtagacttgattcctgccaacaggcagcaggagatccaagagcttagaagcctttggttgagcttatgaaagcatcttaattgatgcaagaagtttatgcaagaagatattcttgttaagaatcaagctggaggtcagtgagtaaacattcaacagccattgattgagattcttgtttgtacaaggccctgtgacacaaagatgaaactagaaaagattctagttgcttgcagcctaggagtaattgggtatggacttggaagatgtgcaggatttgagcaggaggagatggggaggggaaggcaatccatgtgtagggaagagtgagcagaggtgcagatgaaaggggcaggaaatgaagatggagagctgcttctgttcatgaggctactaacagcatccttcaaagtttcttgcaggctggatctgggagtgtggccaggagaacaagaggagaggaggccatttgactactttggagactggggagttgggcagagagcaggcgtggaggagaggcagtgtgtgcaggccactctcaagaagaggcagtgcagaggagagagtatgatagttgaagtctgtagtagagtctggggggaaatttgtaggagaaagctgatctgtggatgtttttaggcaaaggggaggagtccaggggagagagaatgtgtgtaatacaaataatagagcaaaatcgtccccatatccccaaggagggggagcctcttgggtatcaaatgcaggtattagctttggcaaagtgaagtgtagctgggcctggtgatgaaaaagctctggagtctggtggcctgcaggctgcatctcagcagtaccacttactagcctggaggctctgggtaagccccttgcctgcgagaagcagttggttttggttgaggccacagatcctggagctaggctgctgggttcaagccctggctctaccaattatcagctatgtgatttagtcttctcagctataaaaagtgggtaatgatggcagtaataccttagggttgttacgggagctcaagtgacttaagtaagtatagctcacagaacagcagtgggcacatatagtagtaaatatgatattatacaaaggtcttagcatcattcctgacgcatgatctatgcccttgctattatcatgagattgttattggagatgccaaaagtagggatgcctctcttttctggagtgtactcacactgatactgtaaatgggcataaaaatatctagctcataagactgctataaggattccatgaaatgatgtaaatcatctggtgtagattagacactcaatcaattttggtgctcacctctgccactttcctctttttccacattcctggaacatagtggacagcatcagtaagatggtatcagggatggagtatggaatggtggaagtgagctacaatggaataactctaaattattcaaccaatattttttttcctagaaaaagctattaattcattttttgttgttgaagagaaagctcttccttttctaaaatatgatatctatttcttagagcaggcacattctccctaaggctgtaattcttgtcatgtttgcatgagcagtcacatagaagtattattttcagagatattggaatatgaggacatttttatgtagtttactgtgattttagttatatgctagaaagattgcctcctagctcattgttctgttgttttgcatattagagaaaatgttggaccactgaatgattgggctaggagtgggagagtgaacctcaacaggacaggatttaggtagccagagaaagttacagcattctagtagcagcctctggggagggttagggttgccatggccactaaagatggtgatgatgtcctttgacttggccatgaagctgccattgtcctgtgtagctgcaccactggggtggtgagttggaagtagacatccctggacgggcacatccactccatgggagtagccaaatgcacagggacttggttcagtctgcacccctgtgactgcttttttggttatcttgacaaaactgagccagtttctcagttttagattcctcttcatttggggtgtgtgtgtgtgtgtgtgtgtgtgtgtgtgtgtgcacgtgcgtgcgcacctggtttcttctgaataactgtggacacctggaaggcagtgcctctatctcagtcttctgacttgcccagagggttctttcctaactggacgttggtaaattagatagagcatcagctctggctcctctttctgagatctctctgccgctacagggaatgggctcatgtaacagtaggaaaattggttgaggggccaggagacatgattcaaatcccattttgcagtatggtcataagtaaggtttttaaagttctccagaaatcagtgctcctctgtaaaataatgagactagacgagatgatcccttgagctttgtccagctttgagcctgtggagtataatgacataaacctgaccaaaggggcacactgtgttgtttatagagacagtgcaactgaagtatctctgaaagaaaaaggggatgaggtgatactttgttttgaagttgtaggagaaggagaaaaattctctttgattttcaaagtgtgttattttagtgattggttgattactgacagatatgtttaattttttaaaaagtgttctttagtagaaggagacagagtaacacaaatacctacaatttgtagtatccttgtttataaaatgtcttgtcgtgcattatctcatttgccttcacatgacatagagcaggtgttctcctactttcctgtgagggaacgtgcctcataaaggcgatgtgcctgatcatctaggcccagatcccaggtctcctggttccttgtccaggcttctttacatgctttcaatgtttcccaaactatggcactctaattgtgccaaagataattttggggggcatgtggaaattaaatctttcaatgggttgataatttattttcatgaatattaggaagaaatatataacatacacctaaaatctataaattcatggctatgagagcagggcgcaagggtaagttttaaaataaatgagtcaattgagaggaaaacattcactaactgtaagtagtggtggaattgagatctgacaaaaatcctcaaggtgatacacaaaggactatttctttcatctccttcataattatcaagcatttataaagcatcatgccttcttcccggggcttttatagtcgttctgtttaattcatacaacaacctcatagtcttgttacaacccatatccttcagtgaaggagagtgtggttctgcctattcattttttgtcagtcgttgattttttttttcttcttttcccattaaggggatgaaatattccctgagctacctccctgctgaatatgcttaagtatgttccaggttatctttttgagccttcgttattctactccatatcgaaggtcaacctttctagttctgtctctatgtaccgaatactctgcttctctggggtgtggtgatatcataccatgagtttaaaatttagccttagctatacagcttagcttattaaagtttcacgtttacttttcaggttgttgtgcagttgtggtattagccagttagagatgttgtgcctcttgcctcctctataagtcaccacagatatataaactggggacacattaatataagctctgatatcaggctgacttaggtctaaattcaaccccttacaatctgtgtgacctggaacctcagtcttctcaccagtaaaatcagaataacagggttacatattcatagagttgagaaaattaaatgagataatatccataaaagttttagcacaatgctgagtgcataggaaggggccttcagcaaaagccataattactattcccctttgaagtgccatcaggccatctgttattttgcctccctgatcttcctttagctaggagtctctctatgagcccctcaagcttgggaaaattctccaagccttagcaaatggtcttgacatgctgcttccctcctcgtttaacttagaaacttgttctaagattttcattcataccctgatttaaaatcttttctgattaacatggaccaaacgccttgtctgtctcacacttcctctctccatgcacagtggatccatctcttgactctggaataaaaaggcctaggtttaaatcctagctctgtttctggctggttgtgtggattttagcaaaacacctctcctctccaagccttgattttgtcatctatatggtggaaataaaaacatctgtgttatccatcttctaggattttaaagattagatccaaagtatatgtgaaaatgctctgtatgttataaaccactatctatgtgttcgctattatttttattaccttctgcactggacatgggctctacgtcagcttagaacatggcttaagagcatggttaccccaatctgtttttctagtaaaaataggtgtagatgtagccttcattccttcattccttgaccttgaacaagccttcctgggtgagctgaccaaagtctatgacatctgccttcttttcctaatatcaacaactgtttattgaatatttattatatagctagcacattccttagatattccattgattccttcccaatgatccatgtgcatgtgatgcctatttttatgatcttcactttgtggaaggaaattgagccttaaaaatgatcctgcccaatgttagccagttaagcatgtgataaagccagtacttgaatctggagactcaggctgcagactgcagatgcacatctcaactcaacagaatggctccctgccctagtttgggttgattattgatcactacaaagatgtcattttagtaatttcacttttcaccttcactttccaccacactataaggttctgtaactcgggatgtggcagtcatgtcttcccctcccatttgaagtctttgcttcttgtcctgcacctgtctatcaaaaggctgggaggctggaatgttgggaagtcacttaggtggatagcaaagggttgtgtcataggatgaactatggatttttatgtttcctcaggcttttctcccacagaaactgtttccatcgaaagagctgtgtaagtgcagaggcctgaggaggcacccaagtgacatcccttattagataaatttaattcaatttcagaatttgagtttaagtcaggctttggccatctccttctcatcctagctctgagagctagacagcaatagctgcccaggtctttcaaattgtagactgtggttgtcactgaatggcatgtgctaatgtcctgccagggatttttaccattgtattgtgtgtttttgctgcatgggaggaggaaacaacacggttttgaggagcacttactcatatttctttggagatggcagttgaaacaacagctttccccaacagcctccccaggtatgtgaaatgtcgtcagatgtcagttttagagaaaaatctccattccatggcaaaataaattaggagctttttgtgcatttttggtacacacattgtgacctaatttcaaaaagaaacttgccaaatattttttcagtctccaaaaaattaaactaggcttcccgccagatatctggctctggttcccaatccaggaacggctcccaaatgctgattgtgaataggctgtaggtgaatgccttttacaaaataaagtgcattgtttttattaaaggtaaccctagctgcaaaatcctgaaaccttaataccttgaaatcagaaagtttatttcaagctgagtacagtggtggctgacaatggtagtcctagctactcaggaagcagatgtgggaggattacttgagaccaggagtttgagaccagcctggacagcacagtgagaccttgtttcaaaaaagagaaagtttgtttcttacttatgcaagtccgaccaggggtgggaagggtccagtcaggtgggacttgggctgatgaaaattctgtcatcttcatcttttgttttctaagctgggccatagctgagcattgacatggatcaagagaggagtatgggaggagcaggtggaggccccattttgtgggccagacctgtaagtggtatctgcaggcagaggcaacattgactggaattcagccacatgaccacattcaactgcaaagaaggctgggaattgtagttataaatgtatgccttagaaggaagagaagtgggcatggtgaatcccaggtctgtttctgccacagagctgtgcttgaaacagggttagggagcttctaaggtagagtttggctattttccataacatggagagaccaaggtattcctttactttcaatgttattccccttgttcaaactggaccccttgacctgacctttcctgagccacatggtgggtcaatctcttctggcttctttgtttggatctcaactttcctgtttcactgagaaggctgaggacacttcagagacctgtagatggtcatctgatatccacctggcagtggaacactgataaagtaagcagccttccttatgtcagtctatgagcatcagctctcattttgaacctgtcagagtgtttctcattgccttgagactcacttacggctggatgaggctcttggcagctcatgtgttattcctcccccattccattgtgagatggagttgctgcaaggccatccctttccatggtaacagccacagactctggtgccacagacatgggctgatgtctcaggaggcaggatcaggcacatggaaacaagggtcagggagcacttgtggagagccaggagagctcactaattcagtctgttatttcagaatagataaggtgtgtgtttttaaggggagcttctacaacattgtgttcatttaaacagtgtaatcattacacatgtttttctataatgtacctccaggattcataacaacagacaagataatcactttgctcccagaagcaggagacagtgtggttttgaatgtaatgttgttaaataaaattgcatatcctcaatgatattctggcattcttctctgagtcactatcctcagtcaaggtatatatacatttttgtgcagaattaatgaggaatttggagaataataggttaagaaaatatggtttgtatacaagagactttttattacaaatatctccaatttgaaatatttccttaaaaaatcaaagcctaaggtacatttcgtagcttagtcttcatatttaatttgattacagcaatggacattaagtatgaaacaagctgtccaaagggctgttgaattatttaattacctctgggatttaggaggtgagagtcagcataaacaattccacaagtgggatgtgttagaaagatcagctctttctgtctcaagcctagtaatttgaacgatgtgactatccaaacaccagttgctgttgaacaaaatattaaatgcttaaatctgtttgcaatattttactttccagatggtcatttatccaaaagcagtactgaatgtgttttaaaagtattttcagttaaatgaattttcaatgaggttaacattcagaattagttttttaaaaaggaaaaaatatacttacatttaaggacattcttttattaccatatatgtaacattgaaatagtttctaacaatcaaactagaaaattaaacagaatttattaaggaagtttgagcatctaccatgttccagttctgaggatacagggatgcagagtcagggcttcttgccctgaatgatcctggagtctgttcagggaagacaacactacagtcaagtttttttggtgtgatattagaagtgtgaaggaaatgctataaaattcaggtaaaagggtgattagttatgccgggaggcagggagacagggaagagaagcatcaggaaaaaatacacttaagatgcaccatttcaactagacttacacaagaatgcatgggggtttgtgggaatgcgaaccaatgaggaagcaggtaagaaatggctgagggaaagaaacatgtaatcggcagcttcagaacaaattcgttgacttttgtttttttttttaggctaacccaccaaattgctattaactggaaaaaagttatgaggatgggactgataacatttctaaatgcaggaaatattcccaattaagcctcattcatctgacattgtcagagaatgaaaattttcacccaggtgatttttctaatacctgaaactttctaatttaagtgtcaaggctttattttaactttctaaacctgaagaaacaacttgacaactctcatttatcttaataaatgtcagctattgtgctatgttaaaatatcctcaggggctattaaagcatatggatctatctgccttgaaaattggaggcctcattttgctattttatttttaaattttggcttctgaaatttttcttcctctattattttttctgtatcctcaccttgctgtaagcttttcttgctgctgtcaggatgcctgcctctgatagttcttttaatctaatttgctatctttactttagggagggatgggaaataagaaatccagtcgtgttcaaattatgaccaagaaagaatacatggtttatgaattgaggtactcaaccaggaggtttgaaatgtaggctttgggatatcttatttgttcatttgttcattcttggttgtgttttatctggaaaggtttctaaaaaaggtgatctctacaaattcagttgttactctatttgaactaacatttgaatctgtttgggaaaatgtcaaatgctgaaattacttcaagtttatgtttatcttggaataaaccatagagattttataaaagcaaaccatatagaacacaatatttcaaaatgttgatgggatgcttgtagtctacattttataaatttctcagccaaagaaaacattctagcacaaatagagtaaacaaagtgaaactattcatttgtcttctatagcagagacacactgagggcttttcagtggattgtttttcaacagttttgccttggaactttggtgattaaacatttacaattattgtacagtgaaatggcatttcaagaggcaggatggtatatttgggaattcaaaatatataaacagatttagttttcttttttcttttttttttcttcacggtggagtctcactctgctgcccaggctggagtgcagtggcataatctcacctgactgcaacctccgcttcctgggttcaagtgattctcatgcctcagcctcccgagtagctggaattacaggcttctgccaccacacccagccaatttttgtatttttagtagagacagggtttcatcatgttggccaggctgatctcaaactcctgacctcaagcgatcctcccagctcggcctcccaaagtgctgggtttacaggaatgcgccactgcacccagcctggtttagcttttttttcccccattttttttccccagaggaaaagctaataactcagagagtattcaaatcatgcaactattaggctgccaggcaaagatttaagtccttgtccactaagcccatgctcctggaaacttgcactttattccagtccttacaataatgactgcttaatagtgccaatttacctggatgtctattaccttatttgtaaaacaagataattaaatcagtttatttttaagagttcttctagctctagttagactcctagatattttagattaattgtaagtgcctagaagatgaagagagagattgcttgattggaatgatcccagtgagacttcttagtgcatgatatcacaaaactgaaaatataaaattttaggcttgcttttgtagttgagatttacttttcatggtgccattctgcaccccagcctccaaggccttgtcatggacaagttccagaccccatagaaataacgtgtcaaagaagatagataagccccatggcagagcatgtggcaccagtgtcaaaatatgtggagttctttgcaactttcaaaactgctttctgagtaggcacttaaggagtgatggaggtatttcttgctagatgaagaacaaataagcatcattcagataatctctcatttctctttagcaagggagaaagtcatatttaaagccatccccatccattttgtactcatgcagcccataacattgaagtcccctgaaaattattgcttgtgagaagtctaagtctcccacgtataactgtgtgttctgtgcactgcacaacactagggggcacaatccacatgggttaaaatttggatggcagtccttggagttgtgcagtgtatgtggtaacccttagacactgacagcattgcaggtattataataataatcaccatttattgagccatttattctgtactagttacatcaaatacaatatttcttataattttcacaacaccctattaggtaatatgatgagctatagtttccgggggaagaaactgtgactcagaaagtgcccactggtgggttgtagtggcaagatttgaacccaagccttcctgacttcatagcctgtgctctttctactatactgtactctctgtggaaattcccctaagccaggccagtgcagactgggataaagaagaaggtgatctcagcaccctgcaagcattacttcagtgttgacttaacagcatgagaccacaatactatcatgatctcaaaccttccatggctcaacattacttaaaaagagagcctagagcctaaataatgtgactgagacctcatctcccatcctttcgacgccgctcacctacctctcctccaaagtagtcattgcttctaactgccacgttttgaggtatttctggccacattgtgcacttttgcacatctgggccccatggaccatttcccttcgtttagctttagactaaggccacattttggcatcttttgggaacttttgaataaagagcaagagagtcatgcccaaagtaggtgaggagagtttttgctacagatgccagagctccactcaaagatgctttctagttgaggactgtgggaccaatgcagaatagcagttaaatctcaagggccagtcttgcccacaaaccctctatgccaaggtagagatctatagatgtagtcaccaataaatacgctcatttttttcttttttttttaaacttttatttttggtttgggggtacatgcaaagatttgttacatgggtaaacttgtgtcacaggggtttgttgtacaggttatttcattatctaggtactaagtctagtaccaaatagttattttttctatcctctcctactcatttttttctaaagcaaggttatagtgcgtatgtatcatacattggtggggggggattgtttttatgctataacgcaggagtatacagtagataagcagtagggataaggaaaaggaatcaggtgagactgaagatgctacctttgggtctagggagaaggagctaaggctggctcaacaggggctctccattagtcatgtgttgtactcccatgcactgtaacatgcaccccctcccctatcctaccaggactgttgtgttgtattcactgagaaaatctcgactaacaggagatgtgagggattgcctagaaaaacaccaatgaatgacagagacatttaacattagatttcttgatggactgcaaacttcctcttttttttttttttgagacagagttttgctctatcacccaggctggagtgcacttgcgcgatctcaccacaacccccgcccccaccaggttcaagcaatactcctgcctcagccttccaagtagctgggattacaggcacccgctaccacgtctggctaatttttttttttttttgtatttttagtagagacgaggtttcaccatgttagccagactggtctcgaactcctgacctcagatgatccacctacctcggcctcccaaagtgctgggattacaggcgtgagccactgtgcccggcctggattgcaaacttgtgaaagaactccctccactcctcccaccctttacctttactgctgatgttgtctcagggtatcttctctgatcctctgctcttttcccagactgggtttagcctcagtgattgcctctatctttgctcatatcacatcacttcgtagtctttactggtttctctcctctcctccactgagagctccttgatgacaaaggcaatgttttatgcattgtgttttgttaacacaacacacacatactatacttagctgtggtcttgccacatatagctagaccccaaggtagctctggcaagggtgaagagaagatggcagtgacaggaggagcaatccctctagatggttcccagtgagatgaaggcagatgtctcacagcatcacctgcagagcactagtgagcaaacacgtgaacaagagcagaaagatgaagttccggtaaataatcagaatagaaaaatatgcgctggactgtagtgtggtgtcccttgtccaaattgacttggttggtcccaatacttccccaccccggcagtgacagtgcattcccactcctctagccccaccagctctggcctcagtttttattttagacctggatgttcttggatgactgcgacatgtccaagatatacagtgttcaacaaatcacctcgttagccaagaaaaatttagaactaggctataaaggtgtttgctatattccaagaataacataaatctcacgagcctggtatcttttataactagtgaataattcatggactccaagtctcgccagtaacaaaggaggaaggatcatcacctctatagcatgattagagcaattactttttaagatacacagaacatcagatgtagactagaagaatcttagagattacctaagtctgagccagtagagaaactaaggggtcagaaaggtcaagacctgtccaaggtcacactattgtttatgaatcctgaacaggtgtagatgaagtctgcccaccacccagagctgcgtgagcttctatatgtggcttctgtgtcccaggcctcccgtgctccatcagcaggacggggcaggcagcacctgtctcatcacatggccttgttgctttttcctgcactctgctgaccatgtgattgcacagtacttaaatatcctaaaaagaatatgaaaatcatcgttcctgagacacagaaggaaagcaagaaagacattaactgtccttctcagctgttcagaggcatttcttacagtcttaccacattgagcttaaaattgatcttagtttgtattgacaaccaaagggataaatagttctcttattaaatatagtttctatcctccacctttaaactgggatcttttatgacattgacctgcttttagaactttatgaaaagaaacttcagttccagacaaatattggctttctcatttctctctcctttcctgggcccagttccaaatttggaggacagaatgagagggacacatgggagagggctcatgccccatgttttagaaactgctttcctggttcacctgtgattcttccttggccctccgctggcaccactgcctgaacctccaggtgttctcagccctggaggaaccactttcatggctcacatactcagatttaactggtggctaccataagtgatgtcactggtgcaactttacttgggaatgctaatttctccctaactccattgtactgtgttttttttttttttttttttttttttgttccccctagcttttctggccttttctttataagctcttatttcttctttcatgctcagggcttttgctgctagggtgaaaatggaaataggtttatgagagaaaaggtagctattgggagtttaaaattaaagcaaggaaattgttaatctctatgcaatgttgattgtgcacaaagcatcattctgatcattataactggagtttacaagcttgtgtcagatacagtcccttccctaaaagagcttataatctggatggggagttaagaggtacacttgcaagagatgtatctcatactctggaacagcatattatgtctttgtttcccaaaggaggtacaagtaccactcatacggcattaaataactgattcactttgtaaatgtagtgtattcctgtttcaatttcctttcatttttttctcattatctaaaaagaagggaagagaaaatctcagatttgtgctaaattatctttaaaacctttctaatacttttaaatctttgtcaataaaagataaaaagagttaagactctgatcccaagcctctggacactaagtatccagctgcaatgtaataacattcttcatttttattgcattttttacagactacattctattttattacaagtgataaggtttttctgtttatggtggtagtaagataatgttttctgactaaatgtcttagttcaggctgttaccatagacttaatggcttaaacaatgcacattaatttctcacagttctggaggctgaagtctgagatcagggtgccagcagggtcaggttcttggtaagggccctcttcccggttgaagggccgctgctctctccttccagtgtccttacatggtgaaaagacagcaagctacctttggcctcttcttataagggcattaatcctattctgagggctccaagatcacaactcgcttacctcccaaaggccctatatcctaatatcatcacactgggggttaagattcccacatatgaattttgggaggaatgcaaacattcagtacataacactaaaaaaattcatttaggtagaaaaagcaacttaattccaaatagtaaataaataatggtataggatatacaaaaatacggcagaaatcacaaggggtgtgcaaatgtttgtgaaacggtttagaagtgtgaagtgagggctttaggtttgaattgcaagtggaatttcaatgaataattgtgtaccggggctgggaagaattcctagaggaggtgagctttaagggagcatgtgcgcgtgtgtgaagattcatgtcagcagagatgtaagatgtgatggcaggtgggaggtgtgagtgtgaagctgttagaccgaatgaacagtttatgtccaggagtcacagttggaggagagtcacagctggaatcatgtggtggaaaaacccatatgtgaggagtttctttgcttttttttttttaaactttctattttgagataactgtttattcatatgcaggtataagcagcaatagagagattccatatatcctttgcctagtttccccaaatgatggtatcttgccttgccacagttcaatagcacaatcaggaaactgatgatgacacaagcccctgcccttattcagatttttccaatattatatgcactcatttttgagtaatttatatttagttccatgcagtttggttacatgtattgattgatgtgaccactaccataatcaagacacaacagttccattataagaatcccacctctacacttttatagccatagccatcttcttcccttttgtcttttctaacccatgacaattatgaatttgttattcctctctagctacaattttgccattttgagaatgttatatatatggaatgatacagattccaaaatgcaaccttttggtattagctttttttttttcccacactcagcgtaagcctctcgagatttattcaactggttgttttgaccaatagttcattccttttacttgctgagtggtatttcgtagtatgaatatgccacagtttaatcattcacccattatggaatatttgggttgtttctagattttggctattatgaataaagatgttataaacatttgtgtacaagttttcatgtgaacataagttttcatttctctgggataaatgcccaacagtgtgattgctgtgtcatatagtaagtttggaatgtttagtcttataagaaacttttctggagtggctgaaccatttaacattcctaccagcaatttatgagggatccagtttctctgaatctttgacagcatttagtgttatcaccatttgtattttagctattgtgataggtgtgtagtgatctctcattgtggatttcatttgtatttccctaatggctaatgatcttttgatgctcttatgtgccatctgtatatcttcttcagtgaaatgtttgttcatatcttttgcccgtttaccaattagattgtttatgtttttattgttgagtttggagagttctttgtatgttctagatataagtcttttgtcagatatgtggtttgcaaatattttctcccagtctgtaatttgctttttaaaatccccttcacgtggtatttcatagagcagaagttgttaatgttgatgaaatctaatttatgagcttttccttttatggattgtgcttttggtgtcaagtctaataagtcttcacttaactctaggttctgaggattttctcctgtttttacctacaagtttatagttttacattttacatttaaatccatgatcaattttgcgttgatttttgtataaagatgaggtttaggtcaatggttcatttatttttgtttgttgctgttctgctttgcctcgcttatggatatccagttgctccagcaccatttgatggaaaagctattcttcctccacagatttgctcttcatatttgtcaaaaataattagccatatttgtgtgaaccctttgccttttacaaccacttgttgatatttgtctatcatttgacagcaacatctgaaagaggttaatggacctttcacccaaatgaatcatgcctctagtataaaaaattatttgattacaaaatatttaataatttagagaagtctcattacatactcatgaatcatccctaaggctttatggtccttataaaaacagattggcccagatcccaccaaaatatttccttttacctaaatagaaagacatgggaaaaagttcccatattttttttccccagggccagtacatagttgcttatgtttgactctgagtactttaaagggatgagaaaagtgattggccaccaaaagcctcctttatgcacaggcctgggcagggacacacaaccaacagctctgtcgggaacttaggagcctgctcgcctacaaaaatgataagagagatctaaagaaaacaagctaaaccttttgagggacatactgaagccagataacccaaggtattcacagcaagatacagtgagtcttaaagttaagcaccgtgcaattagctttgcttccttgggtttttgaaacatgcatctgtataaacctgcctgtgcagacatcccgagccccaagctgggtctgccaaaatccagtgaatcggctctaaaatgtagatggcacctagcagtgaccaagactcagcctcaggcggcctgcaaacctgtgaggcccagtggagcagccgaacagaaatatgtggaaaagtttctacgtgttcatggaatttcgttgcaggaaaccaccagagcagagacgggcatggcatacaggtactgctgattgcaaagtcatccaaccagggcactgcactgatgtcaaaggttgttattaaagaaataaggactgaaatagcaagacaaaaccctgtaagaaaaagaaggaaaaatgcagtgagccctcttcttgggttgcattcttgttttttttttttttttttttttttttttagctttaagcgttctcttttctcagagggttacagaaaagacagtcaagttcatctgtggaaactcctaaccatgtgctccagaagaagtatctttggctctgagtagggaggtgatttggcaggtcaaaatgaagagtggggactccattcttcttaagggaaagagaatttataagttaagagtagaatttttttttttaatgctgcctgggattcaagacttattttcttctaaacttgaatcatgtggtctgtactaatagctaataaagtagttcaagttctccttgaaatgacagcactttatttatttatttatttatttatttatttatttattttttaaatcagtgtcacccaagataaattactggttgtacactaaacttccaatatcattatttattttatgaaagattaacaaaaaggagaaatgttttcttggtatagggttggatgtgtaatctttataagttgctctgtgatgggaagaatctttcctattcagagcaattattgctcctgcacaagtgcttcctttacgtacgcctggagttttaaacagcccagaagctgagtaaaagctattcagaaggacaaggtactgaaaactgaaaaaacaatttagcaattgtaagaacagttgtcctagctcatatcaaaacttctgcacagcataagattgtttttcatgtacaagatgtccccagtgatttcatttttccaaaatctgaaggtctatttcagtgtagtagctgctgctctaatttatcagctaattatattcataaagcaatttgcaatgatatggctcctctctggagagcaaagtattttacacagactctatgtaataaaagggttgtgcagaaaagaaatgaactcttctcaatttataaggaggataggacagcctaccacatcctgctttagaaggggagctcaccttttcatggtagctcatggaatgaggagggatggatgaggaggagatgctgctgtttctttctgaatctgtcaccggaaggagcctgcttctctgtccccccacgttttctctcttctccgtgtttcctcgaccctcagtggtggtagtgatggtgatgtgaacacagatcgggcgaaggggaagatggaccatttcacttttaaaaaagtctgcctccatgtctttgtcataggatgggtggtattaccatgaattgttacataaacctttagagggtatgcctttctctctcaaaagtctagtttaaatatcaattacagatctgtgctgtgtgccaatgttcagatgaaggtatgttctaggaaagcatttttcaaaggattatgaagtagaggaacacgttcttcagacaggtgaaagcaaagctgcctcagctaaaggtgggagcttggagcccacctgcttgaggggagcagtcatcccccagcctcttctgagacacctatgtggattccatactccccataggttttgggcgactcttcatgatgccttggtggggaaggctctgttaccttggagatgccagatactgccttggacaagggtgtatgctaccatatcacaccctagtaagaaatgggacttaggagaatgttgcccctaaatcagtttgaggggagaaaagcacagtttaattgatcattaaccctaagaaatagccaaggctctaaattatgatgagcttgtgctctgacacatcttcctgacacatttctccattacccactccccaatgtccttagtgctctgtttattctccctttaagacactcgcttactgcccttatttaagacattctcctgcaaccatttggaaaggatttttaggaaagagaaccagggttctcttggctcctccccaacttagctttagaccttgatttcttataaacatagttggggttaagagagaagctgactttcatattcttacttctttattatgatttttccccctcaggaaaaagagggtgggcaggggaccatggctatgttaaaaaaacaacctctgttaagccttgttttttctattttcttttttcttgtaaagttgaaagaaaatgggcattgaagttaaacagaccagagttcaaattcaagctctgcctgttttagaactgtgtgacattgggccagtcatgacatagaaatgtctaatacagtaggtgctcactgggaatggaggttttcttcccacttactctgtagtgtctgtccatcagtctaagtgggggagggattgaaaccctttaggtgaaacatataaatggataagagaatattctcaaaaggaaaaaaaaaagaataagacaacccacagtagttcacaatctgtgtaggtttccatgctcagctttagaattctgagaggtctggaagagccgggtaagctgttttccattctgaatttggtcagacgccattgcagactttagcccaataccagctgcttgggtccctcgatcatctgtgagagagcattatgttgtgtttccatggagacttcgttttatttctaactaaggttgaccaggaggagaaaaaaaataagtaaatatgcaaacacatgcatcaattgaaaagaaactggaggacattgaatgtggtgtaaaaagtgccaagttgctgtgtagatccttctgttggcttagaaatctcagcaaaaatagaagttttaaaattcattttatcagtgactataaaatggttacctaagagggtcttcagtttactactaagaggctgaaaattaattgtctttattacatagcactgaactctaagccagacagtaaacacgagcctgagtcaaggttaaaatacactgaggagtagttttatgagaaaaacaccaaaaatatctagactgagttaagatgtagcaaatacctagctttgaagcaatcttataatactaacattggcaggagaaacttaaacagatataaaatgaagctctaatccagggacaacacttttcctgtaaaaggctagatagcaaatatttcatgctccaggttcgtatctgcctctgttacatctactgacctctgctatgtagggtgaatgtggctattgatgatatgcaaatgagtgggcacagccatgttccaatgaaactttatttatggacacggaaatttgaattttatagtttttgcatatcacaaatcttattttttcctccaaaccactaaaaatgtaaaaatcattcttagcttgtgggccatacaaaaacaggtggcaggctgggtttgttcagcaggccatagtttgctgacccctggtttagaaagcaaggccttcagttgctcaggttatgtatttacttgtttgtatttatttatttttaaacctttttgtttccagaggtatttaaggaactcaaatgcatataattgagaaagataaaaataaattacaaagaagatagaaaaaacagtgccaagaaagaccaaaagagcaggaagggaacagagagcctggggtgagggaccatgctgtgtataagccaatgtgttgcaagagttagacctggatttggctctgtgctttccagcagcattaaattgtgaagagggaaactgagccctttacaaagttacagggtccttgagttagagacaagccagttgctccataatggcacacctcttcctgatctgtaaatcagagagaagttccttttgaggttcttctttgtgtaaggaataatatccttgcaatatccttatagcaaacacagcagcaaggttcctagaggatctttcctgtggagcccctaatattactatcatatcaaataataactcagtaaagacaaataggtgcataatggaaaaaagtgacattgtttaaatagaaaccatattggccactttgggctatgctttaagaattttccaataacaaaaacacagatttcttttttattcttttttttaagaatgacagggcttctccaggttcatggaatgaagcaattgtttctagaaaaataagtgttatttgccaatcaaggataaaattttctaaagccttgagctgacggcagggagaaggctataaaagaagaaagggaaaagtagagaaactcttggaattcttaacttgagatgggccttaaggataatctgctccaatttctggtcttacagctgaagaaaattgaggctcagagatgttgagtgtctagcatgaggttgcacttctagctagcaacaaaactaggactagaacccctgtctcttagttctcattccagtgctttcttcaagctttccatatttattcccagctccccaacctccatcccaccacatgccaagacacacacacacacacacacgcacgcacacgcacacacaaacacacaccgcaccctggagatactgcagatccagccatattcaccgtcctgctctgtctacttttccaggctccccgttattgtgctctgtgacttgcttagtcctgctgctttgcatgcttaccctccaccttctgccagaatcattgagtctctactcatcattagttttcctacctggaatattcttacacatcccacttgcctaggtaactccaacccacagggtctccttttgcccctacagcattgaccaccagacttttctctatataggatatagattgttagttatttgtgtgtgtgtgtatcttattgtcaaaattgtgcatcatgaccttgaggatgaggactaaaacttatattttatacttcttcaatgcctttgcacttagaaagtgctggtacatacttgttgcttgattgaggtgcatccattcagaagttgggaaagagagaaaccaaagagcaagtaggaactttccttttccctgctaatagtgctctagccccatcttttctcctgtatcttagatacaatatgctacttaatcttgttaagcctcagcttccatatctgtaaaatgggcctaatttaacttacttcacaatggcattataagaaatccataaagtcacatatgtgaaagtgcttggctcactgcctgctagcatgggaacctaagtgctcccttgcttcaagctcctttttaaccaatcctagtaatctatcacttaggcatctttagcatttccaaaaagaagtgtgtgtctatttataaaggatagagggacagaaaataaacacctaaaatagaatattgcacaattctgaacatatcaccctcctttcatcacttgctttttcattttctttcttttttttttttgctgttgctattaggatctactcagaaagtgtttgtttttctttctttttatctcacacatgggctcctaatcagcttggcctcaggaagtgtgggaataaataactcttcaaacgatgtaatacgaaggtatcttttatcaactgctgcatttccagtgcctggcattgtgcctagaacaaaaatatttgagccagaatgaaatgaaaaggactgaaacttccaccagcttgcagtgtctctcccattagcttgccccagtgtccgaagatctccctagactggagacatcagttctcagagacttctgttaaaaggggagtgtgcttgctgagtggtggccacgctaatctaagctactagatggtagaccaagaaggaaaccggacatagtccaagcctgacctaaaataagagaaaacaggaaggaagcttccaggctagatcaacagaaaagctcgagtatccgagcatggtacattactacggactatcatagaagcaggagggatggaattgaaaaaaaggggaaggaaaactagagagaaacctcacttagctaccagcttttctcagagatgtcagggcagagaatttgaaggcataaatgagagttttcattgatcattaaacaaagactccagagataagtaggaacaatttttcacctgaacccctctctgtgggttctgtcacagtgcaaacatgatgttctagcagaaggatttaaagacaagctcttccctccctcctctcatcccctgcttccttatctacaaaatgaagctgaaaaaccctacttcaaagggtaacgccatcctctcaaagaggcatatagtggatacccaggaaagactatccctcttgccctttctccttttcatagtattacagggttgacatatgtggaagttgaaaattacatttgttcctaaattgcacttactttcatcctcccaggaccctccaaaccccaccaaaaacaccctttcatcatgtgttcttgtgacctgcccttttcatgagacacttggcacactcagacctgcttgaaaagtattaatagctagagctgtgactgtgaaaatcaatagcctagaaaaatgctactcatgcagggggttgtattaaaaaatgtccacatgatttattttagatgacctaatttggtaagtctctgggcctgtgcttatttgctgtgagctctctagctgtttttctccttgcatcaatatttctggaggaaagtagatgacaccaagatggctcaggctcaggacgtatgtgattacttgaaacctgaataggctgctggtgaagggctgtggaggcgtagtgaaaggggcttattcaaaacaaacagaacgtgttatttcctattgaatggaatagaaattctaaaataagtatgttttcaaagtgtcagtttagatagaaaatgcttagaatttaagcaagagtgagagacgagtgctgcttgggtttgaaatattgttgagaggggcagatattcaatctgttttgaaatttccacttggggttttccaggataaaagttgctttgtttatgcagcatgacgaaaatactggaaattcagggcttgagaacaatactgggttacagggatccgtgctttcttatatacaagttgttgacagcggtttcgtctgaaaaaaagtgagcattttgaaatctgattttcatgaccgaggagtaactgtaggccaaagatgttttcacccaagagaaaaacaattcctgaatttccctgcagtgcctttgagtgccactgggatgtgctatttcataaagaaaaggaagctcttctgttgcctgaaacgctgctagcagaaaactttattcagacagtcctagactcgaacttaaatttgaatctatgtatttaccttgattatgacaatgggaaattttatatagtgagaaaaaaattaaaaaggtaagaccagcatattcctaaggttctgagaagcctagattccatggcaagcctatgttattataacctaacccagttagatattttatagagcaaattttctatgtctgggagttttctagcgtagggggttctgagctacaccacagacctctgggcatggctggtgaagaaaggaaaagtagacatctcatcccctaccatctttcagagaatattctgttggtgtcagccccacctcaggtgcaggcaccttgttacacagttaagatggagcagactggaacgtgtgtgctatctggactgcacgggagaaggccatatcaaagcctgtcaatgctctcagaaccatggtcttgtgggcctggctcatcaccaagttaggagatggccctcctctgtacccactgtttgttttcacatatcacgtgtcacctctccacacttagagcgagtgcctcccatccagtgattcctcttcctctccttatctagttaccaactaattctccctaagttttaaaatatagatgctttttaatagagtgtctgcaaaatatatcatccaaagaaatgaatccctaatgatgggagtacaggttatttttagacaaactgtctagtacttaaggccagaactattttaaaatttttatctgaaaataatttcaaacataaggaaaagttgctaaaataatataaagaacacatctgggctatttattccttaacatattgttaacattttgccccatttgctttaacttttgttcatgctctcacatgctcactccttacaacccacctctccatttatttttccaagctttttaaaactaagttgcacacatcatggctttttagtcctcagtatctcttaatagttatgatattttcttatccccaatacaattaacaactttggtaaaatttacataaatatgatattttaatctaccattgtattctaattttgtcagctgacacaataatgctctttgtggcatttttttactccagttgtacaggatcagtattggatggcaatattttgttgtcatatcttttaggtctccttcaatctggaacagttcaggagaaattaattttagtataggaaggaggtcaaaggaaagactatgactaattgcaagtccgccttgggttgggaggtggcgctgtggtgccacacaattgttatgcctgcaggaaggtctcctggatattgttaccgtgtccctgacaacgactgtgtctcccacagctacccagcgagggttaccacgttttcttctggaactttaggcccaaagctgagggatctcataggcctgctgaccttattagcctacataaatccggtcccctgtgtccctgtgctcagcacatcccctgagggtgggtgttagtggtaggtgtgttaaaagggagtcaccaggcgttaagaggggtaaggccctctgagcactgatggaccacagacacggttacctcaggattgtctagcccctaagtcaggtgcccataaatgagctgggttaggaaaccatcccaagaggctgaagtggcagccgaaggagaggcctgataccagctggattcagagtgacgggagtatggattctggccttagcttctggtgaacccactgtgggaggggtgggagctttcagaaagatgcaggttctcaatgggctagatggaacatttttagacaatggattttgacccaattgtcttctgtcattttctccttcatgatattcctcttaatttgctaaggcagatgagatagaagctctgacaattgtagagtgtgggtgtaaaatgtgcagctcattaagtatccaagctctccgtttagcatttgaagggtttgtaacaggtcagtgattcaccctgcttttggaattttacggcactctataactcagtgcatagtgacaatacatgcctctagaagctagttacggtttcaaaacagagctatgattacttccagagatgaccattgtataagatgggcacctttatacgtaacttcccaaaaggttaactctcgttgtaacttctttgtaacattccatgctagcactttcttcctctacctctatttttccttttggcgcacttatttgtttatttctgtattgtctgtctctctcactggaatgtgaattccaaaagggcagggattttatctgtatagttaattactgcattcccagaatctgacatctagtgtagagctcaataaatatttgctgaataaataaattattaagcaggagtctaacaaataaaccttcaatgttcactggaggacaagccgctggatatcagtcacagggcaccacttcaccaggatccatagtctccccagcgctcacttcctaactttctctctttaccaaaaatccaagtatccttatttgagatagtgatacttgaggatgacattgttctcgtaggaaataggtccttaaatcttggattttaagatgctttgaggtgaccatatcatgctcatcatggcatagcccactgtatgtttgtttcttctgagatatccattttgtttaaccttaatttgctcatttacttcaatcattcattaagtttgtgatgattaattttgtgtcagtttgactgggccacagggtgcccagacatttggtcaaacactattctgtgtgtgtctgtgaaggtgtttttgcatgaaattaacattggaattggtggactgagtaaagcagactgccctccccactgtggttgggcgtcatccagtcatttgaagttgaacaaaaacgctgacctctcacaagtaggagggtattccttctgcctgattgttggatctgagacatcggtctatttctgctttcagagttgaactgaaacatcagctcttcttgagtcaagtcttgagccttccggcttttgggtccaaacttacaccattgacccacctgaatctcaggccttcagatttggatcagaattacactattggctctcttgcatctccaacttgccaactgctattcttgggagttctcagcctccacagttgcatgagctagttccttataatcaatcaattaatcagtcaatccctatctatccatttatctatgaatttatccatctcctgttagttgtgtttatctggaaaactctaagtaacatagatttctcattgtactttcctccaaaaaagttctccatgtgttgctgcccaggcctattcatagtggggccttgagttaccttgaccagaatgagacactcgttgctttcactcagtgtgaattcctgtttccacttagaggtggtgctttctgagggaggtttagctgattacagtctgactaaggtcaccagaagtagtgcagatagtagtgcagatgtctaacacactcatattacagagccatgggcctctccttctccactcctctcaccaccagctagctcttctttccctttctaccagttgtccctcaatcccactggcaagtcctctttaagtttactcttttcctcatttcgcctttccatcttattacaggaggggtcatcatctcattgtagcagccagttgtcatcctccgaactatgggggacaagtgtggagagctagcttacctgttgggattcctagctgactcgtcctcctagataaatgcgccagaggattttctgtctattcagtaattgtggatgagtgtgggttctggttagacttcttgttcttggtatagatcagactttcccatcaactatttgacctacaactgaaacactctttcactggtaattaatagttgcaggctggtccttggtggtatcatcagatccatgggttttcttacttaagtctgccctactctaccactttggcaagaccctggcccatttgactcagcaaaggtagtcagtgctgctgggactgggcaatggcagtggaggggtcatgcgtttctacttcagagggttggttacctgcaggagcctgggtgagactcattacagtggacagaatccagctatcttctttctgccccttcttcacaggtacctctccaagggccttccatttctgacctaatgttcaccacttcttgggttctggatcctgtatgggttaaatattttccctaatatgtctcatgactgtctcatttaaattgttggataatccaaaacatattcttatacaagatggaaaaacaggttcatgcagccaaatttactaatacaaattatatgatacattggtgacactctttacaaagctattttgtatgaccactagtcaagcctcgctgtttttggtacactatctatttttactgaaccatctacctatcccccctgccctgccaccacccctcacacagattcatccaacagctctccattgagtgctcaccttgagttatgcacaattccaggcattggagatacagcagtgaacacttaggctaagttctctgctttttaaaggatttaattctagtggggacgtgccagttaatgaacaaaaataaataaataaaatttataatactttagaagcataaattctctggagaaacacaaagcacagaaggaggatgagtatttgtgacagggagcagttgccattttaaataacatagccaaggaaggcctcactgagaagacagcatttgaataagtacctgaaggaggtagaaatgacaatcattgaagtttccggggtaaagagtattatagacagaaggaacagtatatgcaaaagcccagtgtgaaagtctgtagaaagaaacaaaaacagccagtgtgtcaagggcagagtgaatgaatggtagaatagtaagaaatgatgtcaagaaggtaaaggggagaattgaaagttcaggaggtcctcaagaatgctctcaggttcagtgattcactagaaggactcacagaactcagcaaagtcattatgctcatggtcgtggtttattacagcaaaaagatacagattaaaattagcatcaggaagaggtacctagggttgggtccaggagaaccaggaatggagcttccaattgtcctttcccactggagttgtgtggatagtgcttatttctctcaggaactgggaagcttacctgaaccttggtgtccagagtttttatttgggtttggccatgtagacacggctgactacctgtgtgtttgaccttagtctctggcccctctggagttcaggctgatacaatgtggcccaagactcccaccataaattaaatacttagcctagactatctcgtagggccttaggcccccagataaacaaagacatttttattgggtagggcattccaagggcttagaggttaactcccaggagttgggggcaaggagctagatttttctttgggcaagattaattctttactgcacaataggcacattgtacaaaaatgtgtaggccattttaaaggtggtggcttctagtctgagtgagatggaagcttttgtgaatactgatcaagggtgtgacatgatttgaattattttttaaaaggattgtctgaatgctatgttggaaaataggctgaaaagtagaagtagggttactggttaagaagttaccataattgcccaggaaggaggtaacagcagcttaaaccagaatggaaatggtgagaagtagttggattctggaactgttataaaagtagcatcaggaggatttgaaaaataaatggatatgatatgcaataaagggaatacttaaagatgactttaagcttctcagctcaggcaattgggaccaacaagttgcccttaaattagatgagaaagatttcaggggagtggatctggagggaagaagagtaggaacttactttttagacaggttgggtctaaatgcctattagagaacagtgtcaagttgataaaagtttgaagttcatgggagtggtatggactggagattcatgctcaaaatataaatataaatatataaatcttggagtcatcagtatattgcgagaacataaagccatgagataagcaagtaagtgtagagagagattataacaaaagccccaggactacagcctaggctctccaatgtgaggaggtaggagagatgaagaggaaccagcaatggaaactgagaatgagtgtgcagaaaggcaggagagagacaagatagtggggtgtcaggatcaaacaaaagagagaaagatcaagtatgttcaatactactgctaggtcaagtaaggtgaggactgagagagaccattggatgtaggaacatggaggccactatttataagagcagagagaaaaacgtatcttactttctacacagcactatgcttgaaaggagaaagcaaagacccatatatgcatgtaggaacattttaaaatttaattctgaactcctacttaacagaactctgactaccatccattgagcagcatctctgaatttcctcctacttatgaacatatagaaaaaaatcataagaaattggccctacctatgagcagaatacagaaaggttttccacaaatgatgatacttataaagctggattattaaaaataatactcataagttatctgtctcatgaaacagcatctctgccccctgattgagagtagaaagacattgtgctcttattctatggtatattttatattatagtgctccctttgttttgacaactggaaatgtccctttataggttataaaattgcatttaaattaattttgttatattttattcagaaattctatttgcttgaggtgtgtatgcgtatgcatgtgtagaatgttccacatcaattaaatcttttatattgacccacagctcaatttttcagtcaaaataacatagatattatgcttaacaaccaaaatggataccattaaattataaaagtcacaacaaaaagaacaggatgaaaaacacacaaatattagccgttgctatttttaggcattagaaaggtggattattttttttcctttcctctattccaaatgcatgtgtattactataataaaagggccgcctgtaatcccagcactttgggaggccgaggcagggggatcacgaggtcaggagattgagaccatcttggctaacacggtgaaaccccgtctctactaaaaatacaaaaaaaattagccgggtgcggtggctggtgcctgtagtcccagctactgggaaggctgaggcaggagaatggcgtgaacccgggaggcggagcttgcagtgaggagagatagcgccactgcactccagcctgggtgacagagcgaaactctgtctcaaaaaaaaaaataaaaaataaataaataaataaataaataaataaataaataaataaatgggccaaaaatgtaattaaaataaaatttaacattaattctattagattttaagaatttaagatatatggttttgaaattctttttgagataaggtgagatagctcagatctaaaaccaaaacaagtgttgggattcgttagtcatatctctactgaggtttacaaataaatactcttacactgaaattaaccaggagaaaaatttgggctctcatgtaaacaagacactgaaatgcattctatcaaagtgcttctattttacagttaaccttggatcatatagactattttttatcagatataacttgttttttttgcaagtaacagaaaacctaacacaaactggcttatataataaaggaaacttactggctcatccaactgaaaagtccagaggtagggaaaaatttcagatttaagatgcaaacaatgtgtacaggactctgtttctttctctctgcatctgtgggctttctttcttgataatggcttcattctcagctccacatggtgggtctgtggcagcttcaagccttcctctcgtctgcaatgtggcatgtgactgacaactgtcagggttacaccctacctcattcactcccagaaggaaaaagcaaaggcacctttcatttcccagaagctctggcttatgattctttagttttgattggattcattgtttgtctctgaactactgaccttatctgggagatgagagaagctgaatgacttctgtagcttctgtgctcaacccctcctaagctgcctgactgagaatgaagactcagaatactcttggtgggagaagaggggagtagtttatggcgaggcaacctacatatgtccgcccccccctgtaataattgagtctggagggcacagatggagatgagctcatgtggtggtaaattcatggtagtgaagattccaggtggccagtcatctggaaattgggaatgacactactctatgctacctagttgtgtgttgtttctatttcttgagctttgggtcttattcttagctctcttcttgctctaaaactctgacttcttaggggtaggggaatattttcctctattagtctatgtctcaagtggtttgtgctgcttagtcacatgactaaaatgagcagaaatcttatctaactaaaagtaagaagagaaactggctttaaatgatatttaatttagcatggaaagtaatgcatttttaataaggaacacattaaaaactcataaagtattttatttataaggcggttagcctccccttgcccattgttccaataaataccattaagttccatcaactcttcagtaagtacaattacacaagtgccacatttcattttgcatttgattatggcagtgccccctccacatatattcttcatacgcgaagactaagtgcacagtattttagaatctgaggagatattaggaataattttgcataccccatcccactaactaattttacaagtaagttttctgaggcttgaagaagttaagcaacctgctaacagtcacatagatggtttgctaccctagttaagagtttaatcaaaggcttttgatccaccagttttctctttgcacaatagaattgttcaaatcaacaagattcactgagcaccagctgtgccctgggcaatatcactgagtttacaacagtaaaagacatagttccttctctaaagaaattctaagagcagtccagtagaagaaagagccatgacaaccaggtagttagagtctggcataatacatataatactgcttttaaaaacacagtcataacatagtagagcaagtgatgaatgctctcttgatagtcagggatgacttcttagaggcagaaaatcattcacagggttggataagagttcaacaagtggtctaagactagaagagaatttgatgtagaggaaacagcatgtttgaaggcccaagagctagggaaccaaggcgatagtaataagcacaaattttagagacaggcagatctgcactaaatgcttgttttaaatcttgctaggtgagtgactatacaatttaagtatcctttctgaacattgacttgtttgcatcagaagtagaaataacaatacctatcccatagggtttggagaagattaaataatagaacaactataaaacatgtaatgtagtaggagctcaggagcaggtagcaactcttctccatctcctcctcctccttctcctctttctccttgctctcaccccacccctcaacccttttggcgaagagagtgttagaagatgaggttaagaggcagggaagaaagagatcagtggaggtcttagaagctgaccatgaaaaactgttgaaggattcttaggtaagaagtgacaagatcaaactgccatccaaaaaaggtatttctggaagatctgtgcataggaaactgataggaagtgatttgaataatataggtgagagagcttgaagatgagtaacagcagtagaatggaaaggagaggaaagcatggatcaagagacattggggaagttaaattagcaggatgtgttctgcatagctttgttcgctgcattctggctttcattttcacacgtacattaagaggttgtctagaagggaaaatgctcattgatctaattaggcccggaggtagtcattgtggcatgaaggaaggaggcagaagggcagaactctgcagcagctgtagctgcttttggctcttgtgtctttaaaatgcttctacagaatcacttaaatcatcctcttattctcattcacatgaaaggaaatctcagagagagcccttgaactagaaaatcttttctttcttctctgactttaaagcaactccttaaaccactccatttctgaggcaattatctcttcactacaatttattaactgagagtaacctcaaatcctttacttttaagcagcacaaaactttcctccaaggctgtctgtgtctgccctttaagaggtattaaagggcccagtgggggtaggcctggcccctgggggtgctcaccaaatcctgtggatcaactgcatcacctcactgcctcgtcattcacccattcaccatgtacttcctttaaaaaaccctgtgatctttaccacatgtttatttttcttgtttcacaatggttttaatgaccccttttattgatgacctaactgaaagatggaataatttgttgacacacacaaaccactcccatccagcccccaaccctccagaggactgatgtcaagaagaagaatgtagttacctgacatttgtgataagatcagctgacagggagtttcccctcactcttcctcactccatttcatgctgattttggatctaactagtaattcagtttcgtccatattttctttttgaatataggtaactgtctatatatttttaaaatattttaattctacccacatatgggtttctgcataatctgtgaaggctggtccacataagcaaagtattgtgactttacactttacataaaataactggttgttgacttgtctacaaaatacttaagtatgtgagctcagatgaaaatgaatgaagaattattgataagggattttaatttttatccataatagtatgtttacataatagtattatctacaaaatacctatgcatgtgaactcagatgaaaatgaatgaagaattattgacaaggcatcttaatttttatccataatagcatgttttgcttatgttaaaaacaaaaccaaaaccgaaaactactcacatagcattcttaaatacgacagggttttgaattttttggtcttgatattgaaagcattctaagaattcacaagactttagaataaacatttagaacactgtgcgtgggatgcctgatttttaggattgggcacataacagcctttgaagaactcacatctgaagtgctttcatacttgaaatcatagaatggctttctaaacattgcctatggccaaattgaatagaaagagtatttaggacatatttatactggatttttttttttaatttttagcaaggaagacagagaaaatggtagcaatatcactatacctgtttatttttgtgcattatgtgaatctgatgtttcttcccattttaggtatttgaccacctgctacgtggaagatattatgctagacacaagttaggactaactaggtctcaaaacagagccttccattaattagttgccaccagtctccttactcctgatggtcttgagagaacagttgtcttattttcattgtatgttcagctgtatcttgaggttggagagaatcacggatgttactaagacctggagtctcttgcttaaaaaggataaggtagttcctaacatctctcatagacctgtgatgtctgtgaaattccttcagataatttctgctgatgactgaaagtgaggcgatttgccagccagcatcatgacatcttcagtaactcttacctttggtttaaaagaaaacaaaacaccaaagagcttgaccctgggacagcctggggagaaatctgcccaccctgctggctccaaatgcatgaaaaccactctttacctccttcatttgattagctgcttcaaatttacaccaaaggaagcaaaaatcctcattgacttgacacttgttttggacaaaaataagatcagaaaagcaagggaaaccatttcacaaagccaattatataattcacaaaactttggtgctctgaagtccgtaactaattgcagaggaattataattaggtagcttagaaaattgcttttaaaattcaagtttaggtgtggtttactgaacagtatttgaaagtaagattcacactatgctatcctatatggtagccactagtcacatgtagctaatttaaattaacataacagtaaattaaaaattcagtttcgtcagtggcattacccatatctcaagtgctgaatacccatatgaggctagtggctactgtgctgggcagtgcagatataaaacagcctcatcatccaataaaagagatggggattataaaatacaactcaaggcaaaaatctcagattcaacatccttaaggttgtctttgttttatggaattttttttaggttttccagtgagctatggcacttaaaaaaatgccacatagtccccttaccttgagtcatgccagatagtgggacctctggttgttacccaatgtcaacctcatggtgaatgtgtaggagttatgatcaataagaatgagattactatctggcagtgcagttgagttagtaacttgtaaataaaactcagttatggaaaagatgtcagggcgtacctcacctaaaaacattttgatgtatgcttttctgtatattcagctattattcaagttactgagaagcatcttggtcttggtgattaaatttctgcaatgagcacattcctggcaccagctgaatcttacgataagagatatatgaattttgtctttattcttgttgattcatttccagccataaccttttgctgggtgtaaacacagatgaagaagcactttaagtcaacttttatcttgttaattcattaccctttgtggcaacggcaaactttgtgcagaattataaatcaagtccaaatgttgcacggatgccatggcatgaagtttcatttagtgtggatacaaccttgatgatctacaaggtgattcattgctttttatcctgtcttccaactgaggagttggatgctggtgcatactaatgtgcaagagttaatgctaggcatcaagactgcaaagttttgcatactatccttctcagttctaactgtttcttaacccactggcgacagggagtggtgcctttcagaatcaattacataaatacagtgaattaatctgggtaatatgaagaatgacttggcctccctcctcccctctgcctgttgatggtttgcctaactttatggtttagatgtgactaaataagagaggcagaaaatgtaaggtgaatgcttgagagaataagagagcattatacctttcaaagtgcttttgcaatatattataccccatttgatcctcacatcattctgtatacaagcagagaaggtttagatgttaccaatgaggccgctctcttgagaagaattgatcatttttccatcagtgtcccattggcttcattcctccctacatgcccctgtttttaattatttgtgtacatgaccatctctttcactagacttgaagctgcctgcagggagagaccatgttcttactcattttgttttcctggcaaatagtgtgatgcctggtgcatcagctatttatttgcccagaagaaaggcaaatgtaacacaaaagatccgtgaaggaattatgatgtttgttcagggagaaaaacatgctagattttgtcagtttgggtgttttccctgtccaaattgaaaaagatgttgtttagcctggtccgggcctcggtaccagtgatggagatctagggctcaggactctttttacaatatgtttctcattaaaactttctcttctttttataccactctgctttattttaagacactccatctctttttgtagttagcccagcaaaagggaaaataaattttacttgcattcagaatagaaatggattgcaagtgcttaaataggaagaattgaaaagctgtactgctgtttacatttttgttactggggatgatgtctaaaatgcttttgatgttgaaagaagatcctaatgaaagcaaataggccgggcgcggtggctcaacgcctgtaatcccagcactttgggaggccgaggcgggcggatcacgaggtcaggagatcgagaccatcccggctaaaacggtgaaaccccgtcgctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaagaaagcaaataagtgagcagagcattatactgtaaactggactataaacagaaacggagtggtgagtttgctgctaactgacggacccaggcctgtgatattgtgtgtggtcagtggatgtgcagtttgcagacctgcaccaaaggtcttgctctgtgctcagtctggcagtttgagagaagagggaggcagagcttaggtgaacaaagcagaggagactgaagaagggagcagtctccacaatcagcattactgtgtttcatgtattgagtcaatacccctaactaataaaagatagcatgaagttttactccattgatcaacaccttaatttgcttacagatcttttatattacatttgcctttctcttctaagcaaatgatgttttgttatagttagtgtttttatatgtatttatctttaacattatatctgtattgcggctttattcccttttgttcttctgagctctcctggtttttcttttcaatgtaaataattagttctcacttttcaaatgtaaattattaattctcaccattttgaatctccttgaattggggacttgtttactgtgttctcacaagggcatctctgccttcttgttggatcacagagtagttcctggaaggtgtgtaagggattctaaggctgtgctcatgtgcaaaagaaagccttttgcgatgttgggaactggggtgtgtgaatcacctgatttctggctggagcttgggcccctcattttttccatattcagatgttcagcgaacatttgtatattacaagagaaagagagaaatggccttacttaagggaaagtaatatgccacgatacacagcagaagtaaggagaaagactaatgtctcagatgatatgctgtgctttactgttaagtgtagtgttgaaaacaattatcagtgtcatgccatgggcatgaggcagagatgaggcagcacatctctcttttctgaaagttccaaggtctgtggaggcacacactcagtttttaatacataaaaagggtctagaaatcttatctttgaaaaggaacaggggagcagaggatgcatttgaaaacaaacagtaatataaggagctataaagaaactgtgtagtagcactagagagatactaacaaattaagaatgaatgcgcaatcccaaaacaaatgtaaacatgttatttttatcattgtgctagacaaatttaaaaaatacatatatacacacacacacacacacacacacagataggcaatatatggtgtactttaaaacagtccttattcatgaatatcagcaagatcccagtgcttcttttatgggtttacatcttttaaagcatttccagatttcatttgctagctgtttgcaaacattctctttgcttttgtggtaattgcactattgtacagactgtttcagctaaatgtctaatggaattggtagaatgtatggagtgaataaattggtcaacaattttatgataagggattgtattccatttaagcatctccccttctaataaaattctcctagatgattgagcttttcatgtaacgttctgcgaaggctttttaggatttgtaggaaccggttgatgtttatggcggtttagtgtggcaggacattggaagtcatcctggacatgggcacctcttggttgtgctagactgtccctgaagggcaacaagtctccattcctgaccagtgctgctctagaagtccagcaccctactctggctccaacaagacagagtccatgggaccccagggatgtgcccagctatctgcatcccctttctgcaccaccatgtccacatacccagaatcctggtattccctcactgaatgacttacacagcctctttagatctcttcctctaagagtggacaatgccccagaccacaggtggccaagcttgagggtgtggatgtgtgggctggcatgtctatcagacggtggcgtgtgagactttttgcaagggctgaaggagtagggaatggaaaaggaggagattccatctacagttatgaggcatgagctggtccccaagccacacccactacatgacagtggcaatacagttattgttacgatcaaatcacttctggaaatttctgaaataacctctgggaagcaacagtgctactgttttaagcaagaacattgggtttcttttttaaccaataagctttctctgaagatgacctaaaacaaaccccaagggtgttttgtgctatgacaacatcaatagaataaaaatatcatttttaaaggtgcttactttgaagaaaaactcattgacatgtataaaatatgatgtttattgaaaacaaaacagccagtttcaacaaactttttaacaacaacaacaacaacaacaaaaataagtggagattgagattgaattataagatttttgtagtataaggtgatatggtgtgggatattcagccaagagtcagaaaaactgtgctttagttctagcatttccatggagcagctgagttatttggggcacagcctcttaggatctcatttttgatatctattaaatgagaggggttggacagaatgctctctatactttcttatatgtttggaagtcctggctgggcatggtggctcatgcctataatcctagcaccttgggaggctgaggtggatggattgcttaagctcaggagttagagaccagcctgggcaacatggtggaactctgtctcctcaaaaaataccaaaattagccatctatggtggtgcacacctgtagtcccagctacttaggagactgaggtgggaggatagcatggacccgggatgcagaggttacagtgagctgagatcatgccactgcactccagcctgggtaagagagtgagattctgtcccacccccaaccgccccccaaaaaagtaagtcctgaatgtgtaaaaaccatgttctctattagctatacagcatataagtatctatcaaaccgaagatactatcaattgtatggtacaccagtaatttgtgtactgttaagaaagaaacacactgcctattatcatttaaagagacaacaataagaatacggttttaaaatttaaaaaatttaaaaggctgtaggaagcattccagtttagaaatgtgaaaatataaaaaatatatcttagagtctctaatacatggtgattattattttattcatctaaatatttttcacagagtcttgcacagtacctaccatatctattaaaaatctgtgtattcattcaacaagtgaatataaatttgatgcttattatatgttaagcaatacaacatggatacatcaaaatgtactgaataatggaatttttgaagtatatttgctttttgtaacatcaacgtgcacatgaagctagtgatgctgttgagaaatcagctcaagaaaacagcgagatgttttctttttaggacagcagaattaccaaaaacttgatctctaatgtagacatttgctccaaagaaatttgtactgaaaaatggaaggcagataaacaaaagttcttagatcagtttcttagtcatccagggacttctgttacttctttcacatttctgtaaaaatcttgttgaaagaatcacttcttgcctccatgactctgatgaagatgttctttcagctgtaatttcttttccagtagaaataaggcgagggatgattttctatgaacactgatgctatatcatatgaaatatttttatatgatttattattgtaatttactgttaaattgatttttttacacttaagaaatcttcgtattatccacttgtatctaatagtatcctaagacataaataagttcccaaaagcaacatttttaaaggaatatttccctgataagctctccctcacagttagaatcttgagtgcaacaaatgacgaataaagctcatttagtctcaatatctttatctacgggggttattatgctgaagaccttaggaaaatggcaaaataatgagttgaaatgcttgagctcaatctatataatggaaaccatatgcaatgttatgtggtgattttaagcctaattatattcaacagtgatgtttggaccctcctcaggaaggaacgggcaagaaatttagtcaggaatgactgagagaacagtttttgttcttgttctctttggatttcccttcttgagccgttcttgccttatgggctctctgggtatttctatttggtcttcaacatggtttggctctttgtccccacccatatctcatgtggaattgtagtccccacatgttgaaggtggagcgtgatgggaggtgattggatcataggagtggtttctaatggtcagcaccgtccctctagtgctgtctcgtgatagagtcctcatgggatcggacagtttgaaagtatgtggtgcttcccccacttgcgctctttctctcctgctctgccatgataagatgtgcttgctttcccttcgccttcggccatgattgtaggtttcctgcagcctccccagccatgcagaactgtgagtcaattaaacctcatttttaaataaattacccaatttcaggtagttcttcatagcagtgtgaaaatggactaatacagtcttctttcagtttctgttcaaagttcattttcagtacagtgccctgatcaatcatattcccaaagaggccctttttccctctactgcccaaggctactcatcttgagactggcttttctctgggctcagaaggcttcccagcttcctgtttctcttggggccaagcacattgtgttttctgaccagctgaatctcttctccaaattgggatgaagagaggaattaggatcaattgaacaattggttcctatggggcctgtggggccaatcgtcatgggtttcccttcccaaggaatcgttttttttttttttttcctaagtgcaacatttccctgaaaatgtggctttacctattcttatggttttatgaagtcatagagaaagcagcaactgcagttattggcattccggctactactgtggttgatacctacaatttctgttgcaaagtatgcttgtccaagaatacttagaactacatccaatacagcttggaggtacaggtcattacttgcaaattgccaagtcctgtttaagccacaaaatgaagtgtcatcctggccgtgctccagaaagggcaaatatgggttttggtgtgatagatactacccatcaatcagctatttgttgtttggaaattgctggtgacaattggatccaaactttgccacctgttttgcagtgcatggttcagcctggttctaccattccctacaattcatgggttacatataataatattcagcctctccttggtttccaacatgctccagttagccataatgctcccaacttctgtctcatgtcattacttggcatgcacaccccaaacattgagtcctattggaacaaatgtaaagcaaagtgcaagaccacaagaggagtttgtcatgatatgttggactcatatttggccaaatttatgtggtgtgattgatttggaaatgttttcaattcccttttgctgcacatagcagaacaatttcctgttaactaatatgatgttttgactcttggttttagtatgttttggtataaatatccaaagacaaatttttcagttgaatacatctgagaaacaaattgttcaattgacccaggaattacgtacactgctttttggcggtgagtgggcttttacccaattatgtatgtctacctttgtttgagctacacaaggataagaatttatagttgattaaatatgttgcctaagaccatttctgtcaactctgagcaccggcttatagttagaaacttcacgcacacatacacacacacacacacacacacacacacacactgaaatcagttcccatttatatcattttaacctgtgtcaccccttgcaggaacatccattgtaagagtaagaatagtctatattggtttctctcttctataaatgtcattgaataattgctttcctgaagaatcctaatccatatgactacattttaaacacaaatttctccccagtggtcctttggcaatggagaaattagcatgaaatataaagcagagtgcttgaaagaatttccttgagggaaattgggatagcaggagggaaagagatttatacttttcatttagtggcaatatgtactttatccaattttatatcattaggaccattaaaaggcaggaatgtgaaatatgtcttctctgaagacagttcttcatatttatataacattttctgctttaagaagccaattgcaagaaagagtccaatgcgaatgtactgtgctgttcaaagtgtttatttcaagggctcttcatttcccctacgccctccagagagttaaaacgctacatggcctctaatctctaagtacataaccaactctcttctctggacagtcagtttctgaaaatttcttttgaaatcagtgacaaaaatgcctagcctattggtggattccattttgtaagcttatttttacaaatcacagacttctctagtatctttgtaattatttaatctgaccaagtgatttctgggagtaaaatatatttgaggctgtgtatatcagccaagggtgttctttaatgagaaatcttatcacacacaccttctaaatgcatttcaactgcacacaggactgggttttatatttcttggcattatgccaagaaaaatctctaggaacaaggtgagcgtttgatgcccagtggattcacacataaacttgtcaattttcttcgtatctgtattcatcagaagttgttattaaaccacatactatgagcaaacacactctaagtccctctggtgggggatgtgtgacagacagagggacagcagagtttcataacagaattttgaagccttgcctttctgcataattcaaatggcttttttttttttttggagacagagtcttgctttgttgcccaggctggaatgccatggtgcaatctgagctcactgcaacctctgcctctcaggctcaagcaattctcgtgcctcagcctcctgagtagcggggactacaggcattcaccaccacacccagctaatttttgtactttttttggagacagggtttcgccatgttggccaggctggtctcaaactcctgaccttaagcaatccaccctcctcggccttccaaaatgctgggattacaggcgcgagccaccacatgcggctatcaaacggcattttaaaaaagggaatgaggatggtgacatgattggttacttattcccaggtcagtggttagtggcaagtggccactgagagtagataggggcctttctagataattggaggtagtcagcatgaagtcacagagtagacaagacaaggggataaaaccgtaggctaaaggactgagataggtcctggaaagtcccaggggaatattgcaggcagagaatactctctgagctgggttttgctagccatggagagagcccagggcatctaatgccttttaagctagagcagttccaatctacccatgtggccccacacaactttgctaacacctctggatgtaaaggtccttctgtcatctggcagtttctttcagaagctagtgtgggtattacattcacttgtggaccttaaacattttgcttctagggaaagacatgtaaggctcattgaaagcatctggcaagtgtttagaaaaggcttctcctctggagagaaagaaaagcctggaagaagatctgaatgtcggatgcctcaagtcactgcggtcaacaggcagtgttgctgtctaagaggggcagggaccctggtcacaaggccctgacacaaaattgggtagaaattgactcagcacttttcttcttaagaagctcagccctgatttcactctcagggcaacagaaccattatcaagatggccagtgagttaaccagggtgtttccgagatgagggagtgagggtgtaataagacaatgggaagaagagggtctaaaaaaacacacaaaaaatcaccatctgtaagtgaaactcttcctagttttaactacttagttataaatgttaaacacactggaaatgggttatgaatcatccaggtaataagagcaattactgtccagtggtcagtaggaaagaaaatagcatagttcatctgggttttacttccaggtctatccaattgtcagtgggagtctcagtcaagccccttaacctctctggggacctcagtttccccatctttaaatgacagcatttattctaagttcttatccagtattattaacactctatgtaacaaaaaaatgcaacaaattgtatgcgatggttaattttatatgtcaacttgacagggccacagggtgcccagatgtttgtttcaatgttatttctgggtgtgtctgtaagggtgtttccaatgagatcagcatttgtaccagaggactgtgtgaagcagattgcccttcctgatgtgagtggccatcatccaatcagttgaggacctgaatagaacaaaagatggaggaaggcagaattcactctctttgcccaattgattcaattgattgagctgggacgttggccttctgccctcagacagtgacatataccattggctctcctggtcctcaggccttcagactcgtactggaacaacaccaccaactttcctgagtctccagcttgcagactaccgattatgggacttttaagcctctataatcatatgaacaaattccttgtaatgatctctttatgtttacctcctattagttctggttctctagagaactctaatacattctacatttggggacaaagatattgctcaaggctagccttcttatctccagttttactcaaaataattttaggaattaaatacttggtattttctctctttgttcccttcaagcaataattaatttttagtggtttgttcttgggtaggaattagaaacattatgtagctgacagagggctacatgcagagcttataaggaggagctgctttctgcagccagtttcttgatgagaattcagcaggaggagctctttagctgtgtgaacatccatcagaagggtaggtagttagcaggatctacagtattcagcaaaataaaattctcccagcagagaatgccatgcttctttactcattaaggaatgggtgagcccttccctgacaccctgactgttccagcctgtagtcaaagtatcaatgggaaatcagggacccacatacctaccaagtccttttttaggtcttttctttaaagctggttagttatcccatacatcagtgtgcccgaggtcgagaagagctggaggggctgatatttagccaatgtggtcgcttccacaggccctcttattctcatagcagctcagcctcccatcaggaggcatggagccaccaacgcaggggtctaaaaaggtaccaggaagactgggcttgggctgccaatgagggtgcatctgccagtgagctttcacttttagaagatatggcagcttctagctaactttaccagatgctagttgttgaactcttcctcaagtctacaagtggaattcttcagggaaacatggtgtttctctggctgccacaatatttatttatttacctactcaactatttggtggagaacctcacagggcttagagtggtctcagccaaattgtcagctcatgaggcttctgatctgttgcagtgagtttggatttttacccctctggactgtcatcaacagaaaacagaggtgctttgggtttgtttgctttttattttttaaggcttttaatacaaatgtttttaatacaaaatcacttagagaaatacagaaagaaaatatcctacaagccagttactaaataaaaaaaaaatcccaaccagcaaatttgtcacattgggcaggcattagaaaacaggaaaaaagaaaaagaaaaaataaaatacaacgtccctgaaggccgggcacggtggctcatgcctgtaatcccagcactttgggaggccgaggcgggtggatcacaaggtcaggagatcgagaccatcctggctaacacagtgaaaccctgtctctactgaaaatacaaaaaattagccgagtgtgctggcaggtgcctgtagtcccagctactcggaggctgaggcaggagaatggcgtgaacccgggaggcggagcttgcagtgagccgagatgcgccactgcactccagcctgggtgatagagcgagactctgtctcaaaaaacaaaacaaaacagttcctgaaatcaggcaggtggattttagaggccacggggagcttgccttagtcatcctggtgaaatgggatagcagtggtttttggaatatggccaccacctcctctgtttcttgccagtaatcgtcatctgaagggagggtgctagcctgggcaataaatatttgacgtcacttatgcagtctgaggtctcaaagacaagtagccttggagtcttccattccatatcccaacagtctcttgtcactcgatgctgagataatgaagggctagtcagggtggaaagcaacttcattgatggagccagcatggccgggcagctcatacagtattctcctgcttgtggtatcccacacatacacaaacctgtcggctgtgccaggtgctattttgcttccatcaggtgaccaagaacatcttagaaggttcttttcaaagttgtgcacatttccttgaactatgtttacacacctctctttgggggcaaatggccagacatcccagacacgaactgtattgtccattgcattggacaagagataagaaccttcagaacttaaggtcaggccagtcactgaatctgcatggcctgtcatggtgtaggttagtttgttctggcacaggtcccagaccttgatatcattgtctattccaccagaaataatctgatcacttgtgtcattgaaggtcacagctaacacctggtacatgttctgaaatgtttagatggctgctttcttccagagtcccaaagcttaactgtgccatcgtcactgctagtgcaaacaaggtggctagataacaggaattcacaaaggaagtatgtccctttagcgttttaaccctcttgcccgtttcactatcccacacagccacagttttatctgtggatgctgggaagagcatactgccatctgtgttgtaatgcagttccatcactgctccactgtgttccttcagtatggcagaattatcacagtcaccatagacattccacaacaatatcagtcggtcaaatcctgcagatgctaaggtggatcggttgggggtggaacttgcagcagtatacttccccttcatgtccagagagcagcatgattggggcttgaagggaggaacacctcggaggtcctgcttgcagcaaagctcctggcgtcgcctgctgctgcccggctccagggcccgatcccgccactcccaacagcaactcatgccgctgccgcttgactgggaccagcggtaactctgggcctgtacgcttctgctgttctatcatggcggcaaccggatgatgctttgggtttttgaggcccacctgcctccatttttgtgccacttcctccgtggagctctcccatccctcagtgcatagggtccctgtagtgcctctgtcccttccccatccttcaaatctgcttgcagctactccacagctttttgaaggcaatatgatgatgtcaactttattgtatgtgataatgacttctgttgtttctccagggacatctgcatttgaatagtacgaaatccgttaactcacaaagcaatttcaggcaaaagtttgggaggaaactggggagttcttatagagtggggctcataccacatctccccaatcacgttatgtggggttctaaccctcagtcacacatggccaatcctgctcactatacccagacacttcttataattgcctgggaaataactaatgcaaatttgaatttatggtatttttatttctttatttctttatttatttgagagggagtctctctctgtcgccgaggctggagtgcagcggcgcaatctcggctcacagcaagctccgccttccaggttcacaccattctcctgcctcatactccggagtagctgggactacaagcgcccgccaccccgcctggctaatttttttgtatttttagtagagacggggtttcaccgtgttagccaggatggtctcgatctcctgacctcgtgatccgcccgccttggcctcccaaagtgctgggattacatgcgtgagccactgcgcccggccgtttttaatttttttgagaatttgtcaaaagccgtggatcctcatctcatttaaatgtacacaggcatgcatatcttcttttgcgacagagtctcgccctgtcgcccaggctggagtgcaatggcatgatcttggctcactgccacctccgcctgccgggttcaaacgattctccttcagcctcccgagtagctgggattataggcgcccgccatcatgctcagctaatttttgtatttttagtagagacggggtttcaccatgttggtcagggtggtctcaaactcctgacttcgtgatccacccgccttggcctcccaaagcgctgggattacaggtgtgagccaccgcaccccgcccatatccaaattttacatacaattttaggaagggtcaccagacttcctagagctcatcttgggatcccagggttaaagaaagtttggtatttgaagtaaggagacctggattcgagtttccactgtgattttaggcaagctttccgtgttcctgtgaacctgctttcttgcctgtaaaaggaaaaccatagactctatcagtgggtttcaactagatataaaactttaggagaatattgaccctcacagtcatttagaaactggggttgagaactatcaggcaaggagacctctacaatgacctctggctccagcattctttgattctgaggttttactccagaaatctccacaaagttgagaagacactccttctacccctagtggggaaaagagaagatgtagcacgacagagatgcccagaagcctgacttcacttttctttccactctgctccattgtttcatggaagaaaattgaagaaagggagcagagcccttctagagttaattctctttgcattaagagtctattggattggggaaggatttatctattcaaccttgaaaggatagagaatctaatttatctttattttttgagaacctacttggcatatggtaggtacagaatgaatgcgtttttttacttaataaaattgtttctcaagatttattattttttggccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggagcctgtagtcccagctacttgggaggctgaggcaggagaatggcatgaacctgggaggcggagcttgcagtgagccgagatcgcgccactgcactccaacctgggagacacagcgagactccgtctcaaaaaaaaaaaaaaaaaaaaaaaaaaattgattattttttaactaagtaattgtaatgagcatgtgcttctccactccagtgattctttgagaatcaccaatataatattatataaggtttatttttcctgaagtcattgaaatagatatgaatttattgatgaattgaaattcaaggaatatttactaagcttttattatgtgcttgacacagttgaattttcaaaatagtaaagatttaagaaaagggtttatagttccatgctaatactatatatatatgtaagtactacttctgaaaaatattatagtccatttatacctttcctttccattccattccagaaggggggatataaaattttataaaattaaaaacaatttaaaaatattctttattattccctggtttggaacccccccccccaccccctcaccccctgcgttcttcccccgcgttcttctggctaattgctcgttatttcacgtggaaggacccagccacatacatgtgttttggggtggggaagcagcccattttggactccctcagaaggcacctgtcatggagctgaactagcttcactaacagctttatcttcctgtctacctttgcatgaaatgactctgtaaaagttctggctgcatgcaatgaggggtaaccccaggcaccaaaggcagcaatagaatggaccgaaagtgatgagactacatattgctctgtcaatgctgttgctcaaaactgttttcactcaggaaaagattgaattgcttcaaatactgaacttctcccttagaaaatgtacaattgactgagtatgaggaaaaaaccacttttctttcttgaccatagttatgtttttaacgtaaatcatcctagtgtaagtaataatattaataaatatgatttattgtatattatctatgtggtaggctctgtattagtcactttaatgctgacattgtatcgcttaacatatattgaacatttactgtttcagatacccaagtaattctctcagcaggcttattagcttggtactattattgccatcatcctccttctataattgaagaaatgaaggcttagaaggattaaataagttgtcagaggtcactcagcctataaatggtcaaaagctgggattccaatccagcttctctaatcttatttgtaattcaatcctcatgccaatcctataaagtagttatggacatttccattttacagataaggaagcagacttggagaggtgaaataatctgataatggttacataggaagtaaatggtggagccaagcatggaaccagattagtctgactcataaaccaatgtttgtttaattgtgccatactgactagttgtggatttaaagaatgttaccatgtaaaaagggagttacttagctatttaaacttttaaaagactagacatttattttggtttgcctaacaactttcttttcttggatattcagtatcaggaaaatgcctggtacctggagaataccaaaaacaaaaaaaattatgacatgtttattactgcttacaatgatccattttctactttttttttacagtaatatttaagtgaattattctgcaataaatttttttaatacaatccaataactgctttttgaatacctaccacatgcaaggctctgagttagatgcaatgatgatgatagagatgagtaaaacatcatctgtcctgaagaacgaggcgggattcatgcctcacccaggagagtagataggcaaataagctaagcagagtgtcatgcaggtctcagggagggagaacagaaatgtcacatgaagaaggtggaaacagagattggccttgaagatgtacattagtttgtttgggttgccacagcaaagtaccacagactaggtgactgaggaacagaaatttattttctcatagccctggacagtggaagtctgagatcaaggtatgggcagggtagggttctcctgaggcctctctccttggcttacagagagctgccttctggttgtgtcctcatatggccatcctttactctgtgtctgtattgtaacctccttttcttcaaaggacaccagctatcttagattagagcacaccctaatgatctcattttaatttaattacctctttaaaggtcctatttccaaatacaagcacattctgacatactgaggattaggccttcaacatatgggttttgagaggaacaaaatccagcccatgacagatgggtaaactatcaagagaggggaagtctagcagacgaaacaacacgagacagaggttagaagggagcagcgtgaaatgcatttgggggagaaattaagtaacccaacatgatggaaaaaataatggcatttatgagagtcccgagtgccagggtgaggagttgatgcttacactggtgggcactggagtgatttgaaattctctagcagtggagtaatttgataaagctctccttggggactgtcaatcaaacaatgatgtgttggattggctggaaagaatacagagagaaggtaaggatgccctctaggaggcttatctgggagtccagtcacgaggagatgaggatgtgaatgagcaggccagtaatggtggtaggtacatgaacacagtgaatcagagggactccatctttgaatgactccatggaggcttacctcaatgaacctggtgactagttggctgtgtgtggggagaaatggaaggaggagttaaaaaaggctctaaggcttgatgagtcagtggatggtttcatcattatctgaaagaggaaaggcagtgaggtggggtagggggagtaaagacgttgaactcaatttaggacatgtcaagcttgatgttcaatagacaggaatttgaaaaggtgggtctagaatatgggagtgacattggagtatataaaagattattaagttatatgaaaagttttaccaggaaagaaactggagagttattcatgaaaatgttaaactaattgtatttgggaggcagactgcagtttatttgtattccttctttttagtattattcaaaatgtttatcatgagcaactttaataactttataattatattagtgtgaggtatccatgtttcttaagtccctatataagatgggtttaaaatccctgttccctcactcatcataagtctaataccttctgcaagatatctgagaatttaggagcctctcacccaattagtttgtggattgtctaaaactcacaggccctgctcctattttgtatctcatttatgcagatattgaatcagaattttgcttattttatgaagaagagatcataaaaaggctcatgaaaatccttggctaatactagaatttattaaaattcaggagagattgtggggctttacatgcatatgtgcaaataacctaacattgacctagggacatccttcttaaagagtccctcagccatttctaccaactcagcctaagtttatgccactcatctctacttttcctcaggtggacacttcttcttcacccttattttccaatttccttccattttcttaagaaaatcaatttagccttctttatattctactccttctttccagggttggtttttttttcccccccccgggtcttatcttttctacccaaatgtcccaacaaggtatcttcctaaagtaagacaattttttttttttttttttattttgcggagtctctctctgttgcccggggttggagtgcactggtgccatctcggctcaaggcaacctctgcctcccaggttcaagtgattagcttgcctcagcctcccgagtagctgggattacaggcgcccgccactatgcccagctaatattttgtatttttattagagaccgggtttcaccatgttggccaggctggtcttgaactcctgacctcatgattcgcctgcctcagcctcccaaagtgctgggattacaggagagagccactgcgcccagccgacagtttcattcttaagaagaattttagttctagcctttaatatattttttaccatacaataattgatttaaagagtacttcaaaaataactaaatgttggacgtcatggagagagatgagaccatctgggaagagtatacagagtggaaagaaatgaggccttgaggagcgcccacgacaaggggtggagttggggcatagagaaccccgggagggagacaaggaaacatgaggtaggaggatcagaagggtgcagagccaaattgagggaggtgagggctttgagaaggggtgggagataagtctcaaggaacagggttccgaagaataaaaatggaaacaaagtcattgaggccacgggattcggtacagtggtgctattaggacccagacccaggatccctgttgggattgtcacattcactggaggacttgtgactgcctgaaagaatggggacactccagaaatcctacactaactgtataaaactggcagtgcatggtttgtgtgctgttcagagaacccctgaacattgaagttgacttggctgaacgtgtgctcagctgtccctagcagctcacctagtagccagcctggctttttgccctgctgtttgcccatagcagcctcagatgccagtttctctcactcatctctccccagttgcaggggtttgtagtacagaacctaggtccttgactctgcaatttcctgactctgtgaactcaggcaatcactgcatcttctggactcagtttccttatttgttagtggtaataagcataattatacatgccatctgggcctcccagggtcattatgagagtggcatgagaaaaagtataagtataaatgctctgtaagtgctattgactcaggttgcgtgggcttggccaccacttacagaatacgtgatcttcaacaagttatttaattttggtgaccctcagtccccttatttgtaaaatggggataataattatacctacctcctaggactgttgtgagctctaaataagttagtatacataacgaccatagagcaaattgtgacgctcagtaaatgctgttagctattattatactattactattattgtacaagtggtgatgtatttatctatatacatacaatttttttgtccctcataggatccaagacagtccaaagcttatacaatgcagagagatgacttaaattagaattgggtgaaagatggttattccttctgtgttcatgctcctgcctctattccgtaaccaccttccattctgttttctgccagtttgattctgcccctgccaggcctggcttggatccttttgtagcatctccaggctccctgttgtaccaaaaggaatcttatattctgtccagctctgttttgggccagagtgtgattagtaaggaagtggagagagacaaatagagctctcagggctgggaggcaggctggggagaatctcttaaagaaggagaccctgcaaggtgtttggaggctaaaaagaagttgccagtggagacagaggaatgcaatatgctggctagacagataattgatggaaagagtgcctggaacagccaaaatggcatgagttcaaggacacaggtatctaagaacaaagttggctggattttaaaaacagtcttcataaatcaagtgaaacaaagctgtctatctttgcaacctaggaccatcaaaatatctttcagggtaactcctctttgccttcctccacctgaaggtaagtaaggtcagttctaagcaaaactgggaagtctgccaaagtgtatcccctccttccccatacctgtttctcctgtctcttgtcccatactggttgggccattttccctcccatccctgggctcctgtgctccacaggctcatgtctaacatgccaggctccagatccagtcaatactgatggagaccaactaagtggcaggaattctcatgcatattatttaacattacagtacctccatatctctgttctcatagaggaaacaaaaactcagagagggtaggtgtaaagctcaaggccacacagaaagaaagtggtgggataaaattaaaacccaggattcctgaagactggtctagaggcctttccactatttcccactaagtccctacctgttgtcttcagtgaccttcattgacactccacccactttagcaaagctcttccccagctcatgtgaccttcagtcttcagggctgagcatcttctatggttccaggctctgatatcccttcttccactcacagccaccttttctactagcaggcccaagcccatgtccctgttacctccatagctaccttccagcctcaccatctccaaattatcaacaatttcctgggcttcactttctcccctagccagctggggaggcacaactttacctctattctcttagagtttttctgattagcctgagaattaagttgatgtcagataggagaaaaacatacaaatgtatttaatgtcacttttatgtggtatggaagatttcataaggaaatgaaggcccaaagacccagcctgagttgaatgcttatatagtgaattggagaaagattagtaaattgtgaaaatgtgacaaggctaaggggcttgggctagggcagttaattgggtagagaagtaactaggaagataagggttagtgtaacaaggtttgtacagatttccctcagccccaacttcccatcctcgatgataggagtattttttttttctcgtatagggaggacacctttcagatgggaatttcatcttctatttttaaaaagaggaagagtgatcttcttgtaccttctgtttttcaagtacctctaattcaagattgtcaatatgccagttggtgccttttgggggcaatgtgttctgaacttctctataactaaacacatataggccatccctgcaacttctgtactgatatcttccccacttccttcctttccttcctttggccttgcaaatcccaagtttgggaaatctaaatattctcttctctgcatctacataggagcagctactgagcatagtgcagaaaaatctcactttgccaatcaattggccacaagtctccaatgaccagccttgctggggggctcaattcaaacggatggtccttttcttgaaggcttcagttctgttttacttgctactttagtgtttcatctctcttttcaagttcccttcttttgcccaactccatgactccaatctgaagaacctgcctattttttttctggggagaaattagagcccatctttaaaggattgcctttaaaatttagctttttaatccacaaaattgtccgtattagttgtttctgtcctattcctttccacctctgtagcatcagtggttcccttcctgttcaaagctgacatctccctcctaggctgtgctgtggaccacatctctccagacatggcagcctctgttgtcttctttattccttgttcctgccttctgtcactgccctctcagaatacaagcctgtgcaagtgtttcctttttacagacaaaatgaaactcctttccttttgtactctctcccagtagctgctgcctgtctttccttcctagacctgtcctacctgcttctgccttctcatttctgttcaacctcttacctccttgcaccctagctttcagtctccatccctctaggaacactgccctctacaaggtgatgtgtgcttttactaatagctaagggagaggtttcaggccttgctctccttgttctttgagccctccctcccttttatactcctctcctgacttttagggcattgtttttctgaccctccttagcatcttttttttttttttctttctggagatggagtctcactctgttgcccaggctggagtgcaatggtgtgatcagagctcactgtagcctctacctcccgggctcaagtgatcctcccacctcagcctcccaagtagctgggaccacaggtgtgcaccaccacacctggctaatttctttttattttttgtagagacaggttctccctatgttgcccaggctggtctagaattcctgggctcaagccatcctcctgccttggcttcccaaagtgttgggattacatgcatgagccaccgtgctgggacatctcagtgtctttgactctatctttgaatgagttctctttcatcactaaccctccaccttggtatttctcagagattcatgcttggctggctttcttttccctttatacactccccatgagttgactcactcacattcttggtaaatgaactactgcttataactcttagctctgaaatctttgtcttttgtccatttgtcttttctgactgccacatccatattatcatttttacatatctgtgaactggataattctgcctggatgattcacagtcacttctattcagcatgtctaaaacataattaatatttctttatctccccattccatcctgcttcttgaactctccatccctattttctggaaaacagtatgatgaagtacacaaccactcagatcggaaacttgggcatcctgctggactcatcctcagccctgaactgtgccctctgtgcatctggcaagtcatcaagtcctattgactccacttcctaatgatctcttgcatccacattcatcctcatgacttcttaccttaacaatcgcaaagcctgatctctcttatttcagttttgcctcattttactccatcacccatggtgaagccagtgatttcaaatgccaatcaaatcaggtcatttccctacttaaaatcctcagtgtcttccctggcttacagcttcaaatctgggttcgctagcacagtatacattccccttcattggtttcccaatttatagcttaatttctcatcaatttcactcctttgtacttcacaagcttatcatgctgaactatgtggcattttggggacagaaacatttgtctccaaaatgtacaggcaatatgggacccttggtgggcagagcaatacaccattcattctctttatagcttcatgtcctttcacacattgttccctcagagagcattctcacgttcccttggtgaatttctattaatattttgggcatctcaagattacctacttggataagtcttttcccagcttcccttggtaagtttatattttatggcttatctccctgtggggtttttttttttctgattataaatgtcatcactctagaaaattttggaaaatatggaaaaataaaaaataaaaatggcctacaattcattcccccagaaattaatttctcagcattttagtggacctccttttggtatatttaccataaatatttacatatatttagaaaccagtattatactatatattgttctatagcctgctttgttaaaaaaagccatggtaaatattcttcaaaggcttgacatttaatttaaaaaattgattcttctgatttcaaaagaaatgcatgctcatgtaaataaaaatgcaaacagtacagaaatttacaatttagaaaagcaaagtccttcataatcctgtcataggttttgaacagtttgttagcatacgctttcagactttcctatgcttctactaatttcaatatacattaaaaatttatattgtgggacagtatgcttcatctattctgaaactttcttttaaaatatacttaacaacgtatgtttgaaaatgtaaaaacgaactttaatggtgtctcagttgtaatcatcattttgcatttttctcttctactataccctgaggccttggaagaaagctgttttcctgcaagtgaacttaatttactgttttctgagtaatttgggaggatattagacagatagttgtgatcacttctcagagaactccttgcccactggagaagggtgagtcgtggtgggccctggggactgaccatgctttgccgctgctgctggagttggctgacaaggtctcttcttggatctggagcctaccttgactcaagacaggttcctccaaccacaagcccgaggatgcccttctcctgctctctaaaagtgctggtgacactttgtccatgttgaatggtcttcttgtcctatgactccctttatttgacacattctcagcttctgtttctgactaggagctgtaaacttataatccctctttttggttaagaggagaatcactggaacccagctgatgggatcacagggctaaggagtccagagttatttgaatccctgtgtagtccagctaacctgttccatgatgagagctgcctgcctagtccagggagccaccccaaagacaaaagccttccttaatcccagagagggtgtgtgagtaagcagccacccactggcattgccagaagaaacgatggatggtgggtgaggagctccgtgttcccacaatggacaaaatgctgttattatggccagtgtgtgctatatcacattgccaaacccagtgtttcattaaaggggtgttgggggacagggtgccagggatggtgctcatgtattgataaatcaaagtgcttcttgccttttctaatcttttgcatctcctgttctgttttcctaccatttaaatctctagtgtaccctaatatgacagtgtggttaaataaatgtggccatgaaattcagagaaagaaaagcttattcttttcagtaatcgtcagttaaaatttcacaatgatacatgctttatacttttcagacacaggttaggaaacatctatctccaaaaggtacaggcaatatgggagcctcagtgggcagagcaaacacatgctaaggtcattttgttgggtcaggggttgaggggggcattgtcatgggctttttaactaaacaaatcgccaatcaaatatcttccagattctgatacccatgctgaattgaagggcctttttgacaggtgtaatgtttggccaaatattaaaccaaaagcaattattaaaacaatactttaaaaatgtttattttaagaaaatttgtacaagtatacaaaagaagttcaactacaattagtttctgagttatgttgagtcattaatcaaaagcttcagtcctgaggaattctgcgaagttcaccactgcactttgcctgcatcgcttttgtggttttcccagacatcttcctaaagcatttgaaagtaactttccttccgcctgctcccccagtgcccaggcctcttacctttgtatagctgcaaacgatttgcaattgccaacctgtgttttccttaccgctaggaccagtagactgtgatttttttttcttattctgtattaaacataaaaaacttagctctaaatataattgcatccttcatttgtagaagttgatatgttcctcatgacagctcagagacataagaagcatcaaaagtagaaaaaaaaagaatcagtgtagaccatttctaaatatagtcagtcacttataaagtacaagcaagaaataaagtaaatagctggtacctattgaacaattaggtgtcttgtagcttattgtgagatggaggacaaatcactaaacttccttgagcctggttcctcatctgcaaaatgagaacagtaataccggccctgctggcttcataagacccttgggagggccaaataaggtgatgtctagaaaataggaaagcacttttaagatttgtttttttttggaaacagagtctcgctctgtcacccaggctggagagtgcagtggtgtgatgttggctcactgcaaactccacctcctaggtttaagagattctcctgcctcagtctcccaagtagctgggattacaggtgctaccaccgcgcctggctaatttttatatttttagtagagacagggtttagccacgttggccaggctggtctcaaactcctgacctcaggtgatccacccacctcagcctcccaaagtgctgggattacaggcgtgaactactgtgtgtttttaaataataaaaatacaagacagagtggtaatataaaggcatgcctcctccaaaatgcaggagcagaggctcataatttgaggatgtttgtccttgctagagatttgaagagatggattcacatgtagaaataaacaaatatcaactggttagatcacagaggagaagcctcagaacatcagatcaagaacatgtagaacatgcagaaaaggcctcaaggcaacagtttgctttgcctgtgcagcagccttacaagaattcatggttttccagtgtcagtatcttagattctgtgacctgtcactagggaacctactctgcaaggctggcaaggaaactaacctcccatcccagggccaatttgctttacagaacattagcactgttcttgcctttgggcttgagcatcactggaaaatggcttcacacacaggaatgcttccttgtatggacttttaaaatgctctttcatcttttgttcttcaaactggctattcctatcagtaaagcctatatgcaacccccatgttttttatgaatccaatttaaagacacacaatacaattcttgtaagtgagaaaatgtcacagaggggctcagtcagaagttgacaaaatgtgcccgggttcttacagctattgtggtttaagggcaatacttaaaccacatagtatttttttaaaaaatactttcaaaaaaatgtcttctttttcccattgatataatgctaaatgaagagctgccagctactgatgacatttgcttttgccgcatttttacccctcaatttgcttgttcattccctgcctcatttaatgctatccccatgaacaaagatagccaaaggcacaatcccaggtgatgcccaaggcaagcctcacaaacaagactgaatttgatgtgaaggaaaaggactctgattctccaaatgttttcctttactgttggctaatacctaaagttttacagctagaacatcctttctttggaatgtccctctctgttcctcttctctatttccaggcaccactgatctgcttttggtctctatagattagataatttgaattttataaaactgagtttgaattttataaaactttatataaatgaaatcatacatgtatactctttttttggtctggcttctttgattcagcttaataattttgagactcatccatgttgtcgcctgtagcatgagttcattctttttattgcagagttgtgtcccattgtatggatctattgcaatttatttatttaccttttgatgattttgggtagttttaaattgccattaacattcttgtctctttgaggatttttaaagagatcttgttactagtttttgatttaattccaagaggattagatttgaatttttaaaagtttattgagacttttaaaatatagcttagaatataatttattttggtaaatgttccttaaacacttgaaaataatgtgttttgctgttgttagggttttttataaaggtcaaacgataaactggtggatagtgctgttcaagtctttgatatcactgctgatttctatctctttgtttaattaaatattaaaagaggggtgttgagttctccaaatgtgatgataaatttgcctttttttggcaattctatcagtttttgtttcatgcatttttgacgttctgttattaagtacatgaatatttaggttcgttatgtcttataaataaattggcccttttatcaatatgaaatgagcttctataaccctagtaatattatttgctttgaagtaggctttttctaatattattatagctaatctggctttctttagattagtattatgatagtaaatatttttcaatccttttagttttgatctatttgtgtctttatagctaaagtagctctcttgtaggtgggagattgagtcttggttttttatccaatttgacaatctccatactttctaattgggtttaattaaatgtaaattaattacatttcattgtttttaatgtaattattgatatggttggatttaaatctaccattcttgtatttgttttctacttgtcttatctattctgtgttcccttttacctctttttctgtcttctttatggattaattatattttaatgattttttccttttttagtttattagttataactctattttgttattttagtcattgctttagggtgtttaatatatagatggttcttaacttatgaagatttgacttatgattttttgatgacacaaaaacaatacaaattcagtagaaaccatactttgagtacccaccatacaaccattctgtttttcactttcagcatacagtatttaatagattatgagatattcaatgatttaatagattacaagatacttattatacaataggtcttgtgttagattattttgcccaactctaggcaaatgtaagggttctgagcatgtttaaagtgggtgtattagtctgttttcacactgctataaagaactgcccgaggctgggtaatttataaggaaagaggtttaatgagctcacagttctacatggttggggaggcctcaggaagcttacaatcatggcaaaaggggaagcaggtgcatcttacatggtggcagatgagagagagtgaagggagaagagccccttataaaaccatcagatctcatgagaactcagtcgtcactatcatgagaaaacatgggggaaactgctcccatgatccaaacacctcctaccaggtcccttcctcgacatgtggggcttatggggattaaaattctagatgagatttgggtggggacacagccaaaccatatcagtggctagtatgatgtttgctaggttaggtgtattaaatgcattttcaacctatgatatttttaacttacagtggatttattgggacgtaacttcatcataagttgaaaagcattcatatatctttaatttattatagttaactttcaagtgataatacaccacataaagcaaaagaatcttaaaaatatacttgtatttcttacctcccatccttttgtacaattgttgtcatacatttttcttctctgtatattatagaacccataatatattgctattagttttatgttaaatattaagaaaaaatttaatatttacctataacaacccttatagttattacttctcatgcttgtcattcttttatatagaaccaggtttccatttgttgttttttttttgttactgaaacgctttctttagcattctagtgttgcaagtctgatgatgatgaattatttcagctcctttatagctgaaaactttttgatactcactttgttttaaaaatagattttcacttaatatagaattacagattgaaaagtttttccttttggtacttccactattttctggcttacattgtttcctgtaataaatctattctcattcttatgcttcttcctttgaatataatgtgtttgttccctttggcttctttttaacattttctttttggcacttatttcaaggaatttgattatggtttgacttggtatagctttctttaagtttcttacttttggagtttatttatcttcttggatccaagggtttacagtttccatcaaactgaaagttttcagccattccattattttttcaatttttaaaattcccacgtcccccagttttcagggattttaattatacatatattaagctacttgaattatccaacacctcgcttatgctctgtgcattcatttttaaatctttttaaaagtttattatactttaagttctgggatacgtgtgaagaatgtgcaggtttgttacataggtataccagtgccatggtggtttgttgcacccatcaacccatcatctaggttttaagccctggatgcattacgtatttgtcctaatgctctccctctcctttccccccacccccaacaggcccgggtatgtgatgttcccctccctgtgtccatgtgttcttattgtttaactcccacttgtgagcgagaacatgcaatgtttggttttctgttcctgtgttagtttgctgagaatgatggtttccagcttcatccatgtccctgcaaaagatatgaccttatccttttttatggctgcatagtattccatggtgtatatgtgccacattttctttatccagtttatcattgatggacatttgagtaggttccaagtgtttgctgttgtgaatagtgctgcaataaacatatgtgtgcatgtgtctttatagtagaatgatttataatcctttgggtatatacccagcagtgggaatgctggatcaaatggtatttctggttctagatccttgaggaatcgccacactgtcttccacaatggttgaactaacttacactcccaccaacagtgtaaaagccttcctatttctccacatcctctccagcatctgttgtttcctgactttttaatgattgccattctaagtggtgtgagatggtatctcattgtggttttgatttgcatttctctaatgaccagtcatgatgagcttttgtttcatatgtttgttggctgcataaatgtattcttttgagaagtgtctgttcatatactttgcccacttttggatggggttgtttgattttttcttgtaaatttgtttaagttctttgtagattctggatattagccttttgtcagatggatagattgcaaaatttttcttccattctgtagattgcctgttcactctgatgatagtttcttttgctgtgcagaaactctttagtttaattagaggccatttgtcaattttggcttctgtggtcactgcttttggtgttttagtcataaagtctttgcccatggttatgttctgaatggtactgcctggttttcttctagggtttttatggttttaggttttatgcttaagtctttaatccatctgaagttaatttttgtataaagtgtaagaaaggagtccagtttcagttttctgcatatggctagccagttttccgaacaccatttattaaatagggaatcctttccccatttcttgtttttgtcaggtttgtcaaaggtcacatgattgtagatgtgtggtgtaatttctgaggactttgttctgttccactggtgtatatatctgttttggtaccattaccatgctgttttggtaccattaccatgctgtttttgttacggttgccatgtagtatagtttgaagttaggtagcatgatgcctccagctttgttctttttgcttaggattgtcttggctatacaggctcttttttggtctcctgtgaaatttaaagtagttttttcaagttttgtgaagaaagtccatggtagcttgctggaaatagcattaaatctataaattactttgggcagtttggccgttttcatgatattgattcttcctatccatgagcatggaatgtttttccatttgtttgtgtcctctcttatttccttgagtagtggtttatagttctccttgaagaggcccttcatgtctcttgtaagttgtattcttaggtattttattttctttgtagcaactgtgaatgggagtttactcatgatttggctctctgcttgtctatcattggtgtataggaatgcttgtgatttttgcacattgattttgtatcctgagactttgctgaagttgctcatcagcttaaggagttttttggctgagatgatggggttttctaaatatacaatcatgtcatctgcaaacagagacttcctctctttctatttgaatatgctttatttctttcccttgcctgattgccctggccagaacttccaacactatgttgaataggagtggtgagagagggcatccctgacttgtgccaattttcaaacggaatgcttccagtttttgcccattcagtatgatactggctgtgtgtttgtcgtaaatagctcttattattttgagatacattccatcaatacctagtttattgacagtttttagcatgaattgctgttgagttttgttgaaggccttttctgcatctattgagataatcatgtggtttttgtcattggctctgtttatgtgatggattaagtttattgatttgtgtatgttgaaccagccttgcatcccagggatgaagctgacttgatcgtgatggataaactttttgatatgctgctggattcggtgtgctagtattttattgaggatttttgcattgatgttcatcagggatattggcctgaaattttctttttttgtgtgtgtgtgtctctgccaggttttggtatcaggatgatgctggcctcataaaatgagtcagagaggagttcctctttttctgttgtttggaatggtttcagaacgaatgctaccagctcctctttgtacctctggtataatttggctgtgaatccatctggtcctgggctttttttggttggtaggctgttaattactgcctcaatttcagaacttgttattggtctatacagagatttgacttcttcctggtttagtcttgggagggtgtatatatccaagaatttatcaatttcttctagattttctagtttatttgtttgtagtattctctgatggtagttggtatttctgtgggaccagtggtgatatcccctttatcattttttattgtgtttatttgattcttctctcttttcttctttattagtctggctagtggtctattttgttaatcttttcaaaaaaccagctcctatattcattgatttttgaagggattttcatgtctctatctcctttagttctgctctgaccttagttatttcttgtcttctgctagcttttgaattctctcttgcttttctagttcttttaattgcgatgttagggtgttgattttagatctttctcgctttctgatctgggcatttagtgctatatatttccgtcttaacactgcttaactgtgtcccagagattctggtacattgtgtctttgttctcattggtttcaaagaacttatttatttctgccttgattttgttatttacccagtagtcattcaggagcaggttgttcggtttccatgtagttgcatggttttgagtgattttcttaatcctgggctctaatttgattgcactgtggtctgagatactgtttgttatgatttttattcttttgcatttgctgaggaatgttttacttccaattatgtggtcaattttagaataagtgctgtgtggtgctgagaagaatgtatattctgttgctttggggtggagagttctgtagatgtctattaggtctgcttggttcagagctgagttcaagtcctgaatatccttgttaattttctgtcccattgatctgtccaatattgacagtggggtgttaaagtctcccactattattgtgtgggagtctaagtctctttgtagctctctaagaacttgttttatgaatctgggtgttcctgtattgggtgcatgtatatttagggtagttagctcttcttgttgaattgatccctttaccattatgtaatgcccttcttggtctttttggatctttgctggttcaaaatctgttttatcagagactacgattgcaaaccctgcttttttttttttttttttttgctttccatttgcttggtaaatattcctgcatccctttattttgagcctatgtgtgtctttgcacatgagatgggtctcctgaatacggcacaccaatgggtcttgactctatccaatttgccagtctgtgtcttttaattggggcctttagcctatttacatttaaggttaatattgttatgtgtgaatttgatcctgtcgttatgatgctagctggttattttgcatattaattgatgcagtttcttcatattgtcattggtctttatattttgattttttttttttttttttttttttttttttagtggctgctaccagtttttccttttcatatttagtgcttccttcaggagctcttgtaaggcaggcctggtggtggcaatatccctcagcatttgcttgtctgtaaaggattttatttctccttcacttatgaagcttagtttggctggatatgaaattctgggttgaaagttcttttctttaagaatgttaaatattggaccccactctcttctgagttgtagagcttctgcagagatatctgctattcatctgatgggcttccctttgtaggtaacctgatctttctgtctggctgctcttaatgttttctcttcatttcaaccttggagaatctgacaattatgtgtcttggggttgcttttctcgaggagtgtcttagtggtgttctctgtatttcctgaatttgaatgttggtcaccttgctaggctggagaagttctcctgcataatatcctgaagagtgttttccaacttggttccattctccttatcactttcaggtacaccagtcaattgtagctttggtcttttcacatagtcctatatttcttggaggctttgttcattccttttcattcttttttctctaatcttgtattcacattttatttcattaagttgatcttcagtctctgatatcctttcttccacttaatcgatttggttattgatacttgtgtatgcttcacgaagttcttgtgctgtgtttttcagctccatcaggtcatttatgttcttttctaaaccagttattctagttagcaattcttgtaaccctgtatcaaagttcttagcttccttgtattgggttagaacatgctcctttagctcagaggagtttgttattacccaccttctgaagcctgcttctgtcaattcatcaaactcattatccatccagttttgtgcccttgctggagagaagttgtgatcctttggaggagaagaggcattgtggtttttgaaattttcatcacttttgcactgtttttttcctcaacttcctggatttatctacctttgatctttgatgctgatggcctttggatggggtttttgagtgggcatcatttttgttgatgctgatgttattgctttctgtttgttagttttccttctaacagtcaagaccctctgctgcaggtctgctggaatttgctggagttccactccagaccctgtttgcctgggtatcaccagtggaggctgcagaacaccaaagattgctgcctgttccttcctctggaagcttcatcccagaggggagcctgcctgatgccagccagagctctcctgtatgaggtgtctgttgacatctgctaggaggtgtctcccagttaggaggcatgggtttcatggacccatttgatgaggcagtctgtgccttagcagagctcgagcgctgtgctgggagatccactgctctcttcagaactggcaggcaagaagctttgtctgctgaagctgcgcccataggcaccccttcctttaggtgctctgtcccagggagataaagttttatctctaagcccctgactggggctggtgcctttctttcagagatggccttcccagtgagaaggaatctagagaggcagcctggctacagccactttactgcactgtggtgaattccgcagaaattcccaagggcttaacactgtgaggggaaaaccgcctactgaagcctcagtaatggcagatgcccctcccctcaccaagctcgatcatcccaggtcaacttcagactgctgtgctggcagtgagaatttcaagccagttgtccttagcttgctgcacgatgtgggaatgggacccgctgaatgagaccacttggctccctggcttcagccccttttccagcggagtgaatggttctgttttgctatggttccaggtgccactggggaaccaaccaaacatacaaacaaacaaactcctgcagcttcctcagtgtctgcccaaacagccaaccagttttgtgcttgaaacccagggccctggtgttaggcacacgagggaatgtccttgggtggtctgaggcttgcaaaaaccatgggagaagcatagtatctgggccagatagcacagtctctcacggcatcccttgtctgggagagagaggcttcctagctccttgcacttcccaggtgaggcgatgccccaccctgcttctgctcaccctccatgggctgcacccactatctaaccagtcccaatgagatgaaccaagtaccttagttggaaatgcagaaatcacccgccttctgcattggtcttgctgggagctgcagacctgggctgttcctattcggccatcttgccagatcccctgtgcattaattttttattaataaatataattttagaacagcttcagattaatagcaaaattcagcagaaaccacagaaagttcccatataccctatcctccccaccccaacaatctctttcactatccacatcccacacacaacagttaatttgttacaatcagtgaatccacaccaacacatcattatcactcaaagttcatagtttagggtgagtgggtccactgtagcatagtcagggtgagtgggtctgctgttttccttgcctagttctgctccagcagcagtgtcagcgcaggggcgggggactagcaggggcagggctggcaggctccatgtccaccaatgctctgatgacaatgacattgcggcaggggaggggaagtgcagtgcactcatgccggcagcagtggcatggtaggctgcatgcatacactcatgctggtggagaagggaaggcaaggatccatacacacatgagaggtggccgttggtgagtgcaggtatgtaaagtggcatgtgggaggctgcggtgtggggagggctcaggcaggctagtgcatgtccatgagggctgctttgctggagcattctgctggtcaggtgcatttgccagcacaggagctatgatctaggcccccaggaggtatctgggtgctttattgtaagcaggcacaattgggctggggctcccacagaggcgagcagaccaaggggttctcaggtcagacagggctcatctcattggcaagactgccctgcagagttcaggtacaatagtttctctggggctaaagtctcctgtgggagcaagttgagcctgtggggatggctgtccctggccatgctctgctacagatgcttccacaccaaaccctctaggctcaacactggctggagttctgctcctaccacttctctaagcagctctccctgccaactcaagtgtctgtcatggttgaggagtctcctcctgctgggattccagaggcctgtggtgagagtgggttgcttcttgcctcttcaacttacccattcaccccttccacagaagtcactgggggccaggaacaagtcttgggtgtagccctctgcagtgttctcggcttcctcctccttcagcccagcaactgtgtcttccctccatccactctcaacgccttttctctaacgatctgctaggagtgcaccagtcttcctaatgtccctgtccctcagtgggagatgttctttctggctgtgtctagtcagccatcttggagcaggaatccctggcatttcttttcagttctttcttagaatttccgtctctctgcttaccctacctatctgttcttgcatgttgtctactttgtccactcagtgcccttagtatattaatcatagttttatttataatgtcaacagttttttggtcatagatattgtctgtcatgttaaggtaatattgtttattcctactgtgccagtggtattattttttaaattggaaatcaatgttgaattctgaaaaaaaattctgaataaataatatctcacttatttagattactactaataacagattttttaaagttggagtaaaaacctccttacattactgaaataaactctacttggtcactgtgtagtagtcttttacttgctataagttttaatttgcaaaaattgtatttgtagtttttaccgctagggttatagtgagataattttttaaagtttttagattatctttgacaagttttggtattagtggtgtgatattttaacatacacacaaaagatgatcttttcatcttttgtatgcacagttggtaaactatggtatgacccacatgacaaattattcccatcatttgcttttacaaataaaatttcactgggagatattcatgaccatccattaatgtattgcctgtggctgctttcccactgcagtggcagggttgagtagttgcaatagagattgtatggtacacaaggctgaaaatatttattctctggtcctataaaagtttgctgatctctgatttagcataatttagatagcatagaaatgctttctgtctcttgatgatctagaggagctcactcctgaaacaaaagcatgggctctagagtaagatagcattgggtttaaaactcagctccagcccacattattaatgatgtgatgctgggcaacatacttaaccttcctatggaccgttttccccaactataaaatgtgaatagtaataaaaataataatacttgcttaaaataatactataaagaatgaaatacgttaacacatgttcaaaatacttgtcagaatgctaggaatgcatacattcttaaatacaagttattgttatgtttctcttgggagagttttttgatactgccgtcaaatcatgtttgttttctgcagtacccaaaggctatttgctgccaaagatatattcttaaattaagtaaattagttttttatctgaaagtattttttccaatccagattctttctatcaaatatatgtttttcaaatcttacagaaataatattttctaaagtttactctgtcttttcagcaagtctcttttatagttttgtattctttcttgctttgattcttcagatcttcttctaaacttctgtgattactcatatattcagtgattgtttttcatttgtgcatcagggggaatcatcttttgctcattgctgggactgcagataggtccagatcatacttatttgggtctttctccaatatttcaggtctgggcacagggtgaaaagaagagcttagagtagaaaccaagatgtcagtgggagtaggaagacagctattgtttatttaagctgtaaggctgaaagcttcacttgtccaaaaaagtttattttctatgacgattacattcataagttagctgagcactttccaaccactatatttactgaattattaggagccatgcactcccaggtggggcgggactgagatttgccctcctactcatcgctgcatggccttctcttgtctccagctcctgtcacttgtagaggtttggctcagggtctcattcactaacttcccaggtgggaaattactttttaggttatgactcagggtttggtaggctccttttaaaatctagtcttacatgtattttatcttataggcattttcaaagttaccagcatatagaagagacacttccctctgtttagaactgacataaattctctatctctatccatttgaatagaaataaggggcaagctggccggccatggtggctcacacctgtaatctcagcactttgggaggccgaggcgggtggatcacttgaggccaggaatttgagaccagcctggctaacatggtgaatccccatctctactaaaaataacaaaacattaactggatgtggtggcacatgcctgtagtcccagctactcaggaggctgaggcacgagaatcgttggaacccaggagccggaggttgcaatgaaccggattgtgccactgcactccagtctgggcgacagagtgagactctgtctcaacaacaacaataacaacaacaacaaaaataaataaataaaaataaggggcaagctaagttgggcagctaggatgatggactcgaatcagatgtcaattgattttcttatttttttaaaaattgtggtattcaaacacaagagaaaacatttctatcaaatagccaacatgtacaacacaaaaattatatatctcttaaataccttggcaattgataattatattaagtgagttttgtaaattacttgaaaagataattgtaagaagacttcttttctttgccaactctggggtaaagaagggattcttagaaagaacattttcacggagaaggcaaaattccaagtttcctttctcaagcttaattttcatagattgagctatattggttctatatctgtgtccataagtcagttattcagataatgaaaaaaacatttaaacatccaccttggtatgaatttttggtttccgtgttttaatttaagccaaaatattttttggtttgaatttattatttcaataaataatagtgaaattatttcactattccactttgctttgcatgtgtgaattaagccagtggaagcttcaggtgtaatagaatttgatggcgttaataaatataaaagtgaatttgcacaaaaaatatgagatgaacagtaggaacacctggcatgggacagaacatccttgttagtatgcaggtaaattcagttactttcattttcttttctcccctatacattggttgtcaggtccgatcgatcatcaagtccagttgtttctaacacctagctctctccctaaactacccgctccttcctctgcactgagacataatctcttgcccccaaattcagtggcctctgaagaggtgcttttagactctgccctcctctaatccccattgtctgtcctacattgacttctaaaatatggatctggccttgtcaataccctgactagatgctttaatgcctttaaggataagaactgaaatctttaccattgcaaaaagtggtctcaatcatctgtgcaatctgagactttccccaggcccttcagtccaggcacatggatagtcctgttgttcctagaagacgtcatgctcttttatgcctctgtgcacttgtacatgctgttttgtttgccgggatcacctttgcccctttactacattactgtgcactgtcctatcatattctaccttcaagaatcaggtaaaacatcaccaagcccatttggggagtttgcactccccagtttttggcctctggagcatttgcacgtatctttatttgatgatggttccctagcattcattccctctttctttgaccagtggttctcagatccctggggatctgtctctcctccattgtcaggttatggggattggcttgacctcacactcaacccaaatgatggctctcactgacttaagaatatttcactttcctggctccagtgactggctcaagggtgatctgagccagtccaattagcatgaacccaaaaccatactgtggttgtgacacacagacatcacttctcttctgggtttggtggtatgaggcttagattcctatgaccatccccctgcaacaaggagaaccttcctgaggctataaacaagcactttaaggaggaagagttgagagaaggagcctagaaacatcagtgaacccccaaatcagggcaaggctaaagctagttctgccttctaaactactcttcatgagccaaaaacaaataaaagttaactaactgaaactgactaaccaccattttttggataacccagcataggtaaagtttgtttatttacatttatctttgcatttcaacatataacagccacctggggacatcatagttattcagtaagcgtttatgaaaagatgggaaggaaggagacttgtagtttttcctaagtattttctgcttggctatgtaagtagcaaaactttgctctgatatttttagatttcaatccttttgtattttatttcttggaaaaaatatggaaaaaatgtttcagtaaaagcaaaggacttacacaagaaaaaatcaggaatttctgtttctcatttatttttaccaaggagcctatcagagaatttgcaggacgtgacattgtctgtccctggaaggcactagaaattgagggactgtaaatttgcagctgttgaaataaagtgttagattttggtttttaaataatactctattttgtgccaattatcttctttctccagatgcactctctttgcttctctaccctgctctgcaacccagaaggcagacctgcatggcctacatcaataagaggccttatcatttggtttggccaatgggaatccccagcaggtggcagggtgggagtagtgggtaggagtagtgggtaggagaagaagaaaatgtggttggggtatttatgtccccattgggtatttatactctccttgcaggggatcatctaaggctgactctgtctcttgaccagaggtagtttagtccttgataatgggctctaggcagcctactctttatgactctgtctaccttggttctagcaaatattccctcctctcttttgcaactcaccctaggttactgcagcaacccttacaattcttctacacctttgcaaataaactcatttgaactgcctaatttgagtgtgccatctgttttctggtgggaacccaagtgatacatgtatatttcagaaataaaaaaattaaacaggaacaatacaaatctaatccacttttatgccgctacatgaaatattatcttttaagattggtggaagaatagaatccatgttagctgtgcccatagaaaaatgactaaaaagacaaatcagagaggagaaatgcttagagggcttccttggttgtattcaagcaggtcttcccgttgcacaacctcaggggtgtcattcacaggataattcaggctaactttaggaaattttgacaaccagaactatttctgtttaatatatagagaatgagaggaaatcaagtacctttatttgggtgaaatgaggttaaaactggtactaacaagagccacaaagagaaaaagaaatctccaaacaactcagcttcttttggccttgggttttgctcctttagtgtaaaacttctgaaataatacagaccaagagtggtgattcaaagtaagaaactttggtttagaggtttgttcaggtcagaatacatgatatatttttttttctagcaccaattggcagaactaccagattcctaaggcttgtgctatatccttgtctaattctttagtcatgactgggaccaaagtttgggaacttcctgcatcctagtttgggaaagggtggatcatcatgatttcccattcctgaaggttgccgctgctcctacttgatctttgcaacagttgtgttctctgagaagtgtttctaacttctctcccaatgtctacccttctttttgatgctcctcctttttcacggccatgcttcccatcttgcgaacagggctgtgcctctatctcagcttggctttctctgaagtgcagctgtagcagtgtggagttaaaaataacgacatcttgtgagactaggaaggaggatgagagtggggagcaggaagcatgttcattaatggcttttaaatttccaaatgacccctctgagtcactaacagacttggctaagaacatctctgacaacttggagggggaaagaggtgtttctgtgttgtactctgagtgtgttatgagggtttatgttaacaaggagggaaaaaaatacttgcccatactgacaatgagctgaatttcatgctgtgagaaaccagaacaaactgttaattctggtgtaagtcagctgtccaagaatcctgcatcctgactgcttgccctggtatcacaatgttcactaattagccagcattcttactatgtgggcacatgttctatacacagggcaagccaaaggttctatagtgaaacctcactcattcatacctattggaagtggccatcaggcttaatgagaaatctcagttatgggatagttatttcaggtgtatagttctcaagaatacataataatataaatgcataacgtaagaaatgcaaagacaggtatttttccagccccgctttaatggataaaaatccagggttattcatgtatttagtgttaaaagaggcgtaagatactatgttttttaaacttaattttttaaagacacagtcaagtggagaagtaaatttgtatacaatcacatttagagatgatgagttccataatcagagtgtgtatggtattaatggtgcagagaagacacagtttggcttggtggaaagaggggcaagagccagggaatgcttctggaagggacgtgggagttgagctggagttggattagggtgggtactctaggcagagcaaatagcatgtgcaaaggtactatggcagggaaacagactgtacttatgttaactggtattttgtttgcagtttattcaaaataatggagaatgctctcctttaggggaaaaggtcatgaaagggctcctgcctatgtacaatgcttaccttaattaataagccaacactcacgtcaatgaactttagtctaaaagcataatgctttgaagaaaagaaaatttccaaatatttcctgaacattaaagacaggtgttatggctttgatagtttagacaaaatatagactgcatgcatttcagttcatgttgatacagatactttcaggaatctgaaaatatctgtactttcaggtcacagatgtgaacagaacacaagatgtctggaaaattccaccatagcacagaggcataaggaagtatgttgtgtgggggctgacaaacatgctcaatattggtgtgtctgcaagtctactaaatttatttcaaagagtttattctcttatcaaggttaaatgccttcagcatcttgttcaaactgtttattgcatagcaaacatttctccagaatggcagaaagataagggcttggagcagtgacggaaatcaaatgagctaatttcaaaccagtgcacttgcattccgcattagacattagagacaatttcttgaaaaaaagatctttaaactgttagcttgatattaatttaaaactactaaatcatcaatacattgtgccagtttccctgcttccctgcaggacatctacaatgatctgcactcctcatggctgctcactaagcaaactgtcagactgcactgggttattgaattggagtggaagaagcacaggctgagactgtcggtgagctgagggttgctgctcaggaaggcatgggcagctcgctgaccaggaatgcctctgcctccccttgctttgtttgagaacttggccctgctctatggagcagggcctccattttacttggggtacatttcactttttctgaagtgttgtgtaaagaacagaatttaggctagatatgaatgtatacagatctcattcttagttttcacactatcctgggttataattctggattgtatctgtagtacagaaaatttgggtgatttcctatgcattctgtttatgctttctggaggtcagagggctccagcagatagaggttatttcctcagcctgtactagagagagccagtcatcatgatatttacaaaacactcgcatcatccattcatctctgcatgcaaaagataattattgatcaccatgatgtgcctgacaccatgctgagagcagccatgctagctaaaatggcacctcacccatcaccaaaccgggtccagagatggtcctaaaattcaggagcaagtggcagcactgacactagaagctgtgtcttttgatcccagaccctgggctttctctgctccccacagggttccctgggagtgggctgggactgtacctggcaggcacctgcatctggaagccatgcttcagtgtctcttggctgggtattgcccttctggaaaaatcccttccactttcaaagttattttattatttacttgctcaaagaggacatggggtaaacaaattcgtgggtgggtgcctcatagtatgattttccacagggtttggtccaggaagcagagttggccaaatgcaatgtggaggtttcaaagattttttaaaagagagaaaaattcctttgtgaatgataatgaaatccaagctgtcaggctgtgtttggtgtcaaacagagatttgagatggtcctcagtatgagtgtgggcagtgaaaaaaggggtgcagtggagtgtcctctcatccatgctgagagaatattgaagaggagtcagaaatgagaatcaaattatcatgactgaaaattttcataccttattctggggaactatatatcaaagggggagaacaaaaaaagtcacaaaatgcattactaattagaaattgtcttcaaggtttgcttactgcctgatgcattccagcaaattattacttttgaacttgttaaataattatctgcaatggttaatatttgtaatatgcaaacatgcattagttttagatatatggccaatgcaatgggttggatttctgggtaatcatcagttgcttcgtctggatattatcaaaacaggtagatgcctttcagccctaatataattgactaaattctaaaatcaatctctcagcttaataaccccaggtcctatgccaatgcccacacacaggatgatcaattaagcactattgtggaaaaggcattcaaagggcagtttgttccttgctatcatattatgccccatgaagatggaaatagatgattcagtaacggaaaactcagccaatttacttacccatggccaagagactggcttactttgacacttctcataattctgtggtgattactcaaaggaaatgaatgactccaggaaactgagggatatgtctatctatgtgacagtccaggtggtgtctgaacttgtggcaggttgcccaacagaatttcttatctgagatgtggaaagcccagcaagagctgttcacaggaagaggctctgaggaggagctagaattggaggaagagtttgggctctcaagtcaaaaccggaagggaaacagggccagaaggggtgatgctggctaatgtggctgcacagagagttttgtcctccagatttcaggtatctgatgatactgatgagctctttactggggtgcaaggaagccttgtaagggaacttcatgatcccccaccatgttagttcagtgaatcaagcatcttcctggttcccagttttagtgatagttcatcctgtagatgcagctataggaggtggagtgatagaaagaacagaggctgtgtgcagaccagggaagaggcagtacattcttcacctggaacactcaagtccaagcagagaaaaattttctaacctttcccaggggtattttcagtttattgatctctctagaaaacttgaaaatcctcaaaggaataaagtgttagtgatggtttcagatactatgaaagatgatggggtagatttcttttatgaataaaaaaatgctgtttttccttcagtcattccacaatcaagagctaattatgaaatccctactatgtgcaggctgtgggccaggctttagagatagctacaatggagcagaaacagattggttggaggtgctcctggatgttactggctatgtgggggatgcgaagggagacaagcagacaaatgattgtaaactcacacccactaccaggtggcaaaggatgacacttctgactcctagagtttattgcagaggtctgacctaagcagctaagacctccagaaattgatgattgggttaaaatcagaagggtaggcacagaggggaggcgagcacttcaggcagaggaactgcaaggaagcacttctgggatgggaggagcttgaggaaggcaaagctctgaaagtgtgtcacatggaaagggcaagagggaaggtggtgagaagtgctgctggagcataaatcctgggaccttgtagatagtgcaaaattgtgaccgtgtcagctagatagtgcaaaattgtgactgtgtcaacagagtaagtggggaagccgtggaaggcttttaaggcaatgaggagtgatgtttcaaaataaagacactctgaccactatttggagaatagatttggtgggacgagtggaagcagggagatctgggccagatggaacagctcgcttagtaactaacaccagtaggatctggtgatgggctgagtatggggtaaggaggaaggtgctgtcctcctgtgtctgttagaagtgccagtattctcttagttacccaaataaaacaatgtggagtcctatcagtctctttcacttttttttttttttgtcttttgagacagagtctcgttctgttacccaagctgaaatgcagtggtggggtcatggctcactgcagcctcaaatttttgggctcaagcaattctctccctcagcctctggagtagctggaactaaaggcatgcatcactatgcctggctaatttttcttttgtagagacagggtctcactatgttgaccaggctggtcttgaacttctgagctcaagtgatctttctgccttagcctgccaaagtgctcagattacaggaatgagccaccttgctcagcctttttccctttcttaagctccatctctaataagttgcaagattctgccaaggccacgacacacccacattgctaaagtagcttctggggaaaatgagtgatgctctgctgtcctccatgcagggtggggattgttggggaaactcttgtcagccttgtcatctgcctttgttttggagactctggtcatatgtaataagcagtatcccttatctgtttctacctgtgacataagaaatttgtatttggtctttgcccccagttcctgacacagaggtcctaaaacccttggaatttctggagtgacaggagtgtcttttgctctagtgaggcaagtctttagagttcctgagtagcttcaggatgggaaggctaagccatgattagaagcttgggactttcaggcccatccactgtctaccagggaggggagaggggctggagattggattgataatcaatcttgcctacgtgatgaagcctccttaaaaatccctaaatgaagtggagagcttctgagttggtaaacatatccatgtgccagaaggtagtgtgccccaactccacggggacagatacccctgtgcttgggacccttctagaccttgccctatgtacctctttctctggcattttatttgtatcctttaataaactggtaaagtaagtaaatttcttttttagttttatgaaatgttacagcgaattattgaatctgaggagggggttgtgggaacccccaatttgtacccaacttggatggaagtgtgagtagtctggggaactgctacttatgattggcatctgaagttgggggcagtcttgtgggactgagcccttaatctgggggtctatgctaattgcaggcacttagtatcatctggttggcatccacagagaactggagaactgcctggtgtggaaaacccacacgttcggtattagaattgttgtgtgagtagagaatactgagtgttttcttttgccacccaagacaaaaatggaaagactcataaaaaatcagtccccaaacttcctgttattgctttcctttttggaagatggagagattttgtcagctgagagcagatagttacctgactgcagtgatctcaaggtagggcattcagctaaatgattccaaggccatctacaggctggaaaggatcaggaaaccacccgaccgtattcttgaatggtaacagaatgaaatgatttaacaagttttcacagctcaattgaagccaaaactaatttctcaaaacttctgatctagtcatgtcttcccagtgagtgtaataaaggttgaaacattcattcttgtcacgaggggataatgggattgatgtgtttgcacgaaacacatcaggctgtcgcccgccacaagcaggatcttcacacactggtctttcagggtgtacagccttccttggaaatgtctattccttatccacctctagtattattctttctttaaacctattacctatgagttaattgttaaacagataatcataattattataagagtaactaaattgtaattgttctcatttctgagtgcctacttcatgacaggctaagtaagttttctacattattttatttaatttttataacaattctgagaagtagggactattagctcatttgtttgagatgagaaaagagaagctatggaagttaggtaacttgcagaatgtattcagatattaatggcagaggtgggagtcaaacaaaacctacgctcttgagcaaggcataagtcatggagagttacctgtggcccgcaagcatcactcaattcaattgacatgtaatgacctcctagtatgtgtgcagtataagagacgtgagatggataaatttagtttcttcttgtaggccttaaaatctgttggggaattaaacctatacatccagttaatagaacaagataagttttatttcgtcctaaagtagaggtcaggcagaggttatgaaagtgctgaggtggtggaggtaaattttgacttgggggttggtggtacatgaaggcactagggaaagcttaggagaggtagtgtcctttcacttccatcttgaaagatcagcaagcatttggcagttggtggagacagacagggaattccacatagatgcagcagcttgactgaagaccctgaggtgagaaaatgcacagcgtgttcagggaacatccaccactgcagtggcatcacaggctacctggggaggaagaaagggaaggatcagagagaggctgaactgaggtaagaatggcctccactgctgcctacaggattcatatagaatgggtggccgtggaagatttttcgaggagagagatgacataattcctttcattatgtgggagagtaaagcactcagggtttgttagctggtgctcagtgtggtattagattgatttttatgaaattgctgacataggaccattttcaaaatacaaaaatcacaatttcatatggttcaacataacacagttcaagattttgctttgcttctggaaaagcctttggatatagtgggtagctacaaatttggggtctcctggccctcgcagatcctcagaagcactgttgaggtctgctgacttttattattttaacttaggcaatacgttaatgaaatagaatcttacttatttcaagctggaatttgattaactaaggatggtaaccttagctacttcatgctgatccaagcccttgattagttgtagatgaaatcattatttctagtatttatagggaggaggtagatgggaaatgaagatttaaaaggtctctgatggtaagaactactggctgctgcagattgctgctgaaagctggcatgaacataggcatgccatgtttccaggcaaccttgggtggtcctgggcttgcaattacattccgtcattcttcaaatgttttctgagtgcctaaatgttttgtgaacagttctaggcactgaagagatggttggaaataagctagataacttgtttatctggtccttaggttttccgcccaaactagaatgaataacatttgacaaaactgttgttaagaaagactgtctagtactaaccctgtgcatgaatgaggcagagtagactctgggggaagatagggtgggatgggggcaagaggaacattcagtagtccctacttagtgccagacactgggcttttaactcattttctcctttaaattcccctacttttggacaattaggtagttttatccctgcttgacagatgaggaaattgactctcaaagaaattgagaaaattgctgccagttgcccagcatgagggtggtggagcagagtttaagcccacatctgtttgtccagcacctgagttctttccatcagcatccccagtatgaagtgattttaggttttacatgactgacctggaggaacaaatgcttatttgttcagaggcttattttcttttcaactagagttgaaccgtacaagtgtaatcaggtccatttgttgacaatggcaaggcaggctgtagagatgaaattagagtgtcaaggccaggtgactgatgtttgccaaaggcatgaaaacagcattttacacccaaggtaatgatgccgcagattcctacacgtcaaacagactccactgctatgtttagagaaagtacaataatattgttcagagtcagcaaagataatgtgcatctggttccagttctgatgaatctgtaaaaattgcaatccagatgttgtgctattaatttgggtgacatgattattattactttggcctctcttttccaaatatgttaacaacagcaacaacaacaaaaaagttaatatgatttaaagtttcatgtcacattatgttttgagacatgcaatcaggaaactagagtgatatacgaaaaaaaatcatttccctagttttaaaaatgactttcttaagacctgagtaaaaagaggctgtcctgatgagctcattcactctcagagatttttgttcttttgaagtcattgcgtttccactatggtttagtatgaacaaagaaaatcaggaactcttttcttacttgagttccagggatgtagagactatagagcttattttcttcttgtcattttaaaaatgtaaagtcttggagctgctttggcatttattattgatatagaaagagtgctcattatttaacatgcctgtgcctccctccaggggatggcaaatacctgttatggtgtctctggaaacaagctggtcataatgtcccatttacaacagggagttgtgtacctccagttacctggaacaggtaacgccagtatcaggaattgaaaatctccagtctagggattaagatggcaaataggaggcaggactagcttgtagctcccactctgatggactgagtgatatgtggagactcacatcataaacttgctccaagaactaccgcaggaacataccagaaaagcagagggaatccacagacgctctgaaagaacagaatcactgctgcaggctccctgaaatgtggaaaaactgtgagtcagcttgctttcttcacagggaggctcgtggtctggggcaagttctcagccctggtcaccagctgccagactcggtgctgttgtggggacatggtgggaatgagaccggcctttaggactgtgggctgtgtgagagcggggtgaggccagtgactgctggcttttccccacttccctggtgacccgtatgactcagcagaggcagccataatccccctgcgaatataactccactggactgggaaccacattgccatcccccacagcagccacagcaagccctgccaaaggagaggctgagcccagacatgcctatcccagcccctaactggtggtctttctctacctgccctggcagctgaagacaaaggttataatctcttggtagctctatagccctgcccactgcctgagaaacctgaatacttaaccagttgtccctagggcaaatttgcatcatccctataggactgcagctgatgtactcttaaaagcgtcacctcctgtctggaggccaacgaaaacaaaaccagcacactaaacaaatacacaaccaaggacccttacagagtccacttcacttccctgctacctccactgaagcaggtgctggtatccatggctgcaagacctgaagacagatcacatcacaggactctttgcagacactccgcagtaccagcctggagtcccatagctctgcagggtggctagacccagaacagcaaaaaaaaaaaaaaaaataataataaaataaaataaaaataaataaataaataaatataaaaaaaataaaataaaaatcactgcagtttggctctcaggaagcctcattcctaggggaagggggagaacaccacatcaagggagcactctgtgggacaaaagaacctgaacagcagcccttgatctcaggtcttccctcttacagtctacccaaatgagaaggaatcagaaaaacagttctggtaatatgacaaaacaaggatatttacaccctgaagagatcataccagctcaccagcaatggatccaaaccaagaaaaaaatctcttaattgccagaaaaaggattcagaaggtcaattattaggctaaccaaggaggcatcagacaaaggtgaagtccaacttaaaaaaaatcaaaaacatgatacagggtatgaaatgaaacttcttcagtgaaatagagaacataaataaaatagaatcacaacttctggaaatcaaggacacattcagagaaatgcaaaatgccctggaaagtctcagcaatagaatcaaacaagcagaagaaagaacttcagagcttgaagactaggtttttgaattaacctaatccgtcaaagacaaagaaaaaagaatttaaaaaatgaacaaaacctccgagaaatttggactatgttaaatgtccaaacctaagaataattggtgttcccgaggaagaagaggaatctaaaagtttggaaaacatatttgagggaataattgaggaaaactttccagccttgctagagatctagacatgcaaatacaagaagctcaaagaacatgtgggaaattaatcacaaaaatgtcatcacctgggcacatagtcctcaggttatctaaagtcaaaagcgaaggaaggaatctttttattattattattattattattattattattattattatactttaagttctagggtacatgtgaacaacgtgcaggtttgttatataggtaaacctgtgccatggtggtttgctgtacccatcaactcgtcatttacattaggtatttctcctaatgctatccctcccccagcccctaaccccctgacaggccccagtgtgtgatgttcccagccctgtgtccatgtgttctcattgtttgactcccacctgtgagtgagaacatgcggtgtttgcttttctgtgcttgtgatagtttgcttggaatgatggtttccagcttcatccatgtccctgcaaaggacatgaactcatccttttttatggctgcatagtattctatggtgtatatgtgccacattttctttatccagtctataattgttggacatttgggttggttccaagtctttgctattgtgaatagtgccgtaataaatatacgtgtgcatgtgtccatatagtagcatgatttataatcatttgggtatatgcacagtaatgggatcactgggtcaaatggtatttctagttctagatccttgaggaatcgccacactgtcttccacaatggttgaactaacttacactcccaccaacagtgtaaaagcattcctatttctccacatcctctccagcttctgttgtttcctgactttttaatgattgccattctaactggcatgagatggcatctcattgtggttttgatttgcatttctctgatgaccagtgatgatgagcattttttcgtgtgtctgttggctgcataaatgtcttcttttgagaagtgtctgttcatatcctttgcccactttttgatggagttttgattttttcttgtaaatttgtttaagttctttgtagattctggatattagctctttgtcagatgggtatattgcaaagagtttctcccattctgtaggttgcgtgtttactctgatgacagtttcttttgctgtgcagaagctctttagtttaattagatcccatttgtctattttggcttttattgccattgcttttgatgttttagtcatgaagtctttgcccatgcctatgtcctgaatggtattgcctaggttttcttctagggtttttatggtgtgaggtcttacatttaagtctttaatctgtcttgacttaatttttgtataaggtgtaaggaagggatccagtttcagctttctacatatggatagccagtttccccagcaccatttattaaatagggaatcctttccccattgcttgtttttgtcagttttgtcaaagatcagatggttgtagatgtgtggtgttatttctgtggcctctgttctgttccattggtctatatctctgttttggtaccagtaccatgctgttttggttactgtagccttgtagtatagtttgaagtcaggtagcatgatacctccagctttgttctttttgcttaggattgtcttggctatgtgggctcacttttggttccatatgaactttaaagtagttttttccaattttgtgaagaaagtcagtggtagcttgatggggatagcattgaatctaaattaataaattaccttaggcagtatggccattttcacgatattgaaggaaagaatcttaagagctgtgaggcaaaagcatcaggtaacctataaaggaaaacctatcagattaacagatttctcagcagaaaccatagaagggattggggtcctatctttagcccccttcatcaaaataattatcagtcaagaattttgtggccgggcatggtggagactcacgcctgtaatcccagcactttgagggctgaggcgggtggatcacctgaggtcaggagtttgagaccagcctggtcaacatggtgaaaccctgtctgtactaaaaatacaaaaattagccggacatggtggtgggcgcctgtaatcacagctacttgggaggctgaggtgggagaattgcttgaatctgggaggcagaggttgcagtgagctgagatcatgacattacactccagcctgggcgaaaagagcaaaactccatccccccccgccaaaaaaaaagttttgtgtccagcaaaactacgcttcataaatgaaggaaagacacaatcttttccagacaagcaaacactgacagaattttccattaccaagccagcactgtaagaactgctagacggagcactaaatcttgagacaaatcctcaaaatataccagaatagcatctccttaaagcataaatctcacaggacctatataacaataacacaattaaaaaacaaaacaaaacaaggtattcaggcaacaaaaagcatgatgaatagaatagtacctcacatttcaatatcaacattgaatgtaaatggcctaaaatgctccgcttaaaagatacagaatggcagaatggataagaattcaccaaccaattctgctaccttcagtagactcacctaacatatgaggactcacgtaaacttaaggtaaaggggggcgggaagaagatattccctgcaaatggacactaaaagtgagcagaagtagctattcttctaccagacaaaacaaactttaaagcaacatcagttaaaaaagacaaagaacactatataatgataaaagaactagtccaacaagaaaatatcacaattctaaatatacatgcatctaacactggagctcccaaatttataaaacaattactactatacctaagaaatgagctagacagcaacaccataatagtgggggactctaacactccactgacagcactagacaggtcatcaagacagaaagtcaacagagaaacaatggacttaaactataccctacagcaaattgactcaacagatatatttatagaacattctacccaacaactgtagaatatacattctattcatcagcacatggaacattctccaagatagataatatgataggccacaaaacaagtctcagcaaatttaagaaaatctaaatttcatcaagtactctctcagactacagtggaataaaattggaaatcaactccaaaaggaaccttcaaaaccatgcaaatatatggaaattaaataacctgatcctgaatgattgttgggtcaacaatgaaatcaagatgggaattaaaaaagtctttgaactgaatgataatagtgacaaaacctatcaaaacctctgggatatagcaaaagcagtgctaagaggaaagttcatagcattaaatgcctacatcaacaagtctaaaagagcacaattagacaatctgtgtccggaattggtgggttcttggtctcactgacttcaagaatgaagccacggaccctcacagtgagtgttacagttcttaaaggcagtgtgtccggagtttgttccttctgctgttcagatgtgttcagagtttcttccttctggtgggtttgtggtctcactggcttcagcagtgaagctgcagacctttgcggtgagtgttacagctcataaaggcagtgtggacccaaagagagagcagcagcaagatttattgcaaagagtgaaagaacaaagcttccacagtgtggaaggggacccaagcaggttgccattgctggcttgggcagcctggttttattctcttatctggccctacccacatcctgctgattggtccattttacagagagccgattagtctgttttacagagagctgattggtccattttgacagggtgctgattggtgcatttacaatccctgagctagacacaaaagtgctccaagtccccactagattagctagacacagagtactcattggtgtatttacaaaccttgagctagacacagggtgctgattggtgcatttacaaaccttgagctagatacagagtgctgattggtgtatttacaatcccttagctagacataaaggttctccaagttcccaccagatcagctagacacagagcgctgattggtgcatccacagaccctgagctagacacagggtgctgattggtgtgtttacaaaccttgagctagatacagggtgctgattggtgtattcacaatcccctagctagacataaaggttctccaagtccccaccagactcaggagcccagctggcttcacccagtgtatcccgcactggggcacaggtgaagctgcctgccagtcctgcgccatgtgcccgcactcctcagcccttgggtggttgatgggaccgggctccgtggagcagggggcagcgctcatcagggaggctcaggccgcgcaggagcccactgcagttggttgggggggatgtgagactcaggcatggcgggctgcatgtcctgagccctgccccgtggggaggcagctaaggccaggtgagaaatcaagctcagtgccggtgggccagcactgctgggggacccggcacaccctccacagctgctggcctgggtgctaagcctctcactgcctggggtcagcggggccagccagccggccgctctgagtgcgggcccactgagcccacgcccacccggaactcgtgctggcccgcaagcaccgcacgcagccccggtttccacccgtgcctctcccaccacacctccctgcaagctgagggagccggctccggccttggccagcccagaaagaggctcccacagtgcagcggcgggctgaagggctcttcaagcacggccagagtgggcgccaaggccgaggaggcgccaagagcaagcgagggctgcgagggctgccagcatgctgtcacctctcaaatctaagttcttacctcacagagctggagaaacaaggacaattcaaacccaaacccagcagaagaaaagaaataatgataatcagagcagaactaaatgaaattgaaacaaacaacaatgtaaatacaaaagataaatgaaacagaaagctgattctttgaaaagataaataaaattgatagaccattagagagattaaccgagaagagagaagatccaaatgagctccattagaaatgaaatggggtatattacaactcataccatataaatacaaaacattattcaaggctgctatgaacacctttacatgcataaactagaaaacctagaggagatggagaaattcctggagaaataacctcctggattaaatgaggaagatataaaatctctgaacataacaataacacacagtgagattgaaatggtaatttaacaattgtcaacaaaaaaaagttcaggaccagaccgattcacagctgaattgtatcagacattcaaagaagaattggtaccaatcctattgacactattccaaaagatagagaaagaggaaatcctccctaaatcattctaggaagccagaatcaccctaataccaaaaccagggaaagacataacaaaaaaagaaaactacagaccaatatccctgatgaacacagatgcaaaatcctcaaagaaaatgctagggaaccaagtccaacaacatatcaaaaagttaatttaccatgatcaagtggtttcaaaccagggatgcagggatggtttaacatacacaagtaaataaatgtgaaacaccacacaaacaaaattaaaaacaaaaatcacatgaccttctcaatagatgcagaaaaagcatttgacaaaaatccaacattgctttatgattaaaatcctcagcaaaatcggcatagaagggacaaacgttaaggtaataaaagccatctatgacaaacccacagccaatattatactgaacagggaaaattttaaagcattccccctgagaactggaacaagacaaggatgcccactttcaccacttctactcaacatagtactggtagtcctagccagagcaatcagacaagagaaagaaataaagggcatccaaattggtaaagaggaggtcaaactgtcactgtttgctgatggtatgattgtatacctagaaaaacctaaagactcatccaaaaagctcctagaactggtaaatgtattcagcaaagtttcagaatacaaaattaatgcacacaaatcagtagctctgctgtataccaacagcgaccaagctgagaatcaaatcaagaactcaactcctttcacgatagctgcaaaaaataataataataaaatacataggaatatacctaaccaaggacttgaaagacgtctacaaggaaaattacaaaacactgctgaaagaaaacatagatgacatacaaatggaaacacatcccatgctcatggattcaatattgtgaaaatgaccatactgccaaaagcaatctataaattcattgcaattcccatcaaaacaccaccatcatttctcatagaactagaaaaaaatcctaaaattcatatggaaccaaaaaagagcccacagagccaaagcaagactaagcaaaaggaacaaaactagaggcatcacattacctgacttcaaactatactgtaaggccacagtcaccaaaacagcattatactggtataaaaattggcacatagaccagtggaacagaatagagaacccagaaattaagccagatacagtcaactgatcttgacaaagcaaataaaaacataaagtggagaaaggataccctactcaacaaacggtgctgggataattggctagctacatgtagaagaatgaaactagatatctatctctcacctcatacaaaaatcaactcaagatggatcaaagacttaaatttaagatctgaaaccataaaaattctagaagataacatcaaaaaacccttctagacattggcttagacaagacgtcatgaccaagaacccaaaagcaaatgcaccaaaaacaaagagaaatagatgggacttaattaaactaaaaagctcctgcacagcaaaagaaataatcagcagggttaacagacaaaaatctcagaaatcaccgctaaagaacttattcatgtaaccaagtaccacctgttccccaaaaacctattgaaatcaagaaaaagaaaaaagaaaagctcatctgcaaagcttgtgaacaactttccatgttttggcggggatccttttattccagtttcaggaaacaccccacagccaagcccagcactcctcctctctcttatgtaagcgataagcaccattaatagtcctgtcagtcttgattaattctgtgtacaatgatcaagagagtattttgactttggggcaaatcaaaccatggtggactatgacacagacataagggataaacatttactaaaagtaaaaaacacacagcctggagcttgtaaggattccatagaaataaaagcatatgaagaatgaattccaactatagattttttacaaagctacatgatgattaagtgcttttgggttattctattctataatatttaatggtttctaaatctaactacttcttcgtcacaatgttgtttttaaaaagttatccattaggtctttgtgtgaacaaatgtaggccattactccactgatcagtaactaatgcaaggaaaaagttcttttttatacttttacaacgtgaactccttttgatagtactgaaacgactggccatttgcaagaatgaaactaatttaaaaagcaaagacaaaggacattgttctcaaaggtatttaataggccctgaaagtttgacttagaaaaaaaagtgtttgaaatcacaatcaatgttgcaataaagtgggacgattccaagcagctaaaaaagactttctctccgatttcagtgagaattgtcttttctcatgatagtctgaatctagtgtgtgtgtactatttttatatgcaaattagtatacgattctcttgtttgattcaacaataggtgatgtaggtaagtcgacattattatatttcaagaaagaaggcaaatgagacccagagaagttaggaaatttgttcctggtcatgcagttagtaaacagggatgcttaaacctaaaccccagtcactcaccaaatgattctcctcttcatgtaacaggctcaaggcccccactagcaggcacagtggtaagttctcaccctaaactccggaaacgcccttttagggcaccatcccggttcagagctgtttaggcaaactgtgcttaaggagggacctcctcgtacacagctgttctgcttagacatggattttcctcctccagccctttctgccatgtcatcaatacaaggtcagaaagagacactgagtcagcaatgaatatgggaattatctgcacatttagcagtggaatcctagaggcacgggaagagagagcaggtaagtggtaggatccagttttaaacttaccttcttgttgcatacattgaaagtaaacatcagaaacgtcttccaccttaaaattttgcacaataatttattgtaccaaattggttcaattccattcctctgttcattcattccattccacacatctttattgagcacctccccttggcagtaactgtgtcggtgggaagtcagatgctgtccttgccctcagatagtgcacagtcttcagatgaaggggagaggagaaaagaagcaagtgctggttaggaggtgggatgaaagcttagattttgtgattcacaaaaagccatacacttcttgtctgcagccctaccgtgtgctttgaacataggagcagcagttgatggttttgcctccatttgactgttacagatcccagcccctgtgttgtttcctcaagcatttctggaagtccctgaaatgcatctcatgtgtggtcgaaagcaagcctggtcagccttcacacagcgtctgctgtttcttccttctcactagcctgcctcttcggggttctatcatgttccactagagaccgctgcaggtgtgctagagcttggaggtgggaagtggggagggcacctctccttctcatgttgccttccactgaaaggctccaaaggtttacagagtcttaagtgaaatagcttgttcaggttgagttccaggcttttcttacccttgacctaggttggagtcaatgggggatagatcagagaaaaacctcagtgacagccactatgtgattctcaggattgctctcctcttctgaccaccctatttctccttccacagacagttttctgtctatggccacatggccctttgtaggctggttatttcccactgtcaagattctgggcaagcccgcctctgagttccatggcatacctgaaccccagcggagactagggtttacacagagagaaggtgttgttctagtgtggagtttggggagagggcactagacataccccagaggcatcattcccctcttccttgtgtgtaaaggggagcctctgaggggtctcagccctgaacacagtctttttgagggagaggtttgaaactctgttttaaaaagaacaagactatttttctttctatggtgtattagttcattctcacactactataaagaaatacctgagactgagtaatttgtaaagaaaagaggtttaattggctcgtggttctgcaggctgtacaggaagcatggctggggaggccttgggaaacttataattatggtggaaggcacagcttacatggccagagcaggaggaagagagtggggagaggtgctacacacctcacagatctgtgagaattcacttatagtcaagagaccagcaaaggagaatctgtccccttgatccaatatcctcccaccaggcccctcctccaaccttggggattattacaattcgacatgagatttgggcagggacacaaatttaaaccatattatgtggttacagataaaagatggaacacaattatgttggatgcattagtggaaaggacaacacttattcatcctgaagtgtaatcaatggaggagtaagatgatatagagtcatttcctaagctggtaagaagatgggctcagaaaagcaggagggactagaggtcttaaatgaggggtatagagaggggtacagagaagagagacaatggattaacacagaaatgtatcgaagaccttccagttttgactgtgctaattccttgcttcctctccagttgggtgttggtaaatagcagctgtgcctagaggtacttgtttgggtagcaagatattgccaaccctgcaattataatttaaaaagtttttttttttaagagaagaccacattcctatgtaggaagagcctatgtctcaaactgtgatagttggcatagtatgggaaaacatttagttagacatctaacacatacttattgattgtttcattatgtttcaggcctggtgctgaatgttctacttgtaaagataagctcacaggcttattctttattatataagcttgacatccaaagagcatgaggcaaaacaatacttagaattgttatcatccagttttaagtttcttaatggctgcaccattttatcatatttgtggccttgtgttcatttatctattcatttaacaatacagtcatgtaccacataatgacatttcaggcaatgacagaccacatatatgatcatggtctcataagactatatttgtgctgtacctttttatgtttagatacacaaatacttaccattgtgttacaattgcctatggtattcagtagagtaacatgctgcacagctttgtagtctaggagccatgagatgtaccatatagcctaggtgtgtagtgggctatgccatttaggtctgtgtaagtgcaatctatgatgtttacacaatgacatgacaaattgcctaatgatacatttctcagaatgtatctctgttgctaagcaacatatggctgcatttattcagagatagattgttgtgtgtaatatacagtgacactgggtataaaacaattaataaagacaaggagcttgacttgtggaatttacatgagagagagagagagaaaacaaagatgtcaacatccaaataaatatacacacacagcttgtgctatgaagtaaacacgagggatgatgagataaagaataggaatgcagggagtggtttttcttaataagaagtcagaacctctctgatctaagtagtagacacaggatatgtttatttgtgagaattacatatgattgtgtatcttctgtgtgtatatatcagtaaaaaggtttatttacttttacaaaaagtttgcattacaattgtatgcacacactttagagagtcaacacatcctgaggatctgttgggagaaacagccttcagcctccctcttttccctcttctggagaaaactgccttttactcttagatggatctgtttgtaacttctgtgttgatgatttggggtatgatagctttctctcctcctcttgctctggtgcacaggtgtaccctttccatcctcctcttacagatttatcttcagtttgattacagcaatattcaagacttgcatcattttgaccacagttgagctgggattatttgtaatcacatatgattacttttcttttcctgtaacattaatgaggactaagctctgattttttattttgcccaaacttctatctaaggggtctggggagtcatgtcctacaaaccataaattctcatcagatgggttttatttgactctgtatatcatgacttactttccaatctgactctggcataacaaggaagaaaataaaaaatgttttaccccaaaatatatttccttgccatgccttgaaattgccctacaaaatctcttgtgggaaaaatccacattctatagagaatcccctttcttccctcccctcccctcccctcccctccctccctccctccctcccttcctccctttctcccttcttcccttcttccctccttccttccttccttcctagctccaggagataatcaactaagagctaggcacccttttaggtcttataagaaacattttacaacccgctctctctctgaagtccgctacctaagcaattcctctgcacaataaaacttggtcttcacaatcctttgccttaaccagaacattcctttccattaatcccaggtcttcagataaactcaaccaattgccaaccagaaaatgtttaaatttacctgtagcctggaagccgccactttgagttgtcctgcctttctgaaacaaatcaatgtatttcttaaatgtatttgattgatgtctcatgccttcctaaaatgtataaaaccaagctgtaccccaacaaccttgggcacatgttctcaggctgagggctgtgtcatgggccatggtcattcatatttggctcagaataaatctcttctcatattttacagagtttgactcttcgtcaacattaataattatattgtttttgaatctaatgttattttcccatgtatgtatcccttattcaacatcaaacacttcttcagctaaatatttaaatagcatctaaataatattacttagaaagtaatagtaagcattagccacctgaaaaaaggaagttagattaataatttgcctcctaacccctcccttcatacaaactctcatccccattggttaagtagaaatgtagatttgttttacatgggtggtgatcatatgaaaataaagttaaaatgtagatcaaactatactgaattctgataaatattaatttgcccttcaacaaagaaataccagatacttacttacacttctgttttggatttcaaagtccagggagctagacctttagacaggctcttatttgcttctgtcctgatgctttcgcacaggcaggccaattagtttcttgtttcttgatctataagaataaacacaatttcccagctaaactacaggcttggccaagagggcaaggatatggccagaacttttactactgatcaatgcacagaagcccacgccagatgaaggcatagaattactcttcctatctttgtggatgtccacaaggcagaaatgcaaaggtggtttttcactccaaagtgagacaataatattttccccaagtgtataggaattttaatctgggactatgatttttaaaataaaatgtattattaaggttttataaactatttggaaagaatgaagggctggtagtaatacagaaatactaaaatgccttagtcaccattctaaaaataaaattggaatataaaagtattcaattttcagaaaaacacagaaatagtagagaaagttttctttcattttttttcgcttcctttctgaattcctttccttgagctaagaggccgtgtggattatgataccttggattattatacctgtggattattatacctcttctagaggatggtccatgcctggcagaagtatgaaatctcaaggtccaactcttagattctttcaaaaaataatagttctgcactgaaatctgccaggtactgttttagacacttttggggcacaaaggggaatgaataaaacagataagtgtctttgctcctgtggagcttatgtgagtagccgagagtacagaaaataataatcattgtcattataacaatttaaatatgtaacatattagatactggtaagtgccaagaagaagaaaaataaaaccagaatggaggatatgggagaacagggggctgcaagtgtaaatagggctgtcaaggaaggtctcgctgagaagatgctgtctaaataaagacccaaaggagataggaaacaagccacacagaggtctttggaaacaggagtgtgtccaatgaactgaaggaccagcaatgaggtgggtgaggctggagggagagggcaggaagtaagaaacaacacgaatggagtgatagaggccaggttgagtagagccttggaggccattctaaggcttttgctttctttcatagtgagatgagaaggcctgagtagagtgttttagcatacagggctaaggtttggatgaggaccagcaagggcaaaagcagaaaggcctgttagaaagctcctgctgccattcagatggagaatgaggtggcccaggcaggggaagtatagtggagacagtgaggagtggtcaggctctggatctctcttcagtaaagagctgggaagacttgctaatagattgaatctgaggaatgaacaaaaaagaggtgtcaaggatggctgcagcgtttggaacctaacatgctggaagagtggcactgccttttcttgaggaaagaagactgtgggaaaagagttagagtaggagcaggaacttagtttggacttgtaaaagtggaaatgaccattatacacccaagcagagacatcacataagctgttgggtatgtgattctagagtttacgagagacacctgggctagagatggaaatgagggaggcatcagctcatacatgattctgacaatcctgaggctgggtggatcactgagagtgagcgtggacacagaagagaagaattccaagaattccccaggggctggggttggggagaggaggaggcaccagcattgaacagtgagaggaacagacagtgaggaaggaggaaaaccaggagagggagtgtcctggaaaccagatgaggaccatgcttgaaggaggagagcatgatcaactctggcaaatgtgtctgtgtgcctatgggaaagaccctgtagagaaaggaaacttgatactgtaagaaggagaagagagaactgctgcagcaatttccacaagtaccccagagactttaggagccagaacataagcagaaggcttaaccctacctagatgcaggacagttcatccataggaataggtgaaaggaagaggaaatgggcacccatttctacgtaggatgagaagaagcttcctatgccttctatttcttagcaaaataggaagtgaggtcaacgctgggagtggggatgggttgggggggtgtcctgagtgtttgaagatggaagacaaggtgtgaagaatgggaagatgaaaggactagggaagcagagtatgatttctgggtaccactaagggctcctaaagattaatgtcatgaatttaaagtgaggctgatcagtatggctgtgtggtttgctctagttgcatttagctacacaggtccatgtacagagcaggctgagttagatgtatacagagttaatgtttctccctgaaaatagactcctgatatcttcactcacatcagaggtcaacgtataccagagtttgctattataagaaatgtgaccataactatctctgatctctttcttttcatgtatattagcactgttaaatgtgaattttctagttttaaatttcttcatgtgaatactcaccacaaaagccatgagtaagagcagcatgcttacattcagatatagctgtggtgagggaactgggctccctcgctagctaagtgtttcactctgacccaccagccttgagtgcaagattcaaagtcatgtctcagaaaattttatttgctggtagaaaggacaactgctgaattcgtacacatcagtctctctactctcgttcaagcttgccatttaccttctttgatcaagctgatccacttgtgtgccacttggcctacacaacaaaagactgaggacccagcagccttgcttcattcatatctggcatcacaaccatggttcttccttcatgtcacctattttgtgtcctacgtctttcattctcaaatcttgcccttcatctttatctcctggctatagtctcatgttgctcgactaagcagcacctgacaaggtgccataaacttgactttccttttcagtaatggattactctttccctcccaactcagtccacattcagcttccctgggtgacagtgttacccagtgcagttcaagccttgaggttggtggcccacgtggctgacccaaatgtttggcctttttgacaagtcttcctggagcctgtgaaaagaaatcatcatggtggatacctaccatggcatacattaaagaaatattagcgtaaattcttttacttcttacttttgaaagaaaggttcctgtgaggtgcagattaccattagcttggtggcataaggcagaggagatggggtgggtggctgttctggatcagtgtttctggagggacaatccttgaattctctgcaagataactgcttgggttgctcatcaaaaatagaaattcctgggtccttccccaaactacagaatcagagtctctgaaggtgggggctatgatgttgcttatttgattagtacccaaaaggtacatatagtctaaagttttagggctaccagtatagagcaattgctcccaaacctggtggttcctaaaccacctactggagatggtgaaagtgcagattcaaagacttcatcccagatatattaaatcagactctggtgtggcctgggattctgaatttaaaaaatataataacaataacaataatcacaataataattataacgattctgatgatcagccaggttggaaatgtaaagcatcccttatgccaaactcttttcagctcatttgaaaaagattctttgtgctggaaaactctctcacttcataagagagcagcagctctggatgctgactgccgttcagctcctgcaaagttgcacctctgggatacatggctaaactgagggcttgccagctttgctcttttaaagctaggtctcccaaacctagtcgcatcacctgggggagatttgcaagaacatggattctgaagctcaacccacacttattgaatcatggtctctaggagtggtgtccagaatccctattttgagaagcattcagatgataattaagatgagacaaatttgggagccataagtctatgaccgtggagggaactgccaacctaacagccatttgggggtgctgcagcagctgaacggttgatgaaaacataagcatgctctcaaactactgattacatcaacttgatactttgcactgcctcttacctaaaaactcagtgaacatattctgcagacttcttcttttcttgccttatctcctagcctccttctgtttgtctaccaatgctgccactgcctgccctctggcatggctacttccagtactctgtcaccatggtgtctggttgctggcagagacctgcctgaaactagaattgtttatttgccagaattatatacccagtctaaggctgtaggattctagcttttatagttaggcatgcatgacttcttagttgttttcaacacactaaatttaataaatataacaaaagtcttgcaaataggatctagtaaaaggctgagttaaaagaatgtttttacagaattgcagtgttattgctcttgagtgtaggcgatgaactggggttagagactggggctaggctctttgtaaggacggatgcatgtagacaactgtttgtcctcagtacacacaatgtttgaacaggaaggttagaaaagagtagcttgaaaggagtttattggttttagcccctcatataaatcattttctttgaattacttctaaataatgtactttcatagatgatagcatgaaattttcagtccagtgtgtctagaattatctcagattttgaattttaaaagtctaaatgaagtttactaaatggataaaattgccatttttttctttgaatgtgtattttatttttcttaagaaagtaaacagggtttttcagaatagttgcgttttaattacatcagtagcttaatgttaattgaagaaatattagaaattacaagaaatggaaaaacgagaattaaagttgccttttttttttgttttgggaaatgactgttgacattttggggaatagccctcttgcttttgaattcaacacccccacctcgctcaactatacgtattgttttgtaacttgtaaacacaatgatttgggggattggaagttttttgcatctagctctactgtgtctattttctcttccacctcagggcctttgcacatgtgctttcctttgcctgaaatgctttacctacctcctccaagtggctgttttcttaacatttgtgcttcaggttagaggtcacatcctcaaggaggcctttcctgacccctcaatctaaagcttcaccccattttcaaatcattcctgatcttcttttttacctccgatgtgactttcttaatagtttggtttatttgtttcctgtctgtcttctccaccacagtgcaggtgccatcagaaccagggccgtttctgtcctattctgccctattctgtcctttctgtacactcatttcctagaacagtgctagcccagagtaggggttggatagacatttgtagaatagataaggaaatgactgacagactgactactgagaggatgaatgagaccgttggcctgggagggtggaagtcagagccacagctgagaaggtgagctgagagtccatggctggccaaacagacaaagcaggatgtttaaaaatgggttgccggccgggcgtggtggctcacgcctgtaatcccagcattttgggaggccgaggcggcggatcacgaggtcaggagatcgagagcatcctggcaaacacggtgaaaccctgtctctactaaaaatacaaaaaattagctggccatggtggtgggcgcctgtagtcccagctcctcgggaggctgaggcaggagaatggcgtgaacccgggaggcggaacttgcagtgagccgagatcacgccactgcactctggcctgggtgaaagagcgagacttggtctcaaaaaaaaaaaaaaaaaaaaagggttcccttttaacaagcccagagagatcttaaaggcactgtttggaccctaacaaatggcaaatagcaaaacctgaaaaatgtttctttaatctcagatccaaaatgagagtttgatagaattcaaatgattctacaattagctcagagcttttagattcatagcctctttgtttttagttagtttgcctttttcagtttaattgtttagactgaaagtttgtaatttcttaccagttttgagtagttgactctagaataacatgagtaatttttctaaatagcattgcttgttgtgtcattgattcacctcactggcacatccttgtctctgatctaaaattgtgaaaaatgaacaatatgttgagatatgaaattatgcatgaatcttcaagctgtaaaccagctagctgacagtgaggttattactgtgagaaatgtctacaacaatacttcgctttcatgtcacataagtccttgacttgaggctgctaggaaattaattaattaaagaaacttaagtttccttaagtttcgacacctttggggaaaaaagagcagatcgttacctttactcagagataagacaattgagaaacaagtattttaatcagaagtgttggtgtgaaaaaccataataaatttgaagaattttatttaatattcagatctctcttgaaggtacacactattttacatgtggaatacataataaatttgtcattctgacaaacttttgatagaattcaaatatggaatacatgataagtttgtcataataaaatttgtctttctgcttctttcttgggtattttgtggtcattgggcagcacactgtttctttttattgcctttcctttcatgttaaatgtaaagatagaaaaatgaactcaaaggtagtagtttgtatttctctatgcttgttaaggaaatctattagtagttcacaggagcttcttagcagataggcagtgagtcagtccttagcaaattgtagaagaggtcaacctttccccattcctcttcccactaaagctgcttttctcttcccttcacctaggtctccttctccagccactactctgtggtggttgcaacctcatccatgttgaaaagcccattctgacctgtggctttcagcgctggggcctctgggaatgtccaaccagtagcacctgcagtccttggagagccgacactcaccacactgtctacagcacccttttgcacttgctcttaattatatcctaccatttattccattcgacgtatttatcataatttgtatcttgatttctaaaatttgttcatgtaatatcagtccttgggaaaggatgtaagtttcataaaagaaaactccatcttcttcatctttcatgtctcctgtaccccaaatccatgaagacttgagtctcttcccctcacggagagtatttgcttagaaaagggattaaaaacacctgtgatgggttgaggtggaaagagcttcacaagctagagatacttttaaacttgaaagctacaggaaatacatcatgttagggagattaaaaaaaagaagaatgagaaacacatacacactaatgaggtcatttacaacttaagtgactaatggaagacgtatttcattgtccaaaaatatttcctacaatagacacgttttatgacttcatggttctcgaaaataaattttcctagctttggatttaacataagccttggggttaaggagttacagtccagctgaggaaagacagcttaaaacataataacacattttgacatttctaagcgatatggcctcctttgtctttctcctttttaaattttcttgccctcttcctctctgatttttccttccttcattcctttctttctattttttccttcttttcttccctcaattaaattaaatcaaaatagtacatactagtagtaatgctattaaaatagtaatactattaaaatgacgtaaagagtttatatatgaaaatacacaattcctggtcccaacatgttcgttctcctgactccctctccacagagacaaccacttttgacgctttaacctgttccttctagcattttatgctttcaaataatatgtgaatactgctctcctttgattcatcaatttagacataatgtattgagtttctaatatagcagatgaggatttaactcccttatattaccatcctatccgcttctcctcacttattctcctggtttaattatgctccaaattttggttaagtatatactcaacgttaacattactatgcctatccaagttttattcacagctgaaaactgtaatatctgggtttccaaggatcaggccctgagacaaggattcaagcacaagcagttcatttgggaggcacaggaaacaccagtaggggaggaaggaagtgataagcggaagaaaaggcagtaatcgagggtgcgttatcaagaagtaaccactatgggtaattggagcttaattctgtgagggaaactctgggaactggtgtaaaactcataattcagtgccatcccacctgaaaggtgagggagctggggtatttgtataccagtttctatcagccacttactgaaggctgctcccaagggttgttagttccccaatacttccagcctgccatgtgcaggcagcgtggccttctgaagcttttgtgaaagtcttctgcaaagagatgccaatgctgacagttgaaagttagccaagaagacaaacttataatgcatcatgattatgttttccttctttttgtttctttcctgaaattaataactgccttttaaactttccttagtgttcttgatacttattgcaaatcttcccatacctcctaatagtttctcaacacaatgttttataaagttaatcatatcaggtaatttgccagctctaatttctttttcttagagccatccttggaggcctccattatgctctatggactgtatgcactcaaggtcttctacacagatgacaccctaggacagctgtgctgtcatctcaggaatattctttgccttctgagttggattcctttgtttcctggtctgagtgtttctctttcttggttgacttctggttggaccacatcattctgagtataatcagactcagttcagtggtagagggtctgtctcttgggtaatgctgctccccctggggctgcgtgcttctgtggtgctgctcttctagcatttcccttccctagcacctgggagagttccttcaggactctattgttttgaagctcctctgtttttttaaatttattttttattattatttttattcgtgttttcctttttcttggtttgtttcttcattttaatggaataaactttccagtgtctaagaaaaggtgactgggaaataaatttttaaaaaccttgtgtgtctgaaaatgtctttattttccccttgaactgattggctggatcaagttatatgttggaaataatttaccacttcagaattttgaaaatctttcttttctatcttccagtgttgccattaagaaatatgaagcaattcggacatcaacaccctcctatttggcctgttgttgttgtttttaaatctctggaagcttatcgaatctctttttggctctactattctgaaacgttatcgtgaaatcacttagtgtgggctgatttttgtccattgtgcagtgtgctctgtggggcaggccctttcaatctgtaaactctcatgtcctcattcctgggaaatgttcctaaattattttgttttattattattatttgctacattttctccattctcttgctggtgcttctgttattctttattttaattttttaattttttatttccctaagttttgggggaacaggtgatatttggttacatgagtaagttctttagtggtgatttgtgagactttggggtacctgtctctccagcagtacacactgaacccaattcgtagtcttttatcccccacccgcttcccacatgcttctgttattctgataatgaactttctgccctgcttctctagttgtcgtatatcctctctcttgctttgtatctctctcttttatacactttttttttctgaaaaatttcttccactttattctttaattcttctattgagcttttcattttggatagcatgcttaaatttctaaaaccttcttttggttttctgaatgtttattcttctaaagcatcttgtcagtaatatttcaaagatgcaatatttttctcttaactctaaataaaccagtgattccagttgttatcattgtgtcatattttcttctctgtgaacagtctctattttttcaagttttttttttttttctgttttgatactggcttttgtgttttgacatttttcatgttcaagactttccccagatgtctgatcatccttgatggtgtgcttatttattatttattttttattttattttattttatttttgagatggagtcttgctctgtcacccaagctggagtgcaatggcacaatctcagctcactgcaacctctgcctcctgggttcaagtgattctcctccctcagcctcctgagtagctgagattacaggcatgtgccaccacacctggccaatttttgtatttttaggagagacagggtttcaccatgttggtcaggctggtcttgaactcctgacattgtgatccacccgcctcggcctcccaaagtgctgggattacaggcgtgagccaccgcacctggccgatggtgtgcttatttttttaaattttttatttttcagacaaaatctccctctgtcgcccaggctggagtgcagtggcacaatctcggctcactgcaacccccacctcctgggttcaagcaattctcctgcctcagcctcctgaatagctgggattacaggcctgcgccaccatgcccggctaatttctttttgtattttagtagagacagggtttctccatgttggtcaggcttatcttgaactcctgacctcaggtgatccgcttgccttggcctcccaaagtgctgggattataggcatgagccaccacgcctggctggtgtgcttattttcaagggtgagaaactaaaactttgatggaagccctaaacataggagtagagcttgttgacattgaactttgttgacaggtgagctatctgagtcttttgtagggaaactcctaaagctgggttgtgttttatcaccttagcactactacttctatttaagattaggaattgtcctttccagaactccattttctctgtgattagatttggctaagagaaaaacttgtacagaatttggaaagcagaggtaaagcaggagccattactttcagaaggtcacagtaatcagggaatgtgccatctagatgcagagatgcctagtaggctgtagcctcccctcccaactactgaccccacaggccaagagtgactccaagccaccaaatgcttgactgcaatttctacagaggctgtagcttccatggacctgccataacctcctcacccactattccacttgggtggccaaacatccagtctttctgaacatttcccacatactccatccacacccatgctttaagttgttgtaggtgtttcctagagctgctgtaacaaatgacaacaaatttagtggcttaaaacaacacaaatttattctcttacagttctggagctcagtagtctaaaaccgaagtgtctcctgggagcttcaggagagaaatccacttccttactttttccagattctaaggtcacgtccatttctttggtctggctccttcttttatcttcaaagtgcatcactccaacctccagttctgtcttcacctctccttttctcactttcttcctcttgtctctgttttataaaggctgttgtgataacattgggtccacctagctaatctgggattatctccccatctcaagatccttaacataattacaccaccaaagtccctttttgccatgtaaagcaacatattcataagttctggggagcaggatgtggatttctttgggggtcactgttctgactgccacagtaggtaatgacttccttggatcctctgagtcttctcttccagattcctacttcctcagctcttcccacacttgtgcaagctctaattcctagagtaagccgcttactcccctaatacacttttagtggctctgattttctgacttaaccctgatagatacacccccaatgtcaatatctctatgtatttcctctttcagattttaccagagttattctagtttccagcctagaggataaagacttggctgccaagggtctgagggccaagataatgaaaatagtagaggggtctttgttggtcatatcaattcattgactttattttgctattttcagtttggttctacctcatttgcctgctgtaggagtccccaggacagatatcctttgcattatcgcctctagagagcatcgctccaacctctggccacgtacagaagaaggagcagaatctcaaggtcaggcaaaggggagaagctctagggatttcactgtttctaaaagggtcattatcagattctgcttttatttaccatcacctcttcttcactccatttccagaagcctgttgctatcagtttccaatgtttcagagattctatggttaaataaggttgcttctcaactgtccttcctgccatcttagaatttaccttctagagttagctaggagaggtatctcctagcgatctgcttgattgcttctaaaatttttatcgacgttatccattctttttcttcctatttttacaggtttctatttttaaattaaacatattattttgagataattctagattcacatgcagttaaaagaacgataatcattcagggaaaccacatacccttcccctaatcataacatcttgcataacatggtacaacattagaaccaggaaattgacattgatataatccactggttttattcacatttcaccagttttacatgcactcatttgtgtgtgtgcacgcgtatgtgtatgtgtgctcatgtgtgtatttacttctatgcaattttgtaatgtgaattatatatgtatatatttaaggaaaaattccctttactatataatatttgaaacatggaaaattagatgctatatcccatgtgccatcttcttctgaaagctgaatgactggaaacgtaacgaaaagtatcttgaacttgcaaacaagagcagagcatgggtaaattttatcttctttacaaccttgcccatggactgtagggtcagctaacaaggctctttgtttagctcactgtgttctaaacattctgtatccttcctcccctttaaaaaatcagcccagagaaaggcatttagcaacagaaaagagaataaacagactttttaggatcatggtgttgagttgtttctgtgccaagcttcttatccatacagaattataactgataggttattttaatcaatattggtaaaaaaaaaaagactaacagcatttaaaaagaatcacattctcttcttggagagaaaaattatattttctgatttctgcagagatgaagaattaatgaatcaacagcatgcgtaaatagagaggcgatggagatctgttttgtaatatgtagcgttcctgaatcccctataatcatagctggtagttgggcactcagataattaaattgccccaataggtcatttgcatcaaatttaatgcagtcatggaaaattcgcaatatatgtttgtactcagaatcaggtagtaggagtgagagctgtatgagactatcaaaaccaagcaacatctagtctaaaagttaacataggccaggcgcggtggctcacgcctgtaatcccagcactttgggaggccgaggagggcagatcatgaggtcaggagtttgagaccagcctgccaacatggtgaaacctcgtgtctactagaaatacaaaaattagccgggtgtggtggcgcatgcctgtaatcccagctacctgggaggctgaagcaggaaaatagcttgaacccgagaggcagaggttgcagtgagccaagatcatgctactgcactccagcctgggcaacagagcaagactctatctcaaaaaaaaaaaaagttaataaaaaaaagcagcaaaaaaaaaaaaaaaacccaacattttatgttagtcatttatatatattgtgccatattacaaaatgtatttaggtgagagaaagggatactattttttcctattctctttttagtgggctcttctgggaggttgtgtttgtgagataactgtggtttcatctgctgtatttgatcaggaacaggcaaggtaggtgacaaaggtagtgagtgtttataaacaagggataacaggaactttttttgtgtaagtgctctgtaaccttttgcttcagtctatctgtggtgctgatttagagcatgagaactatatcattataaattcagattggaaggagctctttcagttatctatcaatgcataagaaaccattccaaaatatgttggcttaaaacaaccatttattcttgctcatgaatgtatgattgactgggaaaaaaaaactagtgatgttggccaggtcagactgatcttggctgcactcagccatgcatctgcagtcagttggcagactgtctgccgactggctggtatagaaaggctgtcttcctcgtggttgcttagtctccagaaagctagcctgagctcattcatatggtggttgcaggggtctgagatagcaatggaactatgcaaagccttatgaagactaggatagcaattggtacacagtcacttctgcagcattctactggacaaaataaatcacaatgctaattcgtgttcaaagctgatcacaatggctaaaagaaaaatgctaacaaaattacccaaccaatatgttcacttggtttttttttgtacctggtaagagatttttctcttatattcttgtgcaactcttactcatccttcaagtctcagttcatgcaccgcctcctctgggaatctggcctgtcctttcttccagcagactgaaccacagtatttttttgcgggggagaggaagatagtgtcttactttgtctcccaggctggagtgcagtggcatgatcatggctcattgcagccttgacctcctgggttcaggtgatcctcccacctcagcctcccagatagctaggactacaggcatgaaccaccatgccccactaattttttgtatttttttagtagagacagggttcgccatgttgcccaggctggccttgaactcctgggatcaagtgatctgcccacctccgcctcccaaagtgctgagattacaggcaggagccatggtgtccagtctaggacagtctttttttttgtgtcaccagcaactgtgtttctattgtctgtttacagttctcaattccttgagggcaggaatcaactcatataaccgtttctatatctccagttcctagcacagtgcttggctcaacaaatatcttctgaataagtgagatgatggccatttctccagttcttttatctccccagttcatattctcttgatgctgtcaccttgagaagactttgtccctcctgttaatttctcttccttaaagccttaacaaattgcactatttgttaagttgtaatcaatgcaccaatgaaactatattccatattttgcagctagagttttgagcttttgtgatgtttactaattgcaatgtagcattgttgctttaactgttctgttttggggtggcttccttttatatcctttttttggtacagttgcaagtgcctaggttcctagcatttacaaacacagaaatgtttatggtcaaatgttcaaaactccccggtagttctgtaagacatagctcttaaagtgcttttctttaactggcaatttgatgccatgggaagttgttacatagttgtggaggcctgtaatgagatttttttttttttttttttttttggtaacagacccctctgtttctgagcatttacctcttatttcatgttattgcttacagatgtaagtactatagaatgaatgccattagttaagactctctggggttgagaagagagataatacctaattcaatataatctcattgcatataaatgacaatggaggcccatggaggcaaagtaacatatccgaagtcacatgttgactttacggttttagaaacaggatttgtacagttagaatagttcagaaacatggtagacaagcttgctgcccagcaagatagtattttccccctggttaagccaggtgaagctccacgtgatatgagccctttcttaacagagattcctctttgaaaatgcaccatttaccttccaggtggccgagtgtagagggcagtacctctttggctggactaggagtccatgtgcctatgtttggtccacttgggttagaattatctggctaaatgcagattactgggcactaagacctcttgaagtcttggagatttcgatagaaatctggttgtgtttttttttttaattttttaatttttttattttttagcaagtactcagttgattctgatgcacctggaagtcagaataagagaatataatataatgttaggcaatgaaaagtgctatggagaaaaataaattaatttgagggatgatactatttggatggattagttagtgggaatgactttgaccagagacctggaaagaagtagctgaccatgaaaatatctatgggaagggggaacaagagtaaacacaggctgggcgcagtggctcatgcctgtaatcccagcactttgggaggccgaggcagatggatcacctgaggtcaggagttcgagatcagcctggccagcctggccaacctggcgtaaccctgtctctactaaaaatacaaaaattagccaggcatgatggtgcgtgcctgtaaccctagatactagggaggctgaggtaggagaatcacttgaacccagaaggcagaggttgcagttgtgccactgcatttcagcctgggtgacagagcaagactctgtctaaaaaaaaaagaaaaaaaagaaaaaaaaagaaaaaaaagtaaatgcagaggacctgaccagaaatgagctttgcagtttcaaggaggagaacggctttactataaaccacccagttgcctatcaatcttagaataaaatccagtctcctttccatgctctataagaccttatacaatctgatcattgtcaaggactagtcacatggccacatgtgctagtggggccagaaagagttgttggaaaatgtagtctctagctcagcaggcttctgtcaacacaggctccacactatggaaaggggagcacaaacctttggggatatcttcttcagtaagaccttagcaagatgagccaaaaactgaccactggatttggcaaaatgaagatcattaatgatttgacaaaagctgtttgaatggagtcaggggaaactgattggagtgattggtaacttttagagacttcctattatatatgagtgaatagcatgttggctagaaggatgcgggctctgggagatctttttctaaattggaggttttatagcatctttgaaagctattaggattgatcaagcttggagggagaaattgacattgtaggagacaggaaagaacaaacattttgagaagggaagagcagaaggaatccaatgcaccaagggagttgttggccctagaaagcatcagggacagtccatcctttctaacaagggagggcaagtccagagggcttataaggggaggagtcatgatcctagtcaattcttcttcaaagcctgttttacaaatttgcccaaggccagctgtgttcaggaaaaagggatttcattatttttctcctcctcctcctatcccttctcttcccattgtgtgccatatggtcctttgctctcagaacccgtagttctagctaataccatgtattcattcagcaagctttttgtgcacccactccaaaaaatgtgatgtccccaaatgtatggtgtagcatctgggttacggcttcttaccatcagtgagaagacattctctttttttacccttgatagagtagttatcagagttcctgggagagctgatgattttgactagctggctacattcctgggtctgagcctagaaggggtgtcctctctgatgattgggtggcctcaggagatgatgtggaaaggggatttgccctgtcagctagatgagctaaaacaccccagagataaaagagtgacaaaggtcatagtcagatctctctcaatgcccaggctatcatcaggttaatgcttttatgtcatttaaccagaatattcctttaaagactggttatcttgctagacattggcaattgattttatgaatgtgggagggagcattctttttaatatttttttcttttatctgcccaggattttcttaagtcaactttatttcgtaccattctttgatgcataactaagaagctggaaggtacccagaggggaatttttatgaaaaatagaaactcaaataggatacccagctcattgaagagtttgagttactgatgaataacttagtatgtaccaagtaaaaacctgatgctagaagacatggccagcaaagagaatacttgagtatgcttgcaaatatacaattaagtaggcttgtgtgagatggaggctttaagtaattcctgtggtaaaatatgttgtgagtttcacacaaggggctttaaaccaaagtcctgaaatacaaatcacttgagagtaagtatgcttgattgtctaattgtccttattaccaatatgtaagattattaacagaaatatatgaaggattcagggtagggtgaaaggataatgaggaaaggacgacaacaccagggctaaggttggtacagacaaatatatgacaagtgctgagagtactgaaactatatggaatatctgggtatatattatatggccagcagacacacggaaacatatttacccctggagagagtaactgtcagggctcccaggacagctgatggcatttgctcatttggtcacattcctgggtctgggcttgggaggaggggtatcctttttcttgaatgggcgggctcaagggatgatgtagaaaggagattcccactcattcattcggtagctttatactgactgaaaaatttaattgtgtgttctaaaatacaaaggtacagccaaagaacaagaggaatcccagaattttcataggtatgctcctcgagatgttctgtgcaattgaaatttaggctgctaactatattttaaacctgtctataaagatttatagttttcctgatctaattagattgtaggtcaaatgctgctgaatatctgtcaaagctatgtcagagatcaagtgcctataattttcaagaagtgactgagaaagaaactgttacttccagtcatgactgctgcatgttcctctgttctcgcccagtctggtgacagttctagtttcctcctgctgatgagttgggcctttttcctggactgtgatgacccccaggaaatggagaggtgtcttacatgatgggcatggcaagtgagaagcacctggctccccctgacggagggcatcactgggccatacagacattgggatattgccttggcatctctgatgcaggaaacatgtgctcaggcactaaacagcacacatgtgaatctgttccctggcacacgcttaatgtcattcgtagtagaaccaaatcactcagctgaaagtggtggcttttcttttatctcttattgctatttttccccctgtttgctggctgagaggaaagtagagcaatactgtgtacatttgataaaccaacacttttattcttttattgttttttcttttggtgtttctaattctgcctgaatctacaggagaaaggcacagctaatggatttgtttttgacagcactctatttcaagaagctgatatcctttggttgaaataaagtattaatatggtatgcaatatattttatcttccttcaatatatgaagtttctgaggctgtcttcaaagttgcaagttccctagaattggcacatagattagaagtgactgatggctcactttaaatatataggaagaaatacccacagtgataaggtgactgtgggaagctgagtgcccaagatgcattacttgtaacactcctcatcctaatccccaaagcactcaggacaggctttcttctcagtgcaggagcttacacggggacttatggcagaagagagtcagcagctttccaacgcgcattgtcttaaaaactttcatatccagcctactgggctgtgtgaacaagaaagctcactcatcagcaatttcacctctgaattctttcaaatgaccttaggcattctttcctaacataacctgtagttaaactccaaagtaatgagatttaaaattaggcttagagaaaagattgtcttgtgaggagcagcaaagaaaagaccaaattaacctattattgaatggttgagtattctcatggagcagtaatatttggcccaattcatagcataattttaactaaatccgtgggtgtcatggcatatacatagaagatacataaaaggtaggttgctgcaccaggcctgtgtttaagaagactgccttaattcaatttaaagaaatagtttaagagtagcagttgttttgttttctttgttttgtttcaccatgtcatctcagaaaatggaagtacttcctctcaagacactgaacaggagtgagatacgtggctgaaacaaaggctttcacatcccctccccacaaggtcctttgggctccagggctgatgagccattggccatttctagtgttagctctgcctcagttctattcctgggcctgttaggagcagcagggctgagtgctattaatcaggtaagcaagaagccagaatcaacacagaccacaaaagattaccattttgtgaagacaagattcagtggattccaacccagaagattctgatggttgccattcatcagccatacacctactcttttccttgctaacagaacactgattttattccctttcttctaagcagccatgtgtttgaggggaggctcagcttcttccctgaacctaagagtgaaacttgctttgtctaaaccacattgttaatgtgtgggctggcagtgtcaacatcaacctggaaacctgttaaaaatgcagattcttaggtcccatcccagactgctgaatcagaaattccagggaagaggaccaggcgtctgttttaacaagtcttctgtgtgattctgatgccagctgaagtttgagaaccatcggtctaaaccaaacatggaggccatgcccccagcgatgtgatggctttaagtgggggtatatgatgcatttctggttgatgagatgtgaggggaagctgaggcttcttaaaagagacagaagacaggtatgttcctcttttcccttgcttctggaggttgatgtgtaaggacacaatgccctctgcaaccagagagcttatgatttttacaaccagagaacttacgatttttatgaacaagaggtattagtaaagaggtttgacaaagagttatgtctttgaaatgataaaatgttaaaaataaaaagagagcagaggttagatgtagtttatgtgaataatttatttggaatattctggctaagtgagatcttgtttagctacctgccctctgcaggtatgcctcaattggcccagaacctcactcatgggatgtcaccttgaggtcaggcactggccacaggaatggggccatccactctgtgcagatcccttgccaaacactctgtctctcacaggagcattttcccaggatggtgaggaatggttaggcttatatgtcactcagctcacccatgctaagacaaagagggcccccagagttgggtttgtagctgcccaatggccactgctcagaccaagagcagtgtttgcagagctcagctatttctcatcaaggattatttgcagttctttccaggcttatgagaagtctcattgtgaactctgcagaagggagtcacaatatttgatatttagttacaaaggctcacagtagaaaatgtgacctttcgttctgttttattttcttaactgagccctaaagcacaagaagtgttggttgctgagagttaggctagggactttgacttcctatccatctaagttagagttaactttgtaatggttggtccgatttcatacaacctcctttccatcctccagtcttctgtaacatcaaaatctcaaagcatttcctgatttggcctttgggcttaggtaatataccgtataaagcaggcagactgattttgtttcttttcatttttaataccaattgcccagataaaaaggaaacttcagtgaattttattgcaacagcagaatgtggagattaattagcaggctccctctcttttccctgccgagttgactatgtgggtgacacgtgggctccctctctccactctcactgatttagggagcattcagcccattagttggagggcctttcagcaacacggcctatctgtcccagtgtgactatttataggctactttgttccaacaaaccgctttcattctagctccttcatctgaaattgttggtagtgaactatttccattatccaagagggtgctatgagccggatcttattttcaatttgaggtcattaatatcattaggttgaagtgatttaatgtggcacagtagggatgaatgcactacagatgttactgtcatggaagcaaattgggcacagactcaaggcgtaagatagaactgctgtagactgtggtgttcaaaataatgcatgtaacatttattccaaaccagatgtggccccagtcagagtccctgctgtttcctgaattgagtttagtaagctggcattaaggtttttcctgctttgacccgagcctctctcctgctccatcttcctcttacactctcttttaccactccctcggaatgccccacactgcctgctgtggtctgcatttgcccagtacttcatgtatccatgtctctgttcatgccctaccctgacttgaaatgtccttgttttatctgtctaacaatgggctcatgtgtcctccgacaatattctactcacttttcaaggtccagagtaaatatcacctcctccatgcagccttctctggtttcctctcactcagaatgaatctctccttggcacccacacaaactcgccaagcagattacctgcacttcttttagcatgtatgtcattttgccctatattgtggttagctgtttttatgtctgtctttctcatgtgactgtgtaagctgcttaaggggaaaatgggtcttatttattttgaaatgtttcttctgttcctagcacctggagcagcgcccagagtgcggtaggtgttcagtaaatatatgcttaataaatggaagactattatgatttttcttccacattagattctccctagaaaaaggcagaaaaaaagcagccatagtttgactgcagagtttgaataatttcagagaaattgtttgtttctttaggttttttgtggattaattttaaattaacaaatgaaaaagtgttatgttttcagcacctaattgtattcctgatttaatcttaaatataagacaatgctcccagaaatctggcctttctcttctataatatttttttcacttcttttcaaacacaatgttgttccacattttgattaaaaagaaatatatttgactgaaagaatggcactatcccgttcagctatctcttaggaaacgcctgaaggatgatgtggcccagcatttatggctgatgccactttacacagaacactcaggactgccctccctccccagggtcactgtgcagtgcttttaatggaggaggtggtttcctatttcatgatatcctcaggcaggacagcttagccccaccaatgtgagtggatgctcactgtctcctcaggcatcgtcttctgttttatgctaaaagcagcgttgaatcagcccattccactgaagacttaccagtgggccactagattttgagatatttttgcccacttgagagaaaatgtagcttaagtattttttttaccccatgtgtgctgaatatttttaatttactcctccagatatacttcctaccatttttctactctgctttgtgccccaggaggctgtcctgtgcttctttggtctctggcttctagttgggttcagcccattggcaggagattggaggaaggtagggagggagttgggtatttattctctgagcttcttcctgtgggctggctatgtccctccattgaaggttacagtttctgtggtggccccggccacagagctctctatgtgtctgggttctggtgaccactccttccaattgcccctttaggctgagaggtggtaacagacccagccattactaggcctcagctatctcatgttttagggatacttttacttcccttcagggacattcccattataccttgtcaatagtctttgtgttaaactttcctcatgacccatgagtgtaccatcattttcctgccaggacttgattgaatcacagtgtcatatcagacacacctggagtgtcctagatttggttttgtttttaaatctccttctccttgtgaaaaacttgtgctccagactttagtgagacaagaattgggtagtaagtgaggaaaggaacaaaattcatggggctttctgcttagcaacttcctttatcaattcttctgggaagcatctcaatgttaataaaaacccaaacaaaatttctcctttaaaaagagaattttataataaaaaggaactggagaacctgaaaatgggaaagaaccttggaaattgtctggggagggatccggggtgctttgcctgttctatgtccagagccctactctgaggacagcttctaccctacaatatctttacacaataaagaagtttgaagcaggttccttttgatagatctaaaacttttactagtcatcatggagcactttcactatagggagcacacttttctttataatgtatccccatgatcacagggagttggattcaggattgatgccttacacaaagactgccttccatccatggtggctgcttatgagagtcatagtttactgggggatatcacatggatggtgactggctggtgcagtctcagaaaggacctgtcaatcctttctcttggggaatttgaataggagttgtacagttattaagcctgtagacctgggagcagcggaagaagggaccaagtagctgaatcactgtgacagaataacaacagaataggaaagagaagacattatctatggagggagaccaccagaagcagtctgctacagcatacatccttaatgactttccaacttattctcaagcaggtcctttccttgcaataaccctaggcagcattaggcttaactaacttcaagtacagaagaaagagagtctctcttttctaataaaattcccaggattgagtctttttggactggttagagtcacatgaccaaccctgagctaatcactgtgacttgggaaatggaacactctcattgatggagctgggtcacatatacacacccagagcctgggaggagcgtctatcttacctgaacaatggaatgctattttcagaagaaaggagaagcctggacaggccaaaagaacagactgggtcattttagcacatttcagtttcttactacctgaaagatcctgcctaacataactaccattcagaaaagcaaatcctcttttttctatcatgtactgtcatctagtcctatgggcacaatttgaatactttcagggacagcttactaaacctccaggtgggctgcctgatatgctgttgaacagcccacaccgtagcaagtccctcattcatatgcatccacctgcctgctgccaattctccttggtcctgttctgtcctatgcaacaacactcccaaatgtcctccctcctccacatgacagccttttgaattttatgacagttaagaattaagaatgattacagggaaattaaaatcgggcaatcatttgctggaaagaacatatttttctcatttacctacatgcaacgttaaataactcactcctactcaattaaaagccccaagccaaaaacattaggactccaagtgctctctctccccttcccccacatggaagattttataacagacaactatattgctataaataatgtgccttgctgttgagtgagccagcactgggcctaaataatgactttagctgtagaatggcaaatccccctctgcatgcagaacataacagacaatccagtctgatgagcagggaaatggaacgattcggcttccaattggtctttgtttaatgttgtctctctttcaaatgtcacttaaagtgtcacaaattgactaattgatctgtaaatgaacctagcaacatttagagtttaaacctttgaacacctttgggatctagtgactcaatgctgtagaagcaaaccatttcaacaccctggcagctaggagttttgcctgaggttaatgagaagattccagtggtaagaagacagtggcccagccattatctctgggcaccttgttctctgccctgacccccttaaggggtcctgactctcaaggagacttcctaatctgataaagtgagattcctttcaactcagaagagttgactattaattagggatataaaatgttctttctatcaagtcaacctgggaagcctgagatcaaaagtcacatcactaaccctcagctcactgggagctttccacaccctgcaaatgtctgccagcgggcagcaaaaggagatatttctttttgttttggactgtcctcatgttgtctaaagctcttagttctgctaagggctgggagaaacaaacactcctgaacttgctgtttcaaggtaacccatccattaccgaaacaggagcgttgctagtttaaagttccaagtccctaacatagctgacttttatgccattgcctaggttttgttgctttcctctgagttgttccttgcccatctggacctgtgtgtcctaaagctgtcctgccttgtctttgggacactctgctgtgcccagtatctttaactaaaaaccttgcactgctcagtatcagctctcgctctgtgacctccatgatgctctggaggtcctgtttatgccttgactgctttgtcgccccatcccacaatgtgggcaactcggtgaggctgcctctgcagccattctccactattgctgctctgccatctctgcgtgccatccagacccagtgttatgcccaacggggaacgtttctggatgcccctggactctccctcacccttgttagggatgtctagtatctcagccttgtaatgcaggatactcagacttttctcaagaaccccccagcaactaaacgcattgttctttctgatcctgccttgaaacttctgtctaggacttcccagacctctgacctctttctacagcagcttgtaatgaagtctgcattcagacctccaacctttgcttctgacgtgtaaaggaaatctggggcctttaaaaaaataaaccttctctcttagcaaaccatgttctgttgtgttttttaaaaacagttttattaaggtataatttatataccataaaattcactcaaaataaatgtacaattcagtgattttagtaaacttatggaattgtgaaacaataaacaaaatcagttttatgatattctcctatcctcaaaaagttcgctcattcctgtttgcagttaatccctgttcccactcccagccccagcaaccactaatctgttttctgtctctataaatgtgctatttctagacatgtcataaaaatagaattataaaatatatagtctttttttgtctagctcctttcacttagcataatgtttctgaggatgattcatgtagttgcatgtatcagcagttcattccttttaatcctgaatagagttccataaatacaacacattttgcttttccatttgccatttgatggactttggataatttcctggtttggttattataaatgttgttgtgacattcatgtatatgtctttatgtggacacacattttcatatctagaagtgcagttacttggttgaatgatatacttgtatttaagtgtttaaggacttgccaaactacttttcctagtggctgtaccactttacattctcaccaggaagcatgaaagttccagtttctccacattttcactaattcctcgtactaaaaaaaaattattatagccattctagtaagtgtatagaggtgtctcattgtggttttcatttgcatttccttaatgactaatgaggttgaaaatcttttcatgtactcattggccattcacttattctctttggtaaaatgtctactaaaatctttcatccagtttttttagttgggttacatatcttctttctattgagttattagtattctccatgcattctgaatacaggtcctttatcaagcataggatttgaaactatggcttgtcttttcatttacttaatgatatcttaagtaattgttttacttaaagtaaaataatttttatttttaggaagttcaattaacctttttttcttttatatattttcttttattggtgtcatagctttgccaaagccaagatcataaagaattctcctgtgtttccttctagatgatttagagttttaactcttaactttaggtctgtgatccattttgagtttatttttgtgtgcagtttgagggaagggcctaagtaatttttttctcacatatggatatccaattgtcctagcactattttttgaaacgattatgctttctcaattgaattgtcttggcatcattgtcaaaagttaaggttatagtccataaatgtaagaaattattactaagtctcagttctctcctattaatctatatacttatcctttgccaataccacactctgttggtgactatagctttggagtaagttttaaaattagatcatgtaagttctctttgttcttcttcaaattgttttggctatttaagttccttgcatttccatacacattttcaaatcagcttgttaatttttacaaaagcagttgctgggattttgatagggattgtattgaatttctagatcaatttggggagaatttgccatcttgacaatattgactatgccagttcaggaatatgaacattatttagatctttaattgctcagtaacgttttgtagtaatcagtatgcaaaatttgtacttctttttaaaaatttatttctttgtatttgattcattttgatgtttttatgacaaaaatctttcttaattttgtttttggctgttcattgctagtatatagaaatattgatcttatattctgtgatcttgttaaattcatttattctagtagtttttttgatgaataccttgagactttctacataacagattatgtcatctatgaataaaaacagttttacttctccctttcaagtctgggcatctttaatttccttttatttattttttattgcattagctaaaacatcctttacagtgttgaaaagaagtggcaaagtggcattgttccctgtcttaggggaaaaacatttagtcttttttaccatttagtatgatgtgagctgtggatttttcatggagacactctttcaggttaaggaagttctcctctagtttttgcttgggaaagttttatcatgaataggtgttagattttgataagtgtttttttcttcatctattgagctgattatgcattcttttcctcttattctattaatctggcaccttacactaactgtattttgggtgtaaaaccaaactacagaccacttagttatggcctataatccttttacaagtcgctggatttgatttgctcatattttgttaaggatttttacatttatgttcatgagtgatatcaatctgtagtttcttcttttttggtatctttgtgttgttttggtatcaaaataataccttaaagaagaggtgagaattgttccttcttctgttttccaaaagagtttgtaaaggattgttactatattgtcttaaaatatttaagaaaactcactggtgaattctgagcctgggcttttctttgtggaaatatttaaaattaagactcaatttcttcacttgttatagatctatttagattttctcttcttgagtcagttttggtaatttgtgttgttttaggtattcatttcatctaagttgtctattttttgttgtgaagttgttcatattttcttatatattttttaattctgtagggtcagaagttatatcccccttttaatttctgatttgggtaatttgttttcagtcagtctagctaagttttgttaactgtgttggtaattcataaaaccaacttttgattttatggattttatcttattttcccatttcattgatttctactctaatcttcattaattcttttcttttacttggattttgtttacttttcactttcttttttagtttcttaaggtgacagcttaaggtgacagcttaggttattgatttgatactttctgatataggtgtttaaagctctcagttttcctcagaatgctgccttagctgcttcccataaattattaaaattttattttcattcagttcaaaatatttttaaatttcctctgttatttctttgttgaaccaatggtttatttagaatagtcctatttaatttccaaatgtttgaaaatttcctagtttattctctggtttagatttctaacttaatttcattgtgtttgaagaatatatttttatagcatgaacccttttaatatagtaagacttgttttctggcctagcatatggtccatcttggagaatatttcatatataattgaaaagaatgtgtgttctgcagtcattgggtatggagctctattaagttttccttcagaatccaccagggattgttttaggatctcctggtgctcatatcacttatataaattagtgtagtatttgcatacatcttatgcatgtcctcccatatactttaaatcatctttagattacttataatacctaatacaatgtaaatgatatgtaaatagttgcattgtatttttattgttgacttgctatttttaattgttgattttttcaaatattttcaatccacagttggttgaatctgcagatagggagggccaattgcatattgctactcacatagagttgattgacagtattgctcaagtcttcaatattcttgcaattttgcaggggaggatctggttgttctatcagttactgagagtgaggcattaaaatcgccaagaagaagtgttgaattgtctatttttcctttcaagtctattgtttttgtggtattttggtgctctgtctataagtccatatatacatttataattgtcatattttactaatgtactggcagttctatttttataaaatgtccttatctttgataacattttttatcttaaaatttgttttgtttgacagtaatatagttattgcagctctcttatgtttgcatggtctatctttttacaatatttttttcaacttatatttttcgttgaatctaaggtgtgtctcttatacacagcatatagttggatcttgatttttcatgacaatctttgtcttttcatttagactatgaaggtttaatgcatttattgatatgatttaatttacgtttactgtgttgctatttattttataaatgtcttctttcttttttgtcactctgttcctctttgattcttttgtgttaaatacatattttaattagcttgttcatttttaaaaatatttctgtgagttattttcttagtgatattgttctagtgattatgatatgcactttaacttatcacaatatacttcagattaacataacttgattctgataaaatgtagaaacttcgctccaatatacttccattcattccttatcctttgtattatattttgtaatattatatatatacacacatacatacacatgtatataataatgataacaacacagtattaaaattatttattcatgcaatggtatgtcttttaatagtaaactaaagcactttacattccctgcgaatcttgttttatagggaataaaaagctctttggtttaacattttcagagttatctttccatttcagtgtctgattcactttaacctcagtgaccacttagcttatttggttccccaactactatcttgagttgtccagattccaggctttctttttaatgagaaacactcaattcttttgaattttagtgtctttcccagctccttgaccttaccatgagtcacatgcctgtaatcttctatattcagaattgaatctgagatctgagttccagttgaattttgagccattctagtcctggaccacctaatactatgacttccagattttaatgtctacatctggggacatgatagttcaagctttcacaaacaagaaaggtattcatttaaaaacttggggtactcttgcttaggaaaatggtgaaaataataacaaacccataatttttaggggttttatcattgcttgctattttctccacaacttgcatgtttatagtttccatcctgcttccatccagctacttcttctccctaagcttccatctggctacttctacttcccaagtaggccatgtgtcattatctccccatccctgggtcaatgctgctcccaaagaggccctgattcagtgggccattccattttcaccatgagtgtggtgactggtgatcctttcatgtggattctttcatgtggacgtgattctccatacctgagccaacactgctgtccctgggaaaagggcctctgtgtggggtatgggcaggctcacctgcccttatttgatttatgggaattcttctatttacccatgctttccccaaactgactatagttaattggatggtagatcccaaaagatatgcctgtatcctaatctctaaaacctgtgaggccgggtgcagtggctcatgcctgtaatcccagcactttgggagtccgaggtgggcggatcacgaggtcaggagattgagaccatcctggccaacatggtgaaaccccatctctactaaaatacaaaaattagctgggtgtggtagctcatgcctgtagtcccagctacttgggaggctgaggcaggagaattgcttgaacccaggaggcggaggttgcagtgagtcgagattgcaccactgcactccagcctggtgacacagcgagattctgtctcaaaagacaaaaacaaaaaacaaaaaaaactgtgaatataaataatatcctaaacttttcccaaaactgaccaaccacctccccttggaatttagtgagcagattaagcttaagctttatgcctctcttcaaatcttctcctacatttgattttagctcatttttttccccattgttccagccccttcctcattcctacccctctgccaatattctgaacatctacacagaaataccatactgcattactcccattttctctccttcattactatagaactatgtaaaatcaagtagagggaagggcaaagaataaaagcaaaaaactggggacacactaatgttattagagataacgtagaaatcttaacataatgattcaatttctacatagactattcccatccagttatgtcactatcccagaggttggtttaaatcccttttttcattcaataggaattcaaaaagcacctctctgcacagctgtgtgatagattgagaaatgtcctttgctcccaaggagctcagttcacattaccttgattaactatggactaaagcttctcttttctttactagaggccaactatagagagggttaaaaagcctcagttattagaattcacaaagtcactattgcataaaattcctttaatattccatgcataattattgctgtccttagtggatcagaccactccctgcctgacttctcaacagtaatccatatcagatctatagagaatcagttacacagtgatgtgacttggtaaattcttccacatcagtcagcaaagctcagcggtcatattctggatagtctgtccccagatgcttgtttattataaagtaaactgagtctgcccagtgaaatttatcccacattactagatgtggtgaaataaacagaaaaaagtcattggtcttcccttcagaatatgtagacctacaggctccccattacagaaagcattatttcttttttctaggtatgactttctttggttccaaatgcaaaagtgatatgtactcaagcagaaaaaaaaaatacaatactaacaaaataaaggcactaaaaattgcccctaatcccagtatccacacagataactactgataatatttcggtatatagtatatctttttttctctgcagagatactttttgcctatgtcaaaacagtgttacactgtacatattattttgcgggctgctttttcagctcatagtgcatagtgaacattttcccattatattcatgttagaactggcagtagaagcatcgttcttcctttaacagattttaccttatggctggctgactctagttatctcctcctggtcttcctgctttgagtcttttacactccctggccaccctatgcctgtttacaagattgatctgcctaaaatactatttgtacccttgacccccaaccagaatccttgatacaactttttccttcattctgccccaattgcctagagggaggagttctcacctagccctttattccaggctgtcctcaacaagtccaagatgatttatgtacattgttttgcatcacttattacataaatcctttgtctaaatgagtttccatcccacatggtttgctcattattccctgatagacaactcaacctccccattgaagccgctctatctgctggtagagtcttcctctcctattctctatctttgcccaggttcttttctgcccttactgcccagatgttttctttgctttttaatttttttaaaaaaattttatgggtacatagtaggtgtatatatttatgaggtatattggatattttgatacaggcatgcaatgtgtaataatcacatcaaggtaatcaccttgagcatttatattttgtgttacaaacaatccaagtatactcttaattattttagaatgtataattaaatcattattgaccatagtcacctgcttttgctataaaatactagatcttcttcattctttctattttttttaatccattagccacccccacttcctccccaccccccattacacttcccaacctctggtaaccatcattctattctctatctccatgagttcaattgttttaattttttgatcccacaaataaatgagaacatgcaaagtttttcttcctgtgcctggtttatttcacttaacataatgacctccttgttgcaaatgatagaatctctttattttttatggccgaataaaattccattgtgtatgcgtgccacattttctttatccatctatctcttgatggacatgtaggttgcttccaatcttgactattgtgaatagtgctacaataaacgtgagagtgcagacatctcttaaatgtactgatttcctttcttttgtgtatatccctagcagtggaattgctggatcatatagtagctctatttttagttttttgagaaaccttcaaattattctccatggtagttgtactaatttacattcccaccaacagttataggggtttccttttctccacaccctctccagcatttgttattgcctatcttttggataaaagccattttaactggggtgagatgatatctcgttgttgttttgatttgcatttctctgatgatcaatgatgtagagcaccttttcatataccagtttgccatttatatgtcctctttggagaatcagatattttgtccattttcaaaatcagattattataatttttcctctaaagttggttgagcttcttatatattctggttattaatctgttgtcagatagatagtttgcaaatattttctcccagtatctcttcactttgttggctgtttactctgctatgcaaaaagctttttaacttgatgttatcccatttgtccatttttgctttggttgtctgtgtttgttggggtattactcaggaaatctttgcccagtccaatgttctggagagtttcctcaatgttttcttgtagtagtttaatagtttcaggtcttagatttaagtctttaatccattttgatttgatttttgtacacagagaaaaataacggcctaattttatttttctgcatatggatatccaattttcccagcactatctattgaaaagactgtccttttccccaatgaatgttactggtgcctttgtcaaaaataacttcactgtagatgtatggatttgtttctgggttctacattcagttccattggtatatatgtctgtttttgtgccagtacaatactgtttttgtttcaggagcatattgtttaatttccatgtgtttgtatagtttccaaaattcctcttgttgttgacttctagccttattcaattgtggtcagaaaagatacttgatattatttcagttttttgaatattttaagacttgtcttgtggcctaacatatgcgtattgtctatccttgagaatgatccatgtactggcaagaagaatgtgcattctgtagccatttgatgaagtgctctgtaaataactattaggtacacttgacctatagggcagattaaatctgttttttctttgttgatttttttgttctagatgatctgtccaatgctgaaagtggggtggtgaagtcttcagatattattttagtgctaataatgtttatttatatatctgggtgctccagtgttggttgcatgtatatttacaattattgtatcttttttctgaattgactcctttatcattatgtaatgacctttgtctctttctatagtttttgtcttgaaaagttattttgtctgatacaggtgtagctactcttgctcttttttggtttccatttgcatggagtatctttttccatcctttattattttcagtctatgtatgtctttatatatgaagtgcatttcttgcaggcaacagatgaccggggcttgcttttttttttttttttttttgagacaatgtctcactctgtcacccagactggagtgcagtggcacaatctcggctcactgcaagctctgcctcctgggttcgcgccattctcctgcctcagcctcctgattagctgggactacaggtgcctgccactacgcccagctaattttttgtattttttagtagagacgaggtttcaccgtgttagccaggatggtctcgatctcctgacctcgtgatctgtccgcctcggcctcccaaagtgctgggattacaggcgtgagccactgcgcccggccatatcttttttaatccatcgaggcactctatgtattttgactggagagtttagtccatttacactaaatgttattattaataaataagggcttactcctgccattttgctatttttttttctagtggttttgtggtcttatcttccttcttttctttttttctgtgttccttttagtgaaggtgattttctctggtggtatgttttaatttcttgctttttattttttgtgtatctgttgtatgtttttagatttgaggttaccataaggcttgcacttaatatcttataactcattattttaaactgatgacaatttaacttcgattgtataaacaaactaaaaaacaagcaaaaagaaaactaataaaactataattttgtctctctgctttgtaactttttattgtttctatttatatgccattgcgctgtcttgaaaagttctcgtagttattatttttaaccatttcatcttttcatctttctacttaagatatgagtagtttatataccacaattacagagtcataatattctgtgtacttactattaccagtgagctttgtatcttcacatggtttcttattgctcattgatatctttttcattcagacaaaaaaaaaattccttttagcatttctcgtgggacaggactgatgatgaaatctctcagcttttatttgtctggggaagtctttatttcttctgcatgtgtgaaggaaattttcatcaggtatactattttaggataaaagttttctttccatcaacactttaaatgtgtcatgccactctctctgagcctgtaaggcttctactgaaaagtgtgctgctagacatattggagctccattatatgttatttgtttcttttctcttgctgcttttagaattctttctttatttttgacctttaggagtttgattattgaaggttttgaggtagccttctttgggttaaatctgcctggtgttctatagccttcttgtacttgagtattgatatctctctctaggattgggaagttatttgttattatccctttaaatacactttccacccctatctctctatctcctttttagggcctataactcttaaatttgctcttttgaggctatcttctagatattgttggtgtgttttattcttttttattcattttcttttgtctcctttgactgtgtatttttaaatagcctgtcttctagcttattatttcttttttctgcttgatcaattctgctgttaagagactctaatgcattcttcagtatgttaactgcatttttcaactctagaatttatacttgagtattttaaattatttcaatttctttgttaaactcatctgataggattctgaattccttctctgtgttagcttgagtttcgttgagtttcctcaaaacagctatttcaaatgctctgtatgaaacgtcaaatatctgtctctctccaggattggtccctggtgccttgtttagttcatttggtgacgtcatgtttttctagatggtcttgatgcttgtaaatgttcaccagtgtctgggcattgaaaagttaggtatttatcatagtctttgcagcctgggcttgtctgtacccatccttcttgggaaggctttccaggtatttaaagagtcttaggtgttgtgatctaagtttgtggtcactgcagccatatctgcattaagggacctctcaggccaagtaacactgtagttcttatagacttgtagaagtactgccttgatggtcttgtataagatctaaaagaatactctgaattagcaggcagatactcttgttctctttccttactttctcccatacagagtctgtctctctctgtgtgagctgtgtggagctgggggaggagtgacaccagcacccccgtggctaccaccactgggattgtactcggtctgacttggagccagcacagcactgggccttgcccaaggcctgctgtaatcactaactggctattgcctatgtttggtcaagggcctcaggctgtacaatcaattggtggcaaagccaggcagttttttgtccttcctttcagggtggtggcaagttcccctgggccccaggtgggtccagagatactgtctaggagtcagggcctggagtcagataccttagaaatctaggtggcactctattctactgtgactaagctagcaacaaaaacacaagacaaagtttttccaactcttccctcccctttccccaggcagacgagtctcgccatgttcaccactaccacggccctgtgtgcaatactcccgggctaccaccagtgttcccttaagacccaggggcttttcagtctgcttgtggtgaatgctgccaggcctgggactctaccttcatagcaatgagttctcctctggctcagggtaggttcagaaatgctttccaggagccaaggcctggaattagggatgccaagagccctcttggtgctcctccccactgtcgccaagctggtacctaagctgcaagacaaaaccccttttattcttccctctccttttctcaagcagaaggaatctcttctcatagctgccacttctgtgaatatgctgggtcacacctaaagccagcatgtctcagagtcttaaccaagcccatggtgtatactacctggttactgctgctgattattcagggttcaaggactctagtcagcaggtggtgaatcctgccaggagcagttccttttcttagaggcaacaggttccatcctagcccagggtttgtctagaaatgtcatctggaagctaggtcccggaaagggggccttgcacctctgcctgctgccctatctaccatggccgagctgataccctagttttaaaacaaagttctctttactcttccctctcctctcctcaagtgaaaaaaaaaaaaacgggtctcttttggaactatgagctatgctgcttgggagtggggaaggggtggaacaagtactcccttagctgctctggcagatgtctaattaggttacacgccctccaaatccactggctctgagcacagcatagcattcagacttgcctaggaactgcaggctttatggcctagactgcctttcaagtttatttagatcccatagcactttaccccctggcagtgaggcttgccaaaaagcaagttccaactgctgggatgggtaattcccctctggctaggcctggtctaaatgctccttctgtgggcattggctgagtctgcccaatgtagctttccgctgtgacagcacagcactgggttccaatacacagttttacaattgctgcactctccctcccctaagcacacagatgctctttccatgccatgcagctgctgctgtggggtgggagaagggtggcatcggcaattcaccgctgtctttcctactctcttcactgcctttttcagcgatatgaagttaaaaccaggtactgtcatctctcagctgatgtttggttcttaggaaggtgctttttttgtgtagatagttgtcagatttggtgttcctgtggggaggatgatcaatggaggcttctattcagctatcttgctccacctcctccagatcttttctgacatcactgtagtttctctaactgccccaacccacagttgtctctccctcttcctctaaagtgtgtatcagctattgcacttattctgacgtgtagaatatacagctagtcatccatgaatatctgtgtactccccaggtaagaagtgagtcccatgaaaagggctgaattttccaccttttttcccttaccaaggtatagaatttgtcacccaagcaacaaaaaatgcatatggatgttggcgatgacaaatattaatagctgatttaaggatagatgatacacaaagaggaaaaaacaaatggacaaatagaaaacaaaagcatggggtaactgatacataccttgaaaaatcctcaactacacacatgaacaacaacaatatcaattacaacaaccacaaaactatgcatgggaaataaacaccaaaaccaagaagacattgaaaatctggattacttaatgacattttctccttctctcttccatgtatccctgttcctgccctgctctgtaaccaagtttcacacatggttaagagaaattacctatgctttctcaatttttccattaggaacttgtgacacccttataataaaatacttatttcatttgacttacaagagtaattacatggacattgtaaaaaccagaaaatacagtacttggagcataaggtaagaacttttttttttcttttaactaggaaatttatttgacaaaatcttaatgacagatttgaaggttttaaataaaaaaataactatctctgtgatgtagtcaaaagtgtctttgaatatcagtcaggatacctggatgatggctcaaactctaccattaagtagttttgtggaaagttatttaacatttcctgggtttttgttttacagatttatcgtggtataattgacaagtaaaattacgtacatttaaggtgtataacttgatgatttgacatatgcatacattgtgaaataatcaccacaaccaaggtaattaacatatttgtcatctcacatagttaccatttttcttttatttttttctggtgagaacacttaagatttaatttcttagcaaatttcaagtatacaatgcagtattgttaatttcagtcaccatgctgtctgtggatctccagaacttagcgatcttgcgtaacagaacctttgtaccctttaactaacatgtcaacattttccttgtcccaggctcctggcaaccatcattctactctctgcttctatgagttttactatttcagatttcatgtataagtgagatcagacagtacaggtatactttgaagatattatgaattcagttcacaccactagaataaagaaaatattccaataagtttgtttatttcccagtgcatataaaagttatgtttacattacactgtgttcatattaaatgtacaatagcatgtctaaaaagtaatgtacacaccttaatttaaaaatactttattgctaaaaaagtgctaatgaatatctgagcattcagtgagtaatctttttgttagtggagggtcttgctttgatgttgatggctgctgactgaccagaatggtggttgctgaaggatggggtggctgtggcaatttcttaaaataagatgacaatgaaatttgtcatatcagttgactgttcctttcatgaaagtgttctctatagcaagcaatgctatttgatagcattttactcacaatagaacttctttgaaaattggagtcaatcctctcaaactctgccactgcttgatcaaccaagcttacggaatattctgaatcatttgttgtcatttcaagaatattcacagcatctttaccaggagtagattccatcttaagaaactactttctttgctcattcataagaaacaactccttatctgttcatgtctgaccatgagttgcatcaattctgttacatcttctgcctccactattaattccagttttctttgctatttctactgtatctgtagttacttcctccactagagtcttgaacccctcaaagtcatccatgagggctggaatcaacttctttcaaaatcctgctaatgttgatatttgacatcctcctataaatcacaaatgttcttaatggcatctagaatggtgagttttttttttcaagaaggttttaagtttattttgcccacatccatcataaaatcactatgtatggcagctgtagccttatgaaatgtatttcctaaataataagacttgaaagtgaaaattactccttaatccatgggttgtggaatggatgttgtattagcaggcatgaaaacaacattaatccccttgtacatttctatcagagctcttgggtgaccaggtgcattgtcaatgagtggtaatattttgaaatatgtctttttttctaaggagtaagtctaagaagttggcttgaaaacattcagcaaaccatgttgtaaacagatgtgctgtcatccaggctttgttgttccatttagagcacaggcagagtagatttagcataattcttaaggaccctagggttttgggatagtaaatgagtattggcttcagcttaaaagtcaccagctgcattagcccctattaagagagtcagcctgtcctttgaagctttgaagaccaacatttacttctcctctctagctatgaaagtcctagatggcatcttcttacaaaagaaggctattttgtctacattgaaaacatgttgtttagtgttgttaataattatcttagctagatcttttggataagttgctgtagcttctatttagtacttactgcttcaccttgcacttttatgttatggagatggcttctttccttaaaactcatgcatcaacctctgctagctttaaacttttcatctgtagctttcccacctctcttagccttttgaattgaaaagaattatggccttgctctggattgtgctttttattaagggaatgttgtggctggtttgatcttctatccaaaccgctaaaactttttcgctatcagcaataaggctcttttgctttcttatcatttatgtgttcactagataagcacttttaatttccttcaggaatttttcctttgcattcacaacttggctgtttggcaaaagtggcctagcttttggcctgtctaggcttttgacatgccttcttcactaagcttaataatttctagcttttgatttgaagtgagagatgtgtgcctcttcctttcactgagaggccattgtagggtaattaattgggttgatttcaatattgttgtatctcagggaatagaaaggcccaaggaaaaagagggagatgagggaatagctggttggtagagcactgagaacacacacaacatttaacaattaaatttgccatcttatatgggtacagattgtggcacccaaaacaatgacagtagtaacatcaaagatcactgatgatagatcaccataacagatgtaataatagtgaaaagtttaaaatgttgtgagaattaccaaaatatgacacagagacatgaagtgagtgtatgctattggaaaaatggcaccagttgacttgctccatgcagggttgttcacaacttttcagtttataaaaaatgcagtatgtgtgaagtgcaataaagcaaaacacattaagatgaggtatgcctgtatttgttcttctgtttctagcttttttcacttagcatagtgtcctccaggttcatctgtgttgttgcaaatggtggaattttcttctgtttaagggctaaataatattctattgtatatataccacatttaaaaaaacccattcatccattgagaggcactcagattgcttccacatcttggctattgtgaatagtgctgcaacaaacacaggactgcagatatctcttcaagatgctgatttcatctcctttgggtatatacccagtagtgggattgctgggttacttagcagttctattattagcttgctgaagaacctccatatcatttttccatagttgggcgtactaatttacattcccaccaacagtgtacaagagttcccacatccttgccaatacttgttatctcttgtccttttgatggatagcaacaggtgtgaggtgatagaacatttatgttcccaaaatgcatttcattttacctgtgatgaaaagctgagggcgtctcctacattaactttctgtgatctgacaaatttaagaacttaactgttacagaatttcataggatcttggatctgccctttttacaacattcttccttcaaaaatgaatggaataaaaaagaagtgagaaaatacgcctatttataaaaatatattagatgttatgagataaagagacatgtaataatggcttttctcacccgaagaagatgaacaaatttgaacagaaacaaatagattttggcttattaacttatttcttgaaagaccttcaggttagatatttttctccatcccatcatgcgaggttagctttatgtgggaagctcctccagagtctggttcactgtagttttcaagggtgaagataaatgtttatgtaactccacctatagaatagttacttttgagtccaattagactagcttcacgaagtctattttttccccctttcctttgaaatgagataatggatgtggaagtttttaacacagtgcttgcaacatagcgggtgctcaaaaaacattttcttttttccttccctccttcatttaatttgtagtattttagatttaaattgccataaaatgagagttcgtaatgtaccattttagaaatcatcatagttcatcaattctctgaagcatatttttaaaattttgctgaaattgtgaaatcatttttaactgctgctggccaggcagctgtcatgatctggttgctaatgcctgtaagtgagcatcaaaactcgcagagtcggtgtcaccagattggaaaaaagtctcagagacaaaagttcagcatgctttcaaaaaaaaatgctacatcatcaacacaaaggatggctgggtggaaagacatggacattaataatgctcagtaaaacattcataatttcaaattctgaatgtaaacaaatttgggaatactttattttatttttttatttatttttatttattttttatttttattatacttttaagttttagggtacatgtgcacattgtgcaggttagttacatatgtatacatgtgccatgctggtgcgcttcacccactaactcatcatctagcattaggtatatctcccgatgctatccctcccccctcccaccaccccacaacagtccccagagtgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatcccgtctatcattgttggacatttgggttggttccaagtctttgctattgtgaataatgccgcaataaacatacgggtgcatgtgtctttatagcagcatggtttatagtcctttgggtatatacccagtaatgggatggctgggtcaaatggtatttccagttctagatccctgaggagtcgccacactgacttccacaatggttgaactagtttacagtcccaccaacagtgtaaaagtgttcctatttctccacatcctctccagcacctgttgtttcctgactttctaatgattgccattctaactggtgtgagatggtatctcattgtggttttgatttgcatttctctgatggccagtgatgatgagcattttttcatttgttttttggctgcataaatgtcttcttttgagaagtgtctgttcatatcctttgcccactttctgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccattagtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacgtatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagcgttgtagtatagtttgaagtcaggtagtgtgatgcctccagctttgttcttttggcttaggattgccttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctctttaatttccttgagcagtggtttgtagttctccttgaagaggtccttcacatcccttgtaagttggattcctaggtattttattctctttgaagcaattgtgaatgggagttcactcatgatttggctctctgtctgttgttggtgtgtaagaatgcttgtgatttttgtacattgattttgtatcctgagactttgctgaagttgcttatcagcttaaggagattttgggctgagacgatggggttttctagataaacaatcatgtcatctgcaaacagggacaatttgacttcctcttttcctaattgaataccctttatttccttctcctgcctaattgccctggccagaacttccaacactatgttgaataggagtggtgagagaggacatccctgtcttgtgccagttttcaaagggaatgcctccagtttttgcccattcagtatgatattggctgtgggtttgtcatagatagctcttattattttgaaatatgtcccatcaatacctaatttattgagagtttttagcatgaagggttgttgaattttgtcaaaggctttttctgcatctattgagataatcatgtggtttttgtctttggctctgtttatatgctggattacatttattgatttgcgtacattgaaccagccttgcatcccagggataaagcccacttgatcatggtggataagctttttgatgtgctgctggattcggtttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccaattcctccttgtatctctggtagaattcggctgtgagtccatctggtcctggactctttttgattggtaagctattgattattgccacaatttcagctcctgttattgggctattcagagattcaacttcttcctggtttagtcttgggagagtgtatgtgtccaggaatttatccatttcttctagattttctagtttatttgcgtagaggtgtttgtagtattccctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgctttctgctagcttttgaatgtgtttgctcttgcttttctagttctttcaattgtgatgttagggtatcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgcagttgagcggttttgagtgagattcttaatcctgagttctagtttgattgcactatggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctgttaggtctgcttggtacagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgagggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtcttgatggtctttacattttggcatgattttgcagcggctggtactggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaaattctgggttgaaaattcttttctttaagagtgttgaatattggcccccactctcttctggcttgtagggtttctgctgagagatctgctgttagtctgatgggcttccctttgagggtaacccgacccttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaagttggttccattctccccatcactttcaggtacaccaatcagacgtagatttggtcttttcacatagtcccatatttcttggaggctttgctcatttctttttattcttttttctctagacttcccctctcgcttcatttcattcatttcatcttctatcgctgataccctttcttccagttgatcgcattggctcctgaggcttctgcattcttcacgtagttctggagccttggttttcagctccatcagctcctttaagcacttctctgtattgtttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcattcctttggaggaggagaggtgctctgctttttagagtttccagtttttctgttctgttttttccccatctttgtggtttttatctacttttggtctttgatgatggtgatgtacagatgggtttttggtgtgggtgtcctttctgtttgttagttttccttctaacagacaggaccctcagctgcaggtctgttggagtaccctgccgtgtgaggtgtcagtgtgcccctgctggggggtgccttccagttaggctgctcaggggtcaggggtcagggacccacttgaggaggcagtctgcccgttctcagatctccagctgcgtgctcggagaaccactgctctcttcaaagctgtcagacagggacatgtaagtctgcagaagttactgctgtctttttgtttgtctgtgtcctgcccccagaggtggagcctacagaggcaggcaggcctccttgagctgtggtgggctccacccagtttgagcttccaggctgctttgtttacctaatcaagcctgggcaatggcgggctcccctcccccagcctcgctgctgccttgcagtttgatctcagactgctgtgctagcaatcagcgagactccgtgggcataggaccctcggagccaggtgtgggatatagtctcgtgatgcgccgttttttaagcccgtcggaaaagtgcagtattcgggtgggagtgacccgattttccaggtgcgtccgtcacccctttctttgactcagaaagggaactccctgaccccttgtgcttcccaagtgaggcaatgcctcaccctgcttcggctcgcgcacgatgcgcgcacccactgacctgcgcccacagtctggcactccctagtgagatgaacccggtacctcagatggaaatgcagaaatcacccgtcttcgtcgctcttgctgggagctgtagaccagagctgttcctattcggccatcttggctcctcccccggggaatactttaaccaatttttttctgtcgtattttctttttatatatgtacaagagtgaaactggagggaggcagcgtgagtttaaaaagattcttttgattaattgaaaataaacaagggataagaaagcattatgtcataagtgaccacatttttaatattagtgatatataaaataaatgtgtactcgggttgatattattttacagtagttgaaatataataattccacttatctttgaaaacaaattctctgtgagttaaggtctttagataaatctcttatccaaagacatggccaatatttatgccatcttgttctaacataagacaatggcaaaaattatactaatgactaataatttaggaaaaactaatgacagttgtaaaaaataaactgaccatgtgtccctgtctcctctcagtgctatgtccaggttccagacaagcttatgagaagttaactaccatgaagaggcctgaacaaaataatctgaattgtgaatttctttttttggtgggggggatgggggggtctcactttgtcactaggttgagtgcagtggcgtgactcttggctcactgcaacctctgcctcacaggctcaagtgatcctcccacctcagcctcctgggtgcctgggaccacaagtaggggccatcatgcccagctaattttttgtattttttgatagagacagggtttcaccatgttgcccaggctggtctccaactcctgagctcagtcaatccacctaagccttggcctcccaaagtgttgtgattataggtatgagccaccgcacccggtctgaatttcctatttttcacacttgcttcctgtaacactatggcaccttgccttgagcatataaagtgttatgtaaatatcagaggtctgctatatcagagtgttcaaattcaggaaataatcattagtggctgtagatatagtttaaatgttaattggaaagcacacctatcctttgattaattatgctatggtcctggacatgtggctggtagtgtgagaaaatctgtattaagcctgccttcagagtttctcagtggaggttctctggtgagcctgtttttccagggaagtaggagggtagacatctggaagtttgttctattcagcagagccttgatatttccaatatggcttctccattttactttgcctgttattcaaaatgctgtgctcatgcaaatgtgggcccatactaatttttatagctggttcaatttctcagaatataataaattgctcttcaaacccatgttttaagaatttctgatgaatagcaaacttgcatcctagaaattcttttaatcacaaatgataggcacaaaaagtggcttgccatctgtatactcacatgtttaaaattcttctaatattagcattcttttctgttttggataaacccaattttgcctggctgcataattgagtgttttctgtcccctgttggctgtggtttccaatggaatataaaccgtaaattctgagtggacccagcaaaaaatgtttggttctgactttactggcaacaaattgaatcaatcaataacttgccaggtgataggaaaaaaatttttttaagcaacaggaataaattatcgtgaagtatttgaaaatgttggtaaaagacatactcaaaagcataggtgatttagttgttctaaaatctttagtctttttaaatggaaattatttctatcacttataaaaatatcggggtttcttttaaactatattcataaagtgacatgatttaaagcccctctcataaggaagttcttgcagtggggatcactatgcacagtgggtaagaaccaagtctctggaggtaggctgcctcaagttaaattgtagtgtgcctgtgtcactttaggcaagttatttaacttctctgagtctcatgtttcttcatttgtagaatggggttgataatgataacacctttcccagagaaccacgttcttgcaccattttatctctctgaggatactgaggcttagggaggttaagcatcctgctaaatggcacacgggaaggcggggcagagtagagctgggattcacacccaactccaactgactgcacaccctaaagtcctttgagttaccatgaagactctaagatgagcatgaggagacagggcactggcataggagttatgtagcctgtgatctgttcctaaccagttctgtcaccatgacccaatatgggagacattaatgccaaagaattccacatgttacataacaaatagggaccagctgagactcaggcaaagtgtaggagtaagtcattatttggccccgtgcaatgttgcaacctccgtatcaaaaaaaaaaaaaaaaaaactaccccagggcgtccacaaaacaagaggaaatcagttttacgaagtaataaatcctctatatggtgactcttgataaaagaagtggtgattttcaagaactttattattaaataatgacaactatcgttatcattcacgctatacatcctatatacaatgtgctccaaaaaagagctccaggctgggcatagtgactcacacctataatccccgtactgtgggaggccgaggtgggcagatcaggtcaggagtttgagaccagcctggccaacatggtgaaaccctatctctactaaaaatacaaggcgtgatggtatacacctgtaatcccagcaactcaggaggctgaggcaggagaattgcctgaacccaggaggcagaggttgcagtgagccaacagcctgggtggcagagtgagactccatcttaaaaaaaaaaaaaaactcgaaatacaactttgtatataggttgcatagggtggaataataatgatagttatcatgatctaataacttttagaggcaccttcttcagtgagctccaatagtttcttgcaagcaatgatataagaactaaagtaaaaacaaactgtgtctatatctgtattaatttgttatggctgctataacaaagaaccacagactaggtggcttaaacaacagaaaattatttcctcacaattctggaggctagaagtccaagatcaaggtacttgcagcattggttttctctgaggcttttgtccttggcttatagacagtcgtcttctcctgtgccttcccatcgtcttcacatatctgtgtcctaatctcctccttctatatggacaccagtcacattgggttagggcccacccatatgacctcactttacctcagttacctctttaatgtcctatcttaaaatacaatcacattctgaggtactgggggttagggcttcaacacatgaatttggagggagcacaagccagttgaaaacaatatctatatctatatttacacccacatctatatctatgtttgtgggtcttactgaaacctgaaatgatagcagtgaagactcttcccaatcttatgatgtgacaatgaaaagatacatattccaagtctaattgacatgtggcctcttagcacaaacttattaggaatgagcgttttctcagccaagtgttatctaatttctgggctcctgagaccgactgctccattaacactgggaaggggagcacggctgggggaagccaccaatctgctggctggcagtcagaatgcccatgtggtatcagatctgaaaaggtgcactgtgggcagccagaaagagactagcactgtgagcatcctctggcctcaggtctttgattttctttgaggcatgtcctaaaggctgggacactcatctacacacaagaggtgcagacatgaatgtggggcaattatccactcctttcaagtgagctggctgtgcttaaactagaacgtgcaggattttctttctttctttttttaaggaatcaagtttatccaagaatatggcatcttcccatccacctaccttccttcctttcttcctccctcttcctttctttgttttcttatctccttctctcaattatttatagagtgagggcctgctatgcacaaggcactctgtgtggtcctatgggggataaaaaggtgactaagaggcactctgccttgcatgtttcattctaataacctactccctgttctgctgttggttgtgctttcagaaattgctctgctagttcttggcaaggctgaaagccacttcagctaacagcatccagaccttccctaccttcaagatcttctgtcctccctgtggaactgacagcactccacctcatctctgagccccccacacatctcctcaagctcagccagtgtccaaactgaagttcctggctcctgacccctctagacggatgattatccattcactctgtctcgcctcccagactgctttatttttttccttttctgagctgttccttctgattcctcccacttcttcctcttctcattttgactcctttcccaattcacattgatcatctctgatgagccggctgagtgtgaaaaaataaaggttctaatgatctggcttcctctctgcccactgttgtttatccagggagtaaagacatgcttcaagtactcctccctcagagctgagagtacaagaaggggtcccagacttatttgttcctttccccaaccctcactgattctaaaattacttctcaatcactgaacattagtcaatatgtttattttttaaagtaaagtgtgggaaggttgtggagagtgaatgatgagattctataatctgatttaaatcttatctgcaggttataaaatgttaaaattcatgtttggaatagaatgcaacacaggcacatattctccttgaaaattttattcctgcagtttaatttagttgggaagaaatggtcagaccagctatttttttaatcacgtagatagattgtgtgtcctgtccaaacctggcaacccctgggatcactgccttcttcctctcctgctaatcaaattcaacccatttttcatgtaccaggcaaagtcccactcttctaggagggtcgcctgggcacccatgagcttcttgagggcccagcctctgtttcagccatctttgtggcccagcaacaagcaaagtcagggacttggtagaagtgtggggaatgaatcaaaatgaacaactttctccagtgtactttctctagtgtacttagtgtctgtgccatccattcagatatgtcataatatgccttccaacattgttagtcagaccctttaaggctgaatattttgtccttccctcccagatggcctgctccttgaggagggggacagtgcttccttttttctccatattgatcttcattgactaatacagtgatggtattcagaaatattgttgcgttaaatactggttctttttgcttgacagcagtatctgttgggaactacatttagaaagctgattttgcagaagccataattttattgtaagtaaatctgtgagaggggtttggtttccatacatttcaaatggaaagtaaattaccagccaactgatgcttagtttggttcagtcacatttattgagcaattgctttgcacctgacatcaaaccagaaaatattcctgcctcatgtgggttcagagtccccagggatgtcctactgcccacctgacctggagacaggatatagtgcttgtcctcacaggtggccacagatgatcagtgggcagtgtatgtggtttcagccacatgcctggaccttactgggtggtactatggacctgctgcacacctagtgcatccccctcctgagtggtgctggattgctgcccctcccccatcccagtccctcctctggtagccagaataaattttgcagtaagttagcagagttgattccaaaaagtctgcactgtggcatctcaggaaaccaaacttatctgcttaagaaataacttgcagagagaaaaggaactctgacaaggctaataacagggatttcaagctgtgtttcagcaagccagtcacagagtattcacgtgttaattcactggcgtgttccgcggcataagcaccccctctctgccttcccccagttccaactgttgtgctgcagcagatttggtctgagtctgggcagagcccctttttatggagcaaccctcccgatttgttacagcaagagcctggtgcaagtgatctttgccttcccatcgcacacaaaggcaaagagctccttaaagggacctgcctgctcctccgtgcagctgcaaacccgtgtcggtgcaggctcagcaacccaggctttcgctcgagaatgagtggggaggggtcttgaggagcccccacgtcctcccggagcggaggcgggagggagctgacagccggagtggatggagaccaccagtccgaggggacccgcttgcgattagctgcttcttgggatgctccgcgcgccagttgagcatcctgcctgtggtccaggggatgctggcggcgcatcttgcggtaagcctgcgctgatttgagccatcgcccagaagcgagcccgcattcagacaccgcggaccggctccgcgaagggctgcgtgcagtcaccatgaatgctcagctctaggcttctgtaaaaacctcccccactgcatggatttggctgtttaatcagccgagattacagcccgggaagatttgcaaacctgattctccctccagctgctgtgacaacttcggggccgtctgtttacttctctgggtccccggggactctttcctgcatcgcagccccttgtgccactttgtgggcttggctcgaaagtcagccgccaggactcctctgacggcatccccaggaagggggagcaaggagggcttaaaagaaaagcagaaatccccgcaactgctcaacctctcgtgactgcctgtgttctggggttctgagagggaccgtgcgctgcctggggaagcaatgcaagtctccatagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggtatgcacgtaagattccctctgtgcggggtatccaggttctatacaggtgcagtggagacagtccatcggttttgaaaagtgatttactcatcagtgggttgctcactttagaattctcaggtggttctaaaatagctctttagggggatgaataaacccagggtggttgtgtgtgtaaagatttttaaaaatgtggcccattttgtataattctaaagtcctatgaacattttagaaactatgtacattccagtccccagaaaaaaacacaactgctggaactggtatttagatcaggatagtttttcagtagcaaatgtgtttgttctattttatgataaagacagtagtttctgggattatactatcagaaatagtttctcatctagtactgctctcttatttatcttttgtttgttttgtttgagacagagtctcgctctgttgcccaggctggagtgcagtggtgcgatctgggctctgtcgcctgggaaatagcctcctgggttcaagcgattctcctgccttaacctcctgagtagctggaattacaggcacctgccaccacacccggctcattttttatgtttttaatagaaaagagctttcaccatgttggccaggctggtctcgaactcctgacctcaagtgatccgccggccttggcctcccaaagtgctgggattacaggagtaaaccaccgcgcctggccttatttatcttttgaaagaccaagttaacaaatgctatacaaagctttttaaagaagctttgttgcaggaaaaaccacctatattggtaaattagattgaatagccatatttaagcctaaattactgcttgaaattaaatgtagaccttgtgaaatatggagaaaatgtaaattgttgcaattctactggtttcctcataaattttaaagcttcctcatcccctatgttgttttccatagttggaatcatcctggtaatagtggctgctctaatagggcatgacttacatttgacaagtagaaaatttcattattcaattatgtgactcctgcctcctcattacatttgctttgtaccaagtccctctgactttatttctttaaaactactgtgcttctagtttctaaaagtgtttgtgaatgtagaggagagaagctaccaacacatcttccaaaaaactttggttacttcagtttgcagatatgattttgttaattgtccatatctaactatctcttgtctttgttaggaaccaggttttagtttaggatgaagttaatgaaaataatgcataggcaacatgtgtttctcatgtgaggttgctgaaataagcatttaaacctgtttttataaaagttgcccttgaaaaaatttctttgcagagttacaggaaagtttctcattgcacaaacatcaagcactgttattttgatatatgtttgagccattaagaaaaaaagtccttgggtgggaaaaagcaaaacaaccataactaaagctctttaccccagctgcagtacaaatgtaagcagcctgacttaggtcaactcattgaagcatcagctgtgtgagtgcctttgcttttcctgatatccctgtgatggagagagtggggcaccacaatgacagttctctaaatgagactgtagtcttgagtccactgatgttttctatggctgctgctgtggcacacacgcagcccctgccttgtggacacagtgctgctctgcatgcacttcagctactgagatggagatgagcagctgctttcctgggcaaggtccccaggaacaggaccctccagggttaaggcagatcacagaaggtggtttaaattgtggcctctagtactttcgcagcactatgaactttctttttgtaaatcagaagaaatcaaaagtaagaccactaatttcttgaggcagagtttcatagttgcttgatgattgtgttggaagagtttgctcttatgaaggcctttggaagtcaggagatttccattaaggtttttctggtggcacagctcaactcatgttgagtgataactctgcttcccaaaagctcagagtgtgagcaaggttcgcttgggcacctttcattactgacaactaaagatagttctctaacaaaaagttagccactgggatcttcggtatatgttgtttcttaaggtaactaaacaagatgcctctttttcacttgtgctcatgttccaagccactctatctgtaacagtcaggagatttgcctgtgtgtgtgtgaatgtgacttactcttctgtttcagattctactctgagtgacctttatgaaggagattatgagattatgccaaatgtacaccaagctttcttagggttaaaagggggagggagactaattatatactttataaaaaatgatagaagtaacttttattagctaaattatccttttttacattgttttaactaaagtataatgtgtatatatggactatttgttaatgataacaaatagcagaatatacaaaaataatgccatagaatagggaagataattggcttaggtaagcaatctggagaatgcctgaaataactaaaatcgaaagttagtagtagctaattgtggtcacaatttcatccttgaaaatggttttcataggcagagctttaaaggggatccctaaatccaacagaagattttttaaaaagtctttttgttcatttttctgaggaaagggtttatagctttcaccagaatttgaaaatggtctacaactcaaaaactgtcaaacagcaatgttgcctagtgaagaggtactcatttagtcagcatagtcaataaatatttgctgagcacctattctatatcaggaacctcactcaactggtacacaaaggtgcagaagccaggtgaagtctggggctaaagtacaagttgaagaaacagaccataaataacaaaacaaacaaacaagcaaacaaacaaataacataattgtctaatagaagatattcctatgaagttatttttttttggaggggtgatagtcatgcttgggccaacttagttgatccattttgaagttaccaactctgcttcagttccagaattaatgattgcatcttggggcatgagtaattgtgcgtatgtctgccacccattttgctatccagagacttctttaaggtatatggtgctacctggcagctgaggacctacttgtaaccctgataaataggtataatgccttctacttatataatgccttatgatttttaaagccaactaatataacagcctatgtttaccacccattaatcaataactcacaaaactgagattttagaaagaattaatgtatacttgtgcaaaacctctgaattctgcaaaataaaatgcttaaaggcactattatattcacaccatcattgtataagaatattgcataaaactggttattgtttgaaggcagaagataaaaaaaatctactagaacattctggcattccaaagctactgtcagcccaagagaacaagattccacctaatgtttatactgaggactatcctgtatgtaaataacacaggattattcctttccttagagggcttttttttccaatacagattatttgtatatatttatggggtacatgtgatattatatattacatgcatagaatgtgtaatgatcaagtcagggtatttagggtacacattaccatcagtatttatcatttctatgtattgggaatatttcaagtcctctcttctagctattttgaaatatacaatacgttattgttaattatagtcagtctactctgctatcaaacattagaacttatttcttctatatcactatgtgtttgtacccattaaccaaactcttcatcatttcactctcagagtttcatagttgtgctttgttagtgcatgaaagttcctttgttctatttttatgtctatttttaatctcagatttcattacactgtgttagtttggtgtacactctacaaccatacatgatagatttacacatgatagatgtaggtatatacatgaatctttcatcctaagaagagcaaatcattcaggacagaagttaaggcacattgggttgtttttgtttggttggtttgggttttgtttttttaaataactttttggaatgatccagctaccagtgtttgacatggtctcagagcttctgtcattcagaattgagcacgtttgtactgataaactccctcctcctcattctgaaattgttattttagttttagaacattggcatatgatgggccccatttcattgaaaacaatctttaaattccactaaaaacttcaactccccccccccccacctttttttttttttttgagatggagtctcgctctgtagcgcaggctggagggcagtggcgccgtctcagctcactgcaaggtccgcctcctgggttcatgccattctcctgcctcagcctcccgagtagctgggactacaggtgcccaccaccatgcctggctaatgttttatatttttagtagagatggggtttcaccgtgttagccaggatgatctcaatctcctgacctcgtgatccgcccacctcggcctcccaaagtgctggaattacaggcgtgagccaccgtgcccggccaactttttccccatttttaaagttaactaccattaaaattgtttttgaaataattataaatttacagaagtttgcaaagaaaagaagtacagggaatttccatatgcccttaatttctccagtggttaagcatgcctgcttaactatatagcatgatagcaaaaccaggaaattgatgatccatatggtttggtacaatccataggatttattccgattttaccagttatacatgtattcatttttgtctgcatgttgtatgcctatgtatatttatcacatgtatagatttgtgtaaccaccaccacaatgaagaatcaaaattgttccatcatcacagggctccctcatgttacccatttctgtccacatccactcccccttctccaatttctaatcttgggtaaccattaatcttcaagtcatctctgaaattttattgtttcaagaatataaatggcataacacagtatgtattgaggttggcttttttttttttttttttttttttttactcagagggtttgtacagggaagtggtgagaaagaatcttgtagtggtgaaaagagattggaatatggctccatggagggtaagatatttagacacgagggaacatcagcaatggagggaccagtaaggatttttaagcaagatgtctgcttacaaagttctgttaagaaaggattaatctggcagttgttccagaaaaaaaaaaattaagagttgtagctatggaataagaaaatttatgttaaattccatggcactctctactttcctatagagagtcaggactatatgcaaaagactcagaccagataccagatgcctttcccatgccattcctttcagagcctttttattaaagcacatgtcacagtcaccattctttacctcccacgaatggtgggtagtttttgaattaaaacaattcaactgaaagatcaatcttgtcagccaattatgtaaaaggcacttagcgcgtgtgtgtgtgtgtgcgcgtgtgctcgtgtgcgtgtgtgtgtgcatgcaagtctccgtatggggaaaagtgggaggaaataggtgggctgaagaggaggaaaaggagagctagctctgtggctgtgtttcaaacagaaatatttgattttagtccagaaaaaaagagcagtttggttatttgaaatgccaagtttcttggtttatttttgggttttgttattgttttttggtaaagaataccgttgtcatttccactgacacccatgggtatgggctttcctctctgccttaaagtaaaatggtgagaatggggaggtggaagagccttcctaaaaattaactgctgattcaatctcatagagtttattccacctctgcaaggcagcagtcagaagtctggcatccatgggatggtgagaaaatggtaggaggggagggagcctcctggaagttattacgcaaacattgttccagttctatggttctggaagtgtgtgtgggggctgtggggctgtgtatgtgtgtgtgtgcatgcatgcatgtgcgcacgtggacgtgaaggagtctgaagagtttccggaaacggctagttttctagctgcaatcttcagtttggttgttacacatggagtccttaatcccacatccactcaatgaccctctttagaagtacactcattttaaagaaattcttttttaaaaattctgcaaacatttcaatttatggtaatttgagaaatgttctgaaaggagaaaaaaatcccatcacattcaaaaggaaaatcagattcctaaatttcactttgatttttaaaattcctttcatcaaattcatagtctatctttagtatatcaatttatgaacagtatgagatttggattcagtgaatttgatcaaaatataggactcttaatttatttgagtaccctttaaaaacttttttaggagagaaaagtctcttatgagaagaattcagtagcatcaattcatactttttcttgaagaatttcaaagccattcagataaatagctattaggcatcataagaagattcgatattgcaagttaatcatattgtatgcttaaagacatttttgtaaccagtttttcacttttttaagaattagaaatagagtgattgagtctggaattcaaggcaaaagtcctttaaattttcatttcaatattgagaattattaatactatgtgatcaccagaaataagagagttagcaatggttgttggtgagggaactcaagacgccatctagtacagttactttgttttatatagattggccagttagttccttggtcagagttacccatgaagttgggcagagggccaaggccaaagtgaggtcctgactccaagggcagagttccttatgctcctttcgcttccacattgcagcttcttgggtaggccccatttttcaacacaggaaagaagcacagcacatgcaacacttctagaaaggacaattcccttctctacataggcagaatttgcagcccaagcttttatctctggaagtagcaaagccatgctgtgtgctgagagagccagaccaactttctccatctcctgtagagccatgaggaccccacagtgctgccacagaggctcttcactggtacatgttctgaagttggacataaattaacttccagatgatagcatgcttagcatcacagtgtctaaagcacaggcttctcaggaagagatctacaaaaccataggcatatatgattgaacattgccacatgtaacactggacaggaaatgctcatttgggcattctgtgctgaacatacttaactctcctgtatgcatttagagattactttgaaagcttgctcctgaaagtcgaaatcaaacacatttaaaattccttactgcaggttgattttcatttacccagattggaaaccaaaacagaagcccagcagtgattttttttttcttggaatcgacagctagggaggactctgagagcattcacacaggccatctggtctagccctcatgagaaatctgtcctgtttttccaatttgcactgtgcagcaactacttgtaaaggcctctaaagaaatattgtataatctttcacagcagtcatgaaaaaatttggctcttctttttgagaatcagaatcattcattcagctctaaagtcctcagaggaagtgataaggtgagggttttcagaattgttgtctattgcctggactccaacagtcaagtcagggagaaaaatgaatataaaagattaaaaaacaagaaaccaagggcacagcaacaagacaaaggaggcacgtgtggcatacagaggactcccacttccttctgatacctggggagggagattctctcccattctcatcccagcacctgttcatcagatctggcctgactgttctactacgaaaccatccaaggtaaaaaaaaatacttcccaatcacaaaattcctctttgcaattgactcggcttctttaaagctgcatcggaaacttcttgtcctgtcctctgttgacgtgaaaatgagctaactataattttctgcctcataaggttgctggtacttgaaaaccgttactacaactcagcttcctaatttccagaacgataccagcagttttctcctagatttcattttctgactcccaactgtaactataactctcattcaaaccctctatacaatgtctatctcttctttcagtcactcagtgctggatacaattccaagtcaaagtctagacttttcagtatagaatagcaagattggctaataacagaaacatggtatgtcctttcgtctgcatgccctggtcatgcttcctgttttagaaggaaaaaaaatgtttttcatattttgaattattctatgaaacaatttctgtaaaacattaaaaaaaaatcctaacctatttattagagtaatgggggatgactatgctgacacatagcaattcttatgagatatcaactcgaaaaattataatggtgacagttgaagtttcttgggttaaagaaatatgaaaaggccaaatttgatgtataggtttcaatgatagttgagtatccaggtagaaagctaacaacttgtactgtgattaatttgctttttgatatattcttatagataatttatttttaacataggaggtttaaatataaatgcaactgtatatgactgctatgattaacaagaaaaattttctgtatgggtaattaacatcttataggagaatgcccatggaggggctcaactccagaaattacaagcaccgagctcctcatgattagttcatatctactggaaagcccatctggtttaacagagctcttatgtaagaaatgcaagatttttcctgaggagcacatgctaataagcttcctcttttccattagcttcctctttaaactaggtttttatgttttgttttttttttaaaatgtctttggcctgagaccacaacaacaaccttgttataaaaatcaactgcgtaaataacatggctttaatgaatgctactctctttcaactcaagaatcagcaaagaattcctctgaggcatttgaggaaaataaaccttttgactcactactcaatttcctatctgtatatgcacaagcacgtctgcatgatagtgtccgtgcatttactttaaaaaactgaaaatgttcagaagaaatcttagcagcctgatttcagaaggttttcatcttgatgaagaacatatttgtttcattttaatgaagagaaaataaatgaactgctactctaaagagacccaaatagaaaggagttgggaaatccatggtctaacatacaacgtctcactcaataatggcttatatttcatttccaaggaaggagtttaaggtttcactttcactcaaatacagtttctccagaagtgatcttttggaaatcaagaggcttggatcttagttcataaaagtttgggataattccttaatgagaaaaacaagtggacatttgccagagaactccaaatttcaccagatattttttcctgagggcttcagcaggaccttccgtgggttctgtttcaaaacaagaggtaattttttaaaagggggtacagcaagtatccttaagaagcaaagctgtaaatttcacactgtattggtttcctcttgctgctacaacagatttccacaaaattagtgtcttaaactaacacagatgtattatttcataattctggaggtccaaagtctaaatttaaagtgtcagcaaagctccttttctctggaggcttctggttggaaatccatttccttgcctttttcggcttctagaggttacctgcattccttgactctttcctccatcttcaaagcacatcattctaatctccagttctgtcttcacgtctctttttttctcacttcgattctcctgcctgcctcttaaaggactgctgtgataacatcgagcccacctaggtaatccagcaaatctcctcacctcagaatccttaattaattccacctacactgtcccttttaccatagaaggtaatatgtgcgcagtttccaggaattaggacatagacgtctttcatgggccagtatacagcctgccacccatatcatgcaaaaaatgttatatgggagaggggagagttaaaggaaccctaaagtatcaagcatcatatccccaacactttttctagaatccaagacttgtccaggtgaagcaaggcagcaaaaagaataatgggatcattgaaaatgctgagtgctggggattttctctgagtaaggctacagcttgggttttgaatcagaaataaaactctcatttacattgtgtggctacagtgtggtaaagtttaaagttttatcttggcctttgcaattattattacagcagctactatctgaatctgctctgcttccctcagcccctcactaacacctacgaggagtatctcttttttctttttttgctaccaagacctaagtacaaactaaattaaggggtcaacattaattgaaaatcaatggacagccacaaagaccaagctgtaattaaaatgctcatgacttaaaaatatatctacctccaaatttcatgactgtaatcagtgagatatgggaatagaacttctttctagcacttgggatcatgggagatgaagcagcgcattcccagtgcatctgggaggctctgttcacatcacagaatagaccttaacccttccataaaactcacgctgtccctgctttgttcacattgtcatagcagtgttgtggaggagaaaagaaggagtttattatgacacacattttcaaatgttttaaatctgatgtagtttcccctctgtgaagttctgtctcacatgccaatagaaaagcctgggtgttccccagttctttccaaagacctacagctctcttatcactgcctagaatactgggctttgaaggttatactcttgatttcaaatcatttaagtctatatactctctcttggcatgcaagcaaaagtaccagattgcattatatctggggagaaatattagtggttacaaatcaaagtgagttaggaaaagagttttctggaaattcagaaatcaggagactcaagagttaaaactcaacctttgcctataatttagtctcttgtggccagatattgtttcctggaggctgtaagagacacaatgcttgagtaagatggaaatgaggaaatggctcctgggggaccttgctgattgtgaactctgctaccaccctgacctatagtctgggaagcaaagcatgggttagaatgcaataatggaggaagtcattctaaaatagggataggaggatattgctctagaacccctcacagggctaggtaactccccatgcactttcagctaggtggcatcatctttatatagatagggcagtgtatttagagtcaacagtgcacatcaagcccctctagtactacactgaggatagtaaggggaagagcctgacctactttgctgtcttccaaattactatcaccagggtctgtattctgacttagaaaagacattttgcttgggcctaatgcaaatacaacaatgaaaatgttggttcatgttgacagtagaaaagaaaaataagcaaatcgaagtctgcatatttattctgcagatggattctgcctgattacaagtcattgatgatcattaatgaagcaaatgtgatgaggttagtgtttttcaatttcatttcttagcagcaaggcagtactatcacacgacaatatcactgagaaagtatttggccttactttaataatgattaattttagaaatagaacattcgtaaaatgttagtttatcattttgcttgttagtattcatgttaaggatattagcacagtctctacttattttgagatagaaatactttggggacagggtttgacaaaagacaaatgctaattatcagaatgtctgaataacattctttgccagtaaaatcattctttatgctgattacctcatgtcaacatccaaactaagggaatgaatagtttaactactattattttatccttgagaaaaactctgaagggggaagcaagcgatgttatgcccattttaagttaccgcaactgaggcacaacataaacagaacttaatggtatattatgtagtctaaattattggacttttgatatcaattctaagttcagacagcttctggcctacttcctgttatactgaccagcgtatgtttatactaatagtgactcaggattaaaaggaatgtaatattggcaaatgacatttctgaacaaggttttaatttcccttgttggcatgtggcagtggaatgtcccccataattactctgctgagaaaaccagggcagaggcaggactggagcagtgtggtggtacaaagaacatgcactaaagagttcaggactgatgccagaatccagaggctaacggaaggttcagcagccattgcggttttttgtttttggcagttcaagctattagaaatctgcctcaagggaggaataaaagcatcatcaggtgttaataggtaaattaatatcaagcttaaagaagtaagagatactttgaagatgatttttatggcaagtatttatcctacatgtttagtccataatttatatcgagtatgtgaatgtgtgtgtgatgtgcgctaaggtgcacacacatacatgaggtcataggggtgaatggctcggtggaagcatggcatactagctaaagggactcgagtatcagtttacttcactttgtctttactaccagtatctgtaagatggacttggtaatctttttcaagagtttcaggattgttttcataattgcaagcgaccatatacctgaagtaccaattactatccattaaaattgtcattaatatcagtattagcatagaatgggacaaatagacaagaaaaaaattaagttctgtgaacatatgatatctttgcaataggtcttgttatttagctttgtatgtgcatggcttcaaaatattcctgttttaatcatccccagtcctagcacggtggcttggtatgttgtaggtgatcaataaaggattgcaggatggatgaatggatgcatgagtgatccagttttcataagcttcaaagtcttctgtgggattgcattacaatacaacccttttgctttccagtgcaggcttaattctctatgagacttgtcctcttcacattcacgatgggcttctttcctttggaaataggaatcctatctgttcttgaccttggttactgaatagcctgacctatccttggtgtcccccaaattattctgccataatgactggaaactaatagttgtacacagtttctgttatatctacttacacccagccttgttccagaaaagaatttaaggtggctctcaaatttgcataggttacaaaagaaaagaaacctaaaaacaacagagacaggagtcaaggatgcttgtgacaattcatcctactatttagacactaaagagcacacatgtcctcaagaaacatttcctggtcattgtctgggtagttgcaaaagagaaagtggagctgtgtgtggggtccttgggagacaattgtgcagggactgcttgagtctttgtttttgttggtctgctaagaatgtgggtcagcataaggtagcgattcctgaacttatcacttgatcctttacaaagagggggcaatggaagcaacatggcttgtgaaactgtattccttaaagtagtgaacagatcaagtaacaaaaagagaatatctgcgtggaagctatacagtgggggcaagttattgatattgatacttacaggttagtattgatcaattaaaaaaagtgatgtaactattccaaaactcttagaaaaacatggattttgagtgttgatctgatgtggtgcacagaaggagctgagttttccctgtgtggcatgttcagtgactctggccttttctcaaggggtgcagtagccaggagactgaatagtccaggactaggcagcagggccacttgaaatcccaactccaagtccattcaccaggacctgcaaagagctacaaccttttcttcgaggttgcatgaagaaagatgggatcctccagtttggttgtactggggtaagtttggtgagaccatttgaagatattaacatgtggtgttcctccctgcatctcttcactttactacattcaagcaagtagcttatgtagtattctgcaaatacgtccttatttgcagaaagtgtgttttcggtgtccagatgtctaagtccattacagagagtcaggtttgaaagaaaaggcatttcccagattaagctgagattctgctggtttggtgggaagtctgtgggtcccatgagccttgctccctgcagcgtccaaggcacgtgatggccctgtggacatggccctgtgacagtggagagactggatccccagctaggggtttccaacctctcccaagttctgcgaagcccctggtgtggcttgaaagcagcagaactgaggaccatgtggtctgggacagccatagacagatgaccaatgatgggcagaatcatctgtaatcacgtggtaaacatggacagaattccctgacgctgaagagtctaagaccctgggaccttgacccaatctcagcagcatcagcatggagggaggcggtgagggagttaatattgtgtaaaaattaaatttccttttggctcggtaggagggagttcctgggttgaaattaagttaattcatagaaaaatattaacatgtcatatgtcttgctacctaagtttgtgacctaagattctaacttgcttcgtgtacattttggaagatggaagaggagagcaggaaggacaattcaggcatcatttcaagatagaaaccagccagccaaagcatggagacaaagatgaggacatatgcttcatactgcaaagagacatgagtctccagacttagccattcagagactatactgatttgattttagaacagaagagattatttttatgaaaaccaggaacttcttaagtttggattcttttcatctttttttttttttattgttggtctacctccacaagaaaagaaattatttattatgttaaaaagttcctcttgccagtacacttatgtctcaaaagaatggttaaattgcttttccacttagagttggaacatgaacaaattttattaaaattgaagttgagtttggtagtgcagggccaactgtaaaaagaaaatcaagggctgtgaaatcattctggtgctgtcatttcccctctgagagaggagaacccaaggtggctccattcatctctgggccaaggaaggggcagatgtgtaaatgggaggctgtcaactgagcacattattactgaaatgtcattactccaaccacgatggagcaggagttacagggcaggtctgtctaattactaaactattgttattaaaacttttctcatattaattttgatttttcagaatacagtaaggctgtacagaatatagtctctgagcatgatgctcagagatatgaattcttaaccgtatgatttggagtcagttgattcattcaataaacattccctaagcaggcactgtgccaggcactgttccgggtgttgaggataagggagtgaacgaaatagccttggcctttgaaaagcttatattgtagaagaggagaaaaagaaacaagtaaatgtttagcatgtcaggaggtgatacctgctatgaagataagctgagcaaaaggtggaaagttgtggagggtgctattgaaataggttgggcaggggacattatttgataactttcagtaatagattggaagaaagtgagcaagtgagcctttgagtatctgcgagaagatcaatccaggcagagaaaaaagcaagtgcaaaggcctgagtgcacatctgaggaacaatcaggagaacattaaggttagaatgggccagatattgagggccctgtgggccatggtgaggacttttcattttattctgggtgagtgagatggagcaggattttgagctgaggagtgatattatccgacttgggcttcctaaggattgctcgggtttcttggtgaggaatagactgtaggggcataagtgtaagctgagaagtcaataaaaaacagtgtgtagtcagttcatgaggacgatggtggcttgaattgtggaggcagggatggaaacagtgagaagctgtagataagcccatgatgataatgatgcagttctctcacatatggagcttctcttctggggctgcccactgtagtgtttagccttgagtttgaatccagcactgccacttatacgttcttgatgctggccaagcttttcatcagtgaaatgaagatcatgacagtgtctgtcttacaagttgttaagaggattgaatggaaggctttgcacagcactgactttagcattctggcactttagttttatcatgttaatgttagaaagcatcaggagttttgtcatcatgtttctttgttctgaacagctatttttaaatggatggtgcatttttcaactgatggaacattagaatttaggaaatatataatataaaactaaaaaaattggcacacacacttgtactgataatttattagcattagctttcagattttcaataaaagttattttttcccttttaattgggggtccattacttatttttctgctttttcttcttctaaaaagaaaaaataatcttccctccagtttcaaaactggaaatcaaacatttcatctggaaatgtattagaaatttatttttttcttgtcttacctacttctctctggctccatactgagttgtaaataatatatcagttttttaaaaataaaaagcaaatacctaatcatatgggtgttttgtgtctctgacactggaaatataaattttaaatctgacttgtctgagtttttgatgaacaaaactaatattgtgtatcatgtagatacagctttattagcctgaatgaagctgcagttgtctttaccacagaggcctcagccctctctagcttttatgtggcagtgggaagccaacacagatgccagcactggctctcagggtctataagcccatgctgttcatgttccattcaagtcaacaaatctagtttttatctgttgtgtgcatagcaccatgatagggtttctgcataaagcaaaagaaatattgaatgctactcctttcagcttttacctttactggggagacaaaatttacctgcttaatgagtcgagaacaatgttagataatgtaaagtagattgcccattaaaattaaaataatatatcaaacggaatgttacaaaccatggataccagctcacacaatctttgtgatcagcatcaaagaaagagctggcctatgcttacgaaaggagtggtgtaaaggctggcagtccttggtcctgctgccctgtttgtgatcaaccacattatcaagtgtcacaagccagagattgcaggggcagaagaattctaggaactaaagagaattagttctagaattctagaattgtaggccttcacaattctaggaactaaagagaaagccaagtgcctagtgcaatgttttctattgttcagggagtgagattagtcctgtgcgttctgttcacacagctgccaagtacctccaacagggcttgttgagtgatgagatttcagcagaatcaatcttggcaccatctccatcttctactctgccctcaatttaatataaagaagcaaactggagaaagagtgaacgagaggactctttgtgcagtagtgcagtggtctttctcccctcactaatcctcctcaaaaaaatggggtatttctctccctgcccccaagccaagagggagactccaagagaatcacttataaaacttgccatgactgtacaacatctttaaaatccaagatggtgatggaatgccatcttgatagttttcaagccactggctgctgtagggtgtggaggaagggtcaggagagagatgggtggtatgacatggggcaaaggcataagtatgaagagttgtgaaaacaggatcccaattggtcctgcaggccctgaacactgagcccaaagagatgagtttgcaagctacagacttctgggtgggacagggtaggtatgcaccagaggagttgataagaagctatcagcttacctgctgggcatggtggcttacgcctgtaatcccagcactttgggaggccaaggggggcagatcacgaggtcaggagttcgagaccatcctggctaacacagtgaaaccccgtctctactaaaaagtacaaaaaattagccgggcggggtggcgggtgcctgtattcccagctactcgggaggctgaggcaggagaatggcgtgaactcaggaggcggagcttgcagtgagctgagattgcgccactgcactccagcctgggtgacagagcgggactcctctgactcaaaaacaacaacaacaaaaaagaagctatcagcttatctcataaagggtcccacctcctaagaattgtccaccagcatccactgttgggcttcaagaaaatgagctagggcagcaattagggcccagatgtggggaggactggaactctccatgggcagagcagaaaggagactcctccattttcttcattttcttggatcaacactataagcaggtgcaagtgaaagaggagatggtgttcgaggagcagaagaccccccacccttcttctcctgctcttaatgtgccagtagcactggattagggtaggatcagggatggaaagagatggaaatatgaattaaatatgaggtcaacatgttaaaagcagcagggctgaatcttagaacgtggtttaagaaaagtgatttaaacgtcatggaattgagccaacagaggctcagtggaagctatcaccctgtggaaaagagagagagggttccaagaagttgagttgaaagttgtgagcaggaaaataaaaccaattgatgtttataccctaacaagttaaggcaagagtatgtgttgtgagaaaataggaaaggcaaagatgaattttgaccagagagttatcaagaaggcttcagggagaaggtaggggttgggtcctaccactgaaggataggtcgtgggtgaatgaagtggggagaacaggtgagctgtgtgaggtggagggaggactagtctgcctggagcagaggcatggggagtgtgacaagttgcacccatgcgcagacctgggccagcggtggccaagcttccacaggaggaatttggcctccatcagaaagacaatgggagtcattgcatattctttagcactgagtgagtggtccaataggaagggtgccttaggaagatggctggtgtgtgagagagagaagaagcaaaggtgctccttaggaagttattccaaacctctggtgtggggctaagggacacatcaatacgagtgtgacttgttactcctgaatctttcctcagccccatttattgactgcaaatagtgcagtgtgcacttaaggcccttcgttttaagtatttaaagggttcactgggtaggcaggctctgcagcctgttgacggctatccattcataagctgcatgtccctacctgggcagcaatcagctttggagcaccccactcatcacacattttgtttatgttacttttcgttctcctgttatctataattttaaactgccgtgtgctcccccaaccttgccttgaaatgcattagtaactatgggaacatgatgctattagaacgagcagagcttagtgacatgcacaattgcagtgttaaattggttttgagatgactggcagtgtggatgctattgctgagtaaaataggcgacaggtattgtgactatattaacatagaccatcacctctggtggaagacatggatattaaacttaagacagaaatcagggctacatccttatcttgaagaagacatgttcccagaggttttaaatagcgtgaaaagtgaactattgagagttccagtaagaaggagacttttcatgtgctaaaaccaacaaaatttccccaaaatatgtaagtatgaatgcccattgtggctatgtcaaatatttcataataccagcacttcgggaggccgaggcgggtggatcacttgagaccaggagtttgagaccagcctggctaatatggtgaaaccctgtctctactgaaaatacaaaaattagctgggtgtggtggtgcttgcctgtaatcccagctacttgggaggctgaggcaggagaatcgcttgaacctgggaggtggaggttgccaagatagcattactgcactccagcctaggtgacagagtgagactgtctccaaaaaaaaaaaaaaaaaaaaaaaaaaaactcataataatgaaattagttctatgtgcattcgagtggtcaaattctgctataaagaaaaagattactgcagactcaaaagatgcaggttgactgctcatttggccctctccccaaggtttgtggaaatttctctcaaggcagggaaggtgttaacaactgcctcttctgacagaaatggccactagcctggctccagctggatcaactagccctgaggaatttgtccactttgtgagcacttctctccctgtcttgtgtctcctcaaccctgcacctcacccagtattgcagactggatctttttgcttcacatttctgtttcttaggaggtatcgatggtcttatacttccacagcattagtagcaaacagcaatagctcaaatttatacatttaaatgaaatccaatgaaagaatttaagcaaattctgattaacagtagacagtgtaaaaaatagtatattattatcaattcactgacatatttgctggattcaatattaaaatggactagaaaaaaaatccaagtgttctgaaaacatttcctcccacccctattttttggctactgtggtaggttgaataatgatctcccaaaatccctggactctgtgcatgttcatggcaaaaaggactttgcagatgggattaaatttaggatcttgagacgggagattatcctggattatctgagtggttcttaagtgtaatcacaggtatctttacaagagtgaagcagagggatatttgactaccaaagagccagacagaaggcgatgtgatgatggagcagtgagagattgaggatgtcatgctgctagctttgagatggaagaaggggctgagagccaaggagtgcaactatggaagctggagaaggcaagggaaatggattctttcctaaaacctccgggaggaatcaaccccgtctgcatcttgactttagcaagtcaagacttgactgagttagggattctgctctccacaactggaagaaagtaagttggtgttgttttaagccactgtttttgtgataatttgtgatagcagcaataggaaattaatagaggtacccgtcatcatgttaaagcatcaagttaaagcacagaaaatggagggaaaaatattgtcagtgtttgagtgaccagagtgtggcgtgaaattccttttttgagcactagctcattttcacagtattgatttaagctcaaagccccccttttccatgtagccttctttccccatctggttagaagtattctctgtctctcacctctgtgtgtaacactcccattccacctattttctgctaggcataattactaggtatctggcatataaacctcttatctgccaattcattagtaaactcctgcagggcagggatcccaactatactttcctttgattcattcaaccagtatttattgagcatatgctatatactgggcacagttcagagcacttgaggggcagagttggaggtgagagtaaaaaggcaaaaatgtagtacatgtatttggtatgttaggtgcggtgtcaaaaatgtacaggggttggggtccagtgttaacatgcattgggttgttactatgtgtcatgcatgttaccaagtgctgatgtttattctaatataacgctcccaacttccctataaggttagtgctattatctccattttatagataagtaaacagaggctcagaaaggaattctatcaaaggccacccaacctgcctgactccaggggccagcctccccaccattctgcattactgcctccataagcctacccagctaggaagcagtatgggcaggattgccgaggatgaggaagccccatggccctgagccaagatcttttacgtcagaaacactaaatgccaaatgcctattttctgattaaaagctggtcataagttaaagacatatgacaagtgcataggtgactttagctcaagatgcaaataattaattgcccttcaatttctattacaggctgagtgcagtggctcatgcctgtaatcccagcactttgggaggccaaggtgggtggatcacttgaggccaggagttcaaaaccagcctggccaacatggtgatatccccatctctactgaaaatacaaaaattagccagacatggtggcacatgcctgtagtcccagctacttgggaggctgaggcagaagaattgcttgaaccgaggagatggaggttgcagtgagccgagattgcgcaactgcactccaacctgggtgacagaaggagactccatctaaaaaaaaaattatattgcaacattttctcgggtctccaaaaaatctggcatcacgtaagcaagaggcaggaaactggtacatactttgtcaataggacaattgcattaccaaataattacatgatatttccaacatcagagaatgagtcagaactatggccaaaggaaggtgaggcttgtctcaatggtgctatgcgagtgcctgcttttttctcttatggtggccagcctgccttgccaatggaaaaggaggccatcatcatctatctgtaagcaggggttgggagtactggggtataggctatagtacactcaggcactcaggggctctggatttgcctctgctagatgatgtggcattagccaaaccgctgaggttctttgggagcccatctgtccaccacttccacaaccaggagcaccttgctcactgaggtccctggaattcctcatgacctgaggctttacagatacaagcactggttctcattccaaggacctgtgtcctggaatattatcaaatatctacttacctccaagctgatgtaaaggagtggaatccatgtttttactatcccttacaaaagcttttttttttaatttcaatcatgactactatgtatttgtatctcaactatagcataaatgaacccatttaagaaaaacgtttctcattatctattcatgtgggataaaaccactttataaaagtatatcttcatatctatattatcatattctctaaagttatagatatgtcttgttacacagagaactgataatggtgaatacaattttcttactttctagaatggttgaatgtgaatgtggggtcctaatgtttagaacatataaaatttgaactgtacattgaaatatgggaaaataatagtagataacctgacaacatgtttgtatcatagaagaataatggtattctaatctacagaataaataaaagagaaattccgtgtgttcacatgcacacacatatacataaatatatacagagagatctatatcttaatacagttacaaatggtacaactcaaaaaaactagtttacatttatgtagcagtcacatccttttaaggttgtttcacatctcttttctcatttttattcttacaagaatcctgaggagttaagtggaacaagtcttatttcccgcattttatagatgatgaagccaaggcacagagaagccaggtggcttagaaaaccaacacccacccccagccaagcagtggtaaagtcaagtcagctctttactgggctggaagcctagactcttttcttgacacctctgcagaaaatcaacatagtagtgactctgttctagaaagtataccatattggttaagagcctgggctgagggaagatctaagatcaaatcttgactctagcatttaccagctgtgcaatcttggatgtgtcccataacaggtcagtctcagtagttttcaatctataaaatgggaactgattgtactgtacttttcagggttcataaaatagatgacacattcaaagtaattgagaaaatttaataagggataaaagtgtaggcagagttaagggcagtcaacaaaggacagtaaagcatcctgtggatagcaaagcagctcccaaccctgaagaggggagcagctgccagcagctgaagagagggtggtgcctgtggaagagggcccctgccaggaggcaggtgacaaagagaggtgccagtcctcagcccaaaagagctcaagttgggagaagaaataccagactttactctcatcttactctgggaacctgacagaagccagaagacatgggaactccaaagatgaaatccatgaaggtcagagcccaggccacaaagcagggtaaagagagatggagagtggatctgcagaagcaaatggagaataacctgcacacaaaccccgtctcagggtggaggctgggacgattatatgagataagatgagagaaatgactagcacagggcccagagcataagttctcaataaatgttagttgttagaatgattcttcttattattattcccattaatatttggtggtgtttttcagtttcagggagatatttttagaatcttggctgaaaagaaccgactttgatctgcaacctagaataattattctactcagaggtgggataggtttgtcagcagttagaaatacgattctagacatatccacaggactaattcataggcttataaaggaacttttgcatgtacattttcacattgcgtctggtgacagtgtaattaagattatgtcagggtttccattgtgtcttgctattttcaagcttttataacttggttataaatttttgccctggcaaaaacttggcttactatatctcagcctttagatgaaattttttacagagaaaaacaatctgttaattgtctttcacttgagtaatggaatatatgtgtgttcattgtgggtgtagatgtgtgtgtatatccatccattaatacgtgtggtaatagctttgatgttttgtcttccttcttccctatctcgatgccattaaccctgccacttaataaaggaaatgactcaaaaagatgactcatccacaattccacctagcggaagagaagaaacaaagagcaaaagagcaggaaaaggcagaagggaaaagaatggctatatgacagatgatttacaatagccttgcaaataattttttaatgtatcccagccctcacacttttcacaaagtcagttcccattggagctgaaacacgtaaccattactctgcacccacatgtcttcttggatttactgggaaggaaaacaatgactgagttagcaaataacattgtagagcaaacaggaccttccagcaatattagcatattgcttccattaaagcaatatgctaattcccattcaactgctcaactgaaattttaggcaggtagttagatatctaagatacctaaggtagaggtactcctggttatttacaaagctaatctgcatctccagaataaaaagccaagcctgctttaaaagcagtgacagagaggtaaaaggaacaggaagaaagccaaggagacctcaagtgtgctgggtgtctttctttctttctttctggaagagttcagtcaagtgagagacaataggactaagcaggatagggggcaaaagcctttgctttttaatatacatccatagctcatgattttctataacatacttgaaaatactcagttttcattttgggttggatataaatttagaatcgtggttgttagaaataaaggtctctgaggggtcatcacaaactcacaggcccacagggtccaggcaggcagagtgagtgcccccgtaggcctctatgaacctaaaggagcagaccacatgccctatccacagggagtggacccccagcttcccagcaactgttgctttgttggaatatggaccctatgctgccagatcttccaaatattcaagagaagctggaaatcttctcaaatgtcaactccatgagggcatggagtgttttgtctgtttgtttgtaagtgtgaccctggtgcctataagagcgtatggcacacagtaagctctcaaaaaggttttgctgaataaatacatgtagaaaagaaagtagacaagcaagcaagctggatttttatgtgaatgctcttaaattttaatgttgacaaatagatttttgttttgcatggcttaattaaaagtaggagcccacttctgggaggaccaaacaaaactaatctcagggctagttgcgatttgtcacgaaatgctacttggccatctcatgtctaattcaagttctctgtgctgcagacaagaaaaccaaggccccaagacattaaggacttgtttaagggtcacacagatgattagtggcagagccagtaaaccagttaactaaccttcatctttaaattttccatttatagctttttcttccttcataccttgctgttatttcaaaaataaatacaaaaacaaaagcaaaagattaataaataaagttatattcctttataagatttcaaagtatagcccaaagctttacaattaaaagataagttgcaagggaacatggaacaacttagaaagatacaggaggaaccatccctcctgtgatttttcatacagtcagcctggcagtgaaataagctctcctttccaatattttgtcagttagagtagtccaggttatgctgcaggtgcaaatagccccaagatctcagcagctttaagcacaaggtttagtttttgctcacactacatttccttcatgggtccactggaagttcactctgcattgtccttaccctgggacccaaggtggcattgtccattgctgtggcagtctaattaagtgagcatggcaaatggtacactggctgttcaagcttctcccagaagtgatgttatcacttctattcatttatttttgggccttgtaagtcacatggccatgccaaacttaagaagggcagggaagtacaatcctaccatttgctgggaatgcagggggccagaaacactggtgaacagtgctgttgattaccacacacaacttcacctgcagagctcaagagccctgtgaaaagacactattttccctcaatgcattcttagttttagatgatgtcatgaaatgcactgactatatctacattttttccctaagactagtgaaaggaaaaccaaatgttctgcttatccacatctcctattggatattctccgttttgccctctctcctttaaaattgttccaaataacctggtaatcaagtgcttaaccagatggaaggaaacaaaaacttagaaatatagcttaattgtaagtaccatgttactattctgggtttccaagtaagtataccatctgctttgatgaagtccagttttaatgtagatcatacaggccctctccaacttcgtgagcatcctatccacataatcagcctgcacactgtgggcaggagcagggctacatccatcctggaaaatgaagtgttttcaggtacattatatttcctttctacattctctgaggactccccaggccatcagacagtgctgtgcacagggtgtcagggagccatgcttagctactgtgtcctagctgcactgataagaaaaattttgatttgtcaataattgagttaccctcagttatgctgccctgaatcaaagctattttctctccttaatctaaactgcgagctcctcaagggaagtacattttccttaaacaaaataaacaaaggcttacttgtttctgtactcttagaatctacataatcctacacaaaagatttattaaatgaatgaatgaatggtgcaagcaattgatatgagcttaaatgcactgaaagaagttcttcgcccaaatatgttttatttgaggacagcttccttggaattgagaaagtggtgagagcccatacagaattcttggtattctcactgtgtacaattcattttcttttgccattttcccacagagaacatttgggagatctcagagaaaatctagaaagtgggaggctaccgcagcaggactgtgtccagtgaaagactggcatggtgggaggcagaggggagagtaccaggaatgttgctgaaatagctcttgctcgtccctctgtccttattgctctgggctggcctacaaagacacctccacaaggcctgtccagtgggctttgggaagcatggggaagttctcctctcctcaccatcacgtgtccacatctgcctcctgctgcaggcatccccagattagaggagggcatgctatttgctaataataatggcagaataagtcagcacaagtgcctggcccagcacaagtgcttgcttgtctactttttttttttttctacatgtatttattcaaccaatagtctttgagagcttactgtgtgtcatacactcttataggcaccagggtcacacttacaaacaaacagacaaaactccaatattatttgctaatattaatagcagaataggtcggcacaagtgcttggcccaggaaagagtggatgctggagcccagtaagagaaacttttcccagacccctgtctgtagtgcacacttttcctttcttttcttttcattcacatttagataaaatgttctttagagcaaatgtttctgtgctgggcatggttttttggttaagattcctgaattccctgtctcaagaatggctgctgtttggagaagtatagggagtgaaaatgtggcatgcaagccaatcacacccagaggaaccagtgcaaaagcaaacacagagccctttttatgtgcaagatgggtaatattggcccattatatcctcaagcacatctctgaggcaaatactctattatctcattctaaagatgcacgaactcagagttcaacttgtcaggaccaaaagctactgagcgatggtatttgaacacaaacagcactgctctagcattctcagctgcgatactaggcttcctgctttatatcctttttcccttatgcttccagtttttctttacaagaatatacatttcagaacaaagatttatgtgggtattttgggaatgcatataccttttatacaatttataacattgttttaatatcaaaatgcattctgagttctaaactctcagcttgcaaataaacttttgggtctcactctatttgtaagctggattttgtttttggtttttaatttcattttaaattttaggtagttaaaactgtgttttaaagaaaccaggcagtctggttccagaaagtcaagatcctttaacataccttagaatttaaaagatagatcttaagagatgcatcttacttgtttgttacgttccaaaatcattgcatacagagaaaaccatgtgtcaaaactacccttgaaaataggaaggctccacactagaagccaacttaaccacctccaatgtgggaacaaactatggttacttctgctgaacactaggtgaagtagccagcatttagggacacaaacaagtgcataacttcaggatcccttcagcctagtgagatgctcactcgcacagcgacagtcacaaaggactgggtccagctgagcaaacacaaagggcagattctcccagctcatactcgtcccagaacagttcttagatgaaggaaaccaccaacagaatggttttgattattctcctgtcacttttctgcccccagtgtgttttatcaaatttgaatatgttaaatgaacgtttgatgtgactgaactcaaaatatgtacagtcagccctttgtagttatgggttctgcatccagggattcaacaaactgcagtttgaaaatatctgggaaaaataaaagaacagttggatctgtaccaaacaagtacagacatttttcttgtcattattccctaaacaatacagtgtaacaactatttacatagcatttacactgtattaggtattataagtaatcagagactatttaaagtatacaggaggttgtatgcaaatactacaccatcttaacttgagcttcttatatccattgtaggtcctggaaccagccttgcacagagaccgagagatgactatatatagtgatgcaggtcaataggaaacttagggtctgagaatgattttaagataatcacaaaagcattctaattcttattcctttacctgcttctgtagaacattttaatatttaacagaaccactggtttccaagggattccctttagaaatgcagtattaagagacggaggcattactgactgctccaagtacttctggggttccgatacctcttgcctaatgagcctcttagcccatgtcagtttttaagtccacatatctgaggagactacactataggagaagctgcttggattttgagtgatcagctcttcttttattagaagatgatgctaccgatgtgccaagaagaagctcatattttaaattatttttccaagagtgtgaatctgcaccaatcagcaacacctttctactagcatccgcttggtgcactgatcagcaggccctttgccttagttgtggatttaccttctattatttgactcctaaattcttcttaatttttttaagattgggggctcacctatgtaagaaattaattcttttgttactcatattggtgtataaatataagtggttttcaggaagattctttaggtaaagtggtagatatgaaggaccaatgactggagtgggttttcaaagtgtcctttgaaaaagcataaaactgaaatacttgtactgtttcattggtgttcggggagaaatgacacttgcatttattagacttctcctttatccagtgtatacagatttgtgtttatttacatcatcccagtagaactctatgtcataaaactgtaaaaatgcttaactcaatcattcatgtacttggttttatcttcattctgtctgtacattgacccccatgtcctaagtctttcaaccattaaaaatagtattagagaagtattttttaaacaaatcccttgatcctatgtgagatctgtgtcattctgaagagaggatgtgaggtgtttcttttatgttggtaaaggttgagttgccatggtaatgacttattgtgcaatattgggagacgtgctttaggaacatggcatgtggcaaccccatattgggttcctgttattatagtcgtgtcataccttgacttttcttggtcccaaacaatctttccatcttttatactatccggaatttgcatttctagtgtaaagcttcctttttactgcttcctgttgcttttagaacaaccaaaaagagaattattatggaaatggcttttattaagtatgatagagaaacaaagttcccatgatttttacagcattttcaaacatgtagagtgctttgcttttaatttcttcagttatgcattgttactactttttaaaaccaaggaacatcacatagaacaattatcaaaaaccagaataatttattttgcttttttttttctctcacttcctcaggactgcacatatgtttcatgaaaatacatgaagaattaggtgtgcttttagggtatgatcagaaatgtgagtctgaattaatagaaaaattgaaaccataatctaagccctgctatatcagcatcttttttagctgaatggatagacatgtattttcacttaaataattcaagttcatcctgtccttggcaacagtttggttctcacaagcctttagagtccaagctatattttctatattagtctatattacaatgcgctttaattaggaggcataataggtaagtagaaagtggtttcattaagaccttgctctataattttcactcatctccagggaaatgttgcccatgtatgtttcccatgaatcggtgccattttagtgattatgttgaacaggtttttcagaggacacctcatttattcatgcatttactcattcaatagatactattgagcacctactttgtgccaaggatgctaatttgatgccacacgctcacttgactgatggagttctcaagttcggaactgataccaagtgggagccagcagtcacaggcctctcatgtttcccaggctttgctagtttggggacttttcctcagaccctcacagtcatattcatttttcaatggctctttatcacaatatcactcattcactcaactggcattagttaggccaggctttctaccatgctcaggtaataaaaagaccagggtagtccctgccctaagaggcttagtccagaccctttggaatccagttcttgagagtgtgagtacaggggagctccttttcttattaaccccactagaatcataggttttcttcaaactctttcatctcttcaattctcccctccctttgctcctccaagcaaggccttatgagggtacaattcctgaaaatcatggcactgaacttcatttgcccaagggcacccaatatagtatatgggataacaactttcatttatggagggtttgttatatgccagatttagtgtgaaataccttacacctactggctcatttaatcctcacaaaaccatgtgaggtggatactactatcattcctgtcttacatatgagaaaatcaaggttcagagtaactgttctgagatctcttaggtagataagtggaaaagctgagatctaaacgcaattttgtctgactctggggctcaagctcttaaactttgcagtacagtcataattactccatggcaagttatgggtcccactgtagtgttcattctcttttataaactgatatccatgacactatttttgttacactttattgagaagcacgtctcttacttttaaatctcttccaaagtaaatgtgattcgtagacctaggaagaggaagtggatactattatttgatggatttcagaaagatttaaaaattaagtaaacaaaataacttatctttcctttggatacttgttccatgtttttaaaaaatattttatatattaataaatgtatattaaatataacatttctatattaaagaatgtaagcgttcagcataacatgaaagtctgagatatgtattgccaaattaaaattatcatactggccaggtgtggtggctcacacctgtaatcccatctcttagggaggcagagatgagaggatagcttgagcccaggagttcgagacctgcctgggcaatatagcaagaccttgttctccacaaaatggaaaaaaataaaataaaataaaattgtcataccaactcaggaatgcacatatattttatttatttaacctaattaggttttataattgcacaaaacaaacttctcctcatatttcctcaagtaagttggggtttacaaaaaggatacccataagataatgaaccatggatgacaggaatcttacaggactccaaagaaaataatcatagaatagccagttctcccctagagtggatactaggcagctctagaaacttcagaagcaggggttagttcatcatgccttgggtgcttctccaccagtcatgcccagctactctgggggtctgctcccctctcctgcatctctgacttgcttattcatttcttctttcccgtatttttgccttgttgcattggatgtgcttatttataacccctaactgtctttgacatggcatctctatacatctcttaaactgctgccctacctcctaacaacttcattttctcaggatattctagctaaaatttctatgagagaggatcagatatgcccagcttataaccattatctctgtctaggcagagttctgaccatatgtcatagaatattggcaaatatatagatgtctcaggcctgtagggaggtgcccactctgatcccagatgctttcagtgcacaagagtagtaatggcaaggaatgggattctcatgatgaaaaacattacattctcagtaatccttcagcaatgtggtctactctgactctatgagatctggcatctagcaacttctccaacctcaattcttatcactactctccctattcagcatactacaactatgatacagtctcaccattcctcactgcagcatgctcctgcctgaggacctttgcacttgctgttctctctacctggaaagctcttctcacagcatttggcatggctcccttctgtacttcattcagttctctgctcagatatttcctcctccttgagatcttgtctggaaccactgtttaaagtggtaatcactgtcattgtctatctcctcaccccatttattcttctttatagcgttgaccactacttggtataactttaattatttggggtcttttttgtcttctcccattagaacatataattaagagtagaaacaacatttatcatgttgtagctcagactccatgccctgaaaagcagataagaaacaattgacaggaatactggctcgcaaacctctctgtgtctaagtaggattctctttgcaaagtttactacaccaaattaaacatattttaaaaaatctggttaaggcaaacgtaagagcaataataaaatagcatgtctctatggttgtgattcagcccactgacatattcaatatttgaaagacagcagaagaattttgtgttaatatcagtcactttatttccttcttgatctgagacttagaattcaccttaatctgcccgaaatagacagaagtgcatgtgttgaggccatacaatccaaatgccttgtctttgagtagatatgactaccttggaacatggcttgaaaggcattttctcaataatgtatttttttaaggatgatccataatgagatagatcaggatatattaatttctatatgctaatattagcatcatactttgagaaatatgatttcaagccatatttagcaagttagatataccattaatttattaacccatatataatgtgtactgtgtgtcacgtattgtgttactgatgcagatatagtactatgggctagatccggggcttacataagtaagtaactcatggccctatcatcaagcaagcattcattgtagcatgggaattggaaatatgaacaaataactgaatatctaggcttatgggatctattagagaaatatcccaggcacagagttggcacagagtagaaagtggtcagctgtatcttggagtcaggggaaatggagaagacaaagattaaaaacatttcaggagatgattaagacaacaggaggcaagcattccagataggtggctttcttcattcctgcttatctcccttgtttcaagttcttgactctctaccatagctttcgtgtctccctctggtgctcacccagcatttgtttccccagttctgcatagctcttaactttgcctgtgacttccatctgggatctcatgttgtctaactcctgactccatggaattatgctccctacacctgcccaccaccccaaaattctagcccaacagccaacattccttcccatccacacttctccatacctcataacatgaaaatttaggcaagaacaacatggacaaagaaacaaagacacaaaaatgcttggcctatcagggagctgcatgtcgtttgcagtgggatagcagataggaaacaaggacgatggtaaatgaggctggatagtggaagtagatcatgaagggcttggtataccacttaaaaagagtttgggctctattctacaggccgtgatgagctgtgaaatgtttttgaggaggagctatagcagaagcttggaggttggattgaaagaacgtgtcgtttctgggaaaactacaatgagataaacacctcttacggacactgatcttatattaacacctccaaatccactagatttcccaaagtgttgtctcatcttttgcacgtgttgctattgtggttaagtcatctggatatgaatttggtgctcctttattatttagctgggtcaccctatcctgtagttatgtcgttattgtattaaatactactaattataagacataactgttgttgagttgagtttcatcaagttagtttcagctcattgttgcagcttgtctgtcctttctacttgtaggccgggtacaaattccatagttgcatcttctgatctctgtagaattgttaatagagttgttgaacagagtgcagtatagcgtagaaaagcattgcacagaagcattaaggatttccttccagggagaaattgatctataattcaataggctttgagtaagttcttaagtcagctacaaagccacttggctccacagtctacctggtgagtctttgccttgttgaaatggagttgtttgatatttgtattatttctatagtctatcaacttattatagtatatctagacatttggtatccaaatgggaaaagattctaccttttgatattatcaaaattttctatagtgagttcttttctaagtgggaagttacagtgcggtttaaaaaaaacttccttttgctgcacttatctttttgctggtgacaaccttgtattcagccagtcaacttgagatctctaatatcttcagggtgagtggaattgaagaccaaaaacatgagatgcttgactttaaaggtcaaaatatcaagaggcagggcgaaaatttgaaatgccttgagatcagacagaatttgtccccatcttccccttccttcccccaccacctaatgtggacataagataaaggcactctgagctggaaatgggatggagaagtaggaaacaagagattgagatgctggggcaggggtgggggagcaggggatgattgcctgcctacaattcttcaagtccaagaaaaggatggaaatctactgaactcttctacatttagagatccaagagtagagggatccccgggagagaaccccccaacagctgggccttatgcaccagtggcatgagatgggaataggttggatagtagattaggaatgactacaaggggtctcttggacagagcatcctaagggggacacatggagccatctgtggcctgagaggagtgagggaggacagctaaactctctcagtgtcccaagtaatgtgagaatttggctaaggaagagaaagaagctgaaaaaggaagccatttcactcttgccaagagaaaacatcagagaagagagccacagggaccatccaatagaagatggtagaaagaccagactagagactcttagcaaatgtgggtgtagacacaactctcctttgaatatcttccattaattccacatttcaagggagtccagaccaggctgggttaagatttagaagtaaatgctttcctttttcaacacttgcatttacataagctcagagtttataatcaaccccacggaaaatggggtaaatagagaaaggaattctgaatgaaacagagttttaattccaaaataactttgaaatcatgaaatttcattaatttcccgaaatagaattaaattttctgaaaatgaggccttcagaaaaaaatttaaaacttgttttttcacaaacttaagtgtgtaaaatatatcccatccccccttttataataaagtggggagaaacaatgaaaagtgaggaaattggactttctatggcttatgatcaaatccatgttggtggctaattataaattataaccttttcctcagctaaatgcatatccttagcctaggaatcagcattcgccttatcagtgttgtttccagggcccatttcttcccattaaaaaagaaaaatcagagcagcatcggcctgtttcctccctttaggcacttctctttaccatgattgctctcagagccctgacagtttccacaatccaggtatctacactgttggaagatgaccaggaaggcttccaaaaaaaattcttttacagccacaagggtattttactctgttgcccccagtgctaggtcttagttccactttgaatcatttcttctgacgttttcaccttgagactattttcacttaatggagcaagatgagctcaaaaggacagctcagcaattctgttctggttgtcactaatcccattacatcacctatcccaagcagtgaccattctttcatcatttccctaaggcaatgcctgacccaggtagatgcaaagaaaatctctgttgagtgaacggagctccaagcatgttttctgtggtccctgagcctttttcttttgtcttttagtgcttttggtaagcctcagctcacttctgtcctcccagggcacgctgcatggcttctcaaagcttccaggcctttcaagctttatagcaaagcccttggcattccttttctaggttactattttggtgttcctcttatggaatgttccccttatatctattaaaactactttctaaaaacaaaaaacagttgtgtgcagggtagggagactgaacctccttctcatcctgagcgtagccatcaccttagcccaggaagaggttcttgtgggcaggggatgtggctctgccctcaggctggagaggggctccttgtccatcactgataatcagtcactggaaacctgctcctaggacccttgaagtgactgactggcttgcaaacaatattttctaaccagttatttaaaactatactaagatccttttctgaacacttaacagcaccagcgatcatgtagatgttctaacagtaggaaacacattcccgtttgggttggtattcagacacaactaatgaagagtggagctgaagaatggaaaaaatcaggggtggtgggggtggttattgtgcagatcagtggtaccgaattgctggacagaggtccaagctagttcagacagaagattctaacagtgcatggcaaaatgagtaaaataaaaacaaaggagtcgttttttaaagctaacgttcaatgtaaaagaataccctttcatttcttcttaagagaatttaaaaaatattttgacatatagacacatacataattttacataaatgagggcatataaatgatttttaaagtaaaatttagagtattttctttcacttttttatggtattacaatggctttttttttaaattatgaaaccctgataatagcagatagtggtgggcattttgctgcatgttagctatgtccatgtttggcagaataaaagttagcagtcttatgtctatttcccaaattcttttagattgcctacttgtccttgaaatccagacacctggaagcccctggtgttgatgaattccccatgaaccaagtttagcggcagggggtcaaattttccaaacagtcttgtgttctgaaacctaccaggatgagccagacaaacattaagaaaggggttgtatacctacacacaagtcagcagtggcctggaaattctccctgctcttgtcagaagtacctgaactcaggatatctaaggctgggatgcacaggacttccctgcagccttccttcagttcatcacatgtgaatatctgctataacttgatgcaatactcttgattggaatgacttgacacattttatacaaaaataaactatgaatagtatgtggggtttttaattaaaatgagtttggttaccaaaaaaattattcatttctgggctttatgtgtttgaattcttatttgaatggtatgttttataatataaaacattaatgaaagtttacacatgaattaaaaggggtcaggcataaatagtttgatgcccagattttcttgctttcatacaaggatcccaccccttcaccaaattgtttttatcaagtttagtcatccaatttcttttcatgaagtgaaatcctttatactctagtcctttaaccctctcaattgtaccgtatttacccataaacttgtgcattacatttacttggaactggtctgttgtagaatagtgctccctgcctagtgtagtgggttagtttcaaccagtatttgccaatgttcactgtggtacaagcacagtttttcagagtgtcgtgacatctgctataaggaatgtctccaactgccaaacgggaccaaggcttccatgctcaataaacttccacctgccctagagatgcagtaatttccctccagcaatcagagcacagtcagacccagatgtctgagttttcttttcgaaaatatgaccattgtgatacaaacccattgggtaaaattttaaaataataataaaattgtggttgattgttgtgaaaacttccttacccttaagtacttagtgctatgtatgatctgagatttcctctggggagatcaacttttttcccctggattttatgattgtttatttcctggtttccacaaccaagtttattcagaagcttaaatgtgaaactgttctcaaaattatgtatcttttccttgatttctctattaacactttgtggagttggccttgccaggtaaagcctcaaggagctttgaagctggcctgagataaaatgggaatggagtgaaaatgtgtctgggtagtactcctgcaatccaaccccacttaggcatcatttctcactccttcgtcctgtcttaccctactctttttactttggaagatggagtaaatgcacacacagtgggacaaaacttcaaacagtaaaaaagaatacatagtcacaagtaagtttcccccttttggctgtcctgagttcctctacgctggactgtaaccagttttctatgcattctaacagtccacgcacataccagtatacaaacgcacatagaaacacacacacacacacacacacatacacacacacacacacacgtgtatagctttttcttataaaatggtgacatactatacacattgaccttcgtcttgcttttttatttaataatatatcttaaaatctagtcatatcagtatgtattgcttcatttgttttagaagactattctttgtgtagctatattataattgacgtagagacttcatatcaatgaatatttaaatagttcctagttcttttctgcacacacacacaatagttgtactgaatagcacaacacatgcatttttgtatacagctatgagtatatttataagagatgtaaaattgcagggtcaaaatgaatgtccattttaaattttcatgcacattgacaaattattctttaataagatagcttccaaatacactcctagtgataatgtttgagaatgcctatttgccacactttagtaactttttgatatttgctaacatgacaggtaaaatgtgatatgtcaatgaagttttaatttgcatcttttcacatatttaaaattcactttttttctctctttctgtgaatgtgttcatttttcaattagttgttggtcttttcatgttgatgtgtttgcgctctttataaaaaaattatctttttagatatcaggcagaaaacaaatgatattttcccagaaaaatttaatttgtatgtattcaaatgtattcggtttttgggttcgtgtcatgctttaaaaaccctaaaagcccttctagattaatttttaaataccaaattttcttctaaaacttttatggttttattttttgcatttaaattcctgatccgttttggaatttattttggcataatgagtgtctttctccctttattttaaaggaaaaagaacattccccattgtggcagcacagggtcagggaaatagaaatacagagttaagtggacagttacaccatcagtaggtaaccttccctgaccagtggatttatctccctggctctaagctttttgacaaatgaatgtgttgatagaatgatgctccccaacatcaaggagttggatgaaggaaccaccttggaagggccttctctttcctatcggatcttacttgcagaatgctcttgagtcatatggacctggggcaaaacctggctttactcttgtcagatgtgatgagttgttttatctcagcctcagtttctgtatctgtgaaagttaaggacaacagttccaacacatcgtgattgttatgagttaaatgagaaaaagtgtatgatatttcctggcacagtgcccagcatctaaaagctgcccaataaatgtgcatttaatccttaattttccttttatttttttccacttaagtttttctcataccaatagaaatcaacaccggttggaaatcacagccccagcttcctgttttggccttcttctcacaacttagtcctttcacccactcttctggtatctgggaccctggcctctatacccgtcagaactcactgtggaatcatgtggactttaatgtgaaccactaagcttgaacctgaaattacacctgaatttccccaacctcaggctttcttgtatcaatactgccatcattgcactggttccctgatcatttccttgactccagccttgcccttctttcccaaatgcatgctagagcctgctgctaaattggtcttccagaaacaaatcggatcacaatgctttcctgcttaaaggctaaaaccccagtggctttgcatgacagacagtgccctccatgatctccctcctgctggcatctggagcctttgatttcttgtggatttcctgaacacactattaattttcctgtctcagtgactttatccttggcattccttcaatccaggatgcattttgccttattttttagtctagaaaatgcttattcctcaagagcctactccagcttcctcctcctgtgtgtttacacaccctcccctttgccctctgtcattaccttgctttttcttctgcctctaaccaaggaaagtggctactccctctttgagtcaccactttatacatacaccaatcacgacaccagctgacacctccattactcctcacatactatgaaattatttacacacgtgtctggtcttcccttgactgtgagttccttgccattgaggactatagctctatttactcctattgcatgtcctagcacatattaaacactaaaattatttgttaaacatattaatccatcaatatccagacattatctagatttccaggtaaggaagtaattgtgttaggatttccagactctggaacatatcattttcaactaacactgagatacctcaagaaaaaatctttcatttttcttttccttgtcaacatttcacctgtcgtttggtatttgatgacatgagcttataataaaacaataaatcaatattgtgcttagatagaaagaacacaatgccttcaaaaaaacagtgctaactgtcaaagtgtgattctataaaattgtttgggttttttttttttttttgcattacacagatatgaaaataatagcttgaggtccttttggctaacattgtgcattttatattttactgtgagatgtcatttttgtgaagttgatttgtggttatctacttgggagtaaaaagtcagaaacattggttacaattctaggaactataattattggtttaacttaatttttggaatctagaacatatttaaaagtaacaggccaggcgtgatggctcacacctgtaatcctagctctttggagggctgaggtgggcggatcacttgaggtcagaagttcgaaaccagcctggccaacatggcgaaaccccgactctactaaaaatacaacaaatttagccagatgtggtggcaggtggctgtaatcccagctacttgggaggctgaggcaggaaaattgcttgaacctgggaggcggaggttgcagtgagctgagatcgtaccactgcactccagcctggacaacagagtgagactctgtaaaacaaacaaacaaacaaacaaaaaaagagtaacaatacttttaaccatatggctgttactgaattagtttcataatgtatggagaataacaacaaatactctttcaagctaatctacggccataactctaaacagcaccctgaagagaatctggagtttaattttgaccgtccttgaattgtacatgttcagaatggcatggattaaggacatttgggtgctgatttttatattgatgaaaaattagactgatgtatttgtacatatgtgttcatggtaaatttccagtgacaaacctggagatgccttttgcagattctaagggagtgttctttcttttgaacaagtgctttatcttgagaaaaaaatacaaggagcaggaaggaagaatggacacccacttgggcagcccagttagctgaaccagttgtggagtttggtgagttgatacatcacagttcaatcatgcccagattcataagcaactttcacacgagaaatccaaagactacaatcccaaaactagatttttgtgataaatgcagattagattagcattatatgttcatagctacttgaagtgcaaggactagacataagacctactgaaaatgctattgtagtgtgaagaattggtcggcaagtaaaaatcagagttttataagtgactgcgattattgttaccttattatcccaactttttgcctttgctaccaattgtactaagtttacataattcacatggcgtttagatgtacagacattcaaatcatctatttctacctgaaagaccaataactcctcctctagaaataaaattgcattatatgcaagtgagataagttggaaataaatcatcacctgagaacactgaagttggggcgggttggagtgaggaagttgctattttgaggagtacagggctgatagctttagcactatttgccaagagagactggagcatttctcataggaatcagagagctaaataataatggtttgacttgtttcatgttcttttttccccccactgtcttcttttttcctttctgtatcttcctcctcattccttattctctcatccttcccttttcattttccttcttcttcttcctcctcctcctggagccagagttcactttgcctagaggcaccaagtgggcactgccttctccaccgatgagtcccctttgtagagccagagtacatccattcagagtgtgaaagtacattcactgtgtgtggttgatagtacatttcactctattctggaaccttaaaggaaatcacagtgaatgtaaagatcacagtctcagagttagacaaatctgggttcacacctctctctccacttagtatttgccactagtaaccttaggtaagttgtgactcagcctcgtgtgaaagagaacagtgatccatccctacctgaaaaaatgattgtgacaattaaatacaatgataaatttcagtatgtaacatagcaataaagcatgtttgattaatactgttttctttctttatgccgtgtcacattcaagtattatctatttctctgttccaaacactgcagtatgaactaatagcagatcctattgttaaagagtttatagtctggtggggatggcgatgtatatacaagtaacaattttgctgatgtatacacaagtaacaatgttgcaagccactgggtgatatatgctgctggcctccagagatgaggggatggtccaactctctgtgcctctccaggtactgcctgcttcaaggaaggattcacaaatctggttgatcaagttccaaggtcacatcagtcagtttgctgtgtgttcaaaggttttgcatatggagacagaactctcttttcttccttttaggttgaaaacagtggcccactttcccttggggagtcactcatcttatactttctttggcatttgcactttttttttttttttttttttttttttacagagtttaactcttgttgcccaggctggagtgcaatggcacaatctcagctcaccgcaacctccgcctcccgggttcaagcgattctcctgcctcagcctccctagtagctgggattataggcatgtgccagcacacccagcaaatttttgtattgtttagtagagatggggtttctccatgttggtgaggctggtcttgaactcccgacctcaggtgatccacccaccttggcctcccaaagtgctaggattacaggcgtgagccactgcacctggcctagcatttgcactttctttcatttcactaagcatcccagagtgtggtaaatttcaagtgtaagtttaagggagagaaaacagacccattgggtctctatccctgaccatgtcccaggttccagttcccatgattctgctttcgggagtgccagcaaactctggctagcagaggagagagcattctcctccttgctcatctcagtgagtcattgtcctgtgcctttatctcccttggcacctcatggggctgtggccaggtgggcagtgtcacaggcaggattggggtgctcccagtcacctgaccacaatacggcctcaacaccaccaaaattccaacaacactgctaacacatatctttagaaacatacagtcaaagtacagagatattcccaggaaaggcaaattatatccagcaaggggcatggcaagggttgagtaggcagctcagattgacaggggaaggcaggaacttggcctgcgctcaggggtcggggtatgaatgatccagtgactctggtccacactaaatgattgtgaagtttccccctagaggaggaatgcatgtgtagtccaggtgtaggcatggtatctacattttagcaatagttactaatgttttgttccatagctactcttttttgacatcctggaacataaggactattttatttacctctcagaataaagtttgcagcagtaaggtctattcttagtgcacctagttgggacccaagataataacaccccccgccacacacacacacccaaatttaagtgcctactctgtgtttatttctgatctttacaacagccctggatggtgactattacctcattttacagaggaggagttgaggttcagagaagtgaagtggtctgtccaaaggtgacaagttgcagaaccatggttcaaacttcagatctgtggctccagtgcctttattattatggcctctgctcacaactttgcctacttcaatccatgcaaaaggccagcctgttttgtgataataatacctgtgtccattgtctgtcaattgtttactcaggcaggcagcagggcacgtgccattgagtttccctgtaatagtcatggctgggctgaatgggtacatcctctggccattgcacatctgtgacctgcatgacccattggagggggagggggctcccacgtcttccagggataatgaccccactcctggcttcatgcgtgttttgtcctccctctgtatgaagtcccagaaagaggtggtactggaagacaggatgatccagttcattccttgtcttttctgtcacatttccgtgtctgtcctcttgcccatgatggtagatcataatatttgttcaacttctctctcaagatgatcataaagatcaaatatgattatggatataaaaacaacttctgaagttcaaatgctagtattatggtttgtgtcaaagagaaactggaggaggcattgtgtctcaatattagtagcagaagcatttctgagggatccacagagaatcatacatagctttttgcctggatatcagccctacccctcagtatcctttcctagagtgcagtggaaaagcccatcttgactagaattcagctcaagtcaaaggaaaaacccaatggaaaatgacttctagataagctgaaaaaataaaataaaacccccaaagtccttagcagtgattcagttttccttctgaaagagagaaaaattattctactaaatgccaaattcccactacacctctcttcgagtgggaggggcattgagaccatcacagtgcaccatcctcagccagaagcacctttcttgagcatgccaggtgcaaggtcctggcagatgtagctgaggggcaccatggcagatggacccctggttccatctcaccctacacttccctttggactacgtgaccaagtttggggaccatcacccatccttcctaacccatcttggttagtgctgctgctgccttctgctgaccatgtccttccctttccagatggtctgtctttcctgctgccttggacaagctgatctgaaataaacagccaatgtagggactttgcaggcagaatcaccacctccatcttcagtgggcctgtgatcatctcaacagattggtcaagtcagtgtgaggagaggaaatgggctttataatttgggtgcctgcgcagacttttattgctatgtctttattggctatctttgttgccaaggtagagttatatcctcccaaaatataatggcaggctattccactttgttgttgtttcttcctcaaagtattagactccctcaagacctcccacctctatcacttccaaaattaaggtgagtaattagagaaatattggttttatcgaatgactatcaaagaaaagagacactcctcctgttatgcaatacgttggtctagaaaatggagcatatttttacatttaagtatttttatggcaaatttaattatttgaaatacactttgaaatctcaatgacagcaaaaaatacagaacttcttttatgatgtaaagtcacatttattgatatagatgtatagatatagatattagattctcttagagtaccatacctacattcatggataattcgtagcatcaaatgctggtagtaagtcattgaccctcaaatgagagcaacatacaaaataaaacccaaatctagacgacgagttaagttcttctgaggcacataagcccatcagattaccttctaagttttccaagaaaaagcgataccagtaaactcagttcttaccaccttaaccacactatcaatgccctaaattccccttaatttgcactgccattgaggcctgacacatgtcattcaacacttgctcacatgctgtcattcccccctcttgctactgttgttctcagagcccaattggcctccgagctgtgttaggatgagatcatgccttattgtccctgtggtctgtgtcatggtgctacagagtgctgcatccaggcatctgggctgtgtccattaacatcaaatttttattctgctacatagaaatataatccagtggttctcaaatactttgcccacaatcatagaaaaaaaatatagaaagaaatatattttgtatggtgacctagtgcatacatacatatacatattataccataaactagtttcacaaaataataattatctttatatatgagatggaccttgagctctgatattttctattctattccatttcaccctgtgaccttttattctattttaatatactggatgtgacatttaaaatagatttcatgacaaactaatgggttacaactatcaatttaaaaaacagtaccaggatatgtctggaaaggtttatcccctgcccacaccagagccactccctggcagcttctcctacctcctacaccacctctatgttcccaggtgagcttgtgctaccttcggcttcattgtggatgccacttggaatgcctgatgccttcaataatattctgtccccagcaaacagatgaatggcaaagaaagcgtgagtgtggggaagccacacttcctttcacttctgcatttcttttttcctctacgccacctcaaccacaggtggtgctagaggtagactacacttcagggttggggagacctgaaaggaatttagacgttcagttagaaaagtttatcaatgcaagcttcactgactatcatcttaatccgagggagtgcaccaaagaaagtgaatttcttcacgtggggtctccttatggacaaatctcaatgcctagccatggcctccatgacacaccatatagttcccaatacaaagttagtcagcctggccagcagatgctgagagcttttaaaaatacccatgcacagagctgcacacccagagattcacattgaactggctggaaatggggcttggacattggaatttttgaaagctccctatgtgtttcttttttttttttttttttttttaattttttttttttttattatactctaagttttagggtacatgtgcacattgtgcaggttagttacatatgtatacatgtgccatgctggtgcgctgcgcccactaacgtgtcatctagcattaggtatatctcccaatgaaagctccctatgtgtttctaatgaattaccagggctgaggaacattgggattgattgacctgactggggatcttcaagagggaagtccaatggggggcttttcaagatgttctcaccccgctgaggtgcacaagaattcttcctgagcacatagatgtgagctatggaattagacacacagatagttctccccaaaacaaataatcattagagtcaatgaagtttacatacatgttaaggaagaaaactgtcataggtaacataatatgaacagccccttttgttattataaaaaattgtattagcctccctaccctcacctccttattcaatctctacttcccaggctggaaatttagaccttcctgcataaaatggattttaatcgtacagctacagctctctagttgcttcagctttggagtattttcttctctgtatcttaggttagtgtttctctaattttattatgcacaggaatctcctcagttcttgctgaaatacagtttctgattcagtaggtctgagaaggggctctggattctgtattcctaatcagctcccaggtgatgctgttgctgctggtctactctttgagtttaggccttaaaacagattggcttctggccacagatcccctacctgactgctataagcaggtaaaaagctatgtgggagtttgtgatggttccatgaagtatactcagagacctgaggtcgagggagagggagggattgctcctctggctatagagaagcttctttcagcaaattggccttccgagtcagggccttttcagcctccgcagcttgtgggagggtatggggcttattggaaaggccccagttctcactgtagctgagaccttccctctttgtctccccttggctggttgactttgatcttggatctgataacatcaaaagcatcatggtttaggcaccagcatctttaggattggagagtttaataaacccagggaacaatcaccagtgactacataaagagcctacttctttatagtagcaacctaatggctaatttacataaatatataaatgaagaaataccaagaagttaaagaaagcaaagaacttctaagcagaaaaatgtgtattgctgttccttactagaatgtgaagatccaatttgacacatttggctccctctggatttcctttagcagttaagatcctggctaatttattatgttgttactttcctattcagtaatttgctaaaaccacgtcttgattacatgtcttcttttctgatacccagtcagcctcctatctgatgaggctctcttagcaaacccctccactcctttcagctcttcaatggagcctgccttggccacagataccccacccccacaatgtctttttatcagggagctcaatatcctatcatttgagctcagctctttctggctaacttcctaaaggatctattaggattataaaggacaggatcatctccctcaacaaaatcaaacatggtcctctaaggtcctctctaaggaaaaggggagaaatttgccttgcgacaaagaactgctcaacttctcagcgctgatttttttatgctctcttctctcctcgcctgccgagagccattttcctgttctgaaagctgctgctgctgactgcctacccctcaccacaggtcttagatgctgcgtacctccctcttaacattcttgccatgtgtgcaaccacaggtgaatctacaatctgctcagcgcacagctgagagagggtgggaatatttaaacaagcctttactaaaagccagagcagtgaatctcaaactcatatgtctaagaatccatggaaggatattaaccgctttaatatcagataataagttcctaaacccaaagattccgtttcagtgggcctgggatggttttgagtgattctgagcaacatggtccgagaattacattttgagaaacactagcgaagagatttttttaaatgaggaaaaaaataaaaagaaataaactgagagaatagcatacaactaaatgggatcagtttgtaagtttgtgttctgaagctctaagatcccattacgtcctatctccaggaaaatggaacatcaacctcttgggcatccgtgacatatgcatcgtaccccagaaggtatcgcctcttcctcccagagttcacattctaaataggcaaaataaaatcaaatgaccctaagcattctcctcccaaataacaatgagctgcttaaaatcttttctggaatgagaactactcatataaacagataagtagcataatttgttttatttacttgtaccttaattgcatgctgtgttcagcaggcagtggatcagattcaagaggcttcgtaatttcccttttcctagtgacaaaggtgaaaaactgatctctacacttaataatgtttgttttggggtgaaggaaatggattgacatttcagaaataaatgtattacttggaagttgcattttaatttagttacttttttaaattatggtcttagattctgtaagtttagtatataattgaaaataaggaaatattctatttttgttcaagtataatcttaatacaaggaaaaactcaaatagcctggaattttagataatgaaacttgaatttaaagcagattgatggatttatggctggtatctatctccgaggttaacattgtattatggcctacaaagctaaagtgttttagtttgagggtgttccatttgagaaccttggattcaaggcaatgagaatgagaaaagtgtttgtatgactacatttggctgggacaaattctgttggatgcagggctgataagttagcccatgtgctatagcagagcattagccattcagttgttgaatagtgaggacagatagagggacaggatagtagctgggactttggtggctggggacagcttgaggcagaaactctttcagaagcaattcagaactgattcagaagtacagtgtttgaatattttccatcaactccaatttgcactagaaatggaggagaagaatgatcaattccagcctctatatgaaagaagagaaggaaaagataagaaaaagagaaagcaaagtaaataaatgaggatgtcttacgctgtgctactgagcaacacctcactatagaatactgaattgaaataaatacaattttgctcagcttaatttttggagccatctcattgttctaaagaaacaaatgggaggagtacaagcttaaattagatgaatatttagcatttacctgaaatcacagcaatatgtattcatggctatcatggtctgatgtgtaagttttccgtgttcatacagttaattatattttttggaactactccaaaaaatgtaattaactatatgaacacggaaaactcttccatcagacacctatagggaaatgaagaagagcaaaaaatctcttcttgcagacacctaaagggaaataaagcaaattaactacagcttaagccctattacttttgaactggtaggagaaaaactcagaggaaataatgtaatttgtatgtatgaagtactgatgtatatgtggtaggagaaaaactcagaggaaagaacataatttgtatgtgtgaagtattgatgaatatgtggtctatgacaagtatggtaaaatgaaagtccacaaagaaataaattagcagaagcatcatgtctcccaacaaatatggaaccactacacttcactaaagagagtggcacctggtgggaaggggcatagaatttgtaactggccaagattaaagtgcaaatcatgacattgtctcttaaatgctttataatcaggagaaaacttattatgtaccagtttttctttcctaaaaaacaagtatcataagcttcaggttgctgtgaggattaaattaaataatatgcataaattgtcttattcgtaataagtaatcagtgaaagctagctacaataatcataaaaaattaagtagtcaaatatggaagcatctaggaaaaatccagaagttgattaattttatggaaattttttttccattatagcctttgtatttatttatcagatgagttttcagcagatgtttgtcacacatcttgctcactcagttctgttcttgtcagcatgccattgtcaaaaaacttatgagtagagtgatattagagcaatagaatgaatccacctctcttactgagatagtcaaagagataaagaacctaaatgatattattttcttttcagagtgtatttgcttataagtcatttctggtctgtggcataaatatgtgaagaaaaaaaccctgaaatataaaacatgtatttattaatttattacgcttaaggttaaaaaaggtaacacaaattttaattagtttaaaagacaaaaaggaaaaggaaaaaatgtttagcctcaagtaccagataaagactctgatccagtatttgtgttgagacaaaggaaactgtagagaaaagaaaaatagagcagcaaacactgaaataatcccagaagaaatgagatcactggtcacatccaactcagctgcaaatgcagcttccaaccccaataatcagccctaacaggtgagttgagggctttattgcttgctgtgtgaggaaaaagttacctttctgagcttgagtcctctgaagactctaagaagacacctctgtctttctctcatggttttgccatcagtgagaacctaaatcattggaaggagctagagaatcaataagtttggacttcttcagttccatattataaaaaactcatccaccagttagcacattttattcagaaatgtgcccattatagtatgttattgcccctgagaaaatacatccaaacagtacttaaagaatctggggaagcccagtcatcaggttgtttgatagactcacatttcaactaattgggagagcttgttcatcatttctgagcggtatttttcttccaaacatcattttcaagctcttcaaagttgtacccttcaaattttcttaaaatccactcatctttgtgtacttcaaactaatttggtacttctgtgagtttcctatggaaaattctctaaattcacacagtatggatctggcagggcaaaatcaatgaaaccagaaacggggattagttacaaggattcttgtccattctccattcatttttaactaggaaatacatatgaatcatctaacaagggtcaggcattgttatacacactagggagatagggagaacaggacacacagggcccctttctgctatatgcaagcaaacaaaaacagacataataaaataatgtaggctaggataggagatatgaagggaaaaaaacaccaaacaaaccaaggggtttagagggaaagtcacaagagagtggcttttagatagggtgattagtgtggtcttttggaggctatgacatttaagctgaggcctaaaaaggaggggatagtaaagagtgagtggaagaacatccagacaatgagaacagaacatgcaaaggccatgagttgggaaagaacttcgcttggatgcagaagaagcagaccagcaagggtctattgcagcattaaggcagtagacactagtgatcagatcagggtggtggcaggaaaggttcagggcagtgggtggagttgagatatattaggggtgggactgacatttcttgtccgtggattgggcatgagagattgagaaccaggactcctcccaggttgctagcctgagatgcggggatggtggtgccatttactgagtaaaggaacaggttttggaggaaaaaacttgtgttccattttagacatgtaaggtttgagataactgcatgacatccaagtggagttataagacagacagttctgtacctgtgtctgaagctcagagaggggagtgctctgatctgaagaaataactgggaattgtcagcctaaattcaatattgttattgaatccatgggaatggatgtgatttcccaggaagcatgtatctaggactgaggcctggtttgagtgaatgtaaagaagcctctatatatggtactcatctttgatggttctctccattcccaaaagctcagctgaataattagtatttagggagaatcctctggaccctctaaaatttttctctggactaagccaggccactgactgtattttgatgctgtacctgaacacagaatggcttttattagatcatgctatcagcctatactgaagaacgttataagaaatcacgcaagaaacatcctggtgtttcgcagcaggagctactgtttcccctactttacagaggaaactgagacacagggaagttaaggaacacacgcttagttatgcagcttctgaattttcaaccactttattatatcacatcaactaacagaaatgataatcagtctagaggaaccacttaatttgtccttctgaggttatttaggggcaagtggaagaaaaaaagtagagaaatctggagacagtgcattcacatcatgttcccaccactgatggactgaaacagaaactgcccttcctgtctctggcccagccctatgttggaaagccaacccataaacagttcagtacaactcccagaggaggtattagcaaagtttcctgtgtaaatacctgtctgcttcacaagtactttctaatgagaggaagataatcaatagcaatgaggcaatagttggtcaccttctatcttaccacttctacttttctatttttcttttcttccaccttaccatttctaccaattctccagcttcttgtcttcttgcctttctccttcttgttctttgagacagggtctcactctgtcacccaggctggagtgcagtggcaccatcacgcctcactacaccttggcctcctgggctcaggtaatcctcccacctcagcctcctgagtagctgcgaccacaggcaagtgccagtaaacccagcaaagtttttttgtatttttttgtaaagatgggatttcactatgttgcccaggctggttgtaaactcctgggctccagcaatccacctgcgtcagcctcccgaagtgttaggattacaggcataagccactgtgctcagctgtttttcttatttaattttcattttctactgagttcttttctcccctctttaattcctttttcttatttcctatgaatgtttagcctattggtgttctctaatctggattttcttcttaacctaggacagatcttttcaaattttgttcatcttttttccaactagtttcaaaatgcagagctgagtgttctattttacatataccaacatttgtatgcatgacttgttatttttatgctgttgttacctgtgtcctttatcattgtattctgaaaatccataatgacaagtgatcatgtcaggataactttggttcagttctgagcacatgagtacagatgtttaaaacatgtcagataaatgagataaaaagctgagttgatcagattagttaagagaaaaggccaggcacagtggtttatgcctgtaatcccagcactttgggagacagggataggagggtcattgagcccaggagttcaagatcagcctggacaatatagtgagaccccatctctacaaaaaataaaaaattagctgggcatggcagaacgtgcctatagttccattacttgagaggctaatgtgggaagtttgcaccactgcactgtagccccagcaacagagtgagaccctgtctcaaaaaaaaaaaaaaaaagagtgattattttcctcacagggaaaaattcttctccaaaaaagaagtgctctgaatatatgtagatttttgtttctagagtgttttacttgacaagagaggtcaagagaggaaaaatggaattctaaattgcttcataacctttgcctcctgaagatgagcaagaaataaaaataaagcatttcagaagttaagacatgactccatgaaaatgtgttttgattcaccaaaattttcaggaaagcattgcttgtgtaatgccagagatcctatatcacaaaattctggttaatcattaaataatatctttttaaattaaatgattcctagtacttgctgtgtccctggcactgggctaggtgcaggggcagcctctgccctcacccagctgtgcagggagtgtgagagcagggctcagcagctgagacaccgtgtgtgaaaagtttcctgtgagatttgcacagttgtcatgggagggacgtagtgaacggaaggaatcagacagattaaaagatagtgcggtgggagaacaacctaatttgggcatcatccagtatggaaaggaaatgaaaacttgaatgcaactagaaagatatcataagaaagactgctgactttttcaagtaatctcagagcaaacacaatgcttttgttattctcttggttggccacactgagtgtgtctcacgctgaatccatcagggcaggtaagcaaagaaatcaaacacggaatctagtgaacaaaagagttggggctaaacagacagctctgtgataacaaagggaagctccacgtcaggggttcatgtgagcttcttgggaagaggcaatagagacctaaagacaggcgtgcatggatgtaggctctctcttcccactgcctggcacgctgggctccacccagtctttcagcatccacttgatgttaattaaggctccagttcctctaatttagtgcttactatccagttgttcattgccccccaatttctttttactttttaatcttcatttggcatctaactggcagtgcaaacttctggactcacacagagatttcttccagcctgtttggaggtggagaggcctgggatagtgggttctggcagaagctccactcagtcgctaagtctcctcactggtcctcctgacaaatgaaaggccttgagatgggtaagagtcttgcctcaccagctgagctgtgcattctttacttctggatttacttttatttattctagtagatgtgtgaaacagcctcaggcaattcagggtctctctccctgccttcctctggtctctctccctgcctcccctcttttggggagagtcacacagagccaaggtgagtttagggtgggccacccttgctcccgcttggctttgagtcttcatccatgcaggtccatgccgccctatcccaccagtggggcctcctcaggctgtctctcagggcatgttctgaagccccctgcactgtcctgggacactgctgagctctgtgaggctggctcaggggctgctacccaggcttcctgcagccatttcagctcaagcccgctgtgaggcttggggcagggtctggagtcggaggtgtcagggagcacactgcgactgtcctgggccacacttccgcccctagctcaccctagagtacctgccaacaacccgtctcctgtgggctcctcccggggacccgcatcaatgtctagttctcttccttcctctggctgcctccctttcccattgtaaagactgctgttatctacaggcagggaggatcctgctatgcctgatcagattcctccaaagctatcaggtatgcccagagctctttcccatcaactctgaaggtgaacttctgcattctgtggtgtcacagccgctctaagcaatgacaactgcaggaattataagggacagagcctcagtgaatatgccatactatattgtcctcacagagctcacacagttgaaaaggactttggagctcatccactcccaatcctcagctatgtttgggtctttctagagtatcccatactttaatggcaggaaccttactcggccctggacagccccttcagttgctgaacagtgccatctttaccaaagtctccctgtgacatctggacctcagtcaggtctgtccttggcgtcacactcgatgggtcttctccatgttcctttgatgctcctggatgctcaggccccagctgagcagcctggaaaggaaaggacccccaaccacaggaaaaaggctttgggcagagggtgtcagcctgggcccagctgagccattcctgctgcctgccctgtttcctggcagacctctgcctcagggattctgcacagtgggaagttcgctacctgtcatcgagcccatctgtaggcttcccttgtgctgacagtgcagcctctggcttctcagccaggagcagcacagatgcctgggctcaccccacacatctaacatgccagtggatctggcattctgtactcacacatttgacaaaagttccttagattattgtagcacataccaaaggagagaactctgctataagtgattgggaagcaatttgccaattgtaaaattaaattagtagtagaggtaaaatctgtgcattcagtgacagttcttcattagcagccgactgttaatccacagctttctatcaaatgaactggagcttgagtcttcaggctttcactgatacctaccttttccttttctctctccttctctccatccttttctcctcctcgtccttccttcctttcttaaatgtttaccgagttcctatgtgtacaggcagtgggctaggtaccagatagaaaatgatgaatcagaccaagaccctggcctcaaagagctcacattcagaccagtgaacatattaagttttggaggttgtatcagttgtctattgctgtgtaacaaatcacttcaaaatttagcagtttcaagccacatttaatgtctcacagtttctgggcaccaggaatccaggtggcttagctgggtcctctggctcagggaccctcacaaggccatacttaaggtgttggcctgagctgaagtcatctcagggctcagaggtaggaagagccacttccaagctcatgtgactgttgccaggctcctcgctggctattggccagaggcctccctcagttccctgccacatgggcctctctagggagcagttcacaacagggaggctggcttcccgcagggtgagcaagccagagagggcgagcctgaaagcagccagcacttttttgtgtgacctaatctcagaagtgacatctattattcttgcgacattctatttgctaggagttattgggtccagcccatgctcaaagggaaggggttacaaaaatatcttaaacaaattgcactgcagaagctatttgtgtgacacgtgattaatgaatatcaggacatgggggatttgggggcatgttaaaggccccccacagtagaggtattgtcataatgtgtgtgtgtatatatatgtgtgtgtgtgtgtgtgtgtgtgtgtatatatgtgtgtatatatataatatatgtatatatatgtgtgtgtgtatatatatatatatatatatatgtgtatatatatatatgtatatatttttttttggacggagatttctcttagtacccaggctggagtgtaatggcgttggtgtgatctcggctcaccgcaaactctgcctcctgggttcaagcgattctcctacctctgcctcccgagcagctgggattacaggcatgcaccaccatgcccagctaattttgtatttttagtaggatggggtttctccacgttggtcaggctggtctcgaactcccgatctcaagtgatctgcctgcctcggcctcccaaagtgctgggattacaggcatgagccaccgtgcccagcccataatatccttaaagacatttaagcctcaaatcaccgggcccgaacacagcaaattaaaaacatcaattaccctttctttaagatgccataaggaaggtatgtgaggaaacttccataggattagactaaagccccaaataataaagatggttccttattcctgttttcctactttgctaaaaggtacactcagatgctgtctctaatggagaattgggataaacttcaccagtcctgcttaatcaagtgtatctcccctccaaaaaaaaaaaaaaaaaaggaaagaaagaaagagaccagtgccagtgagacaggtaggggatattcaactgtccctatttcgttccagaaaaactaaggcgttacaacttgcaatgtatctggtttgactcaatatgttttgtattcaagtttccaaccagcaaaatttgtgaccttattaagaatactagttcatactcagtacccaagagaaagatttccattccagaatctagtctactagcttggttattattcatttatagtgtcagatcagagaaagattgaaggcattcctaattagttgccttgggatataacacatttgaaataatatcaattgatatttcagtgtctgttaagcctgatttatagggacttgtgtttcagtctaaaagattaatcatgtgtcacacaaatggatcctgcagtgtaatttgtttaagattttttaaagtatattcacatgtaccatcatttttacagaaacaaatacagattggaaatatctaagtattttataaaggacatatgatacttcaccaaagaatcccattattttaattaacataattttctgacgttgacgtgagacccacatgtgtagattctaactcagtctaacaagcataagtgcttgcaagtcctctgagagaaaagtcacaggcctgagtctgagttaagggagatgtcctcattgcctggccagtttcctcattgacattcaacactccatttgcctgcttgcaaaacaaaaaagttagccctgcatgttgacctacctgaaaggtctttgttaattgaaatactgctgcaaattcatagtgggtttttttttaagtacaaagacaaaataaagccaaatcatacttataactcaaaagttagaattgttttgctaattttgtaaatgagcaaatttatcttcttaatcaaaattcagtttggaaatattccatatcatgtacaggtttctaatactcaactgcagccacttttgagggactcgattttgaatcttcagagtatcagatattgtttttcctcccatcccattattttattattctaaagtgcttgtaatttcatactaaagaaaatgtgacccgagggctggccatggtggctaagccctgtaatcctagcactttgggaggccaaggcaggtggatcgcttgaacccaggagttcaagaccagcctggagaacatagggagctcctgtttctacaaaaactaaaacacaaaaattagccaggcatggtggtgtgcacctgtagtcccagctacttgggaggctgaggtgggaggatttctatagcctgggaggtcgaggctacagtgagccatgatcatgccactgcactcatgcctgagtgacagagtgggaccctgtaaaaaaaaaaaaaaaaagaaagaaaagaaaagaaagagagagaaagcaagcaagaaaaaaagaaaaagaaagaaagaaagaaagaagagaaatgtgaccccaaatgagagattactgggaagaaatgcttggaaacctgtcataatgcataacttatggaggaatgaatgtgaacataaaaactttcattctgcaaggctagtttccaaaagaaacacatcaagtaagaccaaggtgagaccacagaaaataacttaaattctgttttcattttttttttcaagaacttatttaaggtttaaagttttctttgacctctacgggggcagggatcatccacccaagttgttgatgggacaatagaaccccaaagaggggcggtgacatcagcagtcaggtaccaattaaacccacgtgctctgattttttcctcactacgttttgtaaacccaagagcctcctatttttcaaatttagaaattaagcaacttttgaagctccctttctctgggctttctgtacaaataatatactaaaatgcagcacaagttaaatctacagttatcttggggatttgtcatcactggctccacaacgtacactgtgggtttctaaataaacttcccttactggctgcacaagtttctgcagaagtgtcttttagtagcctaaaaaagaaaggctggaagagcaatgtttcttttgaattctctagcaattatgaaatcctaaagaaacaggtccaggttacaagagagggactgtggtgtcagaagtaagtcctaagaataattactctagttggctctgtctttccagagttacagcaatagggagttccttgaacttcccactcaactggcagatgcctctggcatgttgtgatgtggtgggtgttttatttgaaatggtgaagtgaaagaaacaaacaaactctctatggccaaagtcacaatgaaatacagatttatgcatgagcatgtactcataccacacattctctctctctctctcacacatacacaaacacacatgtgcgcgcacacacacacacacacacacacacacccctgttctgaaactcgattatcttatcaagactggatagatgtctggtgcttcttaataaaagtgttgaaagtttccacagtgaatttgtttgctggtcaaaaaataggctcatactgcaatgggtggaaactttcaagtggggacagttagaaaaggaagtcataatttttgagctgtaagagaaaattttttacgagaccctcaagaactcaatttcttgctttttgtatgacaatgtaatgtttcacatacttaatgactgcatgacatgtactacaagattctgttttttctttatgtgattccacctattaaaaaagccaccagagcctatctaatgcttggaatactgtttcaaacttttaaatgatagagagtgctacagcaactttctccgatagaagtataatgaagctacatgtgtaaatttaagttttctagtagctgtatttaaaaagtcaaaagaaacaggtgaaattaattttaataatacattttatttacccactgtatccatagtattatcacttcaatatgtaatcatatatcatgattcagataccttatcaatatatcataatgtaaaaggtattattttatatttttatactaaatattatatatttaattatatatttaataaatactatagtttttatactaaatcttcaaaatctggtattttgtacctaaggaaaactcaatttagatgctaaagttttatgagaaatccttaatctgtacttagatttcataaaatttactgttgaaaaagttgattcatgtttccaagttgttccagacacagttaaaataatttttgtgtgtaagttaattaaaattaaataatattaaaaattcagtttcttaattatgctaacgaattattgttgttttgagtaaacaacagccacctgtggctagtagctacctcattagaagcacaggtttacatcaatgaatccttttcatctttgagccaccatagatctcactggagatggatttattttaaaagattaaaacttttggcagaatgaggcttgagaatttttttgattacttcgtatcatccctccacttgaaacaaaccaccatcaccaacaacaaagctaaggtcatgacataatttggggtggtcatttctgtccttccatcagctaacagcaagaagggaaggagaaggggaagggaggaattgtgctctgagccatgctgagaggacagcagggaagccagagcaggagcccagaggaaacctgctcgctcaccaggtctcctctctggccatggtcttctagtctcctccctcatcttgcctcccaatcactgcaaacagccttgcagcaacttacatctctgcaatttccttgagagtcttttgggaaagggtagaggttttcaagaaaattagaaaacattgcatatgcctgtggaaattattatattagttatccctggtagggtttttctctttccatttttttttttaattgaagggagagcctgaactggctctgggctggagttccagctccctttcttcccacctgcattgccccatgccagaaaacacagctcactttccctatcagtgaaacatggttttgatgaaggttaagtaagttggtatttaaaacatctagaagcatgtctgatgaatggaaagctctcaagaaacagtagagtttattattattgttttacactatggattcctataaagtttttcagcagagaactgtataactactatatataaaatatgaatattttaagcacagcacatcccacagtgcacaagggactgaatgtcttttataatttggcaaaaagcatttatttttaaataaaccaatattgggctttttaaaatatgaatgtgcctcacagcaccattctagttttatcctgaagaggtgtatatattacttgcagaacttctttcaaaatcatactgtttgagtcattctgttggtacttattaaaaattaatgtggccccctgcattgcaaaagaaaaaacatgattttttccagtggtcactcatctgcttttctctattagcttatgcttttttccttattttttagcccatttctcctctcctcagctcaccagcaccttatgatatgatagtcctcagtctgtggctcagaggggacatcagaggccaaacgtccatgagtttaagaaaatgtgcaacaatctacaccttgtccatcctcccccataacccattgccactggttttgaaaggaatttcaaaaggtgaaggcctatgactaagcaatcatttcctcccagtttatcatctcagatcggttgactgttgctgctttgggactaataagatcagtgaccttaaaaaccagcatccaggagatcaaaactgagccaggacaccaagagaacaatgaatgatttgcttatgtaatgctgatgaaatcatcactgtggtgggtatgcaccattatgtgaatttatgtcatctgtaagtgatcaggttagctagaaggtgggcatcaccatgttatgtgatatgtacggcatgccattatagattatactttggggcaagatcctgagatacttaatggatatttagttgcaatgagctttctatagatttgtcagagttccagaaaagtggaaccggaaatgctatattaaaggcaatggtggtatggtagaaaaagaatcttagaaaatccaagtttgtgtcctatcctcccacatactagtggaccattttactccattggagcctctatttcttcacatgtgaatgagcatcaaaatagctataccatggtgtttgtgtgaggattaaacaagataataaatgtggttttctaggactgttcttaagcttcagtgttcggttactattcatttcaaatttatgtaattttatttaaccagatgagaaaatgttcataatttattgttaaataaaaacagtatattaccatattcaaaaattatgtaaattttgtaatcaactagtcacatcattgcatcgagcctgagtttctcccagctctggggctctagatacgtacatccagctgcccatttatcatctctacgtggatctcagacttcacatatccaaaaccaaactcctaactcctgactcaccatcccaacctagcctgcctttctgtagccttcctcacctcagttaatgacagataatttttcctcatgcttccagtcaggaaagtctaaacttagctgggcacactggctcatgcctataatcccagtgcttcggaaggctgaggtgggaggatcgcttgaggccaggagtttgaggccaccctgggcaacatggcaagacccccttctctacaaaataaaaataaaaaattagctaggcatggtaacatttgcctgtagtcctggcagctcatgaggcttgaggagggagcattgcttgagcccaagaggtcaaggctgtagtaagctacagttgttccattgcactcagcctgggtgacagagcaagactctgtttctctccctctatttaaaaaaaaaaaaaagaaaaaccaaaatgttggaatcattcctaattctttattttatcttctgcctaacatctaatctgtcagcaaatcctgttgactctcccttcaaaatgtatccgaattccagctgctcctcacctcctcctctactaccatccagcccaaactgccatctctcgcctgggttactgccacagcctcctaaccgatcctgctgctgtctcccttgtccccttggcccacttgcaacacagcagccagtgatacttttttaaacctgaagtcatttcacatcactgctctgtgtaaaaccctccaatgtcttcccagtacactcagaatcaaagctaaagccttcacaatggcctaacatagccctacatgctctgacacttcaattccccagagctttaccgccctcatcattcttctcatctcagcttactctgctcctgccacaccatcccccgggatgttcctctaacagaccaagcccctcctactccagcgcctttgcacttgctactcccttccttctcttccctagccatccacgtggctgtctgttccccagtttcaggtctcatctcatagggcaggttttcagtgaagccatcagcaccggctccctattccacatggccaccccattcctactccacataccccttccctgcttcattttttctcatgaagctcatcaccacctgactttatcaccccttgatatgtgtgtgtatatatgtgtatgtgtgtgaataatatatacacacacataaaggtatttattgtcagccactccccactatcatgtatgctccatgagggcagggatcactttttcattgcgatagccctactgcccagagcagtgcctggcacagaaaaggctctcaataaatatttttagaattttttattttattttatttgagatagggtctctcttggttgcctaggctggagtgcagcctaagcaacagagacagtgcacacgattatagctcattggagccttgacctcctgggctcaagggatcctcccacttcagcctcccaagtagctgggagtacaggctcatgccaccacacccagccaatttttaaaattttttgtaaagacagggtctcactatgttgcccaggctggtctctaactcctgggctccagtgatcctctcacctcagcctcccaaagtgttgggattacaggcgtgagccactgcaatgaatgaattatttgtctatatttattcaacaaatattattaacccctcaccctgtgccaaacgttgttctaggaacttaaaatacaattgtaaaaaaactagacaagaatactgttctcatagagcttatatctgtatctatagctctatatccatctatatctatatatcaacatctatatgcacatctacatatatctatctaagactgaaaagtgtacagtgaaaggattatggctgatttttcattattgatgctcttctatacattctaaattttctaaaagcgtaatttttaaaatttctagaatgacgtgattattattgtaatgagaaacaattgtgtaaataggaatgaggagtgaagcaacagttaaatgcaagagaaaactttgacatctatactgtgctcatgtgaacttgatcaacatctgattaagtatcacaactgtatatcactgctgttgttgaggcagtgtggcattgaattgaagagcaggattgctgcagacaaattgcctgggttttaattgtttacagttacatgaccttacttaggctatctagctcagtttcctcatctgaaaattggaaataataatagtattgttattactaatactagttcattggttgatgtgaggatgaattgagtaaatacatgtaagatgcttagaacagtgtgggacacagaactgataatcaatgataagtactattattgtttttattgctattatagttatctttattattattgagtgaaaagaagggaaagttgtattctctagaccattacacttaattatgaatctactggctcctggaaaaaaatactgtttataattttattctcatatacaaatttgaataagttatctaaagtatggtcttctattggtaaattcattaggaattaaacaacaattctgagaacagaagcagtcaaccctgatgagcccagctcagttctcggaactttctgaggcattgtctgtggcagcaggttttctggccatgtggagaagggagtcaggatgctgcctccagagctgccacagaaagagcagcggaaatggcttagtgtgattggcactccagtgtgaatgcctgggtgcccaatgggaagttaattatattaaagctaaagaaaccattacattgcctcagaaaaataattagtttcaccccagatcacatttgaaattaatgacattattgtgtattaggtaaatacatataattctttgcaaagcatattcaaatgccatagtttgacaagtggttatgccttattacatctaaccttgaaggttttagtattttggttagtcatttatttattcatttgtttttgctactctgactgtatgtccagccaaaatggattatgttattaattgaaaatattttaattgagcatttatcgtactcattcacaaataatccaattaaatctgatcaagcatattgcttaatgcaggaataagtgtaagacatctgcaaattctgcactttggcaatcttttttttttttttgagacagcgtcttgctctgttgcccaggctggggtgcaatggtgcaatctcagctcactgcaacctctgcctcctgggttcaagagattctgttgcctcagcctcctgagtagctgggattacaggcgcacaccaccacacccggctaatttttgtatttttcagtggagatggggtttcaccatgttggtccatggtggtcttaaactcctgacctcgtaatctgcctgccttggcatcccaaagtgccgggattacaggcatgaaccaccgcacctggcctcagcaatcttatttattatagttagggatgtttacaaggcgactacataaaatggtgcagaatctcagattaacccaacccattttctcccaaactgatgactagaaagctctaagacaaactccatgatgctggatcataccatttccactgtagccactaaacgttagtgacaaataagttcagtgctatgatttaggtgtgttgtgcttatgtacttgataattgaacaacctttatttcctctattccacacaatacttggcactttctcaaaaatctttcagtcactactactcaattcttgtcatatcaagagagactgccagggtagggtggcatgccaaggagggcatgggattatcaacctgaaggaagttccagaggtaatctgtcccattcctctggattcagactgaattgtagaattaagagtacagatttgcatagacctttactctctcagagcaattgagatatatctatgataaatgaggtttatttgaacactagggtaaagtgattagttctagttaagatcagtccatttttcatgtcagaaattctctcttcagacctcagctaagcatgaaaccaagtcctttgatgaatatcaaatgatgatcagctcataacaacatatattagcaattactctgaaggaggtgtccctcacacagcaatggagatgcctctgtgtggtttaaaactgcaacacaaggccaggcacggtggctcacacctgtaatcccagcactttgagaggccgaggcgggcggatcacctaaggtcgggagttcgagaccaccctaaccaacatggagaaaccctgtctctactaaaaatacaaaattagccaggtgtggtggtgcatgcctgtaatccaagctactcgggaggctgaggcaggagaattgcttgaacctgggaggtggaggttccggtgagccaagatggcaccgttgcactccagcctgggcaacaagagtgaaactccatctccaaaaacaacaaaaaaacaaacaaacaaaaaaaacacctgcaacacaaataagcacagacacttgaatgggaaaagagacaatattcaaaaatcaatctcattaaaagtacttgtacacttattttcagggaaaaagtggcagagggaggtcctaggagagatgacatccaggaaaaaggtaatagcaaagctaaatatcaaacacaacccgttactagtgaagatgtggattgtcatctccagaaacgaagtctagcataggtatttgagggacttagatccaagctggggaaaggaaagaggaaatttagtttttctaggtgttttttgtgccagagacagaacagggcttaagagttggtctttggactaacttggcatggtttaaaaccttgttctaactcttactcactgtgtaaccccagtcaatttgcttgacctcttggtttctcattttaaaaatgggaaaaatggagatgctggtagtaatagtacctacctcataaggtggttgagatatttaatgacggaacatgtgtaagttgcctggtaaatagataactgtcaatagtgttaatttctattttctgtatggcgtagacgtgcaagaggctcatcttcctcttgactaaggagaatgctaattgccactgaacttctctttagcctcatagaatgttaacattaataaggcattatagtgcctccaaattctcctagcttgttgcaccccctttccagtgtttgctcttatacaccagtatttttcacagttgtaatcatggtgattgcacgctttcatattcatatactttcttatcatttacctttgcgtctaggctcctgctgggctgtgtgttgtgctcttttgtctgtagtgatttggggacaaatcaaacccttttgtctggaagtcctgagcctcttcatcttgaatttttgcttgctattgctcattatcttgcaaagcatttggtcctggcttcagcctttccaaaatgaattcaaataaacaagattctaaactccaggagtttacagcctcatacaatccaaatggatgcagatcagacataatcaaggcaaacaggtttttaaaaattgcagaaatgaaattgtcagactgcagaagtctaagaggtaaagactgtggcttgcaggggtgggctcactgtttagaaagaatgggacctgaaggaaaatgttcttctcctcagcctttatcttttctcctacacttggcccttacacataaaaattaatgaaagaaagtagaagttttggccctcaaaaagttgataaaaattattataactaatgcacaaatatcacaatatgtgcaatatgaatgcaatctggcattttcatgactactgaagatgggaaatggcaaactgatggtttgcagtttcttttttgaaactgtatgttcactccttctctccggtagagtttaaaacaaatgatgggatgaaaaaagagtgaactttgaataactgaacatatggaaggctggtgctagaaaatagtgaagcaagaaaatctggaatcatgcattatatggccatttgtcatctgtctcctccactggaactgttaaggacattgtttgctttgtttatcactgtgcccctggctcctagaagaggactgggccatactaagtgctcaataatcatttgttaaggaatgagaaaatagaggacagaattttgacccctaagcttgtggggcttgataaagtcaggcgtgatggcccccactgaaaaggtagccatagcgtggagctcccagctcccagccaccatgataccctttaaggtcatttgagggataaccaaatcaggaattgagaatttcctgcatcccatccctttaagacaaggataattctccagcctgcagcaaagactgctgcatcaccacctaagccatgtttagagcaataatttgtaatcattatccagttcataggggaatccagtatctctgcatcttaattttgtcttaataacattcaaacagggaaaccactttgctcaacagtgacctgtcacgcagttataggttacatatgtcttattttaaaggactgctgcatttaaatttaaaccacgtagctcccaagaataatattagctgctgagaataggcataaagttaacagaaggaaaagacctggtcccgggactattgcaaaaaacctgcactaaaagcagaaagtcataatattgtcaaaatggctaatctagtacctgggcaggttgattagatccttgaatttgaatagaaaatttcagagagttttgtagttcataaaagtcctttgcatgaataattagtgccgctaacaattcacctccctgcaagtggcatctcagagtaatctaccttttttttttttttttttttctgaggcggagtctcgctctgtcacccaggctagagtgcagtgttgcaatcttggctcactgcaggctccacctcctgggttcacgccattctcctgcctcagcttcccaagtagctgagactacaggcgctggccactacgcccagctaattttttttttttgtatttttagtagagacggggtttcactgtgttagccaggatggtctcgatctcctgacttcatgatctacccgcctcggcctcccaaagtgctgggattacaggcttgagccactgttcccggccgagtaatctattttaacacacatcctttattcacagaaaaacctgtttggagaatatgaaaaagcaatctccctctatccttccaaccaaaaattgataattcaaaaattgcagctggtactgttttagtagctggcaattttgaggagacttttcatttttcttaacaaattgccaaatggaaatggctatagcagcaacattgtgcaggactgagaggggcccagtgtttaaccccttttctttccccttctccctgccttgcatgctgcaggcaaataagccagaaatgcaaaggaactctgtcacaaattcatttacaaagcaaagagatcttttctttttttctatttctgaaatcggaagatattttaaaaaatacacaagacaaaaatttgaggttgcagaatttccctacaggatctccttccctatcccaaactccaaacaaacaatgtcccctttcctcctcaaagctgctttcagggttttgtttgtatatatgtttgattttatgcaattaaacctaaatcctgtttgtgaaatgaaaggctctaggatgtgcagttatcacagaaaagatggaatggataaggttgccaaatttagcaaataaaaatacagaatgcccagttaaatttggatttcagataaaccgtgaataattttccagtgtgtcttccatgcaatacattgggcatacttatattaaaaaatgtatccgtgattgatctgaaattcaaatttaactgggcattctgtattttatctggcaaacctgggagggctgggaggtggcattctgagtagggagcagttctctgtgcccccaaaatctcaacgaatgcatctgtgcataaagctcacctggtgatccgttcaaaggggatgatgagcaacagtttcactctttgtcactgttgtttagaggaagtttcactctttgttttcttaatgttttttagagacagggtctctctctgttgcccaggctgtagtgtaggtgcaatcatagctcactgcagcctcaaactcctgggcttaagcaattccctcaccttggcctctcaaaacatcaccctttgttgttattttcaactgttatttgcaaataaagcttgccttggaatagcagcatggtagaatggcatcaatgtgcctgggatataactccaactctgacatttattaataagtgtgacctcagactcattcatatttagtaccagagatgatatatacctgttctgaatacttcccaagttgaagtaagtattaaaaggtaaaataaagttactaacacagtgccccgtgtacaagatgaccactcaatgttattccatctcctgcaacgctttgtcccttagtaaaggaaatgctgaaataattatagccccaagctccttggtaaagcatggatgcataggttttggctattgctctttctttgcttgtttctttaatacgttcattgatatataatttgtatgtggtaaaaggcacaaatcttcaatgtacaacttgttagtttttcatatgctcatgtaaccacaggcaggtcaagatctagaacatttccacccccacccactgcctccctagaagattttctcatatctgttcccagtcaatatcacctctccataggtaaccactattctgatttcttttaccataaattcattttccctgtgcttaaaattcacagaagtggaatttttcagaatgtatcattttaagtctggcttctatcatatatttgaaattcatccatgttttcatgtatactagtagtttgatctttttcattccggtatgatattccattgtacgaatataccacagtttatccattttattgttgatgaacattagtgatgtttccagtttggggttattataaataaagccatcatgaacattcttgtatgtatctttctgtaagcatatgtattcgtttctcttagatatatagaaatagcttgactgggtcatagagttctcactctctccaaccccaggtggatcaaaagcacacagtttgcgtagcaaagttgcaaatatgttttttaaaggggagagaagcagcaaaataagaaaggaaaaaaggaaggaactgctagcctatctccctcaccaaacctcacataccactgtaggaaagtctcctgaatttaggggaagagattctttgacacagttcagaaaacagaatccaagagaatcttgggccttatatacttagccacatataaatgatgtacttaagcttaaacaaatgtcacttaagaaaactgtagtttcttctaacataaaatgcatgttccaatcttgtcatttgtttatcttacaccaatcttaatgatacttttgtgaattcttaatttgctccaactgtcacatcatggagattagttctgagacataaaaaatacttcccaaacaagtcagtttttaaaagccaaagatacactaaatgtcattaacgttgcttccattttagaaagaaatagaagactaaatttcatgcacaataaaatgttcataaaaagggacaatataatgctttcactttccaccctctggacagtttgtgccttctgctgcaatttcccagtataggtctaaaattctccctcttgtgttatgacagtgaatacagctacattttgacactaggataagagaggagttgagcttcaactggatcactgcatgcaaacatgctcctctgatgtcagcactaaaacatacaggtctgggcattctattgttgaagctactcagggaaggaggtttatgggacaaagtaagggagaagcagcagagccaaccaaagcaagagctctttcagataaagtgccaaaaagttaaaaatgtggttgtaaagtacaatcacttataaaataatgtgaaatgtattatcctgcctgaaatttttttagcactaagtgaaataatccataataccaaaagtccagtgccaggattataaaattaagccttcagagaacatgtttataatgccccaggacactaagagggatgagggttctgatgtggcatttgttcattcaaaaacacatcttaatgcaaactgatgtatgagactgaatcaggtcactggaaagggaaggggatatgatacaaaagaagtcaaagggttggctcctgagctccacaatggaggaattaaagccctccctggattgtatctctcccactgttgtgccgaacttctgttaaactcaatagggaaggcacaggttaaagaggccaaagagacccagaaccagcaaaggagacgtggggttttattaagggctcacatacaggggagagattccgtggtggcaggctgggtaggagaaccgccttacacatggaaacgatccagtggcggcaggcggcacaggaaaactgcaatggcttgtgaacatcatgcagttcatatagccttctcactcaacaacctccacctggcatccttcatttaacccaaactcaaggcctcaattccttggatggtcctgtgttccatggtacaaaccaggggctcagatgtttatcatagataaggaatgaatctcagcattggccacttccagattttccagcatggaacacacattgagaagtatctgccatacagagtcattctaaggatatgcttagattattgtttttaggtgtctttcccctacacccaccatctgccctcaaggggtcaaggaaattgcttagagaacagtgtgggcttgggaggcagtgggcctaggttcaaatcttaaacttgtcaccagctctgtgaccttgtgaatattaacctcttgagcttcagttttcttatgtgaaaaagaagctaccacagggttattgggagggtaaagtcaaacagcaaaaagttcaacaaatgtttgcttctaacatccccagccttcccctgttctattttttctgctgaaataccctgagcaggccagtgcatcatttcttcctcttgaaattgtcttgactgctgatatcgttttttcacttcctgagacatgattctatttagagaaaaataggatactgcagactagggtctaaaacaggttttgaaaaattacagaaatgcaatcttaaaggagggggctcagggtacatttttttcatgtgaaaaagaaaccagaggaattggggcttgaatgtactgcagtgatcatcaattttagtaaaaaccaattaaatctccccctcagtttttcagtattttgcatataaaaatactcggtatagccaatagatgttgaaatgaattacaatggtcagtctaactctgcatgtaatataagcagagcccaagctaattttcctcacaaaaactactttaacaaccagaaggcaataaaatgaggattatgaatccataaatctttgctcgttacagaatactgaaaatggttccaaactaattttattgtagcaaactgttgataaaaccttgtgactggtttatttttttgttcattataagcaaatagtcatcagccgtcgcccgagaccacatgtgcagttacagattaattacttgcagcgtctctggtttagaggaccttactggtctcaggcaaaccagagacttaaaattatttattaaataatacaatgtgaaaagggagattggatacaacatactgtgcaacacagaagcaaattaggcagagaggaatttcctcacggagaaaataaaattctgagagtaatacattgaatagtaggatatggtgtggttaagggcgtggctttggccttagcactgtggccttgggtaagttacttaatatctctatccctcagtgaactcagttgtaaaatgaggatgataatattattcacctcatagggttgttttcaggattaagtttaaaacagtggttctcaaatttaagcctgcatcagaatcacctggaagccttgttaagacagattgctgggccccaccctggagattctgattcaataggtctagtgtggactgtagaatttgcttttctagcaagctcccaggtaatactgatgatgctggtggacagggtgctacactttgagaaccactgaattgtacaagtgtggagtctgaacaactctggcacatggcaaacactcagtaggtgtgagctatcatttataagcttttgccaggagctgggtttgccaggtagaggaagatgcttcaacaagaggacactgtagacaaagaaacagcgtgatgtttcagagataaattggaaatttggtatagccagaatatacaatgccttggggttagggaatgccaaggtgaggctgtgaaagaatattacaggatagtttgtgaatgcttgggaatgccaccgaaactttaaatgatgacttgatgaacacttagggctacagcctctctcaggtcctctctgttttgagactttggctattggaggactggcagaggcattggcacatgccagacatacagtgaacatttactaaatgcttctgggctaaatgcatgtaagcagaaaaggtaaaattatgtgtaaattataaacggcattataaaattatgtgtgtaaattataaagggcagcagatgaccagttagcaacttcctaaattggaaaacacaggcagctctgagcttcttaggtcaaacacaagatttcaaggcagctgagcagctgaaactgtcttcttttgttatttcatcccaacacaacagggcaaatccacaaagcaatctcatctactgaaaaacaattacagccgggccagggaaaaacaccacaaaaggcttggaaatttcctgagaccagggtatatgaaatctagacagatttaatcactcttattgcagccagtccttaaatggggagcttaatctcattttcattttccataaaggataatttggagagacttcacagaagtgaagagtcaaggcctctcaggtttcaagagagacctcactgtttttaaaaaaggaagaaatgcgaaatgaagttacagaagctgaagtgcattttaaatgtttattatcctgtaaatacccttttaacaggaaatgtaaaatgtaaaatagttgttaatcacaggataacaaaatacttttttttaagaaaaaacaacccacagtttgtaagataagctatgttttcagtctatatggcaaaatttatttccactttttctatgtctctctgagactctgcatggcctgggtaagaagaataccaaaaggctaaatgtaaggccctccacggccatcagccttgtaccaaaggccctttctgacctgcactgtggtaggccctagcaagcaaaacaaaacaattgatcctacctcaggtattggtcagaacaggggatcataatggtctgatccattcaggccaggcaaggggctggctccccaactgtgtctgtcctgtgtgaaatggggtagctcatgaaagatctggagggaagcaggttaagaggagccaaatggccagggttagattcttagctctgtcttcactggacaagtcgttcaatctctctatacctcagtttcttcatctgtaagatgagggtgataatagcacctaccttctagagttattgtgaatattaaatgggttagatcttacatgtcctctactccatagggagtgaccaggcgccagctgcctgccaactgggtggcctcaggaaactcacttaacctctctaggtctcagttttctcagaaaatgaaagaataggatgaatttacctcagagaactttcctgttcttagactctttgatcctgtgactctgtcctgagtgtctattgtgagaaataaaggaatggagaggagcgaaaaactaactttggtctcctcactaattttggccatgaattcctgagctatttcagtgttgagccataccctagagcactttatttgcttgggaagcttgatttgttcatgggagtttgcacatacaaagtgtttatttgtcaaacattattttttagaaggtacaccaatattgaggcttaattcctagcaataggtagttccagtccaaagccttatagaaattggcttatggaaattgcagcggaaatagcagccttggtggttgcatgggtagaagcttcacctttgcccttcccactagcgagaggtggtagaatgcagaggtgaatggcacaaacttcagtttcattgaggcagatgtggtcccatgcccagctctgccacttatggctgttcggccttagttaaacctcgctttccttatgtatgaagtggggcttaggaaagtaggtattaacaatacctactgtaataagttgttgtaaaggttagattttaaaaaaatacagattaagtgcctagcacgatgttctgaatataaatgattaatagacgtgagttctcattatagaaaacacaaagaaatttaaaatgttaagccaacatcattctttgatataaatatacaaggactatattcactatgtaagtctccctcacttcttcctttattgaccactgcactgacattgtttggtttggttttatgttcagagtaggtcagttaaggtaaacgatgataaaataacaatgccttgcattagactgtcgtgatttataaaacaatttcacatgcattatctcctatattcatagtccaactttcttcaaacaagaaaattgaccctagttaatagagctggtgagtgacagagcagaacgtagaatgcagttttcttcatcctctcttccttgcaaaaggccacagtccttctttgtagagtttatgaagctcatccctatgcagcccctcactcccagccacttttgtggtggaagctgggctggtgttattatctccatttgttaggtaaggaaattgatgctccgagaagtttaacgacattcctgatgttgcaaagctgggaaggggcagagaatagaccagaacctgctcattttctagtgacacagacagaaacataggtaagcaaatcaaaacaacgttaatacatgttataattctttaaaaatgaattataaaatggtgtttggtctcagaggcaaaagaaaataattgtgtctgtgtggaggcacatgtgcatgtgtgtgttgtccagggaaagtctctcaaaggaaggaatacttgaattgatattaggaagaaaagtaggcagcaaagtggcacctaaagaaaattaggcagtggaaaaaccatatgcaaaagaacagaggcacaacataactttgccagtatgggaggaaagtctgtatgcctggagttaagtgtcctacatattgaagatttcttcttttttttgtgtgtgtgttggagtgccactctgtcacccaggctggagtgcaatggcacaatctcggctcattgcaaccatcccctcctgggtttaagcaattctcctgcctcagcctcccaagtagctgggattaaaggcgcatgccaacatgcccgcctaatttttgtatttttagtagagatggggtttcaccatgttggccaggctggtcttgaactcctgacctcaagcgatccacccgccttggcatcccaaagtgctgggattacaggcgtgaaccacctcacccagcctttcatttattcttttaacagttattaactgaacatctactatgtatggggctttatgccagctcgatgtccccataacctggtccatagggtactcagaggaagttggaaattcccagatggaattcagaagcaagagagaggcagtgtgagagcaacagtggaaggcactggagtagatgaagaagtcatgcccaagaggaaagaatggtgagaggagggagaggagcagaggatgagccatggagtccagcatttaagagacagacagaagatgcaaggtcagcaaagactacaaagcaaagttcaaagactgaagaggacaatttggaaagagaatgaaaaatgagggcaaggccaacactataacacatagtggagtgaaaaaaagcaaggaccaaaagtcaaccacagggaaaaactattgggaggttgctgtggttttaataagcacagttctaatgaagtgcagggaaaagaagctagatagttgttgtttgaggaataatacagggaaagaagggtaaaaaagaggtaagcccctgagatcggatgactttcaatgagcttggctggaaagaaaagggagaatctgcgggtagtcaagagcttatggaaaggctgaagctgctaccaagggagggttgtttagttgtgttttaagaatgcaagagacttgggcttatttttaatctagaggaaggagtcaatgaaaaggaagacccaaggcactaaagttgagagagaaagtaacaatggaacaaggacttgaggagatgagatcgaggacacaggtagatagaaggagggatatgcttttcccatttaggagtgggactcttattttgtgtcaaacagcaaaaaaaaagtaaaataaaataattaaccattggttttcagaatgaagcaattcacttaaaataaggcaagttaactgagtcattaatggaaaattctaaggatgtatctggttttaagggcagctggatcatggacattagggtttgatattactccatttctcagctcttcatttctacttggcttcaaagacatggagatgctcaggaggcattctcttcgcatctgaaaaaaaattctcaaaactaactcttattggctacattggatcatgtaccccttcctgaccaatgattccagctggagggaaagaagagcaggttggcttgagcaggtcacaagcctacctgtgagttagaggagggatgagcccctcccgagccatgcgaaccaagagccagggagctctcagggaagaccagggtgctgctcgtggaaaactggggaagaatgccaggccagggagaaaacagaccaatggttgtatactgccacttgtgacaaggagataaggatacttcagaggagagggcactgaggaaatccaggctggtggactgtattgtgtgtgaggtgaaggcctgacttgtcaatgcttaacgagctctgcagtcacttcacggatcccagcactttctcccccaacctcttttcctcatcgccaccgaagaaaggaaatgcctattgtgagttggaaagaggtcccatgcaggaggtaaatacctgcaggtgtgatatgagagcgattgctaagaaaactttatccaagcccatctgggaaaatagcttttcaagttcattacgaaaagaaaggcccagtaaagcttccataagaacaagcttagcttgtggaaagtgctgagaaaagctgatttattctcggtgtgcttccctatttttatgggttgcctcaacttttcttcagacaggaacgattggttccaatagtgtcacatgcagagagacactgtcagtgtaagtctccggggaggtgctatggaaggtgtggtatgcatggggaggagcccgcctgactttctgaagaaggataattaatgtgtatatggacatgcagggagcctttatcttcagaacacatttcagaaatgaaaaagcaaacaaagcgggtgatgaggaaaatggatttgctgtaactaaggaacagacctgggtagagaagtaaagacgagaaactcagctcttcatcattagaatgctccagagtccagagcttaggagcggagatcactcctaagtgtttgggtctgcaaactaggacacctagtttatacctagtcccagaacaaagggtggaggaggtaggattgaaagccactatttggtggagcttctctgacccttacagtccacccagaaaaaaaggcagacacctccagcctgaaatttggaggaaaccttagaattttgccccttaaacttgggcactgaactatgcatgcatggtttgttttcagaaagcctgtttcttaagttggcctatctatctccccttagccctttttggccagttcacacccttccttcttcctcaacctttctctgagcatctatgttcaagaaatccctcatcccctcctctgaactccagtggtgtgtcatttattcaacgttaaatcaggtcctgcttccctgttttcctttctatgtgcactcacttcatctccccagtgtggccatagagttctggatggcgggcttcatgactggttcatcttgcggtctctagaacccaacatagtgcctgggttgatactccaaacatgtttattggttgggttctctcttaccttaaggtggctccaagcccaggaacgaggagggtcaagagccaagctggactcaacagaagccaggagcagggacccaaaaacagagggaggagggtctacaaaagagaaaatggaatgtcccccagtgcctcaagctggcatgggaaccattccaggagtcaaaggctgtctctgacagtttctgctgaaaaatccccagagctgtgggggctcttgcctgcaaggatcatgctttctgtgggacttacagccaaccagttccctaggaacagtttgagggggatttgctgattcatctgttttaatccctctgggaagaactctgtgagcattgcatggcagcagcactctgaaggcaggtgacgatcccgctgagaagagtcgggatcctgtctgtttctgagcttggttgatttaacaaatatatactggggccctattatgtctgcaagctctgttccaggtgctggggacatagcaataaacaaatccaacaaacatctctgcccttgtggagcttacattttaactggggaagaacagataaataagatgaggaaatcatgtactatgttaggtggtgttaagtgctatacataaagatagaaaaggaaggtggatgagggtgttggtgtgggaattgtattttttaaagggtactcagggaaggctttcttgggaaggtgacacatgagctggaggaggtgagggagtgagccatgtgataatctggggaagatttccaggtacagggaacagcctgtgcaaatgtctgcagcaggagtgtgcccagcatgttaagaaaaagcaagggggcccctgtggaaccacagagtgaacaaggggagaagagtagagcaggtcagggagatagcaggagccagaccttgtaggcctttgcatggagggaaatgggacttcaccagcgggttttgagcaaagcagtgatgggatctgatttgtgttttaataagatcactctggccactgcataggggcttaggttagaggcacagagactcttgggaggtggtttcaatgatctaggaagaggtggtggcagtagaagtggtaagcaacaatttttttccagacatactctaaaggtagagtagacgagatttacttcaccatgcggtggatgtagtgtgtgaaatggaagagtcaggactagtgctaaggtttcagcctgaataactagaaggatgtggctgctctaagtcctctttctgcaagttccctttcctacacctcataattctagatatggggcttctcaccacaagcacatggaggctactgaacagtcacattgcagcaagttggctttctgctctctgacccctccccatccatcagctgaggtctctaaacaaacctgatccttctccagcgccttcccctctatcttccattgccaggaagagagcagaaaaccagggtgacaacatgtggcagctttgtcttcttagttggtttgtattatagaaaaatattcaccatgttctcctccagtgtaccttgattttgtgcatgttttgttctatacaatgactgatatttacttttgatagctatatgcattccttggtgtactgagcatttatttcggaagtcctgaatgatattttgaagcctttcaatttagatttaagaatacttaaaacctaagctctccaaaataacacaactatttcacaaaaaactagcattagatttcagtctccagattgaacacatttctagagcacttatcaggtagatttccaggtagagggatcagcctgtgcaaatatttgcagcaggagtgtgcccagcatgtttagtgaagccattactaaatttggtgaggttgggaatgaggtataatttcaaagatgaataaaatatagccttagggaaattagaaactagggagaaaggtaaaataacctactttttcttccttcctccctgaaacgtattaaacatcaaataggttcaagaattacataagatgctaaaggcacaaatacacaaaatagatctggtccctgattttgaggggtatagtctgctgagggagacatcagcctccaactaaactcactataacaggagatggaaaatctttcagaagagagccataaacaaagagccactataatagtgcattaaatatttcaaatttactaaaagagtagattttaaatgttttcaccacaaaaaaataaggatgtgaggcgatgcatttgttaattcgcctgatttaatcattccacactgtaagcgtatatcaaagcatcatattgggtcccaaaaacatatagaattggcatttctcaattgaaaataacactaaaaaacaaaccaaaaaagcgcccaaagagccattagaccacagatgaaggagtatggagtatttaaagctgagtcttgggattagggaattttgcagataggtggtgatatctgaactggccggttaaaggatggacatttctgcaaaaggagaaagaacatttttggctgagggaacagcatgagatcctccaaagtgtgtagcagttttagagaagagtcccagtagaggatactgaggggattctggtgataatgaggagattaggaagtgagccagggccatgtggtaaaggaagtgaagcctccagtgtagagagaatagagcattcactccttcaccaaggctggggtctccttgcccacaagcagatgttctaacatgggtgtcttccaagtgaacacagtcagcaagagccttatcacaagtttctttaataggctcttcagggaaatttacagaacttctcactgaactaaatcagtggacattttgaaagctggaaggcaattataagctgggccagaaacacaaaatgaggaaaggatcttgtggaaaatggagctgtttcagcaggcaggaaacacagggaagtggttctaacacactactactacctagttccttctctgctcacctccatatcctgtggcccctggaaaagatgagacctgggtaaaactggtaatacctatccagtcatttgacacgtgaaaggttcccaagactcaactgccacattagccttgcacagatgcttaacatttcattatatttactcttttagctgcaaagaaaaagatgaaatgcaaactcttttgaaggaacagtgcagctaagttgaaagaacactggatcaagaatcaagaaacctaacctcatttttacttcacctgaagagctgtgtggccctaggtacaatagggccacacaattcatctgtaaagttccccaacacactgcccattccaaaatcttggggaaatttaaaagctatattcatttccaggtcccatccagatctactgaatcataatctccagaagtgagatccagaacctgcattttcaggctgggtgagtggctcacacctgtaatcccagcgctttgggaggctgaggcgggtgtatcacctgaggtcgggagtttgggaccagcctgaccaacatggagaaacgcatctctactaaaaatacaaaattagctgggcatggtggtgcatgcctgtaatcccagctactcaggaggctgaggtaggagaatctcttgaacccaggaggtggaggttgcagtgagccaagatcacaccattgcactccagcctgggcaacaagagagaaactccgtctcaaaacaaacaaacgaaaacaaaaaacaaacaaaaaaaccaaccaaccaaccaaacagaacctgcattttctagtctttttgtgatactggttggtgccatttaccgactattttttgtcccactagcttctgggaaccaagtagagttgcattttgtggcccccttgtggtgaggtggggccatgggaacagttctggccactgagtgggaagtagaaggggcaagtgtctcttcctgactggagcatggaattgccagactgagactgtcccaggttgtttttccctctggctttgcaagcaaccactttgggatctccaagtgaccaccataagcagagcaccctgcctacctgcaatgaaaaagaagcctgagggcttgttacatgtcgctgaggtgtggagcttgttagcgcagcctaacctagcttagactgactgataaccatcctctggtgatttgtacacagtcagcctgatgccaggctttgacaaactcgggctagatgatctttcgggtgctttctacgtctgaactttgttggttctgtaaacaggttattagctattaacttctggtaagatgcttactggccatccgatgggaaaagcccttgtcaggtctttctgagagctgctcttgcaaaataggcagtgtgaagagattagattggggatgggggcagggcagagctctcagagagagcagctatatagttgggagcaaggagtaggtacattcccaagggtcaattcaagttggcctgaaagccaacttggcagctggaatttctatttctacttttaacaattcaacatttcctgccactagaatttgtatataaatgaatgggtaatctgcttcaggggttttcatcctgggtgaagatggtcccttaaaattttgcttgcctggaaacccttttgtatgaggcctaaactccttagcactgtaatttaggccacttcaatccactcttaggataaatacccatcctgatttgcccagaattatcccagttttgcactgaaagtctggcatcctaggaattcctcagttctgggcaaactgggacagttggtcaccctacaggccattttgtttctttctaataacatcactgtgaagataaattctcctcaccccaccctgatacttggcaaagttaggtttcaagctcttcccatgtgctctggctcaagtcagaaaaaaataaaacctcaacagcttctgttctgcagaaagaggtttacagatttcaatatgctagccaaaaagaaaaaaattattctcagcttgattcttttgccagcttgataggcatcggcagagatgggtggtttccaacagcgtttttcgcccctgagctggttttgagcctcgcagctctgccacttgacggcatccaggtttccagacgctggcagggatgctacagtctgtcaccatcaggcctgctttgagtttttctgttctgacagctagacaagatgtcatttgaagggtgtttagtacttgggtggttgttttcagggtgggtgagccccagagtagatttgattcaggaaacattaaatgttggaggctggtctgtatcctacttgaagagtcagattaaagggttgtataaaattaggcactttttattctgcaattaaataagttcactgcccttttgctaaaaatggataatggacaactgaatggcagcttgttggaaaatggtgaaacccagagtggctaaagctgatacagcatttgcttcaccaccgtctttttacaagatattatgaagtgactaaggagagtatattcaactttcagaaaatacttctgagtgaactctttgcctgaatgtccttctactctgcagcctagtagcccgatagtaaagaatgatttgctgaaaagcccgattttccctttcttcatcactctcttccctcctttagctctcaaaaagtcctgggtctcagaccaaaggttgttctagaaacaacttgctcttggagaaatgtaccaaaggaaaatggagtgcaaaagcaaaaaaagtctatttctagggagaccaaattaggaagaaatgagaacatgagatatgagtagaaagaaaggaagggaaataaggacctttctagaggcagggatggttcatgtggtaggcagtcattaggtgccagggaatatagttgaagatgtgctgggataggcttcttgtttcatatattcacactggcacaggaaccgcatcagaacttgtactatttcttcttttagatgaagttgggtcctcctcagaaaacttccattctgtgaaaactcccttggaatggattcctcagagaggttttgttcttctggcaggagaaggagggcacctgaaggggtaggggcacctggaaggtgaaaaagcatgggaaggagggtaaaggcaatgaatatcattttttctacttcagtacctttccaacagctggccccatgggaaggaaaagaaaacaagaaagagtaagaataaaattgtttggattggacttttctcctaaccaacctcctcatgaatttaatctcagtaagatttgtgcaagtagagtttgccttaatgtcatttatttctttaagactttggcttttcctgccaatgccaaagtgccagtcagagtacctttagggctttctaaatctggggctttgagggagacatccgtgtttgagaaacatgtgccctaaggaagctcagagatgaggatgatgataaaagtgctactttgggaatcttgtctgctccaataagccacatcactcacagtctccatggcccccactccttgtttctaaaatgcctggttgtttagtgccttctagatctttaagtctattagcttagaaagaagcttatcagagaagaaaccagtctgtgttctgctttagacaaaaggaggatcttgttggatggaagaaaaaaaaaaaagcatccaagttaaagatatacatattgcctacaataaaaataattattttaatatgcttttcaaaaaagcatatttaaaacattatttcaaaattaaataaaatgtcagatatggcacagttacctaatttagaagaaacaaaagcaaaataaattatactaagagaaacttttgtagaataatattttaagtaaaaccagaaaaggaagtttaatttaggtaataactttataaatgaacacagcaaaatacattcttgacatttttctgaatgttagactctttcagaagtttattcattctcataagcagtgatttccctgtgattagctcattaagtatatctataaattaaagtgagcactttctattttgtgtatttgttgtattctgcagattggatttcaatttttttaatgtagtttttctgattataaatcatgaaagatttaatcacctctttaggtcaaagaaattgtatggctcttcttatcgccctcaagcttctaagcaatgggtatttcaaataattcaatcatgattgttactggtggaaggtatccaagttaccagcagtgaatccatacaggtctctagcagtctcaattcttgcctcctcagaagaaataatttgacaaaggggcataaggcagaaaaagagaccgaggcaaactttagagtaggagtggagttttattttaaaaggctttagaacagaaaagaaaagatactcttggaagagacccaagtgagtaacttgaagaacaagtgtggtgtttaaccgtgatcctaggactttatacgctggccccttttccatgattcttcctttagggtgggatgccttcatgcgcagtgccctccttgccattgacaggtgagcacacacagtgtgtttaggaagttgcacaaatgcccatctgaggctttcttcccttttccagtggtgtgcccttggaaggtcgttctctgccattatgtctcttaatgcacatgacagggaagttgcatctctctggcatctgcattcaattgacacttcagtgcaacaggtgtggaccatcaggaaatgacctctccctggtactggctgccaatttatcacttttagagaggcaatgtgataattgccaaaccatcacccgacattcctactgggtggggaaagagccctttcctgccctgctcatgcctgtctaactacctgtaacatgattatcaatataagtgtaaaattaggtcaaatttacttattagacacagggcattgtttaaagtcacctcacctcatctctgaggaaatctaccaatttctttaccaaactggggccagatgctcaaaggttcccttacctgataatggtgaccaccaacagtcttggagcaaatgggagaggtcccaaaggaaagatgaatctttgagaaccaaagccagggctgcaaggcccagcttccctttcatgtcagctccttatcctttgctgatcctggaggatctgaacctgattcattcattcttgcttgcttgctttctcttgcttgcttgctttctctctctcttttttttttttttttttttgcctgtatgctactctacaatctctgtagacttacaaaattttcctcttcaaattgaaaagtactatgcattctagaaggttggctgggtcagggcagatgtggccagggtgattgacacagggatgaagtcccaggattcaaaagggtgtggagcggggtgactgctgaagcagccccgggccagaaaaaacaaagaatgaccacctttgtgctgtagggattgcccgaggccaagccagggagctgaatgttgtgatctaaccttagggaatgagtacagagctggacagagagacaagcccaaaggttagaattggcctagggatagaatagagatcaagagcaaacagaaagtgatgcaggggatttaatggggtttcatgttctcagataaaaatgcacagtcctatcttttaatccagtggcatttcccattatttagtataattttaaaacatttttgttggctgcatatattccattatagctgtagtgtaatgtctttagccatttccttattgttcagttacagtgattgattttcaagattgattctcatttttaatacattcaaaaattaaaatggaaaggacaattactagacagatctgtattcaccagtgtaagtagaaaaatatagatttttcattgttaacaatataaacatacttaacaagcaggggcaatcttgcagccattagggtgaatcagtgttttagaccaagcaactctgaatgctgaaaatggtgtgaatgagcgggcactcttggagatgtgtgcaggatatggacttatttttttaaaatccaaaccattatagaagaaaagagtcagagatttttcttagaagaataaagttaagactaaattaaatggtaaagaaaattcaccgcgtatttgttattgtacttttaaaaattcttctctaagttcaggttccatttgttaatttaaaaaacatatcgctgctatttatactgggtttcatttctgtagaaaagacataaatgtcttatggtcaaggtgtcactctgttatctatgcttggaaaaagtctggtcaatttgttcatgaagaccaagggaggcatcacggatcacctggcaactgttaattgaaatatgtatgatatggtaaccagtgccagaaccctgcagacccagcaaaaatcaaaggaagtagaaccttgtatctggagctaatcctataaaaaatttgcttctgaaataggattggagtgaggtctttaaacaggaaccaggattgaaattaggttcagagttcctggaaggttgatgaaggctctgagctgggactgtgagagccccttcaaggagcaaagagcctcacagagcaaagagtctcgcagagcaaaaagcagtatagcaaggacagtgtttcttctcccagtctggtccttagacatcctaataatattctaacaccacgtttcccaacactctgtgaccttgagctgattctcttcagtctgtcttcttgggaagttctggtgtgagcccaaccaagactgcatccctgtgatacaagtgtgagttacatcatagtctatttcttgctaaggccaaagtagaggaagtcgaggtaaatttgcaaatgctatttgagccagtggccatggaaataattatgctcacattcttcacaacagaaaacgcaagagcatgcctcacatgcctcacatcctgtgggcagctccactcacagttcaaactctctgcagcatctgttcaccagctgcacagcaaatctcttgagaagcccacaacagttgagggcttagtatccaagctctttgcacaccaacctccagctttgacaagtctgtcctttcacgtcaggggcatttaatgattaaagaatctcagctctcctagtcttagggagttggaagtattggcagataagagagactgggctgtgatggtgcaggtgttttggtaagttccctcccaccagatgtttcactgaagcctccagttccacagccacatgtctagtaagtcaattctgaaggtatatgatctgacatcacagcaaagtagtggggtccggtggcactgcagcctctcatgacaagcgaggtctttgtaaattttccctgtgtcctcctcacttggctcagagaattcccctgtcctctcccttgcctggtcagaaacaaatgcagccagcccaggccagttgcagctgcagtgaaaggcacagtccaattctctttaagtttttctctctgaagagcttcctggtgacaacagcaccagaagctcctcgccttgccatgaccttggctccttttgcctccttggctgtcctactctcaccccagcaagaagtcaattagaggaacaagcaagtctgaatctcccaactgctcttcctaaactagctcctgccactactgcattcttatgaccatatgcctgccaccccagatcccatgtacaggaagagatctgtttatggcagtgattctccaagtgtgtcctggctgcagcatccatatcatctgggaacctgtgagaaaggcaaattgtcagacctccgcccggatctactgaatcagaaatactgggattgatgcccagcattctgtgtttaacaggcctgccaggtgatttagatacatgccaaggtttgataatttgcatttcgaacagttttctcagataatgctggtgctgttgatctgagtaccatgtagtgagaaccacttatgcacttggggaaatggttattctatactagtggttggcaaactatagccacttgtccaaatacagtctaccacttgtttttgtaaataaagctttattggaatatagccacacccattaatttacatattgtctatggctttcttgctataatggcaaagttaaatagttgtgacagagaccatatgtcttgcaaagctgaaaatatttatgaaaaaggggtgtcgatctctgcttacacagacatatcatttttggacaaactacataccatcttgccaaatggagtttaggcaaagacaacaataataacacaagggggaactgggcacttgcatattttttatgtctggaaatgaaagggctttcttcaaacctatgaaagcagctctagctgagatcagaaggctctggtagagactgttactagcagtgtgcctcccacccaccccaggtctgagggatagaccagaggaagaatttgcaggttcacaggaatggagaggcaggaatgcctgggtgtcggttgtgtagagaagaggctaatttttggtagtctaagcattccttgacttagaaaaaaaaaccctacttttttttatggcaacatactcatgactttttcagatcaacatgtctgtaaaatgaaaggttgtatatcaaaggcatatttgattagtttagagtcttaaaaaaaggagggaaagtgtttgaactcttttccttggcagctaagaaactccacttttctttgtggttggtttccttccttccttccttccctccctccctctctccttccttccttcctctctctttctttcttcttgagacggagtctcgctctgttgcccaggctggagtgcagtggcatgatctcggctcacttcaagctctgcctcctgggttcacgccattctcctgcctcagcctcccgagtagctgggactacaggcgcctgctaccatgcccggctaatttttttttgtatttttagtagagatggagtttcaccgtgttagccaggatggtctcgatctcctgacctcatgatccacctgcctcggcctcccaaagtgctgggattacaagtgtgagccacagcgcccggcctttgtggattctttttacagtgattgaatacactttccccactcttcccagttgcgagtgttcccagaacaagagcagtctgtaaatgtctaaagctggggagtgtcattaagtcagaactccagtttagacgtatggttcagtttctgatacttatctggcagggagcaggacagggatatgctccaggggaggggtatttaagatatacagataatgggaatagccattctgggatagcagtccctgaaggtcaacaatgtaatgtggcagagtggcaagaaagtttctggaatttgaatacccaggttgaaatttcagccctgtcattttctactggagtggccttgggcaagttacttaactttaaccctctgaacctgtttcctcgtctataaaataaggataattatatctacatccgagattaactaaaacttgataaattcctaacatggtataagggtacttaatcaatattttcatttgccccactggcccattgttaaaaattttccttttgtttatggtcctttcattttgttattttagaaaatttagcagaactcagaaaagagtgactctttggcaacaaattgtgctgctttaagagagctaaaataacttccctaaatttcaggaaagtgcttcatttatttatctccactgaggagctgtctttgaaattgcttcttcctgggtttaatacctctacaaaatgtgggagggagaattgtgggccagaggacaaggattccaagcatagcctattacctatggggaaaataaaacgaagtagaaagatgattctaacagaacggggttccagacctgcttgagacattgaccaggcaaacatttttacttcacatctccctgaaagtagagcaatcccaactgtatttacctgtttcaaaaagtcatgtgacttagatggcacagaggaggggcagagtgatggcacatgggagaaaaagagatcatcattattaactagtatttcagcctctgtagtttgcagatgcccaaaaacttatggatcattaaaagaagaaatgttttgatctccagaaacaaaaataggtaagaaatacatcgattagcttggagaagagaaccgaagtgttcttggtataaagcatgatttctcattcgggccccactcacagacacctcctcagagaggacttccaatccaccatctgaggtctctccttctctccagccattctcctacccctactcctgcccctgccaccaaccactgtaacatcatttgaaattctatggtgtatgtttctgattacttgtttattgtcagtctctctacccagtaggaaaaacacctttcccttattcactgctgtatcctcaggggttacagcagtatctgacaggcactcaacaagtatttgatgaaggaatgaataaattattcctcccaaaatactttttaaaatctggctagaatttgtgtcctattgtaaaaggtagatttcaagccaaactgactcagtagtctctcatttcagaaaaactctctcctatttctgggctcaagtttatcactcacttactaatttctgatgcttatgctttctactcctagccttactgtactggttcagtcaatacaacattgaatataatgataataatagccttctttttcttgttcccaatctcaaagagaaagcttttaacacttcaccatcaagtataatatgtggtgtacaatttttgaaatatccttatcagattagggaaaatcccttctattcttagtttaccaagatgttttttgtgatgtatgaatgttaatataagcaaataattttgtggcaactattggaatgatcaaaggacattttttccccttatattatctaactttaaaccatccttacgttcctgatgtaaatccaactgggttatgaaatatccttttcacattttgctgaacttaatttgctaatattttgctttgaattttggcatctatgctcattagtgagattggtcagtaactttactttctcatagtttctttgtctagtattaatatcaaggttatgttgacctcataagataaagtggaagttttccctgtttttctattttctgggagtttgtgtgggatggctgttatttttctctccagtatttgttagaatttactaccaaagccatttaggcctggaattttcctgtgcttctgtcagaggtttgggaagcagcagatcacattggagttggaggatcaccccctctaagaggggctccagaacagacttgcgccaggcaggatggtgggaacttgtctcccaaggagactgccttaaaggagatggcactcatccagatgaacatggctgaacttatttgtaaggaggcattacttgatgatctccttggagtttttaccccttacgtatgtctattcttcagagcaaacacatcccactcatctcacttctgcaccttctctagccacaccctctcttcaggatgccctccttctcccccagttgctgctgaaatgccacctgactgccaggtctcacttcttctgtatacccttctcttactaatccaacccctagcaatgatatgcacccctcagctttttattcattcctgtgctgcttcttataatgattatatcaagtcaagatttctgtctgacaacctatagggcaggctttttcaacgtgagagtcctgcttcctatgctactattcttgcatggcacatcagtgaacacatactctgtgttaataaatgcttataaattaaataatatcagccagtatatgacagattaagtggcaaggtattacttcttcctccattccctctttctagggagggttgaagacaggatgttcaaaataaaatagctaaatctagttaaggaatatgtgattaatctattcatctgcacaaattggaacctgtcttaaattgccaagctgaaaatggttaccacagcagcaccaggaagaagatgctaaagataaaagcctttttaaaatatctttaataagtttcctttggcagctgagagaaataccatgggttagggagagaccacaaatgcaggaattagatgacctgtgttggggacctgactctgtccttccatttcttctctacaaagtcacttaactattggagtgttaattaaacaccattaaatgagaacaatatgtaccctgcccactttaaatgagaataatgaatataatgggttcaaatgagacagtgctatacaaatgcacagttgtcttacagagacaggatttggcttatgctggagaagagaaacctggaaatacaaactccatttgtattagcttcaccatctcccctagaatatcctagaatggagctcagcagtactgagggaactggcataagtcaagtgttgattctgccatgttctaaaaatgggcccacaagagtgaagtctattttcaaaggtagggaccagaagtggtgggggaagttgggctaagatagaaatgaaaagccttggaggtgtttcagcctgacagctatcacacaatgttgactctgggcagaggagaggtgaacaaggacctcttcctcagctgacttgtgcaagggaggcagctgccaccacaaccatttgtcaactccccatcacaattgaacatagtgaagacaagctctgtggggataaaagaaaaaaaaaagaatgtttgaggccagatcacctacagaagttcaacacgtttgtcccatatagatgacgttaagctgttctgccttcatgttaccctcagcacatgtccccaggcacagttgctgcatttatcctagtaactgccgattaatttccagtctttgcatatttttgtttaccagctttattcttctctcttcaactctgagaaagaatgtaccaggagttcttgctccagtgttcaatgcaaacttggaaatggtccaggatataaatgaatgtaatgattaatgtgtcaatcatctagtgttattgaaagcagctcattgcaaacgtggaaatattcttaaataaccagagatgatgatttgtgaacttctaaaatgcaggctcttcttagtattgtgcattctatttcatataaccttcagacatgaagtagagcttccctaaattaattttcttaagtttctttggtcaaactattgaactaatagacctgtgctctttaatcccaagagtgttgtgatcgtttttccagacaagtgctcaccatacatagtacaattttcattgatcaaaacaaatggcttgttcttcttcttgtgtacttaatcaataaattttcagctgtgttgtaacgtgcagtctcaaaatcagacattgttagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaaccagggaggcggagcttgcagtgagccgagatcccgccactgcactccagcctgggcgacagagcgagactccgtctcaaaaaaaaaaaaaaaaaaaaaaaaaaaaaaaaaaaaaaaaatcagacattgttatttgtgaaggccattggttccaacgtactgttttcaaaaggaagctagtgctgcaaattttattgttttatttatttattttttcctcctaagggaacaatggattctggatttatagtgaacatttccaaagcagaatgcttcattctgggtagctcgctctctttggatttaaatatgtattctgaaaatggtatgtggagaacatctaaagaccagccataaagggacagatttatgactgtgaagagacagattcctccagtgcacgggaaaagcagccaccttccttactatttcatacgttgttaccgtgtgtagaaaatacctactcagtcctgcccaagattggtgcttctaaaagatagtgagaccaaactaaattattacttcaaagaagtgtagaagtcgaaacaatttactggtgactggtaataagaacgttaaacaatacagtgaccccaaaaggttcttgtaaaaccatctggctgtgtaaaccttgttttagctgactctgaaaggcttaagaacactcctgtttggacaggacttatttgtttttcttctctgaggtcacctttgatcatcctaatgggttgactggccccagatgatttttttatgcatagctagcactaaccttgctatttgaaggtaggtagagctagctcagataaatgttttaacatatagactatgcaagttctaaaaagaaaatagaaacaacattttgtttccatttttaatttaaaaactataaagttaaaatgcaaaatattaatatccaacagggcagccactttcatccttctatacttaaaacacatcttttcaatcagtacgagtcatttcttaccaagttctgcttatatgtggcctcacttaccaaagagctcaatcatgacacatcattataagtcaaccagataaatcattcaataattcaacttattcctctctgcctccagtgactccatcctcttccaccaattactggacccaaagaacatcgtagagggcttaaatctttctgacaaatacactgtttaataaagcctgttgctcctactgcctcaaattttctgggttagctttatctgcctgggtatatatttggcagcaatattcatttttcaacatttccaatgacaattaattattctaaaactgggggtggaccacagtcatggaatcactcaagaagttatacaagccatgctggggaaacctgagtttcatgaggattttgttctagtggctctggcattcacataaccagttacttcagttcagatgcgtttcttcttaattaggacaggcgatgtaatgacacaatcaaacacatatggtaagaatcataaaacatttgggcttgctgctggctcctgctctggtatttacgattgatgtgtacatgtaaaaatattggactgaggagtagtaattgccgctgttccttgaagcaagagaacacacttggctaccagaaactgcacagggtaatcagagcaaggcctccttctataaagtatttgagaacttcatgacatcatgagtaaggcagagttatgtaaaatccccacttcaaaactcactagctaagagactttgaatcagccactgaacttctctatgattcagtgttctcctctaaaaaatgggggagacagcaacttacatgtgttgcttattgggagtaaatggggtaatatatgtaaagaaattggcccaagttctctgtagaaagagcattactgtgagtacctggatacctaccatgcagatttgaatctctttattttgcaaatgtctgaaccgtctgcacatttagtatatactaactggaagaaagacctcaggaatggctcatgtgggaaattaagctgtctttctgaagaaatggaattattgaagttttcaatgcctttctcctatgctatgtgacagtgctccctgcctcctgggaaactataacagtttggctcacagtctatgtgaagatgcatatgtttccttccctttttttttcatagagacattaaaaattactttactttggtgtattaagaatcctgcccacacaagaattacaacctcagcccccagggacccatccttttacagggtaaatggagcttctttgttccttatatccattctactcattctttttgccacatctgtcatgatcattgagaaccattaccacactcattgtgtgtgtatatctggggaaaaacaactaataattgattgtttacataaatatatttattcagctccctaattagaatgtaagctctttggaaataagagctttagtgtatggatggtttgtactatagtagatattttccaattgctttcattgtgtgccttaatcaggaaaaccaggcacctccaatgaacaaatatttattttaaaaatatatacatgtaccactatgctcatattacagtaactataaagttcatgtcctttgcagggacatgggtgaggctggaaaccattatcctcagcaaactcacacagaaacagagaaccaaacaccacatgttctcactcataagtgagagttaaacaatgagaacacatggacacaaggaggggaataacacacactggggcctgtcggggtggtgggaaaaggggagggaaagcactaggacaaatacctaatgcatgcagagcttaaaacctagatgatagggggccaggcgcggtggctcacgcctgtaatcccagcactttgggaggccgaggcgggtggatcacgagctcaggagatcgaaaccatcctggctaacatggcgaaacccggtctctactaaaaattcaaaaaattagccgggcgaggtggcgggtgcctgtattcccagctactcgggaggctgaggcaggagaatggcatgaaccccggggggcggagcctgcagtgagccgagatcacgccactgcactccaacctgggcgacagcgagactccgtctcaaaaaaaaaaaaaaaaaacctagatgatagggttgataggtgcagcaaaccaccatcaatgtatacctatgtaacagtgtatacctatgtaacaaacctacatgttcagcacatgtatcccagaacttaaagttatatatatatatatatttactaattaaaaaaataaagtagaaatttttaaaagaagggattagagatgcaaacatgagtgctccaaatattttcttcccacaccatagtgggttgtctcctggagcatatccatcctattttggagatggttgtcccctagcactgaggaacaggccaatctgtttcaggactgagcagccacactaaccacccagttgtgttctgccatgattggccacccagatgtgttctctcattgcttttttttctcccatcaatctcctacccaccaagctctctctctttaatacctccctcttccattcacattgccttagcaggtgtttggggcaacatttgggcattttttacttagcttacactcatgattattttattggatataaaagatacaccagcagccttcattttcccctcatcctaataaatacaagaatctcccaggggttgcttattcccaaggagcctgcaatctgtctggtgtttcagtcgtgttaggtgtgctgtatggaaaggccacccacaaaaattgtggaaaacgttctttctagaaaaaataaaaacagtttgtcattccaggatgcagatggtagtgtcgtaaagaggtgttgggtggggtatgtgtgacatcaagtctgggccatttgtgggtttccagtgagcccatacaatagctttctcaccgaatatgtgctaggaatccctaagacagggtgttctctttagagagtttttagtcttcttaaatatgaactggggaaactaaattacaatgcaagcagctggcattgacaggacatggcaaagttattcagaggaaggtctgtgtgtccagcctgagtcttgacaacacggcctatgagatcagagctgcccggaagagacaaccaaattgcttagagatggaaactcatactgaacagggtactgaacacacccttctaatgctgctggaagccattcttgatgaactgaatctgctttgaaagggtagaccacaaaataaaacttcagaggtgggcaggttttatcactagaatttccatcattaaaagcagaaaaatagaaatcattccattgtaaaatagcttgcaatcatccacttcagaagcagtataaaattaccgcaccaccttctccaccataactcttcctttggacttttgactaccaccatctagttcagttaccagcattcttggttattctgcacaccccactgaggtcataccacaccctcacacgccttccatataagggggtcctctttatggtggccacggttctaaacacctgagagttgagatgaatccacaattagttttccatgtgatttccaaatgtgagcctttcatttgttttcaacacttcctaggggggaaagtaagatatctgtcagtgatatagaaagcagaagaaaagattacaaaagtttgatgttaatgctttaaaatgtctaaattgcctgagggtatttccgggagtggtattccttaatttgctaagtgcacaggcaatgtgtttggagcctgtaaaaccctgcagcctgcaaagataaccaccactgtgcctcaggttccttagagagaaaaagcccttgtcaatcgaaggcagctgctctagtttagactctgatacttttttctttagatgactgaaattgcctcctaattgatctcccttcttccaatcacagcctcctccaatccatcctccacactgctgtcagtatctttctgaaatgcaaatcggatgttactttatccttgcttaaattttctgatagttttccatcacctacagattacatttcaaattaaacaggataattcaagcccttatcactctagttctaatagatttttctagctttgtttcaggatcccaagctctactctgacccactggttcatctgtacaatggtccctgcaatgtatatacaatgcactttcttgtttagatttggctgtctattcaaatttacttctgacgttgtccccactttttcacctagtgaacaccttctctccactcaggtcttagctcaaatcctttcttcctgggaagcctctttcaaataccatcaagcagagtttctcactcacttctctgctcccatcctaccccctacttagctctgttatgtactcaccatgtcatagaatgatgtttatttacttgtcctccctgcctctatacccttagaaccagacacagtgatgcccaaaggctactcaataaatcatccatgactgactgcacagaagagaacttattgaacttttaggtttcctaatgagaaaatctccttcttggggggtttatataattcttgtttgcaggtggcccaatcctcaggaatcttgacatgggggatctcagacctagtcaccacttctttataaacatctttaatcaaattatggatttttggtaaataaacagcctcaaactgaagtagaatgtaaacagaaacaagtgtccttcattgctaactcttcttctctccacatatattgggccctttatacatacgtgtatgtgcaaacttgcaagtcccggatgaaccagctgcaagctgggtttcaccagcaattctgcatctgatcctctatgattgaaccagtccttgacattgaaagtgtacatcatgaatcactgaattgagtcttaattataggattttttcctttctatttttatagagaggcagtgaaattcaagttaagaatgtctcagctaatagatgcttcttggtgttgaaatgtggctgttctggcccctcgatgtccaagttcattcatgtagtccatggaaaagccaaaatgagggtctgagtctagatttccattctctttgtctaacaattagaactcaatttccttccagttaatggttcgctgcaccaacgctacagccacccaatgaaatctgccttttctcttttttcagaacagcaacaaaggcctgcagccaactttccaaagaactttgtccaaaatgagccaaattaaatttaaagatcattctagaatatgttcttctctacatttgtaaaagaatgattgcctggcaaggcagcattaagagaaaaggtcaaattctctccaaagatttccaacttttttttttttttacactagtagtgtttggagaagcaaattgtggtttgacttttttaaaaaaacaagaaagagaaaagaaaagaaaaagtgttacagggcggggaacatttcacactgggtcctgtcggggactggggagctgggggagggatagcattaagagaagtacctaatgtaaatgatgagttggtgggtgcagcaaaccaatatggcacatgtatacctatgtaacaaacctccacattgtgcatatgtaccctagaacttaaagtataatttaaaaaaaaaaagagagaaaagaaaagaaaaagtgttgtgggtgggaacatattaagaaatgcaacaatcttagcgtttcataatccttcgagaccttaaatactatcagaatctagtatctctaaatatagaaacagtatatttacaagttagtctaaagaatgtatttttctgttcacttagagaaagaaatgggtctattcccaaccttcacataagctgtctttgtaaacatatacttttggcctaccagtgttttcatcgaaaatgtcttagggaattttaatgtaattatcatcaaactgcccagagctaaataaataggttctcaataactgaatctacattcctccaacacctgctattttaatgataaatctagaggtttcctttctccctttgcagaacagataagacaatgatatgtgattattcaaaatgtgttttgtttatctgataaagattgggatgctgggatttccttatctgagtaagatcaatagagactacagtccatattagcttacctctggcagtggcctatgtaaaatgccatgaaggaaggctaaatccttataatatatgagaccagcttgtaattataccacaaggaaactaatcactgttgaaggctcagtagtcaacaaagattattctctaaattcctttgttagttttttcctccccctattatggtaactataactatgaatattatttcaggaaatgttttaatattttggtagaattctactaaaatagtctagagttttattgtccattttatgatttgaagcttcattcaacaaacatttgttgaggatttacctgcccctgaccctatgccgagctctgaagatataaatacagatgggataacatttacctctactacttagatatggggaaaaaatctatttcttgctgatggcgggtgagaaaccacttaaaatatttcattcaaagctaattccatctcttctgatttaaaaggtgaaactctctatcaggagcctctcttttctttttcccaaaatggtgtgaggaagtaggagaaagtgtaggaaacttccaggctgccagagtgaagcctggtcaccatgccatgttgcccttctggtcaagccatgctaatggggagcttccatccagggcttggaattattctgggcatccaaggacctgaggaacaagcactaagtctgagattcccacagaattctctggttatttctattctttctttaccctctggagagttttaaccatagtgggcaggtaaggggaaggggtgagcccagacaattacttctgacttatttttatcttctttcctgcagaagagagttctattttccttctgatataaggctcaatgacacatagctattaattagacttgatgagggtgaccatataatttattatccaaaatgggaggctttttaaaacaaaaaggggagctgggcatggtggctcacacctgtaattccagcattttgggaggccgaggtgggcagatcatgaggtcaggagttcaagaccagcctgagcaacatggtgaaacccggtctttactaaaaataaaaaatattagctgggcgtagtggtgcacgtctgtaatcccagctactcaggaggctgaggcaggagaatcgcttgaaccctggagatggaggttgcagtgagctgagatcacgccattgcactccagcctgggtgacagagaaagactctgcctaaaaaaaaaaaaacaaagggaggtggtcccatgcataattgtgtaccaaacaacaggtgtgattagagcctgacctgggttaaccaaggtgcatggcctccagttagatgggaccaaaattcacctaccttacttctagatttaggattctttgctttatattataatggctcttcctaaatacaatgcatagttgatgtagcaagagatttcccctgtaaaaacgtgtatattggagtttaaagacaagtttaaagtgaaattacttcctagtacctttttttggcctgaatttgagtgaaggtctcaaagcacaatgactgcataataattttctttttcacaaaacatttgtctccacttctattaaaaatatttcttagtctgttcttagtctgtttttttttctttactgcataactgagtatgcagttatgcttcaaccgagttcttaacagtgtgaataacttgattttactacaaagtctgtccatcagtccgtggaactgaaggctattgttccccttgacagcatacaaatgatggattgtctgtgcccacttgtttcagcttatgcagcagcttctgaacgattaatcccaatagttattatcatggtagtaactaatgtaggtaaagaatctaaagctctgcaaaccttttcacatgctttatctcacaagtactttttgtcagataaataggttaaggcaagcattaaatgtatgcacattttatacacgaagacaccagggcttggggaagttaagcaactatcccagcatcccagtgcatcctggtacgtcccggtgcaagtgacaggtgaagtccagccctaaagtcagaggtccttgctgctgattccagcctcccactactatacttccctttctccagttttacttaaaatctttttttgggagtaggaaggaaggagcagagggagagtggccagaaattacttcatgcaaaacaatttgatggctttgatgctgcatgtatctgttttgggaaaatgaaaagaaaggaaggtatcagccgtaaaagagatgtacttaagattcaggagcaaagctcaagagagctcagttataaactttagacaagcctagaaggctcagcacctagtaatgaatggcaagttaacattgctagatggtgataaactcctctaactgagacttaacttaaaaatatggcagaagaaatatgaaccctgctgaggttagaagctccctctacctgtaaaaagcaggcccagtgaggggctcctgctgagccatgcaatcagtcttggacaagagccttttatccatttgtccaaaccctgagaagtcacggtcccatcttaggctcagcctaggcaagatgaagccaccccaaaatatgtcttctatgccttcccacctcctgctctccagtcttcctgattgttactgcaggggccagagccctcagactgccagcccagccctctgtgtccatcttcacaagggttcgtcttacccataaagtggtcctgccctgtctcatcccattgcatttgtgtagttgaccttagcaactaagaggaggtggttctattttctcagtacagtaactttctttttctcatcacaaaagcaatatgtgatcagaaaaaaagtttagaaaacataagtatgtaaaaactaaaaatcaaccactattttaccacctagatggacaaccattatttatatttttagtgactatttttaggcttttttatctacgcatttttaaagatcatactaaaaccaaatttttatcttgctttttttcatttaacatggtaatgcaagcattttcttgttttaataaaatactcttttaaacgtaatttcaaatagttacataataacacatcctattgataaaacaatttgagtctcctattactgaagagttttcttccttccaaccttataaataactactatgatccatatttttgtacataaacctaatttcacatttctgaagttttcttttagattgattattaaaagtagaattatcaggtcttgacttggagctcttgattcaatatatggaagaaaagaacagtttttttgtaagcccattagtatcttggtgagagttatgggacagtgtatagcacagagtagatacaccataaatgttgtaaaaatgaataggcttaattctattaggagtatctgcattttaaaagatgaaatttgttagcaaatgcatcttacattggtataaattcagagagcaatatttataaaattgaagaaataaaagttatagtgaatacaagactgtagaggagaatggggcttctaatgagcattacctcaatctgcattgtgaaaaccatagcctatcatggtcaaagtaaatgcagctcttatgacattccccagctccttggtcagtcagtctgcatggcctggcatcacactagggactggaatctatcctcaagaagcacgcaagcttgtgggagagacagatttgcagacaacacacaaagaaccatgagaagggcagaactgagaggtctgagcacagcagtggaagaagtcaccagctcttcctggggaagcccccttggaaagggggattttggagctggatcttgaataagaacatgtgagaaaagcactccaagcagatgcaaatgcaaagacacattcttcctaatccagagaatcctagtgatgggatgctaatctcccctttctttccccaccccagtcagcaccttgtcatgttggtcacttaacattttagtgagaattggttactctgactttcctcagagcagaatttgatgaagagaaaagagatagaacctgagaactggaggtacttgggatcaaaggggcaggagagaataccattaaaaaggaaaggggtacagacgggaagtagagagcctaagacaagaccactgaactattccatagggaaagggagattaggcacatagagctgtacaacaaggtgatgcctaggttccaaataccaaaaccctcaccagtatgggagtgtgacctggccccaagtgaaggttacctaacctaatccacagagtatcagtgttcttctaaaagtcctccagcaaaggttaatccactctctgttatacaattctattttattcactcttcacatagagtctgtagcagcttttggatcttttctgtctactctgtcgtgattgagaggggttaagctggttgctagcaacctggctcctatctctctctctctaatctcatctggtcctgctctctcctcacataccaaactccagcagactcacctgctttctgctcatcaaccttgtccctacctcagggtcatgttatctctgcttgaaattctcttccccaaggtatttccaaggctggttctgtcccttcctccaggtccccgctcaaatgcatctcctctgtgaagctgtttctggccaccttttctttgcctttctcctgcatttaagttttcatagcacctatcattcattgaagttatttctgtgtttacttgtttatcatgggtcttccccactaggatgtaagcctcatgagtcaggaacttggcctgttttgttcactgctataaccctagcacctagaacagtgctcaataaatatgaattgcatgaatgaataatcaacctttgagatatggtcttttaaagtttatgtccttagctccttgctcatagcagctccagtgtgttcattgaattgaattgtgctgaaagtcactattgattcagcctttttaggcaacgttacctcagttcttccaagcgttcctttccattccccttctcaaacacttaaccccacaccccacaagctgtgaacatgatctcttccagccacattgctcttcctatctgcaatcagcagagcacacagagcacacaaataacttcattttctcctcttttcaaaactgcaaaacaggatgaaataagttctgataaattttgaaccaatgtgagttgttaatttccttctgctctattttcttaccccgttgtttctggctgagggctgatggggaaaggactgagatgagtgacagttcaccaactcccactactgccatggcatcaatcacagagagattgtggaaggtgacgggggagggggtgcagtggcgggcggtggtggcgggacacggaagaagcagggaggcgctgggagggggtgtgcatgaactagctcaggcagcagaaacttttatttttctccttctctaggcctccaaaaatggccgaactcagcagggaccctatcccacgtctcagggcccttctaggcctacttgtttctctagggaatagctaagaatcgggtcacttcagatgcacggatcatgtgaaggcagcaaggggcagaggaagaccacacacttcaacatcacaccatactccttgccatctctgcaacctgctggatgtgcgggaccctggcgcattacctaacctctcgcagcctctgtctctcttgtggataaaatgggaacaagagtgcctactcagaatggttgcctgtgcttctgtgtatgaatggtgtataaaagcacctagagggccgggcgcagtggctcatgcctgtaatcccagcactttgggaggccaaggtgggtggatcacttgaggtcaagagttcgagaccagcctggccaacatggcaaaaccccttctcagctaaaaatacaaaaattagccgggtgtggtggggcacacctgtaatcccagctactcaggaggctgaggcaggagaatcacttgaacctgggagacagagattgcagtgagccaagatggtgccactgcactgcagcctgggtgacagagtgagactccatctccataaaaaaaaaaataaaataaaataaataacctgagttcaggtataggcaaaataaagtatgtgtttatgttcacccattaagtgaaaaagaaaaaatatattatgattggttgtacttttccatttcaaaagtcagagacatgcttatagatgctaacattctaattaatggattcaaagtagatacaaagctttactcagttgttcagtttggcattatactgtccaaaaattaggcgtaattggagttgtgactccaattgtcaacataaccagccacagtgtaggaagcacctactttacataatgattttcactctcattatatgttgatactaaagttgaaaattgacttctttagggctgtgccaaagaattctcagagcaccagctactctgccatcaatattgggctctagcctatgaaattctgtcatctaaatcttgcttagaaccagtcaagtcattcaactcgaataaagtatcagtagtgattttaaccaactggaattaattactttaattttctgggatggattaattcacaaatgcataaagtaaggttatttcataggattctatagttgccatgcagtgattaattaaaaatgcctgaagtcaattaaaaaactatttgcagtagtaaaaattcaccctggcccaaggaggggtagctttgatttcattttcaagagaatttcaatcaggttttatcttaaggccctaatgaatatattcatctggtgccttgctgtatcatgagaggacaatcttttcacctttcctccctttcatgtgtttatgggaaggagctttccttttatatcaaataaaatcaggattggcaccaagggacttctgcatttagaagggcaattctcactgctggttgcaggtatttcctagtcactatgagaaggcacaatgcctggcgctctagttagacaccacttcactgctggtcactgcacaatgagatatatacagtaccttcacttctgagacacaacaaactaaaaaatgaagaataataaaaagatcaaagtagaggttcgagaataaagataaactaaaaccagaactctagcctgaccaagcattagtcatttataacagggctcaaagtagtcatgggccaactgtattcaatgttattcttctggagagaaagagcatcattaacttcaaagtcatttactagctcttgatgcatcttagtagctactgagtaagcatgtgctggattagaaaagaaaacaaacaaaaaacagaaacaaaccaaaaccaatgttctggcaatgtgagaacgtttgtagataaaatgaaattaaataataaaaggatgttggcttcaagagatcttcagttttcttctgcttttatttaatttttgggtctactgttcaaggcttccttactgcattttttatttgtcaaccctagtattcaactctagtttcagaattgttaactcataacccggtgaaaaacaaatttgccaggtagagtaccgtgtttgtgtatagttttttgttattgttgttcttagctttacaatatccagtcaaaagactgtttccaaaattatttgtcaggtcctttgcccccatctccttcagtgtggtatgccattaatctgtaatacagttaaattcatttctcatagtctgtatttcatcttgggtccctccaacattctggtagatatttttaaatttgcatagagtgaaattcactttttgtgtttctacagttgtatggagtttaataaatgcacaaagtcatgctattgcccattcagaacagttccatgagccctcaaattccctcatactgccactttgtagtcaagctctccccacctccaaatcctggtaactacacacctgctttctgtccctctagttttgtcttttctagaatgtcatgtaagtggaatcatacaatattgtagccttttgagtttggtgtccttcacttagcaaaatgcctttaattctttttattgccgagtagtattcctttgtatgaatgtacccaaatttgttaatccattcatccgttggcagatatctgggggactttcaacctctggtgtttgtgaataaagctgctatgaatatttatatacacttttttgtgtgtgaatgtaagtttttaattcactttggtaaatacttaggaatgaaatagccgagtcacatggtatagattgttgaactttgtaagaaaccttcaaactgtttttcaaagtgggctgtaccattttgcatatcaactagcaatggaatgagattccatttgctctgtatctttgccagtacttagtatgtttgtttgttatcttacactttctaataagtatatagtggtatctgattatggttttaatttatattttcctaatggtgttgagcattttttttcatatgcttatttgccatcaaatgtcttctttggtgaagtatctgttcagtacttcggctatttttaaatgagtttttgcagatattttctttcagcatgtaacatgtcttttcattctcttaatagtatctttctcagaacaaaagtcttaaatttttctaaagtccaatttttaattttttaatggatcatcttttttatgtcatatctaaaaactttgtcaagcccaaagtcacacatattttctcccattttttctagaagttttatagtgtcatattttacatttagatctatgatccacttttcattaatatttgtataagatgtgaggtttgtgtcaaggttcaatgtttttacaaatgaacaattatttcatttgccccatgaccatttgttgaataaacaatcctttctccatttaattacctttgcacctttgtcaaaaattagttaactgtacttgtgtggggctatttctgacctgtctgttctgttccacttactgtctattctgtttcatttatatgtgcttcactccttttaacatacacaacactgcctttgattactgtagctttatattaaatcttgaaatcagatagtatgagtcctccagctttactctttttcacattgttttgaatatctgagttcttttatcttaccatatacatttttaatcactttgttgctgtctacagagcattttgctaggatataaattgggataatatttagtcctttgatcaaattgaggggaattaacatcttagccatattgagtcatgcagtccatgaaaatgatatgcctctctatttagttaggtcttttttcatttcattcttcagtgttttttagtttttagtatatggagactgctcatattttaataaatttataaacaaatacttcattttgagggtgctattataaatagtattactcttttaaattttgaataccaatcagtagtttattcctaggaatacaattgacttttatatcttgatcttatatctcacaaagttgctaaattcacttattagttctaggagatttttgtagattctttggggtttttttctacatagacaatcatatcttcgatgagagacagttttatttccttttttaaaatatgaatgccttctgtcttgccttattgtactatgacagtgaataagacaactgaattgtaatagtcaatctaaacataaaagaaagaagaataaaataatatctaactgtgggctccacatcagagagttaagaaaggcttctcaaacttttattggattgttcatttagtcactgaagtattgagtcgcacttccatggtgctaagtattacgaggaagacaaatataaatcaggcttggagtctacaatcgagtactttgcaaatgaggaaaggtaacagggcatgaataatagtggctacataaaaagaaagtggtaaggctgatcagagataaacagagagagagaacaagattgaatctagaggcagaagagcaggccaggagctagctatctgtcacaagagtctgacctagtagtggctgtgaagaagtcagggtggtgctgaaggaagctggctcttctggatttgctggctcttcaggatttgctgactggctgtagagaccaagggagaggaagaagacaaaatatccaggtttgagcttcattgttttgatgggggctgacccacagactgacattctgaatttgaaatatgcactgaagattcagatgaggtgaccagcaggtggtctaaagtgctggagttactagaattaaaaagtagagtcaagcctgaacataagagtagaccatggtaggattctccctttcaccctagccccaaactctaaggttgcaaacacttgggacctgggacttggcccttccattggaacagtgactacagttaactggagaggtagagggacaagaagggtctgagtggggatagaaggcatcctgctaagcaggttcacgagctccagcctcttgtaaaattaaaagaagtcctaacacctatgctggttaaaagaaaggccacaatgtttacgatgttcctccactcaaagcagggttagaaactcacttatggaggcaagaatctgtcttctgaaataaggtgaaatgagttgcccctaagtaccaggagcagagcttggagtcaatctgtgtttgtctaataacagcttgcacttacagagcatttaccatgtgccaagccctatcttaaatgctgcaaccctcacattgaatcctcacaacaaccctatgaagtagtttctattattatccccatgtaacagatgggacacagagaggttccatacatttcccaaggctttgctgatagtaagtgatagaggcactgccgcactatgctgcatttcaccactgcactcaactgccccgtgtcttctggcaaaccacagagcctccctggccaagaagaaagtcataagtgagtagcaatactgtctttatccacagcaaagcgatagcattacagcacccactgtgagcatcactgaacagctgttatgcacccagcactgtgctaggtggtgggaatatgcagacaccttagacacaatccctggcctcatggatctcagtctggaaggggaaataatctcgtacacaataaccataagatgcactgtgatatatcgcactctgactgcagatgtaaaagacatggcacatagagaaacaggcattaattttctgttcctctgtcaaggaaaatgaaaggcagactaatgcattatggctgaaagcatttacttttgattaagtgtatgtttaaatatcaccctcctcctcagtcaggctcattcctcagtctctgctacattgctgactttgctttctaaagagaaagtgagatattcacccacagtaaatggaataagaaagatataaggcatagaagtcctacctcagattttttttgtttttgtttttttgcctttgaaaactcatcacagtgaaaactaattacagctctcatcacaaagagaatgccagagaaggctttcccttcattttgtggaaagagctttaaataacattacataaaatacacaggatcccagttaatttgaaatatagttcaaaatatgtaaaaaccaaatctgtgatctagtaatacatacacttctttattaatgtattaacaagttctaggtgtgggtcaattgccacaatttccaagtggtaatgagtgtaaatggtgagcgtaaatgattttttgatgtcttcaactttgaagtgatacaaaaacacctgcagtttttgatggtgtcaaagtcacaaacagtaacatgagtacttatggggtttcttgcctacactgagaatggaaggatatgctaactttcagttaaaaggtggtgaaacataaagatgtatttttcccattcaagtttatgtatccgcagattatatgcccttgagacagaggttccagattcttctgatttaagactttttgagttactgatgtccagcttttctgctgccttagatgcttgagacaggaaaagcaaagagtagctcttatttaagggctaagtagacatgagtgggcacttctcaagccccacctccacagaacactcaagtttgtatggttatatccatacaactttatgtcacagctccattttccctggtctggtgatcatggaaacagttctaaacacctcagatttctatcatttctccaaagtgccaccttcttctttgcctcttttatctgtcttcatcctctgattcccactttttctagtgactctagcaaaataacttacaattcacatataatagattcaggctatctgcaatgtctaagcacaaatttatctaggctggaagatcattagggcaactgagaggatcattaggccagggaagtgggtcttgaaagtcacagaggcagccttctaccagattttgtacccataccagaaccagattcagtgtttaaaatagcgcttttcctaagaaataagaaaggcagaaagcaactaacactaattgaacactgaaatatgctaggactggtactgcatttatattttctcacttaactgtcaacaaaagtagtgtgcgatgattacctccatttatgaatgaggaaagagactttaaaaagccaagcaacctgcccaaggtcacacacatctggtgaacaccatttctacacctttcctctccttggcccactcagcccggcttcccatccgtgacacaactggaatggctgccacagaagtcaacagccatccccacaaagctgaacatgaagggaatttctccaccccactcgctgcgctctatctcatggcagacttcaacactgctgcccactcactacctgctgaaaccatcccctgctttggcttctccacagacactttcctgatctccatgtacacctttgccgccccttctcaattttctttgccgatgcagcttcctctccatcatctgtggtgctggagctcctcaaggccccatcgtgggccctgttcactaacagaatcggttccctcagccgctgacccagcccatggtgcctgttaccctggacactcagaaaatccctctccccactctgagttacaggcaattaaccttggatgtctcatggatattcagtccccacgagattgcccaaagatccaaaaccgttgttcccccaatgtccccaatgaacactctacttcggtgaaaagcacccctcttcacccagctggccaaatcagaaacctgagaatggcctgttattcctcctttttcaccctcatattcaatcaaaataccaagtcctgtagattttacctactggggatatctggaatcttccccatcctctccactccactaaatccgatttcaaggtagcaccatttctcatcaggattaactaagcagccatctagctcctcttcttaccttccttcaacccattttccctgctaacatcttccattactccatattaaggtcaaaatctgcaacataatctttaaggcactgttttatctggctcctgccaccctatcagactcatgtagagccactcaaccctttgttctcccctcctctattgcctagaacgtatttcagttcctcaattacccatgcttcttccagtctctgagcctttgcacatgctgttcactctgtttgaaatgctgatccctgctctctttactaagtttcttcctactcttcctttggatctcagtttaaatattacttccctagagaagcttttcctaaccacgcatattaggtcagctttctgagggtcccaattttgtatttagggcctactatccttttatttaatattataatcaaataattaatctatttaatacctgtctcacctcctatgacataagctgcacgagagcagcaactatctgccactcagcccaggctcacagcctagtctgaggcctggtacataggtgaaatttggtacatcttctttgacctaattaattaattataggaaagtctcttttttccacacttctctagacttttctagaaagatacggatcatcgggtgttttatttgtccaaagaaaatgaataagaacctagtcagaatttgcaattgacaaatgacttaaacttttaaatcaaagaatctggaagaatcctgttctactttgttgctatttttaaaaaggtaagaataaaagttttgttctgccacctgtcaatgtctgtcctcaaaatgcctggctaaatcatttgtgtgcctggtgaatcccaaatgagtcattatttacttaccaacaatgatgaacagtgccctcataagaaaatgttattactatttgtagccaccttcatggctgtcaaaatgtatgttaccttgtaactatcaaaaccagctggctggcaaatgaacatgatttctgctcatgtacattattaaatgtgcatttcttaaaaaaaacaaacaaacccaaatctcatatttgattagtaacttccaggtaaggcagagtataattcagaaggatcagaaagatgttcaaatagagtgagacagcaaatgatgtaattctctgaccacatgaaaaccaggtcaaacccagcttgtttctgccagcctgacacagctgctggagccccttgcatatgctttccagctgtccctgttacgtcaacctttaaatcggggattttgccccatgcatatgcttcttgcttggtcaaatgcaaggcacatatttttgcaagctacttttctcagctgtttaaaattgtgaataaggtctaagatacgtacatcgagaaacaagccatttaaaacaacaaatttgggttacgaattttctgcttttagcctctttgacttgtaaagaaactgtgagcatcagagtggcctgcaaaactgagcctaagagatgcttgatttcagttctcactactccagtattgccttaaaagaaaaaaaaaaaaagcctggtggctgctccataaagtgaggctaggaattacattcagtgcctctgccatggaacaaatcattgtcctgaaataaggtcagccatgtattcaccgagtggagagtctgccttcagaaagaaaggggaatcacaacctttgagctctcaagaagctatatcccttctccacataactctttactgacgctgtaggatttccaaaatttgactgacaaagctaagtgttctgtgcctccacattgatgtcatttgtttctaatattagcagcagagcagttcaggttcacctgagaaagaggagcttttattttgagttgaacaggagcagatactaaaaatgaacatggtgagacttgtttttgatatctctgacatagataaaatagttaaacctgtgcagtgaaacaattttgaatcaaatggaaaaataattcattctaattggcaatttgatgtgcttacagaatttttatgtagcctcacttatgggaacactgaggaattaagaaatagaataatatcatataaagttgtttttctgcacaatgtcacataagattatgaggtatttgtgaaaattctacatgagtgagataaaggttccagggtatgtgttatagcccagcatgattagtaaacttggtcattatttgatattaaagccacacaaacaagctgctgaactcattagatcaaatgtgtcaagtatttgggcttctattacacatcagatcttaagtggcttagagtaactggacaatagctacatcttcacttagtactgcacaaacatggatagagacaggaggatgcagacgtgccatttggaatagcagaaatcatgttgggatttcatgccctgaattggaggtagctagttcctcctaccttctccagctgcaaagtgagtggcaccatcctgtgttgggagtgccttaagtggtacacgtctcacaaagagacttgcatctgagcaaagttagagcaatgcacacagagacccagatatatctcatgcagagaaaatgcctctcactttaaaagtgaccacctgaatttcataactgttctatctagaggatgaaggtatttggaaaaataattaaaagtattagagttaagggaaacaaaaatatcaaggcttaaggtggggacctatcaccactatagcagtattagtctgtaactgaacttttcttacattttaaaatcttgtaaggctttcattccagaaaggccatcttgggcgtttaaacagcagtggcaagaaaatgggccattagtacttgctagtttgcagtttgtttttgctgacagttctcatgtttggtcttcaaaacccataacagagtgatcattatcttcagttgctgccataaggaaaataggactgccatcaggaaaatgggtgctgagatgttgctaagtacccagtgatataactttgccttatttgagtttgttagaacaatctctgaactagcggggcacggtggctcacgcctgtaatcccagcactttgggaggccgaggcaggtggatcacgaggtcaggagatcgagaccaccctggctaacacagtgaaacccatctctactaaaaataaaaaaaattagccaggcgtggtggggggtgcctgtagtcccagctactcgggaggctgaggcaggagagtggcatgaacccgggaggcggagcttgcagtgagccgagattgcaccactgcactccagcctgggcaacagagcgagactccgtctcaaaaaaaaagaaaaaaaaaaaaaaagaaagaaaagaaaaatctctgaactatagagacttagccttagaactgtcttgctctatagagttttctacaagtcacttctccctactgaaagacattaaaaatacatgaaaacccttttctagatccttttctccatgatacctacaaagttatgcaaatataagcctgaggaagccaccacctcatgtgatctccacggtaagatgtatcccatgttactggaattacatgttggtttttctgtgtccctcagtggactctaagctccttgagggtacaggaccatgccttgttcttctctgtatctccatgactttttaaaaaaattctccctacaatatagcatttgctctagattcctaccccttaaaatcagtagacttttggactaccaagaaaagtctttgtacatctattgatttctgaaaaactactaaatgaacaatttcttataaaaattatgttcactggagcaatccaattattttcgtcccatttagtggttcaaaatattttccacatgcatctttatgcaacagttttcttccagttggacatgtccagttcatatgggaaaatttagcaccatgtctggttggagggtaggagtcagaaagcaccagaaatcgctatgccttgcatttgtttacagtataacactttagcacacattctcacgatctggccctacaaacagtgatgctatgcaaatggcatagacatcaacgctacatcttccaaatgaagaaactcaaccccggaaagaaaagggagcaatttctacaaggtcacccaactagttgtgacaacgggtcaaaagcccgggtctttcaactctttgcatttttatgcattttttattatgttgtgcaattgaatgtgttgcttaggtggcattttatagacaacattaataagcagaggaaaaacatgtgatgcaaaaatgggagtactaattgctaagtctaaagaaaccaaaactgatgacaaatcaagggagaacttgggatagttcagctgtgccaccaatttggaagttttatttgtgttgtttcctttggtgtgggagcaagaagggaaactgtatttttatgaaagccttttatcagagaataagggtgcacttttctacaatgttacagttatttcagctttgcctgctcactttggacccttacactaatgctatgaggcaccctgtctctgagaatttgtttttttcctctatgctagtcagaagacaaaaatgggttgagtctggatttccacaaagacttataggcaaatgcatactagagctcctagttctatccttgtttagaaagcaaaaatatatttcttttccttaaacttttgggaataaagaaatatctgatgttcccgtggtaattttatgtaatcttgaattaaatatatatacacacacacacatatatatgtaatatagttaaatatatatctatgtattatattataatatattaaatataggatatagttaaaataacctaaaagatagttttatatttgttattttaataattcacatccattagaattaatattctgttttagaagtcagtttgttagtcagtaagtcaaaaatatttattaaggctctacttaccgtgtgtcaggccattcaacacaaatcagaactgttctgtgacctaagtctagaccaggatggtaactgaggaagtagtgagaagtggtcagttgacaaataatgaatgaatggttggtgaataagttaaagaagtttaccctcaagaaactcagattctagaaggagagagaaagccagtaaatgggtaaacaagttaataaagaagacaatatgagactgagaagctgtgttctgtgagggacattttctgtgctgcgcctgaacagattttgagcttcctgatgcctgagtggccatgcaagggagacctgtctcaagacaatatgccggcatctgtggttctgcctctatcaggactcatcaagaatctgccaaaatggagatacaatatccacttatgcatgtacagttccacctgaggaaatgatgaccaagtgttgctttgtttttattataggaatcttggaaaatcaggactcagagtttcttgcttgggtcttggtaagtactgagggtgtgacctgggggtgggctggaaggtgggagactggggagggcaccagggagtgactgtggtctaggccaggacctggtctcagatgaggaggaggcttcctggccagtattgccccacttctcctttgagcctttctcttcccatcatgaccctctcccagggagccaccgtgttcatgattccttataggggcccgtcgagcataaggcaacctgatgctaaagcacacctcagagaaagggactcatgcgtcactcccatttagcaagcatgaaggactgcatggcatgcattttataggttcagttcaccactccctcaattcacctgaattttttctatctatccttgttttccctttgcctaatttcctcacttttctatattattattatgcattttatatacttttataatctgccttaaatatttgggggggcaaggtgagatacacataaacacatgtacattaatatgcattaataaataaaaagtattattcctcccagtcaatatttgaagaggattaaatagagatggcaattctaacagcataaagatgaatctgaagtcgtggaatctgactgtgagacttggggaggcttgaggcctccagacatcccttaggcccaggaaaaggcagccttggcattcctgccattcaacaccaatcagagctgttctgtgacctaagtctagaccaggatggtaactgaggaagtagtgaggagtggtcagattgtggctatgttttcaaggtaaaacctgaaagattttctgttgggttctatgtggaagatgacagaaaaaagtcaaggatgactctaaggattttttgcctgagcaacagacaggatgaagtatgagtaaatgaggtagaaaaatgagagagaaatttagggagattaggagattgatttgggacatactaagtttgagatatcgattaggcctgcaataaaaattgtcaagtatgcaaatagacttatgactccaatttagaaaggagagctagatatattaacttgagagtcatcagcaagtagatgctgtttaagcccggatcctggatgagagcactaagggtgtgcttatagacagaatagaaaacagaggcacatggtctaagacctaggaaatccaacattaagaaatcgagaaagtgaggaggagccaaagaaagctgaaaataaagcaaccagcgcagcaggagaaaaatcagaaaaaaaaatggagtcctggaatccaggtgagcatttcgaggaggatggagtgaccaatcccgtcaagtggtgctcatgcatcaagcaagatggggaccaagaattgaccatcgggttcagcaacatggaggtcatcagtgacttttacaaggtctgtttgggtggaatggtagagtttaaagcataattggaatggtcccctgggagaatggaaagagacaagctgaaggctactcttttggatgatgattgctataaagaaaagcagagaaatggagtggcactgagcagacaagtgggatcagagaggttgcttttgcacgtggaagaaatgaccacatatttatacacttatggggaaatccttttgagaggaaaaaatgatgcggaaaaaggagagagaagaatatctggaatgatttcttgaggacgtgagaagcacacaaggagacagtacatgaaagaagcagagtacatgggctttgaggctagtagggcgattgatggggtggtggagggggaggtattttgtcaaagttctcttctattgcttttatattctcagtgggaatcagaagcaaaatcatcagctgttagtgaggatgagaaggaagtgttagaagtttggagagaagacatgcgggacagaagagtgaattgaccagggctaggccacacagtgacaagatagcattaaggatcagcttaagatcagtatgattaaatttgaagtgagaccatgtccatagttatgtgtttttcttctagacatgttcagctttgcaagttcaggtgggtttttgtttttttacataagatgataaaaagagggcaaagatgctgagggcttgtgttgggcagttattttaatggtggagttggcatttaaactgagtagaaaggaaaatgaggacagagtcaggaaaatgagccaggagctaaaatgagggagctgagggactgtgaaaactggataggatcaataaagtatatatcccagagggactaaagaattgttgaagcaaaaacattagagacagtggttggaaggatagaaagtggttgaaaagggaaacatttgaaattggggttacagaggggttcagttattgttagtgacatagtctatggtgtgtccattgggagagaatggtggagattgtatcgaagacaagatcagtgaaggagagaaggttaagaaacttggaggtgaaggtgcagggaagatcatctttggggtcactgaactcactaaaaagtacagcaaaactaacattggagagtggcagtgagaagtgagctaaaattttcaaagaatgagagggagtgaccagggtgggtcagcaactacaacatgagggtcctgatgatgtgtgagactcagagctggcatgtgtgaaggggtatttcaaagatactgaaagccatcaatgtctgagtttttctgattcttcctaataatctgacttgggaggtgaaggcagtattgttcaccataagtctaaggtaatttgacatttgcttaatttatggctctgatattgttactatttactcatatttgaaagaccctggagattcattaccagggacactctgaccttagtttttttttaagtatatctttacagtaaataactattcggtattcattattgaaaggaactacctattaatgtaaagtaagaaatatatgtagtgaaaaagcattgcccaactatttacaagcttgtgtctacggtggaaaatagtttagtcaataagtacacagaaaactcagctgaaagcccttaagacaataacaaattcaggtgcccatgcaatcccagtctccagaggccagtctccagtttttgttgatttttgttttctttaaaactgcagactgtgtatgaggtgcaggcattttagtgaactttgaaacaggcttgattcaggagcagcaagttctatttgagcttcaagttttttcaagagcctgaacacttgtaataagacactgcatgaaaaataagaggaaacaaggaagttcatagggctgacttgcttcattcaaaacagttaactaagcttgacaacttgaataagcactctttcagaacttttttgaactgcctctataagccagaggagacaagaaattcatagaaagaaataatgcaccagccttagataatttgtcaggctctgcagaccccagctgtcaaatccaaatggagctgggtttactgctgcaggcttaggatgtcagctcagtcacgacctacgttcaactgaggccttagaaattaagtagtaaaactgccaggaaatcagaaagctacagattcttttcttgaaatactctaaaagtgatagttaaagctaacaattctgactttcttctctaccagagaaggggcagccggaaattccttgccctgacaattttccttttggtgaactaagagcaaatgtgtaaatgggagtagaaaggtgaagtaacttgagagtgaactgatggtacatccgaaagaacacagccctgccaaggagagaaatgggaaaaaatattaatattatgtggccaatcctacctgtgggttgctgtggcttgcctgttctgtaaatatactgcccattattgtcaagacttgaagtcaaaaaactcatgggaaaggaataaactcagagtgaccaaactcaccccgatctgataggaggtggaactgccttatgagagaaaaatggtagaatttacgttaattcactcattcatttattcatcttaagcaaacatttatgaagccagacattggttacagaagatacgaggacaagagcatggagcctgccctcaaatttatcatagtgcagtgggagttaggcttgcaaaaaaacaaactgataatgtatctgacagatgccgtaatggagagtacagggcaagtgaagcgtgaagaaggtctcctgggggatttgggatagcttgatgggggaacaagggttgccacttggcttgacacttgaagagagaagtcaagtggagagggagggcaagaggtttaagacaggaagcaatgcaagcaacggcgactccagagggagactccaccgaggggaggtacttggggaaatgggtcacatgtatagaatattatgagtacaaggtattggggaacagcaagaaatgagcctggaaagaaagctaggtttgattataagaacccttgtttgccttgctaagccatttagctcttgtcttctatgtctctggaattccttcaaatccaaaggtccccaggtctcaacaaacacttcagggacaaggaggagcaaaggctccatctctctccactctcttccttccacctgccacagcttccatcaaagcagcccactttttctgcatattattattattattttaaaaaaatagactatgttttaatgcagttttaagttcactacaaaactgagcaaaaagcacaaggagttcccatacacccctatccctacacatgcataacctccctcgttatcagcatccttcaccagagtggcacatttgttacctctgatgaacctacagtgccacaacattatcaaccaaagtccatagtttacattagggttcactattggtgttgtacactctatgggttttgacaaatatataatgacttgtatctaccattatagtatcatacagaatagtttcactgctctaaaaaatcctctgtcttgcctattcatccctccctctcctctaactcctggaaatcactgtctttttactgtctgcatagttttgccttttccagaatgtcatatagttgaatcatatagtatgtagcctattcacattggcttctttcacttagtaatatacatttaagtttcttccatgtcttttcatagtttgatagttcatttctttttagtgcttcatactacattttggaaaaaaaattcatcctatgccaaaaacagttatcaaaaccttgctcaagcttgtgataagccattgaaaaccttgggtcaggaataagacatgatcaaaggtattagaagcaacatgaaggctataatagagggaacagggttgaggctggaggcagggaaattaattaggagttgatgatgaggcagtggtatgaaagatgtagaggaaggaggtgattaggagaaagaatgagtagggctggtgatctctggatacagaataggaggtcttcctgagtgcaggaagatgcccagactcctggattgggcatgggggtggatgagctgaaatctcagagacaggagacacaggagggagctgtgagggcagacagcactgttggggagtggtgaccaaagagcttgtgacctcccagcttcagatatctagagaacaaggggaactctgtggagatctctaggctggaaatacagacccaggaacttctcacagtgatgaccctatgattgtcattgagatcacctggaaacacagaagactgaggtgtttggacaggtttaggacatctggctcatggtgtctgcctgagtgtatgctccctgagagcagggactgcctatttttctacactcctattgcactttagcagatcacagtatctggctagtagcaggtattcaaaatatttttgagtgaatgactggagagatgatcaattgctaagaaatgacaaaaggtccactgaataatagcaaggatgcagctgaagtcagaaatcatgaattgctgaggcccagcccagttctttgacttcctccagtggtatatcaatgaagagacagaattgtggggtagggagtggagatagagagaggcccagcatcagggattgtcctaaaagagcgttggagaccggggaacctaccacatacacaggtgatatggggtctaggctgggtttagacccagagctgtttcatcagggctcttgcttctacagttagaaaggagcatctgcccacactgacttgctccaaaagtctcacattaggagcagtaggccggtctgattcattccatgggaggtaacacaccacaatgtccagctcacctgtgtgtgcttgaaaggggctgactttaccttccaacattcactctggaatgggcatgcttcccagcaggcaagatgtctgcaagaaaaaaggcacatcatggttaatttgatgtgtcaacttgactgagccatggaatgtccagatatttagtcacattttattttgggtgcacctacgagggtgttttggaatgagattaacatttgaacttacagactgagtaaagccgattgccctccctaatgtgggtagcactttcccaatcagttgaaggcctgaataaaacaaaaatacttgccctcctgtgaataagagggaattcctgcctgaccatttcaaactgggacattgatcttttcttgccttcagactcaaactgaaacatcagccttcttggatcttgaaggctgccagctttcggagtagaactataccattaactcctttgagtctctaacttgccaactgcagatcttgggatttcttggcctccataatcacatgagccaattccttataattcctctatacacacacacacacacacacacacacacacacacacacacacacaccctattggttctgtttctctggagaaccctgaggagagattttgttgatttttttttcaaaacatcatgcaagtgtatgtggccaaccagagttaagtatttgtaagtgatataggtaggaagatatggaaaacctaagtaaggagtaatgtggtcacttgctcatttttcagctgagcacatattaaacctaatgtaaaataccgtcatccaaatggagctttcctgggctgttcgcaggtcaagaggacaatttatgcagccctgtcagatagggtttgatctggacctaagcagtgaaggagagaaagaacacccccatacctttgggtccctgtttcacacatcctcaagactttaattcctagggaatgcaaactgattccaaggaaatgttctgtgtccttttaggcagctgcttcatgcttcgtccttgaagaaataaagtcataaagtaaaatacttcttaacaccttggaggacttatatgagtctctcaaaaggtgtttcttctcaactctggctgcacattgaagttacctgtttaatttaaaattcagataatctcatctcaacctagaccttttcaatgaggagctccacatgcatgtgtttttcaaatgctgccctgacggttctgaaggaagtatcagggttggaatacattgtcttatctggatggattaagatagaaaaatgtgtgaactgatatctagtgtacccagtgccagcagccatgattcttatctacatggcagcagccgcccgcagatctaggcctgggagctggcctgaggcatttccaactggactggaaagcctccaaagaggagaatctgccctgcttagggctggcctcagggcaggtggggtgagctggcttccctgccattcgactcctgccatctgggtgccagtcttgccttatgcccctccctaaccaagagaactttctagagcaaaagcagtgaatcttaagaataaactgtgtgggcttctttttaatgcattcatatgtgcagaatgtagtcctggctcatctccgtctgccttagtgatgctctcactgcactaaatattttgacactaggagaacacgacattaaatatttaacatggatggtattatttttatgacacccttcatgattcccattcttgttgtttaggccgatataaactagctagctcacctattataacaacataagagcagcaataataaatattatgaagtgcctcctgggacacttgagaggtagttttaaaatgcaagctttccctgaaagagtttaccaatttttctgcataacacaaacagagtgaactatcgtaactccgaaatacccatagagtttaaatggtgtatgaatattaaacatacaagagtgttttaggcatgtcactctttctggaaagtctaacttgaataaatgtcatgatgcatacatattaaaaatgagcagacctttgtatttttccaaaattgtctaaaaatatttcttcctagtttcctacttttatggataaaatccttcttaagaattgctgacaaaaagaaagaaagaaagaattgctgacaagtggttgccttctgaatcagcagggactgctggccacatggctttgcctctgctcccaggagtctattaggagtgatgatatagcttaggtaggagtgtggcaacctaatatttcacacgctgtcagagttgaggcttaggggagaactcgaggagagaaaatagaagggtctgtacacagaggggtttattcaacaatctgggcatgcaaacaacccatgtgcatgcatgcacgcacacacctcatctctctccatgcagccacaaagggataagtagccctcatttgccaacctatgattcaaaaatgaaacaagtggcttcaaaaccattagtaatgggggacaaaaggtcctctctaggcccagatctgggcaatttgctgaaattcatcatttataaagacgatctcactaaacatcattacagccatgagatggagaattagtccttgcagccaccagctccattgtgagaaaacagggtcagggagaggcgatatgtcttgttcaaggccagtgttagagacagcagactcacccattttctatccctccctgctccactagcagcctcgtcccttatggcccatctacttccagcctccaagcacacacagccactgctgtcacccacatctcttcatgtcccaaacttccgcttcctccttgaaatgagaatggctgcaccaaatgtgtagggccccttgcgtctctcacattcaggcagtagtcaggtgatgtcatgattaggttcggcatgactctgggttggcagcttggtgaaaatgtctttactttggactagaaaatgtcagaacctgaatgactcctgacatccatctccagagttagggtagacaatgacttatgaacgctccacagacagaatggggaccggaatccatgtctcttggcccacgatcaggtgtgctttccccatgagaaatttcaaagtaaggatgcaattgagtgcaggcattttggtttttgtgtggataccatcaatgaagctcctagtgcctgcctttccctcctttgcacactgccctaaaggcttcacgaggtccccatagttcctgtactctaagcagcagcctgactaaggcacatcttgtgtatatacaagtctattcatgttgtttacctcgggtttgcctgtgcattctacatttatataaagattatttttctaaactctgtgcagcataaaaacccaaatgaaatttttgtaatttcaatcaataatgcaattaagcttatctaacagtaaggcaaaaaatagagaatcatttgaatcctgtctgccagtggagtggggctgtgctgtgtctgtgcctgcctctggtatgcccaggtgaggagagcacagggctgcaggcagtcatctctgaaagtgcagtgtacgtggctgaatgaccctccaggggccaatgcaccgaggatgactgtgcagacattcataggaatgccttaagggcctcagctgaatgaagaagaaataaagtctcagttcttttcaggcgtattgagtatgaatgaatcagaaaccttccacagtaagccaacagaaaacccagctcaaagcaagccaagacgtcagctctagcaaaaacacaaatttctaggcccacatgaaagaatttctaggctcacctggacagtggacccatatgggtttatctggggatcaaactgtgaattctgtgagctgcaggtttgttctattctcaagctgtcctgaaataggcaagaggactgcagaagcttcatgcctcacatcccattggctctggttggtttatgtatccatccctgagccaatcatcaaagacttcagtctctcaagacccaccctgacactggggaagggtactttaaatccatccaaactgcattctgggagtagggaagtgattcattctcaaaagaaaattaaagaactcttagctaaagaggggaaatagtggctgaggtaataagcagatgaccaccatgaatagttaagaagaaaacatattcctggatctgggatgccttcccctacttatttggcttatctgagccctttctatgtcattggtagccatagttgaaaactgaaattctcccagctttttctatggcatgaggtatgctcagagttttgtgagtcaattcaatttgcctaattgacgaaattttccattgcagggtaaatatacagctttgccttcttgatatactctctcgtttctatgtttttaataatctcaaaggattagtgagacctaaggctcatttacaaataaaagcttcatcctaacacctggatgatgaaaatatgcaaagaaggacctccatgagagagaagcagaaaataccatcaatactcatttcatatctgacaactaattacaattagaggaaaaagaggctaccaacacataattataggaaatgggtgatgaggtaatgagcaatggctaaattggagctgacggtctaaccatgaggatttctttagctgaaaagaaggaagcaggacctgatttggttctgtgcctggaattagcttcatttttcttcatagtctcttactttgcctcccttcccatatctccaccttatgcttgacaatagcctttcctttggcccttgctgagctgtttcttttggcagcaatgtctgtaactgctctctgaagaatagaggacacaggactggtcctgagacatgttgctacaggtgaccttctgtctgacttcgttacctaaccccaccattctcagggcaaaagagaggagcacagcagtccccctccttttcagtgccttccagggaggactggttggctgtcctggccctgctgatggatttgctgcctcggatgttgcctgcgtctcagtttgtgaactcttagacactgcgactgactcggtcatccctgtaaagcacggccaggcactttttctgtcattttttcatgtgttcatggatttcacaaagatgcagtagacgctgtgctggggaaacagggagaaacgacacacagatgcctgccctcacagagcctatctagggagtggaggagacgtggttctcaggatgaatcagatccttgggctatatgcccctaaaggacaccctgcattttttacttgcgtttgatggtgattaattttttagcctgacttatttcctgctggattatcagttcagaacacatgactagaacagagaaaaaggttctcaatatacactcatttatggaatgacgagtgaaagaattcaggaccacacagtcagtactctgaaggaaatataaagcgtcatggaaacatgtacaagggctgcctaagctagggttaagggaggtcatgtaaggcttcctggaggaagagtagtaaaggatagattgggaaggagccaggtcaaggagaacacaaggaaaagaacaattaaacaagaatgtgatagaagtagagaggcagagagatagaggtacaagacatagaaatggcccaggggaggaagtgaccacctcttttgggggagtaggggaaagtgctgctggaagccacctgatgttgaaggatgaatagcaatctgtcagcttgacaagggaaagaaagccacaggcatatcttgttaagttttctatttactcctcacttgggttttggcttgattgttgctttcctgaacattcaagtctgggctagaggcttcctacaagttcccatcacgatccctcttatcaatatgttgccccgtggttgtatttattttcatatttgcctgtcttaccactggattgagagttctaggaaaaagagaccattactatcatttgccattttgacactaccatctggcatggctctgggggaacattgggggtttaataaatattttctaagtgaattaatacatacatttcaggaagaggagcagcttggaagcctcaattagcatggcctggagagggagccatgtgggagagaaaaatgataacagatgactcagaaagattatgaaaagcactgaagccatgtcacaaagcttggtgtttatctgttgtgtgattgggagtcatgaaaacatttaactccaggagtcacttggccagatacattttagtcagctcaccatggtcacagtgcagatggcaaggtggtgagggttgagaatagaggtggggagacaagctcaacgacttgagtattctcacttttacggaagattaaatgtagcaatacatcaattgcccactcactgtaagccaagctcatcatactgtcagcatatacagacagcccatacggaaggtatatcagggcagtaaggtaaatgaggcttgaccaaattggcaaaagcaggtagagaaaatacaaaaggaaatatatttaaaagcataaaataacatatcagaaaaagatctctaatataggtgtcatcatagtaaactacaaagtttctgagattgggtgaggaaaaaaaaatgctagttcctagatattttctgtaaggaaaaggtcaaagataaatagaaaataaataaatgggcaaacagacaaatcaaagaagaaaaggaaatcaaatttgaaatgtaaaattaatatgaaataaacaaactagaattcaaggcaaagaaaagacagtaatgagaggtgataactagtggggtggagtccctgagaaagaagaaggagttgggatccataagataagtggaaaaataagcattgaatagaaaggacacccttccacagtggcaggaagaaaggaagagaagatggtactgttttaatttatgttctctttgaagcaggctctgaaacaaggatttgaaggcaggtagtttgatgattttttgagatgtgagattggaaagggaaggtgataaaggacatataatcaagtcagtgctagtgtgggtaactgaagctggaattcccctgggactcgagccagtgtggaatgcacacctacctgagagtgagggagatggggtgtttccataccatagagagtcatcaaacatctagaagccccagggaaaacgggcagggcaccaattgtgtctgccatgggtcagatagtagatatggcaagaagtagagagggttatagtttgtcttgctttattttctttttgaagcaggaggcactattacctgctgaggttaaaggaagaggacgtaggacctgaggttgagaaaagtggggcaggtttgaaatgcacacattggagaaaactgactagaaaacagaggactgttgagggtctatgagggactagagacaaagaatttacactgtgtcagtctctatagtttgttaatttccccagcacagctcagcacctcggttataggtgatgagcagccagatagtcagatttataaggatgtgggtttttgtcaggcaggtgcaatgaaaggacagtgaatcaatggacttgagaataaagcaagagaaccttctaaatggtgaaccacatcatctagccaccctgaccctcctggataaggaaggaattgaagacagacattagacagaagagaagggaaagagtttgaagtcagagtatgtggggagaatgtacaaaatctgcaagagtgagattctagctcgtggagattaatgaccagatcttacatatatagatatatttggaattaaataaggcataccttcacccaggttctgttgtgtgcatgttcagttctatttttcatggcagcattgctatcttgttgtatttttaccccatcaacattttcttctgctccatctaaaagtctatgtctatctttttattttattttagttccagggtacatgtgcaggatgtgcaagtttgttacataggtacatgcctgtcctggtggtttgctgaacctgtcaactcatcatctaagtattaagccccgcatgcattagctatttttcctgatgctctccctacccctgcccacccccaacaggccccagtgtgtgttgttaccctccctgtattcatgtattctcattgttcaacacctacttatgagtgagaacatgtggtgtttggttttctgttcctgcattagtttgccaaggatgatggcttccagctccacccatgcaccagcaaaggacatctcattcctttttatggctgcatagtattccatggtatatatataccagattttctttatccagtctatcgttgatgggcatttgggttgactctgtgtctttgctattgtgaatagtgctgcaatgaacatatatgtgcatgtatgtttataaaagaataatttatattcctttgggtgtatacccagtaatgggattgctgggtcaaatggtatttctggatctaggtctttgaggaatcaccacactgtcttcctcaatggttgaactaatttgcattcccaccaacagtgtaaaagtgttctgatttttctgcagcctcaccagcatctgttgtttcttgactttttaataatggtcattctaactggcatgaaatggtatctcattgtgctttgatttgcttttctctaatgatcagtgatgttgagctttttgtcatatgtttgtaggctgcataaatgtcttcttttgagaagtgtctgttcatgtcctttgcccactttttaatggggttgtttattgtttcttcttgtaaatttgtttaaattgcttgtagactctggatattagacctttgtcaaatggatagattgcaaaaattttctcctgttctgtaggttgtctgttcactctgatgatagtttcttttgctgtgcagctctctagtttatttccatttgtcaatttttgtttttgttggaattgcttttgatgtttttgtcaggaagtctttgcctgtgccatgtcgtgaatggtattgcctagattttcttctagggtttttatagttttgggttttacatcaatgtctgtcttgcatattttttttaaaattgaagtttatacttgaaagtttgtgatatccacagtgtcctaaatgcatgcaatttatataagcagtgtaaatttaagaaggattggtcttttattcagggggattagtggctgctgtgttgctcttccaattgacccattggaaccacatgaaaacagtggattttcagttacctctgctaagagaagggaactgtgaaatcgaaaatctaattgtatttttgtttgtctttggaatgcactttctatttctatttgaatctgggtgtcacaggcataacatgtcagtggaaaatcaagagtcatctacagttaataaaatatgtaggaacaatataaagatttagtaccccatctcagggtagcattcggttaagcttttagattgccataataaattaatcattctgcatggcaccagtgggagaaattccactctgaccccatcaaagtgatgcgtcccacttgcaccttactctagcaggactggtggcccttgtaatcttgtcccagaaaacgagactgctgatattatttttttttatttcacatttaaaaaaattctgctaagcttcttttgctacagtcatttgctgccactgggatttttgcagaaggttagtagtactaataaaatgaagggcaaagcaccaaagagaatcttgaaggaatagtctgtaattctttatttggtcagggcgaaagaccctgcaaggtattacaatctccattttggggtcaaggccaccttcaaccttccaaatttttcttcatcctctaggaccagtatttattgtctctcttcctgtcactccaaggcttctcactgtactgggacctcatagagttcattcctacaacatcccaacccactgcttagacaagttgtcatctcggctgccattacagtcacagggggagcttttaaaacatacctgtgcctgggcctttcctcagaccaatcaaaccagaatctattgctttggagcaatacatcagcttcctaggtggtcctcttaattgggccacagttgaagatcactggcctggataaggagctccaaattctggcttcctgtgcagctgaaaggtggcctggctccccacctaagttacttgctcatccaatgactgagtccactggaggctttgagtacctgggaacatttttcttcccaggcagctgcagcaagcacagccagagagcagggcagatgccacttttgatgaccaatgcaagaagcaaggggcaggtgaggtatttgtttttcacttagatttcatcccaagttaaaattcagaattttgaataatgtttgaatgttttagtctattcatcattcttcatgtgtcacttcagaataatccataataagtaatacatttttctaagctttgttaagacaggtatgtggttagaattgatacattccaatgtcgactgtggctttcactgtgagttctgaaaaagtcatttatgttcttgtggaacttctgctacttcatatattatctctttggagataataaggaaagtagcatttagtgagcacctgttgtatgcttgtactagtactatttgtctagtactattgtctagtactattctagacactgacatatactattgaaatcattgacagtgtaggctgaccgggcgtggtggctcacacctgtaatcccagcactttgggaggacgaggtgggccgatcacgatgtcaggaattcaagaccagcctgaccaacaaggtgaaaccccgtctctactagaagtgcaaaaattagctgggcgtggtggcgtgtgcctatagttccagctactcaggaggctgaggcaggagaatcgcttgaacccgggaggcggaggttgcagtgagccgaggttgtgccattgcactccagtctgggtgacagagcaagactctatctcaaaaaaaacaaaaaacaaaaaaaaaaaaccaggatagactatgtcatcagactacctggactcatcctggctcagccacttaccagcaaataaactcaaatcacagattggtcgtgggttttaaacaagataatgtctataaagggtatagcactgtgcttggaacgatgtaaattctcaaaaaaaaaagtgttaatttgcatcattgtgattttttttttttttttttttttttggttctcacaataccgtgagtaggtatcattatccattttagagataaacaagtctcaaaatgaactaattatccatgggcataatcaatctcaggcgtgttggaaggaagatgaaaaacttacctttcagaattgttggaaaataaaataaataatttcagaatgtgttacttagcctgggagatagttaatctgcaaagctggactctgttttgatattggagagacagtgatgaacaagacagacagccctgtccttgccaagcggaccttaaaatctccatctcactttgacactatcacgaagtgtgcacacaggccttttgatggcacagtcttcaccacagatgtatactctttccgagttaacagaaagttctactctcttatcgtaagcagtcctgaggtttgggccaatcacaaaataatgaaaaatggagcatcaccagacgagatctttgctctccaggagtgccctctgggaacatttccctcgtttcccacagccagggcccctggtgccagcaggaagagaaatggacgccatcagtgctttaagatggcaaatgcaagctttattctaccatcataactccctggatcgatgctgacctcccagccaccctccaaaatgttctcccattgtgtattcaggtgtggtggctggtgagtacccagaccacaaacttacataaaggccaggaatggattcatttagattaacttatttccaagcaatgaattaattaagaaaaaagcaactgcaggcaatacatgaatacattggacattacttctctgctcatcacttctcctctgctggttcttgaattcaatcattcatataacatttcataagcacatcctctatgccaggttttgtatagtctctggggatacagagttcatcctgagatgttgttaatctcgaaactgtctcaagaaggcttgccttgtgtatttgagaacaattcaaaatactgttgagataaaaatatttatattttttgatgtctctagttacctaaatttctggataactttgcatacagcttgttaggaaatgtcacttcattcctgtacaattgggactatggttataacatcatcacctctatgccaaagcatggctgggaataccagcattcttacaatggaaacttgtcttcaggccaggctgccaggagctgttctttgcttctcctgaaccataattaatttatagtctatcatttcaaaggagaatgactctgtagaatttggactaagtgcaatctcccaagattgaagatgtaccaacattgttttatgatttactattgctccattttcttctttaacatgttaaattgcatataattactgcaaagggaagaaatagacttagaaatagactaagagtcagtgcataaaaagagaatctatgcatagtcctatgggtgatgcaaaaatatcctgtccacttgatacagctataaattttctttaggaaaaggacattacagatttttttaagccgaaatcattaacagttggtatctatcagacacagatgaaataagctaatccttatatgtaaatctgtaaatctacagggaaacatgaaaactgggtaaatttgagtgtaatatggttgggaactttttaaatctttgggtttttgttaaattatcccttatatattctctcagttttaatttttctgtattttaaaaaattcttagtcaaaaagtacatgaatcattttatattcctctttgagtttttattaatgatattcaatactctaaatatcatgaagttcatatatacctcaagaggaagaatttgaaaggactgttgcaatatatttttccttctttttttacaacgtattatcttgttttcactaagagagtttatttgccttgccatggaattaaaatttatttcctcgcagattctgacagctctataagcacacactgtgttttttatgtacagatagaacaagagttactcaaaattattactgtttgggagagaacaattcactgaaccatcaaaaaatatatccctgcacaaaggtaaagatttgacattagcttttcacagacaaaagaaagcataaaagaggacacattgactttcaaacttcttgacggtagcatttttccagacttcttttcatagtaacttactgtggaaaaccaaaagataaataaaaaagaaataaaaatgtatatttgaacacatactatattccagacactatgaaaataattcgcggggaaaaaaaagaattttcaatcttaataatagttcctattttagaagaagatattgaaaatatttaaatttgttttaaaaatcagaaattgccatttagtcctagtgtcacatggaaggtgtctaattttattctaacactgtgttttttatctacattaactactggatacatttactacaggagttcttcaaaaagcaaaattactagggcataacaatgcagattgttttaaaggccctggaaactttattgtaagaaataattttaaacatttaaatgtcagcaggagaaaatatgaggaattttgaccaagacatttaggacaaaatattaagaaaatgtaaacactgcctccttttcatctttaaaatgtaggaagggctgtgacttgtagaaactcttgctcatgaatggatcttctagtaacaagaatattttttaaataaattttgcttctgattataaaagtaataatatttatttcaataatgtgggccaaaaaactaaaacacgcagagaagaaaacatgtatctaaagactttttggctttattttattttaaatttccctatcaggctcaagatgctaacttaatcagtttgggagtgtcatgcctacatcaggaaatttaaggaaattaagccattaatttaagttactacatatcatgaattctaagatccaagtatggagagtaggtcattgtttctaggggtagatttagtgcactgaaatttcattcctgttttgcccacacagcctctagagagcaatgtcaatccttgcagtctgctttataacacaaaactgcctcttctaaacttcacatccccaccgttcatcctatttccaatgtcattcccttgtctttaaactgtaccaatcagattaatggagaaacagaacaaaatggttccagacagatttgccctgaaacaaatcttaaaacaaaatggagctaacagtattccttggcactgaaatacataaaccttaaatctaagaaagaaagaaaatatcaaatacctgtacatctctataagcatcatgaggaactttaatcaatcccagatgtttaaccctcaaaacctcaagctatgcacaggcattagaaggtcagcctccaactccccacaggtttttctgggaggctcagccagccatccccatcccagcctttcctaatgaaagactgggctaccctctgcctctgccctcccagctgcagacagcctgccctaggatcccttcaacagcaatcacatctcattgttgcccagctctctgccctgatccagaattcttaaaagggtttgagggctaaaagtcaaggatggctctgtgcatgaggttggagacactgctcctcagatgacaaaaaacctgagataaatcctgatctcaggtgggactgagagaatttgagagcagggaggtggccgaggagagtgaaggcaaacatatggagttcttcatctagacagccagtttgggggcagagataggtgcaaagcttttttaaaaaatttcatttttagttccgggatacatgtgcaagatgtgcaggtttgttacataggtaaacgtgagccatggtggtttgctgcatctatcaactcatcacttaggtattaagcaccacatgcattagctatttatcctgatactctccctctcaccgccgccccctcaacaggccccagtgtgtgttgttccgctaaacaatgggaacacgaagcttatcataaggaaggaaggttagtggggaaggcattcagcagagggaagaacatgggcagattgtaaagcaggatgttgttacaagcatttagagcaaacctgggccataccatttggctggaatagagcataggggctgtggggaggtaaaggagcatcatcaccaggaatcagcatggggctgtggagtgtccactaagcagctgtggcaagtcacttcttaccactcactgtcactttcttatcatttcctcaggtgaggaaaatagatggaatctttcagaccctgtagttgtgatagggattagagctgatgtatgtaaagcacctagcaccgaaggagctaggaaagcacaatggatctacatggtggaggctgaggatgtctttctcatttggccatagtttcctattttattaagtgctgacacagaaactttaaatagtggagagggttctaagtaatatttagtccttacacacacacacacacacacacacacacacacacacacacactattctttacttgtaaatggagatgctgcttgcacttcacctgcctgaggaggcccacctttatttctcctggcctttaccacttccttacctacttttattgctatttcaagctcttttgtaaaaggcaggtgtgaaagcatcccacccctcagcccccttgaggacctgggtggcattactggtacttgaaagaaaaggtaatgaaagtaaaaaagaaaaggctaagttgctatcacatttgtcaactctggccagatgctcattagcaacaggctagaagccaaaaatgaaagaccaggctgcagcttggatccaaaaataagggccaggctctgtggaaaatactgacagatgcgagccagaacaaggaagaatgctttgtgtgcgtcatttgaaaaagaacacgtccaagcacccagacataggtcttcatgtagtttatcttagtggccacagtagggttgctcagagcattgttttgcctccaaatcacatgggatgcttgataaacatacagatgccccagctgcagctcatatctgcagaataagaatctgtgtgggggtcctgggggattctaatgcaccctgaagagtaagacctattgatctgagattgggagaattaatgcttgagctatgatggaggctggtaagcacttaggaaatttcactgcattctcccaaaaatcctgtgaactagttatgattattaccattaccatcccatcttgctagtgagtggtggagtcagaactccagcccaggcctcctgatgtccccttacttacttagccttttattctaggcctcaccagcaagagggtatcttcattccatgcccttcaattggtagagagtgccaagggcaagaagccaattcctcacctccattacctgtctttacatcccagcgccatcatgggccttcccctcaggccagatttctaagaatttggttctgtttgttttgttttgattctgcatgaaataaagaaggttaaggtaactatgtagcttccctctcttattgaaataacagtgccctctctacaccatcccgtgattgccagggtgcaggagcatgtctgctggatttaaatcccagcttttactccaccacttactagttatttaaactttgggcatgtcatttaacctctggaaaatagagatggcagcaattgagtaaaagaagaagaaaggcaagtcagggtgtaaagaaaaggatgggctggatgctgtggctcacgcctgtaataccaccactttgggaggctgcggtgggcggatcacagggtcagtagttcaagaccaacatggccaacatggtgaaaccttgtctctaataaaaatacaaaaattggccgggcacggtggcacgcgcctgtaatcccagctactcaggaggctaaagcaggagaattgcttgaacctgggaggcggaagttgcagtgagcccagattgtgccactgcactcaggcctgggtgacagagcgagactctgtctctgaaacaaaaaccaaaacaaagcacaaaggaaaaggatgagatgctaccggtatgagaagaatataaactgtggttctcaaccctgactgcaattagagttatctgaggatcttttaaaaatactgatgccaggattccactcccagaaattctgatttcactggggtgtggtgaggaatcaggtcagcaataccatttatatccccccaggatattcaaatgcgcagttgtggttaaaaacctcttgttgaagatagtgaggaaaacaaccaacgttccacaaatgctctctggttagagacactttcttagtaagggtgagaatgcttactgattgaacaagcaattattactcacttaccctgtgccaggctccagtgcaatggctaaaatttaaaatttaaattaaacttaaacttagtccctgatctcaggatagttgcagtctaatgaggaagtcacagccaaaaataaactatgcggttacaatatagtgtggtcaatatggtaatagcagttagttcaaaatggtaggagaagagtaaatggaatgacttcttctcctttcaaagaaaccatagaatcatgaaataatagagatgaaggaagctcaaggttcctaattttgtgcataaggaaacaagaaatcaagagattggaggtttctcagagtcacagagttaatgcaagagaacctaaaaaattctaatgatgtagcaagacatactttaactcaccaggggaagtgctaagaaactatggcttagcagcactggactctgaagctggagttctgggtcctgaaaaataagtagaatttggacataaaggcatggggaaggtttagattttcagtggaaggctcagcccatagctcaaaggagaacatgctcaccagggtaatgacctggagcttaaggatctcaggtggtggccaacagcttagggctccctcctccacatcaactctagttttgggcttacacctatttcttgctggatacgcaatttagagggatgctcccacctccagttccactcctctttgggggttatactatacaactgagacattgaacatgttaattttacctggtgtattgcttaatttcaatgtgacctagggtttgaacctcttatcttaaattctttagtgacgtaacagattaacacctcaaaatagatgaaatgtctctcaattatgactacatttggtcagtcttgactatattaagctgcagttcacatgtgctctgtttaccaaacttaaaatcattaaatctatattgaaatgtgttgaattggctctccattctccccatactctgaccttggtgttctcctagaggtttcaccttctctcacaccctacacatccttttacaccagtaaatactattgcttccccttcaaaatttatccaaaattcaaccactcctcgccatcctcactaccaccaccttggaccaaaccactgtcatgtctcacctggattatgggaacagcctcctaactggtcccccatgtttcagcctcgcctctgcagtctatccttagcacaatagcagagtgttccttttaaaagaaagtcagattgtgtcacttctgtattcaaaattattcactagcctttcctaggtccttcctatgattgacatgacatgatctggcccccatgaacctcaccttctcttctctggccacactggcttcctccttgtccttgctcatgttgagcaagcccctacctcactgctccctgcaactggaacactctccctccagataagcgcctggtgagccccttcactttctttaggtcttttcttgaaagctcctttcttagtgaatcttatctggccaccctatctaaaatttcaatactgattcctagacatttcatatactctatccctgctttataaaattgattctctaacattcatcagtcaacattatgtattttattttacattttatttatttgtaaaattaacatttataaacactatatatttaacttatttttgttattcctttttctttacccatatatctgtttcacgatgggagaaataattaccagttttgttcactgttgcatcccaataaactaagtacaacacctggcacacggtagactcaataaatacttgttgaatgaaaaagtgaggaaatgttaactgtggcataataaatattaatattataattgcatttacatattctcttcttgatagctataataatatattcaaaccatagggagaccaacctgcactatagaattttataaccttaagatgatttagacccaaattaagggacattctacagaatacttgatgagtacttttaaaagtgtctacatcatgaaagacagggaaagactgaggaagtgtcacatattggagtggattaagaaaacatacaattaaatgcaatgttggatgctgcttaagatcctggaagagaaaaaaagacaatgaaattccaaaaagatctattgtattagtactgtacccatgttaattccctggttttgataattgcactatggtgatgtaagatattaaaatgatctcatctaaatgtctaaatatcctttatactccaagcaaggcagtcatttaaatggtaaacatgttttttgaatgagtacgcaagaagtaattaccctgataatcaccaaacgataatgaggtaaccaagatagatgtgtgtggtgggcagttttcttctttttacctttcatccatcatttttctgtgctatggtagatttactccaaggaacctaacacaggttttcaaagcaaatattccttggtccataaaggggtttaatcagaagacacaaaatagttcaaagagttatctttatactctcccttcttttaaaaggttagaaataacaattgtcagtttagtaaaatcatcttgtaaataacatcccactaatttgagattacacagtgaaataattgtatgccattctaggtctcaggaaagcatgttctcattagagggagaaaaatggttaagaaaactgtcacagagggtttttgagaatcatattaactaacaagtcaccttagttcttctggagtggagcacagtggaaaataaaatcatagaaacagagttcttctgtctagaaggctgttgccccgttcctctccagcaggaggggatgtgtcctgtctgtgagaggcaactcctcctcaggagtagaaagtggaccccacctacactgggccacttacccatctgcttgctggaggcatttcagccaaggagaaagactttcccttggcctttttccacaaaggggcatagctgggtgggtacccagggatagggagaaacatttcaatcatctagagactagaagaactaaagattattgataagcattattcatttttctataagtcataataaagatgtttgtttggtaggaaatattcatttttctataagtcataataaagatgtttgtttggtaggaaattatcccaaaattttaaagattaataacagtcaacaaggcaatgtaattcaatttaaccaacacttactgaccatgtactaagaacccacttctattctagggctgtggagatgcaaagacgaatgaaataaaagtgtagccctcagacagcttactctctagtaaaagatataaactctataaacaagtaggtagaaaacaaatgagtagcaagtgtcgaagggccagggaggtagtcatcatgaacaaaataagctgaatataagaatgacaaactccaagaaatggaagcaaacactttattcttattaaattatggaataggtatgtaataatgtaaatatatataatattcatatgctattttatattaaattttaaaaacattgaaaaaggaaaacaattattgctatatttttatttcataattcattactgctttgacttggaatcagaaacctcacatctttttttctgtaccaaaacatgtttcaggccctgtatttttcactgtgatgtacagaatgcagccttaaacacttatgccaggagggtggttggtttttttcagattaattttggagtcgagcctaaacataggctcttcctaacatggatggaattactactgtaaatggttcttatatctagaatcacctcttccaaaatgtgtgtacaatcctggctttcagcattgctctacttagacttcaaatagacttcagtaccgtttttgcattacagtttgataatgtctaatcatagcccaacataggtgctatcaaaaaataagaaaggtaagctaaataatgttatttcattttcataaagtttgaagtctgagaacatttttagaatttggttttcaatggcatagttttagagaataaattttatggtatcttcatttctggaaactgatctcaatgtaggaaagtagatgaaattattcctttacaaatgaatttcccaaaaagttacctttatctggacggagagaagctcacaaatgaaacatttgtgcaatacttgtgactgtacctatagaaaaatagtcaaaaaatatagataagttgtagagtcagcaaaaagctcaggactttgggctaatcttcactgctaagcagagatagggctatcccctgtgatgacattaacagttaaaaaaatctcttctgcaccacagtgcaagtaagccagcaaattcattaagcaaatgttgacctgattttgctcagagacatagaagaatagccaattagtggtattaattactgaatccatggcttctcccattttagctttgtgcccaaagcaatttctgatgaatgaggaaattaatggacttggggatagtgtacctacaaaatagtgccacctatgggctgttacttgaccggcctgacattaactccacacatcctgagagctccatctataacacttggtgactttgaccaatgcattctacatccaaatggtctgagacctttttcataacacagagtcagccatttcctgatgttttgcctttcatgggctcctgtttctgaagttccttgaccccttcaaaattctcaccacaccacaaataaatatagttaacagtgtgctattctctatatctgtgttctcatttgctgcaagagaaaatgccacccataaattaacttgtcctgaaagttctcaatcttatttttaacataccaagctacaaagttgctcattagactaacatttacaaatgcctgttgaggctctggacacataatttctgcagcattcaaaagagactcttttataaactgtgttgtctgtaaaaaggttttgatacccaggcaattttttcgcttaataaagaactgtatttcacagcaactcacttattttattctcattcaaaaacaaatgctgccatttcttcagtccattaaattttccaacacccatcttttctgtgtagcagtcaaagctgatttttttttcaatggtgccttaagatgtaatttttctttgcaaacattctttgtctggatacacttcccatccacccacccccccccaaaaaaaagttatgctcctatttttttcttataataattgttttttaggagatgcacaagttcattttcctcttctttttacactaagaaaaatatcagtaaacacatggtggtaaaaagctactactctttgatttcagtgctgggaatacaacaggaagatgtggaggctttaattaactgagagggcacagtcctctgatttaggggctgtctacctggtgaggacatcagctctttgctgtcaaaggcagctggaaatcaaaacatttcaagaaaaatcttctaattgtttaaatgttggcaacttattcaaaatttattaaaataccaagtggatcaacagcattctagtcaagcaaaacaaggcgccctgtgggctgcccatctgcaacctctggatacgtagagtataaaagtaaaacaatttataccctacttttattttagtccctgagaagtaagagaaaaggtacaattatatgaatgtattcctatggaatatgaactctaagtgccataattaatttggaaatggtctaataaggcagtgtggtgtggtaaaaaggatacccttcttgaagccagtccgtttggggaatcctgggtattccacttatcgagttggttaattttcgattcctcatctggaagtaagcataaagtgatctggtaagcttcttagtatactgtctggcatttggaaagtgttcttccataaatggtagctaggactgttattacaaaatgcaaaatatgcattttcgaccacatttctttgtatgcctcccaaatatcacttgtgcccaggctctactgctctcactcctgccgtccctccctggtgctcccacatttcatctcacggcctgatggtgtaggcccctgctcatcagcactctctggagtttcccacctcctttcctggccggtgctcttgcctctccctagaatgtctgtccctttcttcttcgttcagttaacccctgtgagactcgacctagctgtcacctcttctaggaagtcttcctagaatgccaccaccctccaatctaaatagagcactcccttttatctgccttatgttcacctcagtcatagcatttgtcaaatggtcttataaaccgtgagctcctgcgagacaggaactgggccaatcatctcactgtcccttacacgtgagtgcaatgcttttatgtggcatgtaattaggaatcaaaagaattcattccctcctttaggaagggaaaggaagggaataaatcctccttttaggaggatctatccataaaggatggaatgaataaatgaggtgcctggagaccagcatagcaagtgcccactccacttcagcttcccttctactttacaaagtttcaaacgtctttggctgctgagtgtgcatctctccccttgccttcccaaaccttactcctgctgctgtctccactctcacccaaaccagtggagatttccattctggaatggcaggttatgacagagaaggcacataagtgtcacctcctgagtcttgtaagtgggcactggaaagacctctaagagggtttcttttgaaaagtaataatgaataaaaaatacagccactatttggaggcaaagaaggggagaactataaccataacccaaggtcttaccttcactttcagaacatgtggcttcttagctcagtgggagcaagaatggatcttgtacactagcatccatggtccaatagcagaagggaaagcatcttctaggacagggcttccaatagtatgtacagtggctttcagtaaagaaacagcagccctttctccagagggatacagaccccttctggaatacttagtgagaagaagacagactagaccaactagaccacagcccacatgtgcccctcatccaggtacctttgtgaactacccatacaacctattgaggtagtcccaaagtaagaatttcccttattacgcacaatattagaaaaatgatgatgaataatatgcaaatatttattattttctaggaacatgggtgacatttggaggtcaaatttcagatgaggtaagttacctttggcctctattatgctaatgaaagaaaatgcagagagagctgtattgcaggagtcctcttcctgggaccctgacactctacagggataaggtttaattcacaggaaatggtaaaattgactcagagattattgttgattttatttttcctgttgtattttttacatttagactattaatagcccttgaagctgtacattatatatgcaggttgaacagtcagagaatgaaacaatttggaattaacattagtcactttatgaaaagattgtattgctgtgatgttgttttgctttatttgtttgtttacttttagctgcaattaggatgactaattggtctcagtttacacagaagtttctcagttatagtattggaagcccacattgcagaaaccctctcagtcctgggaaaactgcacagttggtcacctggcttgggcgacttaatctaacctctctgagcctcagtccatcctatataaaatgagatgctaatgctaactttgatggtgatctgttgaaagaattaacacatcatgcttatcagatgtttatatagtcctctgactagtaggtagcagacactcaataaatggcagctatggtaattatatttacaataaaattcctttagatcatcatttgcacagtcaaaacagtacttaccaaagtgatatttttatcatttcctttaaggaataccttcatggcataagtgaggtatgcaggcattgagcaccaagaactcccctgagggcaatgccctgagtccctctgatccttccgtgtctacctgcaagaagagtcagggatagtgtctctgagtgggtgcactgagtgggatccagtcccactctaccattgaccgacctggtttactaacatttatgtgtactaatggtggccacatcaataaaatgctctaaccctctaatcagcaggatggtggttaagattaatgagatgatgcctgtaaagtgcttagtggggtacctggcccagaataagccctttacaaaggtagttcttactatcattcctaacgagacagttgggaaacagaggcttttctccacagctccccaaatcaccagtgttatttagcagatctgagagagaagtcttaactgtatattcttgtccatcctaatgcctgttccctgtattgggcacatgtcaccttataaggcttgtctcatgggggctccccagggatgcagactttaagctagagagtagcatgcaggacagttattaggaagtgttctcaggatcagcacagggcagggaagaaagcagcactgggcagacagagaacttgggtcatgatgcagcctcaacaatgacctcagccaactccatggggatctccaaagctgagatggttctgcagagttgtctcagtttgggacaacataaaggactgggcctttatgtccttttactgaccagtcattggaccagaggctgatcgggaagcaggtctgacctcgggctaggtgactctctctagccaagtgcaatttccagagagggctgacagaggaaggccatttgatggcagcattcctagcagctcagggaataagtccctcggttccaaaggagaacctgagggcacatcccagagtttactacaggactctgtctgactggcaccaggaaggggtgtatggaggaggcacaaagggaaagccacagaaaccagagcacaggctatggacttgaagtcccatacaaaataggtggcaagcagggagggaggcctacagttaataatccactgtatccagcacatatataacctactactgatggtgcttggaagggaaaaagacagaaatatcttccctttctgagcagattggccaagtaaagtgcattatttccccctagtcttcactctcctcttcacagtgtctgctctctgctgcaatgagccaagcttgcccgggtcgtagtgtgaagggctgacctctgagatgaataatttcaaaatttcaagtctaaaaactacgataaagctgtcatgaatggctgctgaagcactcacctcagatgcagaccaggaaaatagctattgtacttccagagagcatctgtggccttccctgggtccctgaagagagaataccagcaaagagaagaagggagacacagccagattcagcctcacccatcacagaattatttgagctcaatgctttccgtgtagcaaaaatgcggaccaatagcagtgagttcacctacctcgattttcctgctttctctctggcgtcaaataatctcaacacaaagtacatgcaaatatggaatactagggctggccacaccacagtgtgctgagttaattgttgataattacatgactgtcaacactttctcaggaggtggggatgtccccatcactgggagagttcatttattgaattaccatttggcagggatattatcaaaaggatacaaacaccaaactctgtaaggtgcctctcaaagatgatttggcttcatcaaaaaataaagatagatgttactgatatgaataattatttacttaaaataatgatgagagcatattaacatcttatagcacttaattttcggagttttatttacatttttttatctgtaaggtagttaaggtacctttaactataggtaacaaaaacccaactcaaatcaggttaacccataaaagaaaaattattatgacttttacactagaagtgtagatgaagagcaaacttcagggccgcctcagtctgtgactcccagtctgcttcccagcgagtctctggccgtgtgggtctttgtgtatcgactgcttaagaaaggcagctgccggaaacctaggcctcaattagaacagtgactccggggaaagggtgttgctcctagaaactcagtaggaacaaagaataatgttcctagaagtctccggcaaacttctcctcatatctcattggccagggtgtgtcacatgacccttcctgagcaactcactcgtaggccccccaggcccccgctagagggaggtgaagtcagctttgcctgaggcctctgggcttcatgcaggaggaggagatcccagaacaaaatcaaccccattttgcaaaccaggaagctaaatttacagagaggtcagatgatttgcctacgtttatttttctagtaagtaggaccctcaaggccagaaatcactcttcagacttagttggtgatgtttttcattatttcacattcagtccttcaagttcaatgattgggaaacatctctgtcatcatttagtttaaatcttcatccagaattctccatcttatcttaaaaaaactctctagataagatttgtgtacatatccaataatataccagtatgtcatatgacatacacaggctaatataaaatagaagcacaataatttttaaaacataggacagtcataacaggaaaaacttgtcttaacttttaatctccagttaggatataatttaaaaattgtaggaatataagataaatgttttaatggtagtaaattaaaagcagtaatagcatactattatgctaaagaatctggatggactccattttgctagcttaacatttttcttggtaggctaatttttaaagcaacagaaaaatagtttattttggaaatgcggatgaagcaactttagcctgccatcaaaacataatggaaaaatcaattaaaattatttgtgaggtgtgtaatttttcaaatgactagtaagtcaatcggcaaaatgaaaaaatggcccttctccactgctgtttatggctatccctctctggctattccttaagctgtgtatagctattctgtactcttctgtcatactcaccacttgcgttcagcagcacaaagcaaggaacaaggagctttgaggtctgtttgcaggcggaacagtgaggagctgggttcctggtgagtcagaggcacgctgccgcctctctgtgttgattcaatggctgctctacaatggcgcctgagattttgctgagctgtgggtggcaggagttttacaacagtcacagctctgtctcagcctcaaggaaaaagtcacaagctttcaggtcaggagtcatccagctgccaaaagttattggcttggagaaaggagttgaggaatggagtcacacagtgatacaaatggccctctttgtcagaaagattaagatgccataaagaatgttgtcaaaccagctcttcccagcccagtgagaaacacaaatctatccactttgggcaggctaaatcccagccttcaagtaacccctcagtgccctatgtctgaaggaaagaatacttctgtcctatggatactggctgagacttctttctttccctctccactaaaactaagaaaaataaggagtggttagtgagaggtcagtgttcctaaagaccggtagaggactcaaagttgcttccaggtttggaaagcatttggcttttctgagtgacctttctctccccttgcaggttgctgaacggctgatgaccatcgcctatgaaagtggtgttaacctctttgatactgccgaagtctatgctgctggaaagtaagtcagtacctgtttgtgtcactcaaatggcatctgtagcaccaaaagaatcagcccagaccatttccagcatgttggtgaaaaggttctgtcctttctccacgtgttggcagctctgctctgttctgccctctaccaccattactagaattggggatattgactgtctctggcactctctgctcacccaaaccttcctgcttctggaccctgtatgaagaatgggctgaaggggtatatgaccaggaagcaattgccatgtctatgtgaggggcagcggagtctgatgccagagtagtggcagaggagattgagaagtattagttgaatacgtgagtgaccaaatgaatgaacagattccaaaatggttgctcaaaagttagtctttttatttcataaccatatctcatagtttttcagcccctgaggaactgggacatcctccttgcagggaaacaggagctctcactgttgaactgcctgtccctacactagcattacagaaagattagacgtcaaagtcaggatcccccaagatgccaaagaatctatcatcttttgtaagaggggatctcagagcccattctgaggacaggaagggctgcagagagtcctcgcttcttttgtgaaaggagtcacatccaactgcaaccttcctttgaacccaaggcagatttggagccctaagacagggcttgttaaaccagaacacataggaaatgcgccaggccaggcctcaaggttcaggccatccaagtcccagcctaaccagcacatttcagaatagatctggggctccctggcctcctactgggaacatggatgtccagctctcagaaccaaggaaactaaatagctgcccagctgtttgaacagctctgcaattttctaactgaactgtgaggtataatcacctgcaggcctaattcacctccttccaggttagaattacaatcaaattgctggacttgctgaatcaggatgatcagtggatggtcccagtgcattttccttgcatgagtttcctccttttcaagaagaggtctatgtttaaggaccatcaaggaggttcagagctcacattcttgatgctttctgttgaatccaaggagagaaagtaaaggttatatggtcttgctcctttctgccttctacccctttccattgttttcttcttgtggaatcctgcttagtaccaaatggcactaaggtagaaaaagggagaagtaagtagcaagtctgttagagtcctgtttgtattactcctgtgaggataatcgctctgattaattattgattgtcggtctataattgagataggtttccactgtgaaatgcaaggttgcaaaaggtaaaggagagatagggaaaaacaaaagcaacaccaatgtaagactcaatgcttgtctctttggggcatgctccacagctaacccgcatcatggcttattgcaagctatacactctaacaaagacagaactctcacttaagaccaataatgactagccatgactcccatccatagcatcctaatggacaaggtgctaattccactgatctcccattcactaagcctctgagaccccagctgcttctgacaatgttggtcttactgggagggacatagaacatttgtctcctcaatcttgggtcccagcctgggtaggtggaagaggagaggatggtggatgccttcagtatgcctctgcaacccagccttaggggcaggaaggacacttcgttatgtcttcctctgttttgctcctatgacaaagtttgtcactggaacctaagatgttctgtacgcgagtgttctctatgtgggacatctaaacccacacatcggttctcagtttatacctgggagcaaatattttttatctaaacaatgtgaggtgtcattgttctccatagtcacaattgaattgcttcacagcaattagaaggaaaactgactccctttggacactaccaagctggacatttatatatgggatcattggttcaaaaacaccaaactgcaaaatgactgctgctgcttagtatcaggactgcaggcggtctcctgccagcgtgtcaggatttggcaggtgcttctggaatgctccggagcaggattttgcaggcacaagcagaaacagcggaaactgtgctaccagccgagagcggcttctattttcgggatatgtaggcactgagagttcaaacaaggaatggttcttgtgttctggattgactcttgcttttccaggacactgcattctaagacattatctgtttccccttccagggctgaagtgattctggggagcatcatcaagaagaaaggctggaggtattgcattcgccataattatttgtttttaaaaaggtattattttgcaccagagaaggaaaaataaaattatatgacacctgaccaaaaggctgtcaaaaaaaatcaactgtttttaaagcaatgatttatagtggcttgaaaataaatgccggcaagttcacttctggagcttcaaaaattactgactagtcattgatcacaatgaattaccaaagagttgagcagagaagggggggatgttcatgaaatatttgtgcatgaaaaagtgacaatttcatggcttctgactgccatttgtgctaatctcttgcaggaagtaacttgacaagaagctgattatccccccacacacatgcatttatgtttgctgtttattttattaactctggatgcaaaggaatgatgaaacaagaagactttgggataaataccccaaagctttcttatctgaacacatttagtcagcatctctcctgtgtgcccaggaaccctattatctggctattcagaacaatgcttcatctgctatccttgagaaacatgaggggctgtgcttacacgtccctttccaacacctcctgtagccaaagatagtggtaataagggaagctataacatctatgggcagtggggaggtaatacttccccatttcactatagatttcagccccaacagccactacttccccagcacgagtacagaattaagcaaagcccagcaaaggttactgaacaagtttggggtcctcctctgccctggcataatatctgctgattaccaaataaatgacagtgtaatgatattagtgaagacaactgtggaaagagctgtgtactcatgcttcaacacttagcatgtattttctaaaatttagtctagagaaaatggacattctcaaagagttcaagagtggttttattatgcttttgcacacatgatttaaactctctctaggaagcaaaactaagaaggtgaaacagacccatgtatttttagggctgcttactccccactctgagataaacttttggtaggaatagagggccctgtggaaacagaaaaccaaatatttatagagatatgaacaaataaactttgatgacctactttctccttctcccttctccctctcccccatcccagggaactgtaaggatgttaatagaaaactatattccaccttatatatggaaaaacattcatgttcccactcagtccttcaccttgcctgagttactttcccactcagagtattggtttacccatcactgcctaaatagagactgtatccattcgctatggttgctgcaacaaaggaccagaaactgggtaacttaaaataacagaaatttattcttgcatgtttctggaggccagaaatccaaaatcaaggtttgacttcagggttggcagggccatgctccctctgacattctgggtaaagttcttccttgcttcctcttagcttccagtggttgccagccatcctgggcattccttgacctgcagctgcagcactttaactcttctctcatgtgtctaagtgtcttctgataaagacaccagtcatattggattacgggcctcctctacctattaactaattatatctgcagtgatcctatttccaaataagctcacattctgaggttctgtgggttaggactttaacatatctttttggggtacacacttcttcaattataacagaaaccttggagataattccactaatagtacagtgaggtctgcaacaaggcgtaggctgctggagtacatctaaggaaggagggaaagtatcggtgcagtagctcttttctttcttaacacccagagaacattaaattatcactctccatagctgcagaacctattttatataccttttgtagaaaatagatcaccatgcattttccacaaactgcctttcattcttgcaaataaaaactcaagctattattatactccataatgtttatatcagttcacagttgcccccgtgagactggtgaaaagataaaccatatcatcatagctttgagcctataaaagctgtttcaactagcacacttgacttctggtcctggcgctaccacttgctagctgtgttatccaggacaagttattacacctctctgattctcaatttacccacctgtaaaatggacagcataacagttcatgaagtgtcatgctgacagagtgagataaggtatgcaaaagcattttgaaggctgtgctgtatcactgtaaaatacattatcattctctacccactcagaagagttgctctaatagcctctgtgggagtcagtgacaatttgccaggctgctgtctactcttgctctttgaacatatagttaatgtgcatatccatataggccaaatgttttacaggaagcctaactttgaaaaactaagtctgtggcagtgtttgtatagaatatgcagctttgaataatcaaaaggactgcattcattttttataatattccatccagctttttgttgaaggttgaaagtgctaaaggagaccgggctcccctgtggcagattgctattataataggtatcatgaggttgatgtattaacctggaaagtacatcagccctttcaggttgtgttatctccaggtacatgtatttatcgaccttccattatagtgattcaaattacttttggggggattcacttcagtgggatggggctgctaacattttcaacaaatttttcttgttgcaaccaagttgtcagagttgtcaccatcattccccattggttatcattaatcatactaggtttttatacctgagagccctgaggcgttgaccctacagatgatggaattataaacgccttatttcaagcgctcctgaagattggccttaacctttgaatctcaaatgatgttttctctagaccagtgcgatcaaattacataccgagggaaaccaaattgcactgagatctgcttcccaattttattgtatacctgtagttctcaagacatatttcttattccatgatcataatgctaggattgcatttcctgcccttggttgtggctttcagaaggtaataagtttgctgatgagatatgcacatttcattcccctagcagtaaaatggtagaaacttgagttaaggactttaggactgttttcctaaaatgacatttccatttaataagacactcaaagacatttttttcctgtttgttctaaatatttactattataattcacttcatcatttaaatgtctatgtagtcagttcctgcctgtgaatgtgatgttagaagggataataacttggagccacaaggatccatgttccttggcagagtggagtcctcctgggaggagttcatatgcaatcagcgtgaggccagatactgaatacgtgttcattgttgtttgttcatttgacttactaaagcaattcatcccctcagtcttttcactttcatccccacacgccatttctgaccctccatgctggcccaccactcacctttactttgctatgtcgacatgggcttgctgtcagttcccaatctgacttgttatcactgccctccacctcctccaggcaaagatcatttccattcagcctcttcctctaggatccgactttgagtcccccgcactagcttccctttgtctttatttcagtgagatggattaacaaatttacctctttaccaatttttaaaatgtgaggtataataacaaattctttctggtgctattataataatatgactcggtacaataacctgcatttatttactacttctctgtgtttgtctttttgatatacaggaggtccagtctggtcataacaaccaaactctactggggtggaaagtaagttatttttcctactaaacagaaaacaactagtagttcatgcttttttgctgttaggcagttattttacatataacgtaccaaaattaattggcttagagagagggttttttgttttttttttgtttttttctcacactaaggaaatagcaattagcctaagatttcattttagcaaggtaatcccaaagaaatttagtgcaaagcatgtggtcacttgttactaagtgattaatgtagatttttcaaataccaatctcatacttagaatcatttccaaaatagagttcaaatttgaggaaagaaaaataggcacaaagcatcacagaagaaaagtcactcaaatctgccaaaactcagagacttctacagaatgcaaagataaaaatatcttgtctggctccatgtctaagtctctgatcatttctgcagagggctctgaaagtgctgatcaaaaggaccatctcactggagaataacatggagctacctgtatcactcgctgtcaggccaaatgaaagagaaatgctctctgttgtgggatacagagaagatttcacaggatgaattggcttcttatgggcctgctggcatttgaactggtacttacattattcagcaggacttagaaggctggcctttttgacaaacatgtaagaaaacagcaagatattccatataccagagcaatcattggtactgtgcttttccatctttgagacagaaatcgcaaaaaaataataataataataataataatgctggagttttaacaaaaagcaaaaacaaacaaaaccttatttaccttcctataattgatagggaattttttttaattagaggcagaggccaattcttctttaggaaccttctaatcaaaatgtctatgtgtatatacacacttgcaaacacatactctattttgttgttggttttgagcctatttataatgatatgaagacagaaagatggaatttaaattttttattcctgtagtaatctgtacaaaaataaagcaacatcatgcctatgagaaatgtggattttcattgcccgagctttgattcacagtgccattgctcagtgctttcgaaatgctacaaaacctttcaggaaatgagacagtctgcaagaaccattatatagtagaatatgtagtagaatactacctacggtattactaatgtacttattaagaataccaaataagaatacattcacaaaagtgaatggtaaatattatatttaaaaagaagctgccaaaggtattgatgttgaagaaacatgttatggatactttaaaattcaagtaccatatttcattctaattggccagagcttgagaattgggaaggcaaaagtccttatgattaagggtctgtcttctgggggtacgaatttaaggaacatttgcttcatcacattttaatttagttttaaaatttattttggaagtcaaaaggcacttccaaatttgcttcctttatcagaaaagctaacaaaaaagttcagcagcctggcaatcttacaataaactcacaaacctatgtcaagcctttttattttctctagattggttaagaacaaggtgaaaaggtcgtacagtgtcttgagttaaatatggacagagtgtacgtggctgagttgctgttaactggagcctggtgttgagcatgttagtggcttggtgacagtcgtggatgattcatctactgagatctccaaagaaaaggggttcagtgtgttgcccaccagacttctctccttagcctccctccagtggtgtagaatttgataagaacagggtgcaaaattagcaattcagaccagagatttagagaagaaaagaaagcacactctcattcaaagttatttgcttctttttcttggcagagctgaaacagaaagagggctgtcaagaaagcatattattgaaggtgggtacttctgcttcaattttatttttggttgtgggcccctcattcaagaaaggtatcaaccaaacaaattcagaacacactggaagaggaaaaagttctatatgaaaagtgccacaatcaaccaagtttcttcttggggttaaatatagggaatgcagagatgtagaggggagaatgggaactcaaaaggaaaaggcaaaattgtatagaactcttctcattttcagctattactaatattaataaaacattctcataagactttttaaaagagctttattgagatataatgtacgtatcatgaaagtttacccatttaaagtgtacatttcatttgttctgagtataattacggagttgtacaccaaacaccctaatctaatgtgaaaacatttttatcccccctaaaataaactttatacccactagaagacactccctatcacctcctcaccccctcccacagtcccaagcaaccataaatctactttttatctctatagatttgacaattctggacatttcatgtaaatgagatctcatgatatatgatattttgtaactgatttctttcacttagcataatgttcattcatgttgtagcgcatgtcagtattttatccctttctttgccaagtaatagtccactatatggatagccacattttgtttatccatttatcagttaaagtgcgtttggcttattttcactttttggctactctgaataatgctgctatgaacatttgtgtgcaaatttttgtgtagacatatgttaagactactatagtttttagtttttattttattattatttagattttttcatatatatattttatttcaatagcttttggggtacgagtagtttttggttacatgatgaattgtatagtagtgacctctaaggctttaatgcactcatcactgagtagtatactatactgttttagaagggaatatacatatgcataaaaaatgtgtagaaaattaccactaggtaattgattcctggtgcattacttttgcaaggcacccaaaactttgtataatttagaaataaacaggaaataaaacagtcaacaagaaccattatgtaataaagtactactactctacttaatcgtgaagattgtgagaattgtgagtaatttttatttcttgcttgtctatatattatcaaactttacacttatactttttgcagtaaagaaaaatgttaagagtttatactagttcgtgaagtacagatgctcccaaatttatgatgggattacatctcaataaacccatcttaaattgagaatatcttaagctgaaaatgcgtttaatacacctaacctactaaacatcatagcttagcctagcctaccttaaatatgcttaaaacacttacattgccctacagttgggtaaaaccatctaacacaaagcctattttataataaaggctattttataataaattaaatgtcacatgcattaataatttattgaatactgttctgaaagtgaaaaacagaatgttgtatggaaactccatgtacagtttctactaaatgcatatcactttcactacatcataaagttgaaaaaccataagtcaaaccattgtaagttgtgaactatctgtatttcaaaaaaaatccaagaattttgtaactttggattcatgattgatcattgaaacaagtgattttctcctttttaaaaaatattttcatttaggaaatactaacatcaccaaaaatgtaaaatgtgctctaatctcaccacttcgaaaatcaaaatagataaggaagccaggttctccatttgctcatccaatctcatcccatcctagagtctgacaatctggtacacatcttcttcaccttttctctatggttgtactgacttatctgtctatccatccatccaaacactggcttatattttaaatatatatataaacagtagaaccaggccacaaatattaacctaagccttgatttttttcttaattaaaatacacaacttaacagattattttcagtttttagcattttaaagaattatacaagtgaccatccttaggtaaatggggtagattccagagtggcattgctaagtcaaagaattatacaaattttaacacaaaatcactttctaaaaggaatatgccatcctgttagatgagctggtcttatttatctccttatttatatatttatttattagtgagtttgagcttcttttaacaattttgttctttttctggaaattcactcttcatgttgtcaggctatttttcttttgatttctttgtcttggtcataatactttgcaggagctctttgatactagtgatgttcactttttgcttggtcatatgtattgcaaatattttctctcaggctgtcgtttcattgtgaacttttttctctccttgaacctaagagctaatgtttcatttgagtatttttattccaacttggaagctgaagatctttatagacctataaacaagactacgttgaaatatcttagacttgcaatagaaaaaaaatagtttcagtattcaatcactgaatttaaaatgaagacatttgaagccagatctcagaatgtatatatatgtattctttcttgattgccagtgtgaaccatatgtgtgtgcatgcgtgtgtgtgtgtgtacatagatatatgccataataattaaatcaccccattgtttccaaagtctttgtataggtttggtatctctcactgactgtttttttaatataattttaagcatatgggctttcaaatcagacctttgttcaagttccaactctgtgatttatgagctggtgactttgtgcaagttacttaacctacctagcctctgtctccttaactatagactataaatataaaggttactatatggggataaaaattatataattcacattgagcacagtgtctgtcacataataagcacttaacgcatgttatttttgtcatcatcattgtccttataagtacaactgctagtcttcattccatggataaggatactctttactaagtagtgacattctgaaacagctacaataagtgacaaccttctagccctaagaaaagcatccaaattcctcacccaaacagcatccctgctcaggccttagtgtcccatttgacattgtaaagtcaaagctaagctgcctctcaaagctgttactgccctagcattcctgctccagcatttgccctcatgacttgtattctcttccatggagtttgccagtgacaaataactcaagtcagcttacagaaccacgctgaatgaacagggcagcagtatgtttcccgaaaagttcttgttttttgttcttttctttttaatctaattaattagaaaagagagattcggaaaatggttcacactggcagttagcaaagaaatataaaatcgaagagaaaaagaatggagaaggtctgctactatgctcctcactgcatctccattgctttaatatttaccagagtgtgtacataatttcagggttctctctttctttctttctttctttttttttttttttttttttttttggagacagagtcttactctgccacccaggctggagtgcagtggcacgatctcggctcactgcaacctccgcctccagggttcaagcgattctcttgcctcagcctcccaggtagctgggactacagtcatgtgccaccgtgcccagctaatttttttgtatttttagtagaggcagggtttctccatgttggccagactggtctcaaattcctgacctcaagtgatctgcctgcaaataagcattttttcaagcctcatatgacataatagaaatatcttaaattccctccacctttaaataagtcaggaattctcttaggaactaatctctgaggatggataaaccagttcagctgaaattcaagctgacccagattcaaactttaacacaaaatttcaaacttttgagatggaagaagaattgagatcatttgttattatgttggtggtggtggtgttattttacagtccatagtttctgccaaagataaagccttgtgattacaagagaactagctcaaagtattttctaggcaggctgaaattagggaattgagtgagttttgcagaaaagcaaggacatgagatgagacccaaaataaagtttaaaaaagtttacaagttattatccttgggtttcattggtacttggttctgtgatgaaggtgacctcactcgacattggagatttgtatacaaattaaattagagaagtaccattagaggataagacagaaagttcaaattgatacagagttcaggccacttctgtgctgggtgaccttagccacctgagttagtttacagagtatacaatgagcttgatttgtgcttaatgtaggtttgaaagaattcatattgaaaggcctttttaatgagcccaaagttcttgacttagatctgcttaggtgtaatgttctccttagattcacaaggaagaggaagaaatttcactagcagattgattacactcatttagaatcacaaagtcccctcaggttctaaaatccaatttactcattcagccattccacaaacattttttaaaccccaatttgagccaatcttagaatttagcagaacagattcctttggtactggctgggcatggtggcttatgcctgtaatcccaacgatttgggaggctgaggtgggaggatggcttgaggccaggagcttgagaccagcctggtcatcatagtgagacccttgtctctacagaaaaagttaattaattaagttaaaataaaatacattcctttagtgcctaatgtgaaggaaaagaaatagtttggtaggtcaccaagtaagaataagtaaatcgcttgtatattccaacagccaaaagctgtgtccgactctacatttgcctttcaggtaaacaattttgttacacaattcaaaacacaaacccactgccattgtttttggagtaggagaggaaaataatctgagaaagctctgcttgaaactttttaattaataacaaatcttaaactctatgaactttaaaagaaaaagacaatctatgatttttcaattaaagaatacatttctgaacaaatggatttgccacaggattttttttcagtgtactacgttcatgtaaacatacatcagccatcaaggataaccacgttttgtaacgggaggcacagccatatgctgaatatgattccagtacaacccagcctttataaaagaagcaggtgtctcaaattatgatgataggtctgctgagaaaaaactagaaattatataaacaatgtatattatttaaggcaactttttttgcaagctagatagaaaagcaagtgcgtggtaggtgtaaaaggtgacaacacagcatgcttaaatagaacccttgcagaatctccaaactactgatttccttgcttccacacagtcaaacctgcaacagtgaacaccccatccacctctaactgtgccaatctgctgactgtctggaataaacatatttctttagaaacctgtgaaatacacttaaattgaattaaggttaccttctaaacagtatggttcttgttaaactttggaacctaaaagaaaaatggacttagattttttttttactgtagtcacttgaaaactattttctttgagtaatttattttcctgtggacttttgagaaattgccagtttacttctaattatctcctcaaggtcagggagcatttctcctgcttctcctgttttcctctttccacagacgctgggttagtgcggaggcacaggctaaggtcaaatagcctccagcaagtacatttgctgcactggagcacttacctccttaggttaagattggctgcccagctgcccttctggagccaaggttaatgcatttttgcatgtctacttaaacttaaaacaatacctggccctaagccagcactcaacaatcatttgctaaatggagatagaacatgatgacttgttttttgaaactaaacgtaaatggctcttaaggagatactcatgaaacatatcttaatgttgatttcatttatgtatttctacaaaattaaagcatccagagaggaaaaagcaggaatatctgatttggtttgcagtcacatgaaagaccaaagcaggaagatcaccaagcaccattttgtccttggacagatgaggaaactgaggctcagagaggctaagggatatcacagggtcattcgggacagcccaaatcagtaccctgaatcccaaaccctgtgcctcgcctcctctgaatgccagactggtccatccagctgccaagagctccatgtagtgactgaggtgctacttagactcaacttggctccccgaccacctccggttggctttccccctgactgccccatttagtaacagtcgcttcacttctcaggccaaaaatctaggagtcattcttatttactctaatctccacaccctatgtccagcacaccagcaagtccatgtattactacttacacaacctgtcccaaatgtgtacacctctcactaactttgtctgagctggatgagctgcggtggctgtgcctgccttcactcttgtgccttcaggtccctctcagcaggtggagccatcagttcaaaatggaaatctgatcatattatttcctctgcttaatctcctcctcactcgaccctccccaaccaatgtctttaaatctcacacagaatccaaagttcataccatggattacaagactttacgtgattgagatttttaaagtgagtggatagtgtcctttagagggacaatttcctttcactccacttcaaagtcagaggagggatcactggcctcagatacttgaatttcttgccaaatatcaagaaagtgcttttcagagaaagaactaaagaggtgggaatgaccaaataccatgaggctgaccttaggatcaagtccatatcattagttccaggtacatattacgaccttgaacaaggaacctgtgccaatagccgctctcaatatgcactgttagtgctccttgggatgaagactgtgtctgtgcatctttaaaccccgagagcctggcacggtctcaggataaaattggaactcaatacatgctcatgggatggaataataaatgacaaaatcacacctgtctgtgacatgcctgatcacacagtgctgtaacagtgccaagttatttgtagcctcttctcctagttactctcagcccacactgagctgtttagaagagaacggagagagagggccattgtcagaaaacaagatacttatttcctctgccaggcataggccagaactgtcattaaatgcccctttccaaaacagggggtctagtgaaaatttttggcatttggtcttctgctgtcttccccctgaaactttccagatgcgaacaccatggtataatttcacattctggttctgtagactatgttacacagctctcccaggagcagcaattctgaaggtgtcagtattgttaggcccactgcagactagagaattgagtctcaaagaaaggtcagagaacccaagtggggtccctagcatgctagagtgcagatttccgacctttcaaaccttgtgataccctgttatttgtttacttagtattcctgtcctttccttacctcctccctgcatacaactgtccccaaaagtggctcatatcatgatactttttcatgttaatttaatttcacactgtttcttgagatagctggtgataccctgtgcctgagcatcacagaaggtttataggagaaggcattagacctcataacatctgtctgccctaatctcttcatcaaagcttttaacaagctaccatcacagacaatcctttctcaatggatggaaaatatttccagaacaatattcaagcactccattttcctgtcagaaaagtaattgtggctggctgataaaccagtatgaaaaatcaaatttaaatgaaccaaatttaaatttataagagcctcatttaacatgcaattaattttatgcctataataaagagactaaagcctctggtctccctgaggaattaaagaggctgataagagaatgctaaatgctgtgccccatggaaatagggtaacatgattctcgaacactgtcatccttttggttgcataatattatatacaatacattctatttcagggaagcattaattttactaaaattaatttttttctgagtattcatagaaatgtgaccaaatggttagggctgaaacataggcggttggttcctgactccctttttaagttcttattctctccttcatattacgtcttcagtctttatagcattagcgtccagtgtttttgtttcttcccccaaaacagagaataatagaaatggtagagctcagctatattttatgttccttaaactttgttccaattagtaaaatgttgagcaaaggcttcatttgctaacccctttatattactattaaaaccaacatttacattaagatggggttggggcagtcatttatttctgatttaaaccattttaatgagttttatgtgtaataaatgtacctctagctcactataagcctattaagtgatccaaaatacataaatattaatttgcattgttcaagaagaaaaacactaactgttggaaagaagctgctttttattctaaattttgcttctggatattgccacatacaagtcactgtgaaggtcattcctaagtgtatattttcctgtgagagtgataatattcctgaaaaagctctaagactttttttattgggggaagtcagcctttcatatatttttaaaacgttctagagtcaattaacaatcattgtattcaacgcatttttgaaactattccaattctatttttttaaagcaaattcttgaaagaaaccaaacttcaactctgaatagtgctcatatttagattttggggtttgtttcctgcttctgctcccaggattgaagggctccctccagaggctgcagctcgagtatgtggatgtggtctttgcaaatcgaccggacagtaacactcccatggaaggtaagttaagaaagctaataaaatactctagaaatcttgattcagtttgagggcttattctgctcacagcaggaaatgaattgtattcagactgatcaaactgaatgtgaaaaataaaaatgtttctgactgatgccttttggcctcagcgtttaaccccaaaaccaatgctctgcgtgctgcgtcttcttcttttaaagcagttgaaggcattgggctcgtggctcccgctggttacagtgctcaccttttccaggttcatttcacttttgtgatttcatcaactaaaacaataaagttaattggaaaggggctttataactcagccatcatcgcgtcacagtaaatcctttgagggtcttcctattttataatggctctaagtctgattagtttccagtctgtggtagcaatgctcagtggtgccaccagcagggattccacagcagtgactgcttcaaaataagatatcattgcagtttgattgttgagtctcaaggagctgcaacattttatcccccttctgttataactgtttgaggaccacagtttaagcttctccctgtggaagctttcagaatgtttctaaaaccagattttcttcgatttacatttatttacagaacttgctaggatgtttgagacagaagatagtttgagaggctgaggatgaattaaaaagaatgttccagttaactgaagtttaaaatcatatggattatcacttacctgaggtgattgagaatgaagatatttgagaaaaagagcaaaaatgaatattctggttatttgaacagtatgatgtggattaccacttttaaaataattagaatagtttgattcacatgagattacattgaaggtaactttgtccttgatgattcaaaaggcaggatcttgtaataaatcaggctctgtaaagagtggttcttgttatagggttatagaagggttatagtaatggaaaagtataaatgattgacatattataaatttttctgggttgtatttctgaccataaaaaagttatggaaattattttccttgccatttgtctcattctcaactacagagaaatgtaaaatatatatagtcttataactaactttctcctacagttttcttctttcttgaatccgggtaaaattaggagtttattataaagcagtatcagcgtgggaaattttccatggaaatgacataaaactgcatattttttgtcaaagcaaagattaggtgtttgagaaagcaaatcataagcattttattagtataagaagtatttattgcaaggataatatgacgttattcaactcttttttttattttttatcttatttttccataagttattggggtacaggtggtagttggttacatgagtaagtgctttagcggtgatttgtaagattttggtgcacttatcactagagcagaatacactgcaccatatttgtagtcttatccctcactcctctcccactcttccccccaagtccccaaagtccactgtagcatgcttatgtctttgtgtcctcatagcttagttctcacatatcggtgagaacacacaacgtttggtttcccattcctgggttacttcacttagaataatagtctccagtctcatccaggtcactgcaaatgctgttaattcattcctttttatggctgagtagtattccatcatatatatatatatacacacacacacacacacacacacgcacacacacacacatatacacacacacacacatatatacacacacacatatatatatatctcacagtttctttatccactcgttgattgatgggcatttgggttggttccatgattttgcaattgtgaattgtgctgctgtaaacacgcgtgttctttaaggaatattcacactgttttccatagtggctgtactagtttacgttcccaccagcagtgtagaaatgttccagtcaattcttaatgacacattaaaacagagcactaaagttatttagtctgcaatagtgtcaagtaaaatgccatttagtggggtctatgaaagactggaattgcttcacattttaagtgcctagtgactattttcctcttttagacagtgttctttgcagttataccatgtacaggatagcagaacatctgagatttttaagaattttgttcccatcttacccctacctttaattttaggaatatattgtaggagtctctcaaacagaaaacataatttgcattatatttatagaagaaggaggaaatcctcaattaggagccaaactatgtgataccaacaagataatgatgtctcttgtatcaatatttattacatgttgaaatttattttaaaaatcttcaaagtgttttaaaaaataattgctgctgcccagtggagttcgtaactgcagcattatttagcctttatgggaatcagagaaaatttacatttttcctgagtagtttcttatatacaattccacaaagcggaatgggaagctattttatcctgagtcattttccaagctcagaagcataatgaagggtgtcaaacaatggagattcgccacttgttgataaggtcaaggcacatggcattttgtagcacagcagcaatcaaccacctcatgctggaatgttgcctgctccccctcactaggaaggggagactcaccccagcaggccaatcaacctctgaggcttattcttctgggaggaccctgcagggacattccacaggcagctcctcatgcaggacttgttccagattgaaatagcttccatgtgagcttttcctagctttcagaaaatgtttatcctcaaacttagtacactcatttgttccaaggtgggcccactggaacaaccagagtttgatataagtctctggaaacacatctatacatatagtcttttctactttactgtaccgggggaaggtactgatctgggaaataaagaagaaataggaaataaagagacaggactgtccggtggacttgggtacatttggcaccctaaaaatggggggaaaacaaggtgcctgtgttagttctggattccatgttgttgagagtcacctttgcaacaattttgtaactcatacagtgtgtgtatgggaataaagttgtacatgtacaatgggggtataccttaggaagactatcagtgtttctaaaaacattacagaaggcaaatgttatttataatcaaattacccttgaaaacactacagtaactctgttagttaatgatattctattggcgttaattaattattcaatttatttttcaaatgtggtgaaaaaatcatcaccagatagttgtccaacctttttttttcggtagtggcagaaaaatccttaatatcaaatgatactactttttttcttgtttcagcaactcacgttggctattttaggttcacttgcatccatttctgtttaagtgacacaacagtggttgccaagtatatattgttgagtatttatatattaaatctacatttattaatactatggacccttagcatttgtaaatcatttttattgatttcaactattatttgccaaccccatggagtcacaacccacgctgacataattctgctgaggcacctcttttaaacacaggggacgtagcactttcaaatgagttcagcccaacccagtgcttgctcttatttgtcactgattaccaggtagcgcggagtacaagaacttggggacactgagagtctccagtcataaactatgcaaatgtcaagggtcatgtgtgtgcccacaatgagcatcgctaagatacattttaaacaacttccatttaaatattattaaaatgccaattgtattcatgtggtttctaccatgaaatgatgttaatcgggaacattttaaaaataaaccaagacgagcttcatccagtttctacatatcatacagcaaccatttgagccagaaaaagattaactgcagcatctttataacatattggcatcatatatctaattagttttttccttcccttatttcttagaaaatcaatagacaaaaagcgagtcctctcaaaagaatggctgtaaattccaaaggtgcaatcagtggagaaaggggtgagaaacttcattcgcaatctgcaaccccatggaatacagttagacattttcaggctatgggaagatgttcctgacaatggaggggagcttgtgtactttttcctctgtccctcttgtttattttttctggttcacctagtagtaagtcatttttctttcacagcatctgccatgccatctgtctctgctacaatatctggcaacgatggcatgttttccagtcctagaaaaaaatcagccccacatcccatttcctccttcttatgggtctgtgttcctcccagtagagtcactgacagttctttatgctctatgaagctcatatccctaattctgtcacttccacaaatccctaacctgtatttcaaaatcttctctcgagctcattagacaagaaaaagttcaggcaatagagtcagtctggacatggatggacacagagcatttgtgtgtccaaggagccatatgaggagttttttgggtttttttgtttgtttcttttgactttctgtcattcccaaacaccaggctaatatctctacctatactcttctcactgctccaggaagaacagattgagcctaactgtggtcatgaaaggaaggtataagcctgtaccacttgtagacaacagcaagaagaggggacacactaacttttcgatctgaaaatatgatttttaaattaaattaaattttagttagttttttattttaaaaacacttggatttgagtccttacttttcatatagagcttgttgccaagactgattattcttacagaattcctgagtcattaaatattatttccatgctgataacggttccagttattaattttttcctgccagcagatcagcacagacataaagcagcccagatgtctcaatttcaaataagagaagcaagaccaaagttagcttcacttattcccatagtatcatcttgtcaaataacccattccataagtatttacttctttctaagccatcttttttagtgttgtcatgtgaaagcaggcatctatggatattcagggattcaggatatccaatgacaacttagaaaatgccagaaagcaaaaaacattgcagtatcccaaattttctacattttgacagttccaaaatactggacctagatatttaacttccaaagtaaaaagttttcaaaaccaaaattaaccacctaaaacctagaaacatcatttaaccacagtagatcaggccttctgcctctatcttttattatcttccctgaaagttaccttcaagccattcgaaaaaacatgatatagaaggaagaaatcttctgcaaatattatcagggagctgtccaatagaaatataatgcaagccacatatatataatttaaattttctattagctacatcattaaaaaagtaaaaagagagaggaacaacacatatcggggcccgttgtggggtggggggcaaggggagagagagcattaggataaatacctaattcatgcagggtataaagcctagatgacgggttgatgggtgcagccaaccaccatggcacatgtatacctatgtaacaaacttgcacgtcctgcacatgtatttctgaacttaaagtaaaaaaaaaaaagtaaaaagaaacaggtgaggttagttattatattttatttaatgtgatatatcaaaacttaccacttcagcatgatccattagtatccaaaagttactaatggcatatattacattcttttttttccctactaagtctttgaaatcagttgtgtacaccctaatttggagcaacacatttcagctgctcagtagacaattttaattaggatcagccacatttcaagtgctcaatagccacatgtggctagtagctactgtacttgaccacgcaggcttataaaccatattcccagtctgacagagccgcagacacatagtaggtgctcaataaatatttattgactagctggatgaatgactgagcaagtgtttgagtgattgaatgaataaagctccaaagttaaatagctccaacttcattttcctctacttgaaaacccatcttggtttcctaacctctataaacattctagtacctggttcaacatatttcaaggagatgttgacaggttgctgccaaacagccccaggacacttacatgctgtttctcatctacaatcacagtagcatccagatgcactgcatctctctttagaaatctgattgatatctaaatgagcagaaatgaataaagggacaatttggcaatacagctgccccctgagtattactgtatcaattaagattatttaatgcatttcatttattaccctggccaggacgttcccaaggcctctggtgtacatcagatcaatttaaccccctggtttgaaagcccgggacagttgagttttcaagaaattaatttggagaaaatgattttcatatccaagaagatgagccaaacccagccaagcttgttgcaaaaaaaaaaaaaaaaaagtgtttcaattttaaaaagcagttttgtttccattttaactgcaaattcaccaaaaattttcctgatactttaggcctatttagctgatgttttgtcctgtacagaccaaaaaaattgtgtcataaaaagacaaatttatttcatccgtcctaagaaatgacaatgggggacagtagggttcacttcaggttctttccatctcaagttcgtctgtttagaaaatctcatgtttctgttcatagtggacctcctcattggaacaatatttctgcagagtggactagggcattagacagacacaacttcaaattctggctttgctacctatcagactgtacacttgggaaaagctactatcctcacagaggctcactttcctcacctgaaaacagaggaaacataaagcaccatctgaatgagttaacaatgtggttacagcacctcactcacagctggggcaaacaaacgtaagctccatttctagaatgccctaggtaaggcatgtaaaactctcctttctctggatctcttctcagaggtaatcatgggagaagtccaaggccctgaaattataatatgatgaaaatctaatggagatagccaagctgcagggctgcacaggatctgtgatgaagtcatgtaagattcaagccatggagttggcagtgtaattttcttatagccctttttttcctcctaaaattttgctctgaaactctttatgccctttaagctgatttaatcataaattttccagggttaatctattcagcctgaaaggtgatcttgtgcctgtgactttattttcaaagatgtctctagaaaaaaaaaacaactcaataataggattaactcattcattcagttgatattcactgaatacttactatttaagcactgttttgggcacttggagaagcagaagttaataaacaaaaatcctatccttagaaaaatcacattcttgttggggagacagacaaaaagttagtaagaaagttacattagatggtgataatagaatggagaaacaaactaatcatgggagggggctaggaagttatgggggtagattttagttaggatgacctaataggaggaaatggtgggcagtggggagggggtttggaaaatagcttggactcctccaaaatagcaaaggtatggcattaagagtcagacctcaattcaaatcctctttctgttacgagccaattgatcttaggcaagttattgaacttctcttgtccctggttttcttatctgtagaacgtaggtaataatatctgctctatagggttattgtgaggattatttgagataatatacacaaaatgcttaggatgttgcctagtaactactcgaaatttagagctaccatttttgttattattactgtttgtatagtactgctgtaatttttttatgcaggaaattaccttgatgcaattgtagtctccaggtctactaccaggttatcctagaggtctcaaagaagaaggctaacacaacaaattaagatgcatgagtcacatggtttatcaaatcaattaaaacacattatgagaagaaagaggggaagagatagggacagttaaaataattacactagaattcacgcaggagaaagaacccagctacttaaatcttgggacacacagtgctcatgtgacctgttctctctatctaccacattgaccttctccgtggtgtgattatataggtcaaatctgaggtttcagcaaggggctcagcaaggaaaagatgcccgggtcagtagtatacttggaaagacacagggacaagcccacctggccatgacctgtagctcatcatttggcctgatgaacagctaaggactatttgcattccttgcacagaggatttctgtggctagaatgggggtcaccaatgggtggctgactgaagacttaagttctcatattttatgtatttatatttagtatatttcaaatgtttgatgtcgtatgcatatggatatgttgtcaatatcacctctttccattcctccctcctatctgtgttcagcatgcacattctctactttgttgatggccactatgactcaggggttactaatccacttagttttaccatgctcatcatataaattctgcctatgtctcacaagctacttgcatctccacccagtttcatttatcctctttctttgtttcactttctttcttgagcagaactgaataatcttaagtcatacagcaaaggcacattacagagttcaccactctcagttgttgacatgttgcctcaggtccggcaaatcttccaggcctgttgaaaaatttccagcattaacaagaggcccacaaagttctgactgtggatcattctgatatgcatctataagaacagagcccctggttaacaaatgatcttttccaactgggttccatagaaagaacaagagctttagagaaattacctttactagaactactgagaagttaacaattgccaaggctgcagaaaatatgtgaagagctggctttaaagaaaactatactccagaaaaacaattgtactcatctggtgttgtattttccgctttctttggaaatcagtgattcccaaccttattccataaagtcctggtttgaagggaagattctaaagaaggatatgcttatatgctatgcagtttacttcctctattttctctcctccctcccccaccttttttttctttcatgacatctttactcaacagcgaaggcagaagagattcaatctgtatcattcagtaagttaaaaaaggaaaaacaaggtgggccaaatgtttgggagactattgtaccttctcacaacaagtctgtggacttcaccaagctccaaaaggatgcttttttcttcttcttctttttcccttaagttgtttttagttaagaaaaaagagagagagagagggagaacagagagtgcttctgctcaccccagctgtcaggtgaaaaacagagctgcttagtattctggggctgtgggtttatgactcatgtgcacttccttctgtgagttgtcatttctctgagagatatttggagttgtgacaaaatttaactccatattctgaggggatgttgactggatctcaggagaattcatttctgtaagttcctcgatctgctgcagcagatctgcagtgacatgcagaggacttggagactaacatgacttagcagcaacacactctgagggtttactggcatgctgattgaatgcagtgagcagagccacctgtgtcagggtaatcgaaaattctcagacagccggggataaacaaataccctcgagtctctctcttactttctgtacaaaaggaagtattaataatgagagtaagtggttttgttaacccccctcctgaatatttaatatgtgtcctaaaaaaatatgaggtctgcaatcagaaggtgagggcgttagtcttaggtatataaacttggctgagttgctcagaccttcagcttctcagtttttcatttgtaaaatgggaagaataaaaatattctagctatttccaagattgttgtgaagacaaaatgagataagtggaaacatgttataaattgtaattgtcctgcacaaatattttgaggttgttgttgttacatatgtttacacttttaggaatatataaaccttggaagatgtaataatcaaagtttcagccagacaccaagaaacaattgaaatgacattttagagtgagatgccagttctccatttgtactttcaaatgaagtgtgcaagagcttgttccatagctctttcttcccccaactttttattttgagaaattaaaaacttatagaaatggtgaaagaataaacacccaatactcttcacctacatttaccaaattgtgccacattttgcctttgtttttccctctcttgttctttgccattgtgacatttcattcataaatattttctccagtatctcctgagaataaggcattcttctatatgaccataacacaatcatcatactcaagaatattcaagccatattcaaattttctaaaatgtcctttataggatttatttgttttgcttttttggggggggcatgaatcctgcagtacatttaattgtcatgactgttaaatttttttattttattctattttagattcgggggtacatgtgcaggtttgttacatgggtatattacataatgctgagctttgggcttctagtgaactgatcacccaaatagtgaacattgtacccaatagggagtttcttaagactcaccaccctgccaccctcccctcttttggagtccccattgtctagtatttccatcttcatgtccttgtgtagcccttgtttagttcccccttacaagtgagaacatgacgtatttgattttctgattctatttcacttagaataatagcctccagctccgcccatgttgctgcaaaggacatgatttcattcttttttctgtctgcatactattccatagtattttccacactgttttccgagggcccaggagggttgctgcatcccattgctggtcctgttcaggttgatcactcgattcaagtgatgtctgccaggtttctcccctgtgacagtacctctttaactttataactaataaataacctagaatgtgattatttgagactatgtgaatagcctgtcccccacaaccttgttttagcacccaccaaggatccctgcctgtgtccgcttttataaggagggctgtgagacggtgctttcctgattccatcagctcctctttctttaggagttggttttcttctacaaagagaagctttcccttctgctcttaccctactctctgttcagtgactctggagctcctcactggcttcaaaagtataaaagttgagagaggggagtaaagggggtctagtgagaagggcacgtatgaagaaaactgtgctgtgagctccatccaccccagcatgggagaaggctgcctcttcattgccaccctggttgggatgggggtttgaaggccattcagatggtttaaaacattacccccatgactggggagcatagtggcctaggagctgatgcatgcctggaaaatccaggggtaaagaggtgggctgactatctgtcttggtggcaccactgggggagtgctgacctcctgggactggtagggaaggtagttacaaatgtctcctgtgtggggtcttcttgagtcctgcccttcagggcctcctggaggatgaaggctggaggacagggatttgagggagaaaatagagaaacagagaaaccaaacatacctgacactcttgtagtcttctagcctaaacaggtcccagcttgggcagaggaaaagagtttgagtttgaagtttgattgagattgttggaggatgtgcttatgacttaaaatgactttaggtctctgtattaccatagaatgagcagaaaagatgtgggaccagtctgagttttcatcaaggccaaaggatacttgctctactgaatgttaaggaccagtaggagatttaaaaaaattaagctgaaggattacattatcattagttatgcttgttacacgtttaaatacctaagtttaaatctgacttaaattacatgcacatgccaaaaaaatttaactcttagtttcagaaacaaatttgtttactttatatgaaaataccattaagtccaatataactggaagtttaggaaaaccttatgtgcttaagattcgagtctccataaattacagaataaagcacttggccccctgtataaaattcatacattatacaaagacatccctcatactccagcactacttcaccccacataccctccttgggaatctgaaaacttttgaggtgtcacttcaactttgggaagtaattatttgttaatgttcaaatagtggaaaatattatatgccacaaaagcctcaacctctgcagtttggaatttacccatcatttctaaatgtatccccatgttaagttttatgtatttgttttaaattcaaaagggaaagcgtgtgttgtgtctagctccagtgaagccaatcatacaaaattgctgataattaaataagatacttttagacttaaaattttgacaatccaaatatagtcagctcagaatttgcttattcaagaaaaccattttgtttgtttttaagggccagtggatggaacagtttgtacagggaagcagtaggaagggaaagaaagcttagtgttaaccaatattcttctgtattaagggcaaaaaggaaagcattgtatcatcgcctttgaaactagaagcaagtttggtaattaaacaaacccaataaccactttaaaatgaatgtttttatctaatgagataggagataaacccatctgacaagagaattcacataaaacttaacaaaaagccaaaaaagggagataaaaaaaaaataaaaaatgggtaagaggaaagaatgaaattttgtttctctcatccctactctcttcctgagcagagatcaaatgttgcaagaccctgtctcaaaaaccctacgtaatgcattttaaatgtcaccatatagtactcagatgacccacagaagaacatgacatagtataaacactcaggtgcaaaacctggccttgtgcatttattcatatccaactaatatttattgagtgtctactgtataccacagcatacataggatttattagagaacaacatagacaaagatcccagcccctgttgggcacattctttctggcaggagagataagaaacaataatataacaaaaagttaaattgtatagaatattagatgttgatgggtgctataaaaaaaaaaaaaagaaaaactaaagcagggaaattagaatgggaatgcttaggaagttggagttggccattgagaaggtagggtttgagcaaggacttgaagaagtcaggtgaatagccataagagagataaggagactacttctggctgtagaaacagtgcaaaggccctgagatgggagccttctgtcatgtttgaggaacgtcaaggacatagatgtggctgcagcagagtaaggaagggggaaggtagaaggagacgagtttagagaaataagtgaggccagatctttgggctctctgaatttttgacaaaaaagtgacgtgacttgacttacatttcaaaaggatacctcctccttggattgagaatacgttataggggcagccttctcaatagccaactccagagtcctaagcattccctccttggattgagaatacattataggggcaaatgtaggagcagggagatatgttaaaaaatggttatagcaatctagatgagagaatagggtgcagatgagggcactagccgtggactgtaatgtggttcagtttggataaataatgaagttagaggcaacggaagttcctggtgaattagatatgagcgtgactgaaagaaaagagtgaagaatgactccaaggttttaggcctgagtcaccaaaaggatggagttgccatcagttgatatgggattcatagctgatatggaaccagctgtggggaagctcaggggtttgagtttagtcatcttgagtttgaaatgtttattaggtggccaagtgaagatgctgagtagggagttagacaccaaagctgaaactccatcttgggatgaaggcataaatttgggagctgtctgcatgcgaatggtatttcaacccttgagaattgatgaaatcacacaagtagtaaaagcagaaaaaaaagaagatatagaaagaaaggactgaggactgagctctgggactctccagtgttaggaggttgagaggatggggagaagcgtgtaatgttcaagaaagaaataaagaaatcacatcaaagaggaagaagggatcaactatatcaaatgttaccgataggtcaagtaagatgaagacgggatcagctatatcaaatgttactgataggtcaagtaagatgaagactgaacattgtctattggtgttaacaatgtggaaatctttaacaacattgacaagagagttctggtgaagtaagaagggagtgggtgagtaaaagccacttagcctctgactcacagtttcctaatttggaaaaaagtaaggaaacatctggaattagcaggacaaagtaaaaatgcttctaccctttccttttaaaaaataaaaagctacccaatacacaacacagagacaaagaaacagaaatagaaacttcatttctcatgaaagtgtcagtgaactgaaaacctagaccaatatgtatgaaaatggaaaagggatgaggattataaatgacttagcagaactgaggaaagattttttttaagtgcctgcagatgagtaacaacttaacatgtaccacacaacctcaggatggttcatctattagagaatccaatgtcacggaagatgggggtgaggcagggaccaggaacaaggtagttctttaaaagaggatacagagctactaaagctcatgtccccaggtctgcagtcagtgtcctgcctttctcctccaatgaaggaagaggagttttattaactggagacattgagttgacaggctctaagctgagagatatcaggcacagagcaaggtggagccaggctgcaaataaaaagactatgagacttgagaccccagaccccttctctcacccatgtccaggtcaccagcagccaggtcacaccctccccatgcagaagacagagtatctcctaggagacaattaactgtcccaggaaaaattctaacagatattgacattgttgtggaagaaaaccctattgaaaattacagcatgaatggcactagtggacaaacaccgttcaagcacaattttagtgctttattcttaaatgtgaactgaaacccaaggatcatctgacattcaaagaaagtctctaacaggaaaagaagctcaaataaatagaaaaaagaaaacagagtaatgcagagagatacagaaatgttcaaagaaactataatatacttggtgatataagagaaggtactacatcaatagaacagaaacgagatggaaaagagcaagaacaacatagaactagaaaaagattttacatatttaaaatacaatggctaattttttaaagtcaattagaatgctggacattaaagttgagaaaatattccagaaagtaaaagagaaaaaggaatggacaataggagagaaaagataagaaaataaggttctgtccacgagtccaacatcttttcaactgaaggatatcttgagagagaacagataaaatggaggagggggagttatcgcaaagcaatacaagaaaatttccagatcggaagaacacaagtctccagatggaaagtgcccactcagtacccaatacagtgaatagagattgacgcaaagaaacattatcatgagatttcacaactgaaaagagaaagaaaagcatcctaatacatttcagagatttaattgaatacacacatgaaggatccagaaaaaagattgctggattctcaacagcaacatggggaaccaaaacaccatgaagcaggccttcaaaattctaagcaaaaagatgatgggcaaactacaaaccaagggtgaagaagtaatgtcattttgactttcctgtctctcaaacacaatttctccacaagctgctggaaaatatgttccaccaacacataaagataaagccacaaagtggaagccatgggatccaattcattaaagggaggagaagaattttccagataatgggaaggaaaacgccaagaggacagccatgcagcaggcacagaaagtgaccagcagagactgcagcaggacgatggagggctctagaagaaatgttgccaggaaaacaaaaaggaactgagtttcttatcagcttgaccatgtggaaaactgtactgagagatatttggagctcggctgtagctccaaatcaaactaaattaataaagcaattgtttaatgaaaggtaacatgaaaatatatgggagaaaggaaatacaatcattatagatgactttgctcagccatggatattaaatacttagtcataaaaatgaaaacacagtgaattatacttacatttgtgagataaacttaacttgcttatgatgtattattttatcattttaaatatcatactatatctggtaagctaatatttaatttaggacttttatgcctatattcataaaaaaaattagcctgtaatttattttcttatattgcctttatttggctttggaggtctttttactcctcttatagggccacaggactctataaataatgaatatttaatacacgctagctatctaatattattccttgatgaaaaaataggaggtgataaaattaggaaacaataaaaagaacagaaccagatagagaactctaagtgtcctgattagcactgcatagtatcagagaaattattcgattctggaatgtaatttggctaaatttaattacaccatcctcttttaaaacatcaagacacagacaagaatgtaagtcttttgtttcaggtctcatagctaattattggaggaactagaactagaatccaattatccagaattctgactcctagccctagtgctcctataaaaatgtatattaatagatactaactatgtcacctctaatttggttggtgataggtacattccatttcaaaaaataaaagtgaattgagcgtttctttcttacctacaataaacgcaggaccatattaagtgctataaagaataaaaaagaagataaaagccttaacatattggttacttcttttaattgctcattctgaagtgcaagcccctccccttgaatctggacatgctctgtgacagctttaaccaaaacaataagacacaagtgatgttatattagtttgggggcccaggcctaagaagctggcagctttcattccacttttttttagcactcactctccaagccctgaactgccatatggagacaccatatatacagagaagtacccagccaatcctcagttgttccagccatcccagcccaggcaccagagatgttagggaagaaattcagatactcctacctcagcttctgtatgactacaactgcaggaggagtcacaagcaacacccagctgagtccaacaaccccaaagctgtgagaaataaaatgtttaagccactaaaaaaatgaaaacacaaaatatgaacttaacccaaagttgagatatgaatatattaataagatagtgggtgttgaaggatatatgagaggaagctaaaggcttcatctccaggagaggtcaacagataatgtctcaaaaggctgaaccaagagagcaatacgtaaatattattgagaaatacagagcttaataccagagtgcacagctacgtaagttggaagtagttccttctgcagtgcatggaaagagttcaagggactgctgctttttgttacaagcctttgagcattgactctttaaatactgtgcatgtattactttgacaaagctaaagagtaaaacaataaccacacaaatgggataaaaataccagtggttttgagtggtcagtattaaatatggctgtgtctgtcaaagtctagacacagtccttagggtttagaaacacacaaccaattttagtttttccagcccagattccttgatcagatgccaacccgtctctcaccagatccctccagaaatatgcccacaccagagccccacccacctcttcctaaacaagctgtagggagcctgacttcttcctcagtaaccaccaaagtgggctgtgccagataatccattgcaggatactaagaaaatattactatttctattttacagcatcctttttctttttttaaaaaatgaatccttcactgaaattatattatcctttttggagtttctatttgttgtatgtacttttgtctatttttaaactttccactgatataatttcagacataaaaagtaaggaaaatagtaccaaagatttctatatgcccctcacccagattcccccaaatgttaacatcttctgtaaccatttagaattatcaaaacctggagattaacattaacacaataatattatataatctgagtcttattcatgtttctccagctgcccactaatatccttttctggccaagatcacacgttgtagctactcatcatgtgtctttcatctcctgtaagctggatcagctcttcaggctttgtctttataattttgacattttacaagactatcgactactttgtagaatgttcttcagttggagtttttcaggcatttcctagtgattaaattcagattaagcacttttggcaggaggaccacagatataatgttgtatccttcccaatacatcatgctagagggtgcagaatgtctagttttcccattactgaagatgttaactttgatcacttggttttatggtggtacctaccaggcttctccactgtaaagttacctttagtaattaataagtctctttgggggagatacattgaaactatgcaaatatcctgtttctcatcaggatgatgcgtaattttagcgttcatcagtgattcttgcctgaaaccagcactgttgtgcttgccaaggtggttttctatttccatcacactttcaacgtttgcaggggaagggggcagattggcattctgctgtaaaaaagaactctctcttcttccccatttatttgtttatttatatcaatatgaactcatagattctgattttgttctatgacttataattcattactagcattattttgttatttatgtccttttgtttgactgattgggaagcataataaaaaatttggaagagcatggctcttagggctgccagtgtttccctagacttttccctgggaagccatcctaatgcccttagttaaatttaaacaccctcctttctcacctattctgcatggtgcctccttctctactcagcacttatcttttcctgctttattgtagacaatagcttatgagtgaaggacagcttgggaactaatgacctgtttctccactgttctgtatctgtcctgtcaaattcctatgttgaaagagattcacgtgtgaaagtttcaaggcaatgaaggccaagtagggaaaagagacttcacattgctgtgtcacagaggagtgccttgtagtcacacacactgagcagccatctgtatgaagtaagtgacctcaggaagcagaatatggttcctgtgggttcccaaagaagttcaagagttaacatttcattccttcaatgtaacctgttatgttctgtcaaagcctcttgatctatcttgctggttacaagcaagtttgccaatttttttcttttttttccaacttttaagttcaggaatacatgtgtaggatgtacaggtttgttacataggtaaacatgtgccatggtggtttgctgcacagatcatcgcatgacccaggtattaaggccagcatcccttagctattcttcctgatactctccctcctcctaccctcaactcctcaacaggccccagtgtgtgtgccctgcagtgtgtccatgtgttctcatcattcggctcccacttataaataagaacacatggtatttggttttctgtttctgcattagtttgctagagataatggcctccagctccatccatgtccctgcaaagaacatgatctcattcctttttgtggctgtatagtattccatggtatgtgaggttgtgaagaaaaaggaatacttttacactattggtggaagtgtaaattagttcagccattgtggaagacagcatggcaatttctcaaagacacagaaggagaaataccattcaacccagcaatcccattactgggtatgtatccaaaggaatataaatcattctattataaagatacatgcacatgtatgttcactgcagcactattcacaaaagcaaagatgttgaatcaacctaaatacccaccagtgatagacttgataaagaaaatgtgatacatacacacaatggaatactaagtttgctgatttctaacttgctgaagtgttctctgtgaacaacagcagactagagccagactgcctgctatcaaatcccagctccatcacttactagctgggtaaccttgaacaatttacccacctttgttgtgcctcagtttcctcatgtgcgaaataagaataacagtaataaccctattctatcatattgctgtgaggaataaagtagttaacatgtaaagtgtttagaacattgctaggcaccttacaggtaccatatgtgttaactgtcatttttaataccccggaaggtaaaagacccttaatattaatgtaagggagcatctcaaaatgtctcatgaagataacacaaaagttcagaccataaagagttagggtgaactaggagtctggagtctgtgcctgatgaatgtgtagtccctgagaaggacaatacattacacattttctatcactgactccttcctactgccctttgcctcacaaccaggcaggtgtttcccctgaagcacaaggaaatgtgtttgtgtgtgtaagaggtgggtttgggaggcagggagtgagttgaaggagccacagagtaaatatgtgacatttttctccatgtcagttttgtaaaggcacaatatttgtaaagatttataaagaaaaatattattattgttttaaatcaatttctttcttatggtgatacggtttggctgtgtccccacccaaatctcatcttgaattgtagctcccataatccccacgtgtcttgggagagacctggtgggaggtgattgaatcacagggacaggtgtttctgtgctgttctcatgatggtgaataagtctcatgagatctgatggttttataaaaggcagtttccctgcacatgctcttttgcctgccaccatgtaagacgtgccttcgctcctcctttgccttccaccgtaagagtgaggcttctccagccatgtggaactgtgagtccattaaacctccttttctttataaattacccagtctcaagtatttcttcatagaagtatgaaaatagactaatacatatggtatagaacgtttgcatacatttttatgataaacccaaaactatctaatactacttgtttttgtagccactttagtgggtcatgtagtagaagcaatgtcttaccatgataaaccttgatgaatcattccttagcagaagattctaatggagaaaataagggaaaacagccaacattgtatggggaatggggaagagcctcagaaacagcaaggaaagtcccaaagaaagagattaagggccccagatacaaccaggcaatgtgtggaatagtgaaataggtacaaggaaataaaatggggcatcctagggaagacccatggagacaggacagcctcttctgtaatggcccttgcagtgacagttgcccagccactactgggtcagcctcacattttaacatatagagtgacagatgctctattttaaaatattaacattaatatttaaaatattaaactcctccttgctgggtaattcactgttgaaaaactaagaaaagcagtctattctaacataccaagttttaaacttaccttttggttagttaacagatatctgacaatataaataagtgccacagagctaaaatgcatttgagactgccagtgagctgagctgcatgagttaagtggaggttttaatatcactaacattaagaaagcatctccttccagacatgtgccatggcacaaccaggaaggaaggccagctctacactattaaaggagcaatgaagattgcttcctgttatagcatgaaactggatttaccagcagaaaatctcattagggtaaatatttttttactcttatcaatcctctgctaagattcttgctttattccttcatctacaagacagaattccttttaaaatagttaaaagcctgtcccaagaagctgatacacagacagctgtataaataaaaatctctagacaggataatagaataagaagttatgtgtcaagattccacatccgtctgtctgaccaataaggatgacatttacacaatttaaaagatcagaaatttaagacttgagtcagatatctgcaatgcaatgacagatgcttccaagtataaaaataactgttccactaatgaatatagaaatattagatgccatgtagaactggtggggtttggttaaatttattttttagcaactcaatgaacattaggaaaactattcttagtgagtatgttgcctaatacatcacattctgataggcccaaaggcttgtttcttcaaatgatatagatacatagggtcttcgaaaagtttgtggaaaaatgtgtattatgaaaaaactgtgcatggactgcatatttattttgtgccaaaataaactcacactaacttggtatagcatgtctaaacaagatctagtttgaggcactaagaaggataagatgtcagtttgaaaagagcccctgtcaaagcaacatgatttctgctaaaattgaagcaagtcaaacatcagatttatagtgaagcttgggtgaaagaatggtgaaattattgatgctttatgaaaagttcatggtgacagtgcccccaaagaaaccagcagtttaaaaacggataaatcattttaagaatggacaagacaatgttgaagatgatgcccacagcagcaaaccatccacatcaatttgcaagaagaaaaattcatcttgcttatgcctggatatggttcagctgcgtccccacccaaatctcatattgaattgtaactcccacaattcccacgtgttgtgggaggaacctggtgggaggtgacttaatatgaggcaggtctttcctgtgcggttctcatgatggtaaatgagtctcatgagagctaatggttttaaatacaggagtttccctgcacaacctctcttttctttgcctgttgccatccatgtaagacgtgacttgctcctccatgtcttcctccccagccatatggaactgttaaatccagtaaacctctttcttttgtaaattgcccagtctcagttatgtctttatcagcagcatgaagatggactaatacatgacctaattaaagaagaccaatgattaacagtggaaagaatatccaacaccgtagatatctcagttggttcagtttacacaattctgactgaaatattgaagttgagcaaagttttctttccatgggtaccaaaaccattgcacacaatgctgctgcagacaagagcagagctttcactggaaactttaaacaagtggaatcaagatgctgaagcatttctttgaagaattgtaacaggggataagcatggcttttccagtatgatcctgaagacaaagcaaaatcaaagcaatggctaccaagagatgcaagtggtccagtcaaagaaaaagcagactggtcaagagcaaaggtcatggcaacagctttttgggatgctcaaggcattttgcttgttgacattttggtggaccaaagaatgataatgtttgcttattatgagagtgtttttgagaaagttagttaaggctttagaggaaaaacatctgggaacgctttatcagagagtccttctccatcatgacaatgttcctgctcaaacaaaggcaattttgcaagagttttgatgggaaatcatgagggatccatcttgcagtcctgatttggctccttctgccttctttttttgtttcttaatcttaaaaataatcttcaaaggggacccatttttctttagttaataatgtgaaaagactattgatatagttaaatttctaggaccctcagttttttaggggtgaactaaatggctggtaccactgcttacaaaagtgccttgaacttgatggggcttaagttgagaaataaagtttatactttgtattgtcatcttttaatttcatctttccatgaaatttttgaggtcccttcatattgttaaccctctatgtgcatcaaatcacataatcaaaagagtttgcatgaaatacaaatgtggatgaagaaaaagggataaagatattttgcttcattctgtttgagcttgggggctagtgggtagggctggttttagagagaaatttaaaactggcttcatcaaattttcatcctcctgaacctgattttttcaaacataaagtgggaatgtaataataccacctcatacggctgtggcaaaacataaatgcagtaatggaaaaattcccagcccagagccaagcacaaggtaggcactcagtagagtccatgccctctctgtccctctgttgccatgtggcctaggaacccagctccctggtgtgacccacaagacccaatctaagcagagtagaaattgttgcttgtctacccagcagccaccctgctttctcaggtgcccaaattttcatatgggggtgactcttttccaagattgccagttgacccagaggaagactgcattactctctccttgccactccttggttgcaaggtaggctctgggttgtaagctaaatgatccttttgtttttcccctttggccagagtcattggtttatgtgacaggaacagcctagagtaaatctcagaagtctttcttggaatgatgaagcagagggcccagctgaattaggtgcaaggaagcacatgacctcacacgttactgacagccacaccagtgccacaagggaaaccagcctggggatagcagagtggagggttagacaaaagattggtcctcagtgatttgtgggaacaatcattcctgaagcaccatgtgactgcatttccagtgacatgagcagataaatcttttacaatttaagacttccaattgagttttcaataacttactccatttaaaaagaaaaaaaacctaattaatacatcaagaagttagagacatctttatttctcagtaagaaatactgcaacccaaagctcaagagaattgcaaaataaaaaaactaacaattcttaaagatattatctttagacatttttatatattatagttaaatgaagggtaacaacaacttatatctttccacatgttgctgattaggtttattaattgtttctgatatataaaaaagtctcgtttagctattctaagttagaataaattggatctatcaaataaacctacagagtaggttaatttccttatttatttctgtatacgttttgtagatcattcattctggtacattcactggaaaaatcaggttattgaaaatcagatgtttgtggaagtatcatcatcaatggcagtgatgagtaactggtaacacctgctttgaaaattttctaggtcaaaactatcttgaccacgttctatgatagaatttgaggggcttcactgactacatatcaatatactagcatagactgcagcagttgagtctcatacagggataagatagccttctaaccaggcaaatgtcctgaagtaggcctttccgtctctactagaggccgctgtcattgtcatctgctcctttgatttctaaaatataattaccctcaatacagaacaccagtatgacaaggggaaaacattaataatgcatgagattccatagtcagcttccattctcctcctcggggaactgctatttacctccatagaaacaaaaggaagggaaaatgagagtccaaaaagcctgcacaggcaagaagaaaccatttagaatattttttagaatattaagtaagtaggaataaaaagattttaaaagatgtgcaaggagtatatggtatatgaataaatttataaaactttactgaaagacattataggagattgaataaatgcagatatatcctaagtccatggacaggaagacttagtaccttttttttttttttttttttttttttgagaggagtctcgctctgttgcccaggctggaaatcgcaatgatgtggtcttggctcactgcaacctctgcctgcgaggttcaagggattctcgtgcctgagcctcctgaggatctgggattacaggcatgtgccaccatgcctggctaattactgtatttttagtagagacggggtttcaccatgttgcccaggctggtcttgaactcccggcctcaggtgatccacccccctcagcctcccaaagtgcagggattacaggcgtgagccactgcgcccggcctgacttagtaccttaaagatgctgtattagtccattttcatgctgctgataaagacatatccgagactgggaagaaaaagatgtttaatgggacttacagttccacatggctggggaggtctcagaatcatggtgggaggtgaatggcacttcttacatggtggcaggaagagaaaacgaggaagaagcaaaagcagaaacccctgataaacctaccatatcttgtgagacttattaactatcatgagaatagcacgggaaagaccagcccccatgattcaattacctccctctgggtccctcccgcaacatgtgggaattctgggagatacaattcaagtggagatttgggtggggacacagccaaaccatatcagatgccaattctgctaaatgtgccctattccaaccaaaatccttccaagcttttaaaataatttgataagctaattataaaatatataagaaagggtaatgggccaagaagagccaaatgactcctgaaaatgggtaaagtggaagggaaggacatgccctatcacagtaccagcactcattatgaaacctcagtaattaaggaaggtactggctatgggataaattgatgtaatataatattagtccctataatagagactccagaaacagacactagcatttataaaacattgatatttgacaaaagtactctagaacatcagtgggaaaagaagggactattcaataaatggacatggaaaaagtggcattctattttctataatatgaaaaaaaaatgaaaccagatccctaccttacaaccacacacacacacacacacacacacacacacacacacacacaaattcaagatgaatcagaaacttaggtgacaagaacaaaactttacaaattttagaaggacaaataattctttttcaaattttaacattttcatttgtgtcagggaaatatcccacatcagggtaagacccatgttcaaactataaaagttgcttttttacagactgagttagttcagtaacattgccaaaggaacccccaggatgctaagaggatcagtgtcctacaacctagtaatgataaaacttttagcttcacaaatgaagatataagtcaggtatctaggaaagttgcacagtcctgtaatttcagttcacttaggtttgtttgtttgtttaaatttgttcattgccttgctccagataaaatttaaactgatgggtttactttcattttgagtgtttttaaatgaattagaattcattgcactattcacaaatcctatagaatttgacatatgcaataatagcattgtactctatactcattgtggatgccacctcacttttatcaggatagaataacctctttaattactaccatttagcattaaccaaacacagcaaactgattacttggaatcaccaggttttagtagaaaacggtggggctatatttagattatgttgaaagaaaaggtgcaattttgtgaaccatattctacataattatttcttggagcatgtcagcaggcagtggtaagtctaggtgagaagctggaaaaactgggggtggtgataaaagaattacagggaaataatgaggatagagtagaaagctctcttattgctttgggcaagtcacttcgccattcttatctaaatgtaagatgaacaactgctgtcttgctaggattaaagagtacatgtctggtggagcaagaaataatattaagaggatatagcatcccatagcctccccttgtagggagagttgtacaaggagtgagcagagttcccaggacagcctgtgtctgtctgtttgggagaaatcacagcaaggtcaagctctcaattcagggaactgttcttacttgcaagttctacaaatgggaattttaggttctaaagttttattttcttagagatgaggtgaaagataaaggtggagggaaagatcacaggggcaatgccacaaagctcaaacaagaccaaataatctctcaacctccatttatttattctcttattattatttttagttgacacataaaaattgtacatatttatggagcacagtgtgatattttgctacctgtatacaatgtgttgtgatcaaatcaaagtcattaacatatccatcacctcaaacatttatcatttctttgtgttggaaacattcaaaatactctattctagctatttgaaaatatagaacaaacaattgttaactatagtctccctacaaagctacagaacactagaacttattcctcctatctggcagtaatattgtgtttattaaccaaactctccgtatcctcctttccctcccactcatcccagcctctagttaccactattcttttctctgcttctatgagatcaactgatttagcttccacatatgagtgagataaatatgagtatttatctttctgcacctggcttatttcacataatataatgtccaccaggcttatccatgttgccacaaatgacagtatttaattcttttttagggctgaataatattccattgagtatctataacacattttctttatcaattcatctgttgatgaacacttaggttgattccatatcttggctagtgtgaattgtgccgaaataaacatgagagtgcaggtatctcttcaacatatgatttcctttcctttggatatataatcagtagtgaaactgatggatcatatggtagttctaattctagttttttgagaaacttccatactattctgcataatagctgtactaatatacattcctaccaacagcatatgattttccttttctccacattcttgccagcatttttttttgtctttttgatggtagccagtctaatgggtaagatggtatcttatgccttgtttttgtttttttagagacaggggcttcctgttggcccgttgtatgtcttctttagaggaatatttattcagatcatttgcccatttttaaattggattacttgttttgtttttgttttttttgtttttttttttttgctgctgagttgtttgaattccttgtatattctgaaaattaattccttgttagatgaataattcacaaatattttctcccattctctaggttgtctctttacactgttgattagctcctttgctgtgcagaagcttttagtttaatataattccatttgtctgtttttgtttttgttgcttgtgcttttgaggtctttcccataaaatctttgtccagaccaatttcctgaagcatttcccctgttttcttctagtagtgtcatagcttcaggtcaggtcttacatttaggtctttaatccattttgggttgatttttgtacatgatgagaaataggaatatagtttcatttttctgcacatggatatccagttttcccagaactatttattgaagagaattccctttcccccagtgaatgttcctggaacctttgtcaaaaatctgttggctgtaaatatgtgaatttatttctagtctattccattgatctatgtgtctgtttttatgccagtatcacactattttagttactatatctttgtagtatattttcaggtcaagtagtatgatatctccagctttgttctttttgctcaagattgctttggctattctgggtcttttgtggttccatgtaaattttaggattgttttctctatttctgcaaagaatgtaattggaattttgatagggattacattgaatgtatagattgccttgggtagtatagtcgttttaacagtattaactcttccaatttgtgaacatgagatgtcttcctattttttgtgtgttctcttcaatttctttcatcagtttcataattttaattgtagagattttttaccttcttaaatttatttataggtgtattatgccatttttgcattgctataaagaaatacctgaggctaggtaatttataaagaaaagaggtttaattggctcatggagctgcaggttgtaccgaaagcatggtgctggcatctgcttctggtgagggcctcagggagcttataatcatggtggaaggctaagagggggagagggagtgtattacaaggctagagggagtaagagagagagaaaagggagatcccagactcttttaaacaaccagctctcatgtgaactgagtgagtgagaactcttatcaccaaggagatgatgccaaaccattcatgagggatccacttgatgatccaatcacttcccacctggacccacctccaacattgtgaatcacatttctacatgagatttggagaggacaaacatccaaaccatatcacttggtatttaattttttgtggctattgtaaatgatattgctttcatgatttatttttcagctagtttgttgttatcgtatagaaatggtactgattctcgtatgttgattttgtgtcctgcaaccttaatgaatttattgatcagttctaaaagggcttctctttttaactcatttattttttcaaggtgaaggctgggctaaagatgaccaaacatttttcaccatggtctcctgcataggtggtctagtgcttcactttggaactcaggggtacttaaaaacaacagttgctgttcagagcctttggacttgagctaaaagtgagactaaaagtgtcccatttcaataacctatttcacattttagaataaggttctgaaatcatatttgggcaatatcaaaggctcacttcaaactgtctagagtcagggaaaaccagtgtgtggcagagaggagaggttgaggaccatgtgctctttagggagggttctctcagggtagctacagggtggaggaaaatgcattgccttcagagacataaagctccattcttgggtcggagttttgaagaaggttcaatttctccagatagaagaggttttattgacttggctcagtgcatgaattcctttctagtctcttgaatctgttctgttctgattcagaatcagtttggccagtgccctgatccagaaagcatattccctataaactgccctgtgaagaccactctttctttaagctttgacagatcagatgcagacaccagccctttttttgcctctcttttcaaagagtcatcagattttagtttttcttcgaaaaaaaacaaaaagaaagctcatatttcccaagtcatttatactcatcatgaactatagccatctgtgtattaaatgcaaagggatggatggatataaccacacaaggcatcacatgttcacaaacacacaatgaggtgaattaagtaaatgctctgttagttttctctccccaaaccatcttctccatcaatgcattatgcaaagaacctctcacgatgacagatcacagaacttcaaagctagatggggtctatagactatctgctgagacctggcccaagtgattttatctttctgagtctcaggttcttcctcaacaaaatgggattcaaatattcccacctaaacagttactgtcaagattaagtatatgcttaattaatatcaatctgctcatttgcattgaagaaactgagatctcagcaaggacaagagatgtcaaaggttagtgactgtgatgggaccaaaaaaaaacaatgtctcctgcatcctaatacatgctctgtaaggcaaatggaaccaggctgtcctcagacattcagcaaacctttaagatatgtgactcatgatccatactaaggatgacatcatttcatttatgattataagtttccagtcctctgaagaatgatagtcctctatctccaggcatcaagctgagaggattctctgcagctcagaatatgaaggactgatcaagattcaagatgattcctctaagcttcaaagcagtacagttataaaccaccaccaccacaagcttctgaagttaaataaataaacaacttaaggtagataaatcacaaacagctgacctgaagtaaaaattgtgcctaggtctaggcctattttttattagtgttaacagcaactcctctgatgaaaccaaattcttgcattataccagtgttgtagcctccatcttgatccttgcctcttaaaaaaaaaaatctgatatcagctgggttgaaccataggatactgtcaatattaaactattatggggctctaaaaatagcaattttatttggttaaatatataatatgttagtgtctaaagtggtgcctttgcttgttagataatcattcttcttttttacataaaagtataacatatttactggaaatgtgaaaaattaagaacaaaattgcatgtaattccactaaataatacaattattttgcatgttttttctcagtattttgcaagcatatttaaaatatttataattgttaataatattcaagcttttaattatgcctaaaaacttcactcctaacctgtttcctcatctagaataagaaggaactgcactggattacctctaaggcttcttttgcttttatcttttttatcttttgcttttatctctgtggccagattaatttgagtacattttatctgatcaaaacattaatttctaataagcatatttttatctttacccctatggcttattgttcatgcagtacaactatttgcttacaactttcaaagttctagggaacattttgcaggaaaaaaagtttaatgtgagctaccacttttggcatgtgatccaatttagaaaattaaaatattgatcaaccaaaattgttttcactcagaacaaatagttgtattaatttctttgacataaaatgcatattttttaaaacattgatggcctacattactgaaacaactgtccccaaaatgttagaatctgggcctatttgagaagaaacctgggccattttcagtttgtgttactgtttcaaattcacaagttattctacacccattatcccacgtcaagctttgaaagaatttcacaacatccatatcatttctcactttacagaaggaaattgagtactcagggaaacaaagtggacctgcagcatttatagggagccacctgtgtgctagggatacagggagtatgtacgagagctgcctgtggcgggtgagcgctggggaggcatcattaggttaaagaataatgattatttcaacctggaaaggagcgcagagggaggacttaacaaagtctttcaatagtttagtcagtttttctaaaagtttgtgattgagagctaatgaaactaatacaaaggccctggctcactgaaggaggctaggacctggacctcagcatttttgccaaatttcccaggcgattctgattcatggtggtggagtggggcggaggggaaagagggagaggaagagagagagagagtagatatcatactagctatctgtttgcttatgtactaaggcaaataactaaagattatagcatgaagcacttgggttagataaaaaagcaaaagaggaaatataggaagacgtttgtatccattgaaatggcttacttgggaatagtataaagcagtgtgtgtcagcattacttgaaaggctgcttaaaacacatatgcagactttgtaatttactaagtctggggtgaggccctgggatttgcatttgtaacaagtttccaggtgctgctgctgctgctgctgctgctgctgctggtccaggagctacaccctgagaccattggtgtagacaagcacgttggttctaaatcctggctgcacactagaatcatcatctgggatgagtttttaaattattatcgatgctggggcctcacccccaagagattctaatataatagaatttcagtggagcctgggcctggatagtttgtaaagcccccactccaggtgtttctaatatgtagtcggagttgagaaccactgggattaaggcttctggaaaactagggaaggagcccagaccaggagagtcacattcagtactgggttatcaggtttaatcacatttgtctgagtctcctttcccagaggcaggtgatgcagtgcactaaactatctttctaacatcctttcctcactcagaattgttattctgcctaggaggcttttaaaaggcatctccatgttatgcacttaacagtatctagaagacagttgatttttcctttcagcaatgctgccctctagtgttcttaattattcaaatcatgtaaaaacccaccttggccatcagtatggttgtttcctattagtaagctaaacgaatttttctctgaaatagaattaaattttaattcatggcaacatgaatctccaaaactgcagcctcttggttctcctgcaatttctccctgcttttgatgttgcagcctccttccaggacaagaactcacagagttcccttttcccaattccaccaagcttttctcttcagagtcaaaactaaacaatgaggaaaaaactaccagcaacaaaaagacctgaggcattggagtgcctcgcagaggctctcctcacctttttctcatttctgctacacatctcatgcctccttttacacttggttcacagtttattgagactagaattcatcaaacaggtgctgccatgtcttcccatgatggttctacaaacctccctgggtcccatcatcttgacaaaagtgtccttcttacctctaggggctctgtccctcctccctctccctttatcaagtctctctccctcttccttcccagccccgaggccatttcatcaataactccctcttcctaggtcactccaaatggcacacaggcttactcttaatgtcccgtgaccctgaatatcccttcagctcctgtcctatttctcttccaaacttattgaatgcattgtgtttaaggcctctccttcttccactcattcttccattgagtggcttccaatggctccaaccttgcttgatcccatcacatcactgacactgaagctgcttttctcatggtctgcagtggtctccctacatatggccaaatccagtggacactgtttggggctgttctgacacaaatgtccatggcgttccaccctgtgggcatggctccctcttgaagtgccctctgctcttggtctgacacatccctgtgtgccggcttccctcctgcccctttggctgccggctacccagcatcctgcatgggtcctctctctaacccctgggctggccatcagaaactcttctcttttctgtctatagactttccttacaaggctcatccattttcatgaatttaaatataatcaatagactggtaactaataaatgtatatacacctctggcccagattgctcactgtcgtatttatccaactattaaatatccacttgacatctcccctttattttttattttttattttttttgagacggagtcttgctctgtcccccatgctggagtgcagtggcgtgatctcggcttactgcgagctccacctcccaggttcatgccattctcttgcctcagcctcccgagtagctgggactacaggcacccgccaccacgcccggctaattttctgtatttttagtagagacggggtttcaccgtgttagccaggatggtctcgatctcctgacctcgtgatccacccgcctcggcctcccaaagtgctgggattacaggtgtgagccaccgtgccccgcccgtcatctcccttttagtatctcacatgcatctccatttttcacatgtccaaagaagaaccctcgatttttctcccaaacctgttcttccttcagtctcccttatctctgtaaacagccagatatctgggaaacagctttaattcctccctttccctgaccacactcagtccatctgtaagtattgtggattctgccttcaacatctattttgaatccatccaccactctctctgtttgccatcatcaccctattacaaatcaccctcatctcctgcctagaatacaacaataccttcctcaagctctttctacttcctccagtcctccctgttactaatgattctccacagcacagagactgttctgaaatgcaaactatattctaccatccccttacctgataaaatgttaatgccttgattaaaccttgaataacatacaaatgacatggtttgccctctgccaacttcatctcatacccctgtcctccttccctcccattgctgggactcactaagctctgtccttcctcagggcctaggcgcatactacatcatctgcctcgaatgctcttccactgttcttcacaaggatggttccttttttcttttttatgcctaaacatgattgctcttcagtgagaccttccttactgcactaaatatgtcttctctttcatttcctgtcccagtcccctgtgttattttctttataacactttacattttataatgacttacttgtttacccctccatctctcactcaacttgaaactccctgagtccaggaaatttgtgtctgttttactcacagaagaatccagcaaccagcacagtgactggcaaacattaagcttttaatacttgtgtgttgtataattaaatgcatgtgcaggaagagtcacaacttccactccatcttcactgcttttgtcaaggactcccacgtgcccaagccacctgtcagcattctgtgcctgtcttacttgatggcagagacagagttaagggagaggccaggtccagtttattctctgttaacctcttctgtgtttatcagcatgtttgattcaccacagtatctccagcacccagaacagcagacacctagtagatactgttgattggctgaactcccagctctgaatgacacaggatgtgaagggaaagggagctggtgcagtgatggagacatctaaagacagaatctatctggggcagagattcatatcattgttttcaacttctggaactgtttatcataggcacgcatctccatttgtataatgaaagagaagaaaagcggttccttacacttttttaatcatatgttttataaatggagaatgaacttcatagttttagttgctaggcaataatttgatattctagagtctttctccaagaaaaagaaaactattttgcttataagccagcttttacctctgttggacacacaatggtgaatgaaagcatttccatcttccaaaaaagaaatcaagggcaattaaaaatagtttacagaaggacgggagcagtggctcacgcctgtaatcccagtactttgggaggccgaggtgggaggatcacgaggtcaggagatcgagaccatcctggctaacacggtgaaaccctgtctctaccaaaaatacaaaaagttagccgggtgtggtggcgggcacctgtagtcccagctactcgggaggctgaggcaggagaatggcatgaacccgggaggcggagcctgcagggagccgagatcttgccactgcactccagcctgggccaaagggcaagactccatctcaaaaaaaaaacaacaacaacaaaaaagtttacaccagccaaacaagcaaagaagctaagaccctgactctggccatttcattccaaatcctgttccgtatcaatctagacagtgcctgctcatgagaaataataataataataaaaaaatacatctactgcaactctactttgagacaaggatttggttcttctgaagggcatttaactgactggtattactgagaaataaaaaatcccaaggcctgtgaccctttgaaactgtcgagtgacctggcatcctgttaaacactgacctgctttgtagaagaaatccaaccctgtctgtgaattttaactaagttaaacttgagggtctccatgctctcttgttctgcagcacatctggctggtgccaagaggatttgctcagctccatcctctggggaagggattcattttcctgtttaggaaatgtgatgtcgagctccatgaggctgatgagcacgctgggtgggaccacaaacaggccccagtgaaatcaattatgtgggtgtcttaggacaaaatttggttcaaagtgatcaaggacagggtgtgtcattgcaagctgtgagccacggtgacttcggctgtttgttcagcatttaatatgtttatctttctgctaaacacattgttgttgagtcacctctcttagagacccattctgtgtgaggtccagctctgcaagtccaatatacaaagacaagcctttcaccttcaatgaccttacattctacaaagttgaaacaaatgccttctcttacttctcactttagtcgggaaggtactcaggctcttaaaaaggtaaatcatgtattctttattaggccaggaatcatcaagcaataaaagtaaaggaagaacttaaaatggtcattatattttcaatatcatttagtgttgttgctgcaaatggaaaatggaatgtcagtttgcccaaaggtaccatcagccttcaaaccatcaatatttcctgtcagactataatgttgtcaccaatattaggctaattttattaatcaaacaaacaattgcattaagcttctaagctttggctagaggagtaaaaatcgcataactttgaaaagtagacaaattcatgaaatgctgtctgtttgaccttccacagaaattgtccgagccatgacacatgtgataaaccaaggcatggcgatgtactggggcacctcgagatggagtgctatggagatcatggtaatttaacttctatttttaaatggctattgagtaccttattattgcttttcagatgccatgcataaattgcaagatcttttgcaaacttttctcacaatcactatggcactggaattctagaatcaattccatcattacagagatggatattggagccggagctcatccgttcagaatacaacagagaatacagtgttctttggtggcaagagggtaaagtgaatttcacagctaatgagatatattaacagagtattctagttttcttataaaaaactgtattaactatactgtttataccaagctaattacagatacttttatatgttagtctaagtcttatttctttaggaacttaaaaatagttaaactacattttctttatcgtagtgtacaattcacaccttgactaatttgctctggacttaactcaatccaaaccctcccaaagaattaataagggtttcctacctttcatattgctcttagtgaaatcggtggtgacaaatttgcttattatttggcatcctacatgtttcttggtttgtactgatttcaccaaagtaaacatttctcatgcatacaaattacagcgaagccttatttctcatcagtataaatttggttgtaatctcattcctccctaggaagcctattctgtagcaagacagttcaatatgatcccaccggtctgtgaacaagctgagtaccatcttttccagagagagaaagtggaggtccagctgccagagctctaccacaaaataggtaatcttcaaaataaaagctactgagtatttttaacaagagaaagatcactgattcggggaaaaaataaaaacagtgttattgaaatgctttcctaaatgtccctaattaacatagacattgtaagaaccatgcattccagagattgtagcagaatcaaaatgtagcagaatctgcatttagtctacagggtatcactgatgaaagccaagcagagttgtaaattgtgactggtatttcagctgtactcagcaggtgttcaaaaaaaaaatgcatactgaataaaaggaacaaccaatgaataagttcatttttcattggtgcttgctcgagtaaacaatgactacctttcaaaaaaaatcatggatatatacatctgtatccactaccctggccctggcactgagttagaaatgggaaattcaacaactattaagtcgggtactatacatttgtgcagatagaactaatgccttcagagacaggggaaatatatctatatataatatacccaagaaatttagacattaggaaaagatgaacaagccacattttcaggcttatttatcaaaagtttccagaaataactttcttcctaagaaacagaagttcatatgagcaggaaaattctgggaaaaggagaaaaagataaaacttcaataacaaccgtaataattgttattattgctctcacttattgagtgtttactatgtaccaggtgtgtgctcctgctgtgtaccaggcactatgttaggtactaaatggacaaggacaacaaaacttcgtggatgagccacatttttcaggctttctgatatgcactcccaagaactgacagtccatgtttaattggctgattaaagaatgaaacacaatttgtaagctcctaaattgtaatggaaaaaaatgcatgctgatattaactcatttatctggccagcttttccctataacctaccaaattctgtttaaacactactgcccccaccgccacccaccttttgatcccaatttgcacaagcaactttctaagttttttcttctgtaggtgttggcgcaatgacatggtctccacttgcctgtggaatcatctcaggaaaatacggaaacggggtgcctgaaagttccagggcttcactgaaggtatttttctcaatgtctagaaaaaagcctgggagtaggaaggagggaagaaggttggtaagaacagctctgcagcagcctagggcttcccagctcaggctgactgtgttgtccaggccagtggcctctggcaggttcccctaagccttctggaggtcttggctcctggccaggtatcagtcagtccttcataatctgactgcgttgaatattctcttcttctggggactaggaaaaaagtgcccagtgacctgattggacttgcagggctcaaattcctacattgttttttattcttatattaaagaaaacattccatcatttgaaactgataaaatgcaaaatctcttttctatataagaggattcttacattatttccttttcttgacaaacaaagtgtaagccataaaggcttaatccatatgaggccaaaagttgtagctgagtatggttgacactttttattgtgtgttgggggcagtgggttagaagggaagacttcaggagacagatacatagcaaagcttctatcacttaaagcagcttaaattctgctctgaagcaaaaagatattcaagatcattgacacaaaattacctccattcaggacatcttgatgactaatttattggagagtactcaaaaatctctccttattaataacaacatgcctgtttttaaaaacttgagagaatgtgtaataacattagaatcacaaattactctctattgtcaagggagagagaatacaggcatttaaaaaatcagataaaccggagtccttctaagaggaagtataagcctgacacaacttcttgcctccatcagcactaaattattgggaaaacagctcaagtcaagtctgaaccaccaatcctttaatcattgtggctgtggccactgtgagcttccctaatcagaacattttcaaggctctaggcctttgactttcctttctctgtgtaacagttgagcttttgcttgtttgttctctaaaataatacaacatgaatacgtcctaaagcctgatgacatggtcctatttctagttttgtattattacaaaaaacaattttcctagaatattaaataaggtcttgcttctgaaaattaaagattgttctgaaacaagtctaaacaagtcagcaaagacagactaaaagcatcttaggaaagaaggtataaaaagaggaaggcaagaagggagtgaagaaggaaggaaaggaagaagggaagcactgagaattacaattttactaagtacctactatgtgccaagcactgagctaagtgttttcattcatcaacttttattctcacaaacagaatggatacaggtgacttttagtcagttgagctaagcatgttgtcatatgttctttcagaggcttgctgaaaaattcaaagcatttctatatatgcagagtgtttgttctcacaataacctgctgagaggcagaccattttcagatgcaggaactaaaacacgaagaccttaaataacaatccaagaccataaactcgtaacagaaaaggctgatattagaacccaggtctcctggctctcaagttaattgcctccctcaaagacatctttatttctctttaaacccaggtttttaaaggaggaagaagtagctatgatgtatttggagtgcatgattgtctaacctccatcactgtttgagaaaagcttgcaaacagctgaaaaatctttcacaaattcactagtgaaaggaaaaagaaaaaaagaaagagtaatgaatgtttgaaggtggctaagcccaaaagcagcttgggaaatatttctattggtgacttttataaagtcaactctgtatctactggaacatccttaacaataaacattaagagctctcaacagatgaaaggtggctgatcacaaagtatgcttctttagagctctgcagactctcaaggctctacattatcaatctgagtgttttcggagtaatatatgtgcacttatgaaagccacttgagtatcgttaccagagcaaaaaaataaaaagtaaaggaggcaagtatcagagcaacctttggagtgaatgaggatgccatgaaagagaaagagaaagaaaagaaaagaaaagaaagaaggaaggaaggaaggttaattaaattaaaagatagatatctgggcaagtagataaataaattggtaacgttcatcccaccctaaaagagaataagtaaatagtttgtgtttcacattggctattgttatactgataagattaagatgttaatattttgcatctgttgtagtactgaactgcaattgaaggataaattaactcagcataaaaaatacctatctagggctcttttagaaagtaacactctttttctggattttctgggccccctcctctggccccactactctaacaatgatttctaaatttgtgttatcagctctgacttcactgctgaactgcacagcactccttctttgtgtctattagacatctccaagtagaagtcccatgggcatcagtcatgcctaatggaatctatcctcacccccagaacctgccattccttcttgcttaacagtgcctccacccatccatctggttgtctcagtcagaagccaaagcattacctcagactgcctcctttccttccttattcctgttcaacaaggcaccaaatcctccagactctatcttgactctaagatccatcttgtgcacagcccttgtttggatcttcaccatttcttacaagatttactgtagtagcctcccatctggactctgatttcctccccttttctcaacaacccaccattgtgactacttaatctttttaaaatattaatctgaccatatcataaccctgcttaaaatcctctaatgatttcccaatcattgcttataggacaaagccataactttgtcataaagcattcaaggaaattcccttgggatctaagttgagcctattttttttcatttgtgtctcccatatcatactacttcattttccatgcaaatgcactgtactctcctttgcctcccagaaatgtccttcttttcattctcctgtggaatcccttcttattgctaaagacaaagcttggttgtcttcctctctatgaagactgtcataactttacaaaactgagctatttgtaccttctctattattccacgaacacttcttacagggtcttctaattctctggttgcgagtaacaaaatctgatcagagaatggggactctattggttcacaaagacaatccttgagaagtacggagtggcctcagcaatgactgcatccatggacttgtacattgtcatgactttccatcttctctatttctctctacatgtgggtgtcattttcttctactataaatgaggccaggagcaggaaaactggtggttgcaggcttgcatttctaaaggcatgtaacctaagataaaagcaatcttttctttaccaacttcagtccagagatgactggacaagcttaggtcatgtgccaccctgtgagaccaatgacagtggccaaaagggtaaggtactgtgatcagctcaggttgtgcaccatcttgtcatggcattttccattagaaggcagtaaagacatagcttgtaaggaaatcattgacaggagtggaaccccaacaaaaaaacacttcccatgttactaggtaatgatttgtgaatacatctaggacacaaactgaaacctgctcatctgactcatcacagagcctgatgagtacgtaagaggtacataagtctttgttaaattaatttgatgagccataacaaaatcaataaagtctgatcaagagaccaggtgtatagcttctaaatagaaataaatagtgcaataaaatttattggcagctcctccctgttgatggcaaaatgctttctagaaaaattataggccaggtgtggtggctcatatctgtaatcctagcactttgggaggtggaggtgggcagatcgcttgagcccaggagtttgagaccagcctgggcaaaatgacgaaaccccatctctacaaaaatacaaaaaattagccaggtatcatgctcacctgtagtcccaaatactcaggaggctgaggtgggaggatcacctgagcctgggaggtcaaggctgcagtgagctgaggtcatgccacttccctccagcctgagcaatacaatgagaccctgtctcgaaaaaatattacaaaattatgtacccctctgtcaaagaaaaataagaagcatgcacacctcgatgaatcaaagttgggagagaggggtggtccaagtacatcaagtgttcatattaagaaactaagcatattgtacattatggtaaaatttcagaaggcaagttttcggctctagcattttacctagagatctcaacctcattagtgactttgtttttgttttgagtcaaagactttgaagtttaagtaaaatagtcaacgatcttggttgttaaattattctagacagtgttcagaactgaaatgtgactgattctgtccatggctccagtttcagcctgagttcaatccaagattaactaacaactaattagggatctggggcaagtctcacagactattcttaccccaatatcaatacctatgaaatagggacatataaaatcatcatagcattgggagagggcaaagaaataggctttaggaaaatttagagttttgtaacatacataaaactaatagccaactaatctgtagagcaaagctcattcaattgtccctttgacaaatatttaatgagtatacccagactttgtgctgggtgctgaggacacagggatgaatgggacagtctcaaccctcaaggagtagctccgggacttgtaatagggacagacatatgaaggggtgaattatgaaataatatggaagccacaagccctgtggagtcccacaggactgctggcagagtcacactgcattggggaggaggtgtcatgatcaatctgaaaaacgggaagagatttattttgactccacggaactctggtttctctgcctcctccctgaccaccatattggttgagcccctcctccttgccagccataagtgtcagaactggagatgctgacatgaacaacaagccatccctggcttctatctgctaggtttagaaaaaccaacatgtaatcaaatcattgcagtgcagtggggtgatagaatagggttggatgaggagatttcaccttttgattcatagattactgtccagtcagcaagcagggtttattactgccacaaccacacccacctccaaccttcctacaaaacacacttgtttgcttccatatttaattaacattttaattaagcctcatctcctatctctgctaacattttctcatttgtaaagcagttaaagctgtttatttccaacacacttttgtttcctttggtatgaggaaagcagtataaaaactatgcatctactttttaaaaaccctaatctgcttgtatttccataggttaaagcaacaatgagatttatggtgttgaacatggattgggactcaataaataattgcttttttctttttaattttttttttacttttggaagtctgtctctgaaaatggtgtgtatgtgtgtgtcacacacatacacatatacacacacacataaatagaacttgtaacccaatcctaagaaagagaatgcactgcatacaagatttcaaaaacggaaaagttacaaaagattgattgataaaccaaccactctttacatgcatggtatatactgaaactcagaaattctaatactaataagaagcaattgttcaaaaagcagttggctattagttttcaatctttgttagtcggtttgaataacattcagagatattggtcctctgaaagatgttatgaaactttagtgaggattggtgatgtttttcccactgaggacaccaaaagtaagttcagggactctctgacatagacagcactctggcccaggaagtctgccccggccccaaggcagtgtccattgttcacaatgcccacctcatcaccactggcaccaaatgtcatctctggagagatgctccaggccactcttctttttgaagaagctgaggcttctcagagctaaggctgggaaaactttagccatctcctcaagcaggctaccaggttaggagccagcccataagcctttgagatttaggagacaaaactggggcggcttgcccttctccttttctcatcggcaaaataactcaaaaaaatcacaataaaacataatgtggttacccttttctttggaaatattgtcttagaataatgaaaaaatgctcaaaaaacaaaagccagcagcctattgaaatcatgtgggtgcagtgtccatggcccactgcctgttgcagagcattctgcggtctctgggaagataaagatctgcgatggctattatgtattatgtcacaattacacgcaagagagaaagtccacattaccacacagtgtgatgatttttaattgttttccctaaaacagactaacactcttacaaatactcttttcccctgggtgttgctgcttaagtgctcgctttatgtagaagagtctattgttccctttctcatagtaagagcagagccttctggaaactaaggcattgagaagttctaaaagatttttatctttatatttaggaaattaggttcattttgtagtctatagatcagggtcagtttcttctcattggctttaaagaatagtttcctgttttgagtttctttacttttttaagtttcaatagttatacaataggtaataacatttgcaaagtctttatctactttaaaattttaaaaaccaactcagtacctatcagttatgccatgtctgcttctaggaagaagctgcagaagctaacaacaaagccccattataaaaagaataagagattagcagtgaattgaaagcacgggggagaaaaatagttaaacaaaaatgtaaaatagtggttttctttgagcagaaagcttggcacccagctttcttaataaaaaggagacataatagatcttggtaagttgtaaatgtacttttttttttgctacattctaaagttgggctatcccaataaaaaacgttacttcttctattggacaggctaggatttaagtgcttgtatgtcacggtcagggttataacaacttctgtgcaggctgatcaatttgaatggtgaatattagtcaaaatcaatctgttttgaaccaataaacaaggagcaagatcgtgaggaacatttctttgcatgaaatcatccctgtcagtgtgaaacataagggtcaaaaaattcagaaaatcattatgaggttcacatattttattgaattaccattctttgacatcagatctttaccagacattaacatttcaatgttatgcttttccccagtgctaccagtggttgaaagaaagaattgtaagtgaagaagggagaaaacagcaaaacaagctaaaagacctttccccaattgcggagcgtctgggatgcacactacctcagctagctgttggtaagaaaattactaagctatggggtggtagagggacttctgctgagatcatagttttctattgctgaccacacccttaccatgataaaatgtctattgcagggacagatgatctctgaagcataaactcctgctaaatataaagtgagttatttgaggttccccagaattttctacatgatagcaaatttttcttacttctttctccttgctcttataacatagtttaaatgagaacatgtcagtgataacatacactatcacagatgtcaggggtgaactgtgtagtgacatccatttcttctggctcaaatttctgtctgttgaaaactaaaccagggttggtgagaagatgagatacagggctgtgacaggcccaaggctactgccacatgaaaagctgatcctagagaaatagcttcaccctgaaagttcttgaaggccataaacgttgttcttctaatgctgtggagtccatgaaaggtcatgattgctggtaacaattgaaaaccacacgcggctgggcacggtggctcatgcctgtaatcccagcactttgggaggccaaggtgggcggatcatgaggtcaggagatcgagaccatcctggctaacacagtgaaaccccgtctctactaaaaacaccaaaaattagccgggcgtggtggtgggtgcctgtagtcccagctacttgggaggctgaggcaggagaatggcgtgaacccgagtggcggagcttgcagtaagcccagattgcgtcactgcactccagcctgcgtgacagagcaagactccatctcaaaaaaaaaaaaaaaaaaaaaaaaaaaaaagaaaaccccaaaccacatccactgtttgagagaaagataatatgaaccacattcaatcatgggtgtctcagtcaacgacggacaacatatatgtaggtgatcccataagattataatggagctgaaaaattgctattgcctagtgatgttgtggttatcctaaggtccgagtgcaatgaattacttgtgtgtttgtggtgatgctggtataataaacaagcctactgcactgccagtaatataaaagtctagcacacacaatcatgtacagtacataatacttgataatgataataaatgaccatgttactggtttatgtatttactatactatacttttcatctttactttagagtgttactccttcttactaggaaaaaaaaaaagttaactgtaaaacagccttatgcaggcccttcaggaggtattccccaaagaggaattattatcacaggagatgacagctccatgtgttttactgcccctgaagacttcccagaggaacaagatgtggaggtggaacatagtgatggtcctgaccctgtgtaggccaaggctaatgagtgtgtctgtgtcttagtttttaacaaaaaaaaaaaagtttaaaaagctaaaaaaacactttttaaaaatagaaaaaaagcttataacaatataaagaaaatacttttgtacagctgtacaatgtgtttgtgttttaagctatgttattacaaataagttcaaaggtttttttgtttgtttgttttttgttttgagacgcagtctcgctctgtcgcccaggctggagtgcagtggcgcgatctcggctcactgcaacctccgtctcccaggttcaagcgattctcctgcctcagcctcctgagtagctgggattacaggtgtgcaccaccaagcctggctaatttttgtatttttagtagcgaaggggtttcaccatgttggtcaggctggtctctaactcctgacctcgtgatccgcctgccttggccgcctaaagtgctgggattacaggcatgagccactgtgcccaaccaaaagcttttttaaattaaaagtttataaagtaaaaatgttacagttagctaatgttaatttattattgaagaaagaaaaatcttaaaaataaatttagtgtagcctaagtgcacagtgtttacaaagtctatggtagtgtacaagaatgtcccaggccttcacattcactcaccactcactcactgactcacccaaagcacctcccagtcctgcaagctccagtcatggtaagtgccctacacaggtataccattttataccatatttttaccataccttttctatgtttagatacacaacaccatgtgttacagccgcctatagtattcagtacagtaacatgctgtacagatttggaacctaggagcaataggctatcccatatagcctagatgtgcagtaggctataccaactaggtttgcataagtaccctatgatgttcacacaatgaggaaaacgcctaacaatgcatttctcagaacgtgtccctgtcgctatgggatgcataactgtatcttattttaaattttctagtgaccacattaaaacattaaagtgaaacatgtgaaattaattttaataatggattttctttaacccaatatagccaaaatattatcattccaacatgtaataaatattaaaaattgagatattttactttgttttctacaaatcttcaaaatccagcatatattttacacctagagcaagcacattccaattcaggctagacacacgttgcatgctcaatagccacgtgctgccaaaggctacacactgggcagaaaagccctgagacttctggttcccttactaggggatatttgtcaggttctatagtaagcacctcaggctcactctcactgtcttgtctccttcatcaccataacaatccgcggaggtctatactattactagtcatatcttaccgatgctagtggaggattttctattactatctccacttataaatgaagaaatgagataaaagaattcatgtggtagctatgagaaaggaataaaatgggtgctgattctagacaaaaaaaaaaaaatcctaaagattaagaaatagcaggaattgggacatatcagaaacactaacccaatgagataaaaagctcaagataaggtctatgcaaataaaataatttaatagaatatttgttggtagcttgactcttcagaggttggaaggcagagaaatgttagttgcaattagcagtcatagaaagatagaaatgggaggtgattttagaggggggaaaatgccatgtaccgtagtatatgtatgactggtgctttaatcctttcttcaaaaaataaaataaaatcaaacaatgtatttaatgttattacttagcaactctacagctttaacaagcacagtaaaacatattagctatttgaccacaggcaagttacttaacctggtaacaattttctcatctgtaaaatgggtataataatacatatcttacaaactagttgagtaaagggaaattatatatataaagcaaaaagtaggtgctcagtgagtgctaataaagatgataatgttcttgcagagagtagacatgcaaaacttgaaattctgtctgctcttagccatggcaagcaatcagagtaatatgcagagaaacatattctgcacaatcatatatggtttttagatagtaacatgaagtattaaacttagccctgaaagacaggaaagaacactctctttctacagaggaaatctttacaagatttagactcttactagatattagatatacatgaaatgccttctttacaggatctgagtttaaattaaaacatgctttttttccccttttcctcctgtcctctcagatgtctttctcacctgtcacttctttctttgtaaataaataattttgtttatagccacaaaactctcagaatcaaaagggaaattatttccaggcacgttatctttgatctgctaggagagtgtgggagagggatcctccggcagaaagcaaactacttgaacccaactgtgtgcctgctccccaagtcacacaggtatactggagccagcattcatactttgttcttagtgaacaggcactctggacatacttgctagtgacacttggttagaggtgctaattatccagaatcagctgcagttgctaccatggaagtaaccagctctgcccagtgggttctcctgtgccctacaggcccattaggggaatcagctgttggtgacctcgagtagtcaggtagtttatgggcaataatttacctagaacctgctttgtcctcagaactacctttaaggccaaaaatagttctcagtgcaaagcagcaaataatgcagtcaaaaaaaaaaaaaagagagagaaagattggattggtacttttatacagcactattttgtattttgcccatgtggaaattcagtgattaccataaaaggcctggacacggtaacagcttaagagtatcagttgacaatatggctgtccaaatgggggcagaagatgtgcttggggacatccatcaatcatccatgcctatgtttattcaacaaacatttaataagttcctactttgtgcaagacactgggctggtggctgagcatccaactgcaaataaggcatacctcacagcctggtgggcaagtcaagaaaataaacagataattttaatacaggtcatcatattaagaagggaacaggggataagggaattagagtaggagcttggaattcagggaagtactttaggagcaggcaatacctttggggaatctcaaatgacaggcaaatattagtgaggcaaaaagaaaggggaaggcaaaaggacattccaggcaaaaggaacagcttgagcaatgtgccccagaatgaagggagaggaagaggagaaaagcagcaagatgcttggagatggagaggatttaaagacaggtgagtgctcctgaagcacaaagttcaaggtagggagccatgaagctgcagaggtaggctagaaaataaggtttgccaaggtaagaattaagaacctcatcttacaggacaatgagttatgtcaggcactagctagggaagtgatatgatcagatttgtgtttagagagactgctgctggctggatgagagctgtatgggggaaatataaggggacaattcaagcaagaggtaggaaaaccagttatccaggagagagatggtgagggcctgagtgagggcagcagtgactgaggaggagaagacagctgaaccggagaagacagctgaaccaaagcagtcattgtcaaactgagccctgtatccacacaatggaatactctttagcaacaaaaagaaatggtatacgggtacatagtgcaacacggaaaaacctagaaaacatatgctaagtgaaaaccagacacaaacgaccacctattgtatgattccatttagatgaaatgtccagaaaagacaaatctggagacaaaaagtagatcagtggctgcctggtacttgaggtagggatcttattagggtgatggaaatgttataaaactgcattaaaaatggtgaaggttgcaccttaaaaatgatggttggtaaatttataaaaattatttaatgtacacctaaaatgggtaaaatttttgatgtataaattttacctcaataaagttggttaaaaaaaaaaaaagagcatggtcccagatagcagcatcagcataagcattacctaggagtgtgttaaaaatgcacagactgcaccccagacctgaatcagaaactcagcgggtgagccataacaatgggtgtttcacaggccctctggatgattctgatgcataccaaagtttgaaaaccacttgattagaggaatatttaggaggaataatcaactggacttagcagttaaaagggaaaagggggtcagaacaggacagttcttaaagagtactcccaggtttccagattggggagccacattgctggtgatgcccccaaatgtgattgggaatgcaagaaggccaggcattatagcaagaagtttgcggtgctggtggggcatctagcaggaaggcccagcagacactgcatctatgagtccagcaacactgagttccaggcagctaaggactcagaagtccactgtaatcaccagcaggctcctggggaccttagcttctggacacagcaagaaggtgactgggatgtgaagaagatcagtaagggaatctggactgaccttttagaagtttaagaggggaagaaggttggggcagtatctaagcaggtaaaaagggtcagaggaagcctattctagaatgggagaaattttagcatgttttgttgacagaaagacacagtaagaaattttgaaatggggtgatgggggcggtgggatcatgtatgaatcaagtccaagaaaaggcaaaaaggagatatctccaaggcagagtttggtcttggacagaaaccgcacacatcctcttctgaaactggaggatatggatgtggatgcttatgcagcaggagagtggggaattaaggaatattccaatggagggacttgattttctatagacattaggacaaggtcatctactaagagtgagggggcaggggttgatgggatggtttaagagtacaggtttaaggtcattttcgggaaaagaaagatgaccaagggcaagagtgaggctggccaggctggctaaagccagctgggagggaagacgtgaacgcataggggcaccagaccatgaactgtgagattctctctagcacgctcagctaccctgaagtagaagccaaaaacgcagatgcagcactgatggggatttgctaaggaagcagaagaagtgaggggtgtgagggttcataagagagtaatttagatcatcaacacaggatgaatcttgggttaggaagaaagggaggtccagagagggctgccaggtaggtgggaaccaaggaaccagaaacctagagtctacaagagttccaagcaacagatgtggaaaatgagaccatgaatacagtggaaagacaggaggttgtgggccaaggtagaaacaggaatccagccatctgctggtgagcagtgttaggtgtttccaggaacaatgtgtttctagggtgggtagcttgaatgccctggttgaggtgacagggccttatgtggaaagcaaaaaggccttaagccccgagccaacccaaatgcattgagtgttaattaagagacatatagtaggctagcaattggaaaaccagcggagaagcaagaaagacagcagtgcatctgtgttttctgcttctacttgagggcagctgagcgtgctggagagaatcttacaatccattgtccagcgcctctatgcatttgcatttcccctcccagctgggctttgacagattctgtcaaatcttctacacaacagggggtgctgctcaggtttttaatcctaggaagcactgtacatcctccacaaaaagaagttaataaattttggctgcaacaaacagctgtagcaggtgtttataagctaatcaacgattggaagtgctttgataaactgacccagtgtcctctcctcccagcgtggtgcctgagaaatgaaggtgtgagttctgtgctcctgggatcatccactcctgaacaactcattgaaaaccttggtgccattcaggcaagtactgcagccccttccaacatcagggaatttaatggtgcctttgaggctatctccaggcagtgtcccatctctccccctctctgtcctgggtggggcaagagtagggggaacaaaggcaacagaacactttcccagtacatggatccagggttgtcctctgcctatgaacaggcagtattcccaaagctcatttcttgggatggtttgtttctgtggaagagtgcattgcagtgttatacgtggcaactgacttcccaggcctcgccataaaagccggcctgataacttgcttggaaatttaagtcataggacaatatacatacatcatttacttgtttgttctttccacaaatattgcccacctgctgtgtgctgagccccttcttgctgttccctgaacatcttgtattccccctcccatgatcttttatgataatgtagtataactgcctgtctctcctgttggactgcaagccctctgaggtcagacctgtgtctttgcttttccacggttttccagttcctagggtacttactacatgtcccttagttaacactcaagatctattgaataaatatttgccatgttttaagagaaatgggctcaaaattctattttggacttccaggatcacatctccctagaagcaaatttaggaggcccatccccattccctatcccatgagatggccactggtccagggcactagatggggcctgcagccatattctggggagcctgtagtggcagtgggtgggttgaaaggatgttcctgggagctctaactagaggggtggagtttagtatctattgtgaccacctcctttccccaaaggccacaactagtcctgagcctatcctactctcaaccctgctaaaagccctaggaacgatcctgcccacaattcctgccatagccactacctggtaaggttatctatttttctcttgctcatggaggaaaagaactgtctcacagcttcttccctatctacctgtccctgcaacaagcacacagccctgttaccattcccaaaaggaaacaggtggaggtagcaacaaacatgatttaaaatcttttttaaaaatagcccagaatacactgtggaataaatggtatagatccctgcccattcccccaacctttcttaggactgtgcagccgtgtaatcacctctgcctctctgcttctaacaactcccatatccagccccataactcctactggattctgtgaggttccctgtagctacgtgaggaattctccctcttatgttcatttatgctctgggaaaagataagggtacacagtgatgaggggacagaacagtttgtacaaaaaagaactgaaattcaatccaatgatttcagtttcactaatatttatggagcacttattctatgcctggcatcgtgctaggcagtgggaggactgagatgagtaagaacaggacctggccttcaaagagctcatgtgctggctgagaaacagtgaattaaaatatctatcccttaattcattcaacagatctttgagagcctattgtataccaggtactggagataacacaggaaagaagaaaaacactgtctaaccttcaagggatgttttacgtgccagtaggagagacagataaatagcaaaatgatttcaggttatgaaaagggctattaagtaaataaatgtttattttactgagactgagaaatgggtgagcctacattaaatgtttttgcaaaaagcccctctggaatatgtttattccgagggcttcatgtgccttcattttttacattctttgacaaccattcacaagtcttcacacagcatgtgaagagtccaggaaagtgcattccagggacagggaagagcagtggaaaggccctgagatgggaaagaccttgacttttcccaggaactgccagctaaggccaatgtggtcaacacgtagttgagcacagggacagcagatgcactgacgtggagagacaggcagggccaggtctcgcaggacaccatggggttagagttcatgctacatgtaacaagtccttgtggagggttttaagaggagggacatgctcctatttgaatgtctgaaggtcactctggctgccatgcataaagtagaatgaagggcaagggcagtcatccaggcaggaggcgatggtggcttgaatgagggtagtggccatggagggggagagaaatggatggattctgcaggtttgggaaagagagacaccatggcttggcagaagagggaggaattgaggatttttatcatgctaatacagggagatcactgccattcctgggggcagtcatagtgcctagggatggcatatgaggcaagtctagggctgagttttaaaagctgtggaaataggcaaggcagctgacagggaaggggacacatttcagaggaaaactcttgagtaatttttcttcccaaaacatttcctccctagcaaggctttggctggcagcaggatgaggctttgcctatcctaaaggggacattatccatgcagcaagactgctaccattgcgggcttaccaatcctcccctgttctacttcacctcccccatacccagcactaaagtccacccaagacgagttgtgattgggccccacaacatggtgaaaagcagactgggtgactaggggtgcccagcagtggtggcactggctgcaaaaggatggaaaatacggagcaccagcagttgtaagaaaatatttctagtaggctgggaaggcagctgcttcaagggatgccacgtgcctaagatgtgcaggaacgaaggggcgtatataaatcagagcctgacagatgggagagacaggaggagaaaccacagctgcaggcagcccaccttcacctgcacaggttccatcctccccactcccacctaaaaggtgggagaaccgcctctccccctcctccccacatgccttaaaacccttctgaggcttcccatcacccatcagagaaggccaggctccacagcagtcgggcctcatcactccccaccacaccttcctggaatctgaatcttgagccgctctcaaccactcagagcttcggcgataacagtggccctctgcctacaaactgaccactatcccagcctagcaaaatcctactccatccccaagttccagatcaataggaacccaatcctgggaggactttactaatgcccagccagccccagcaacattagccagacctcccccaacccaccacctatcccaggcagtgtaacatcaagtttgcaaaactagtagcctgtggggtgtttgtaaaatctgtagtagtttacaatgtttcaaagtggggcttctcttgaaaattctggtcttgtgatactatgtcttgttttattcgagtacttttatggtttcatttttttaatgtttaaatctctttcctatagagatttgctttggtgtaatgaatgaaggattcttctcctcacgtggctaacccgctgtattttagacaaaaaaaaaaatccaacaaatccagtttctaggtttttggtctcattgttacaatctcattttaaataacacattagctgtttggacactgaaattccagagctagtgggaaaccaaattcttccttcagcttcagacagtaaaacattaaccagaatgaagtttcccaggctggcagctctattttgccaaaccctaaggcttctgaggatagcacttgactggagacaaggtcaccttggccagcaggattgcaacaaaggaagaatgaggttgaaacctcagaattggtcgtcagaattgtatttcaccacagtctccacacagggtcagacttttccagtgagaaagtctgcctttgtcccttgtcttatggtgtaatgtgtacccttggcccacttctcacagtaaatgctagccttggatgagctcatcctttcccggggcttcagtcagcatgtcggtgcaaatgactcacaaaccctcaactccagtcctccggcagctactaagctccacagctgcacttgcagctgctcagtcactcctaggtggatattccacaggcactttacactcaacacatcctattctctcccaacttcttattccccaaactacttctcctttggtttctaatctcaataatcaataccaatatacttctagttactcagtcttgaaaccaccatcttcccccaaaatgtctctcaggtccacttttctgctccactgccctagttaaggccctattgcctggcttggattgtaatacatatctaatatctgtgtcccctttccacctcctccagctcatccttcaaactacctccaggtgtctgatagggttactcctagatcagaagtcctgacaggttccccactgcctaaagtggggactccataaaatggcattcaaggctttccacactcttatcccattcttaccatccgtatcctgttcttagcatccccacacctacaccaatcactgtatactatcactccagttcacttttccatgctattccatctacctgggatgcctgttaaaccccagccatccttcaccagggataagaccaccagtcagaataaatctctccttagtctctagacctgtgctgtgtactactatggttctagccacatgtggctattgtatgcgggaaagatggtgagtccaaacagagatgtgctttaagtgtaacatgttcacaagatgtgacttagtaccaaaaacaactgtcaagtatcttttctatattgattacatgttgaaataatgttttggatataatgaagtaaaaacatgtattaatttcactgttctttttaaggtatctaatagaaaattttaaattacaaatgtggcttgcattatatttctgttggatagagctgctctgtatttctatgagccttcacttatgcctttatgccttcatttatgcagtcaatcaacaaggcccctgacctcaaggagcttacaatgtgatggtgttgggggcggggggcttagatttcagctgtggtttatgaagatatatgattctagattactttgctaaatatagagcacaaaaaaccgaatgatcaacactgctaacaatatcctttgtacttctcctcctgctctcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattgacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgttttgtttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgatttttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactcaa

SEQ ID NO: 674 - DNA, 236150 bp, Homo sapiens
gacggaactccttccattgcaaaagctcggcgcggcctcgggagctgcccggcggccccggaccgaggcagccctcccctttaaaagaagcggaggacaggattgggatccttgaaacccgaaacccagaaacagcatcggagcggaaaccagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaagtaagtgccgcgagttgtcccccccaccccaggctaagcgggcgaaaacgctttcgccccgggccgggctcgttggcagggtcgcctggggacaggagcgcatctccagggccacagagggaccgcgcggcaggcggcggcggagtgctgcgcctttgttggggcgcgctcctcccagcctcggctccagagcccgcagccgaggcgacgccgcttgctcggaaggggacagacttcttttctgtcttgctttctgtgtcccaggagcaggcaaggggcttggaggatgctattgtcttgctgagtttctgtgactccctcccgtgttggtgggaaaggcttgcttaccaaaggcagaacttgcaggcacaggcactcctaaagttagaggcttgggcattttaaagccaatcgtcgcattttgtttttgtttttgtttttttgttttgttttgaaacgctgtcccacggaaggcattatctttgctcctaatcatgtaatgcatacttctcaccgggcactgagtgagaatgaaaggcagggtttcttaaccttggcacttctgagattgaaacctggtaattctttgtggtgggggctgtcctgcgcgttgtaggatgtttagcagcatccttggcctctgcccactggatgccagtaacatcccccgccccccactccttccttattagtggtgacaactaaaaatgcctccagacattgccaaatgtccctccccttcgacttgagtaccccagatgtagtgaattcaagctcttggccatttgactggtgggctaccagggaggtgcaggagccctggtttccttgcaaaaagtggttaggctttaggatttgctcaagggagagctgaattctgaccaatgaagcacttcccaaatccgcataagtttgccaagccacagtcacccaaggaagcttcatgctatctgctgaaaaccagcttcaacgataaaaagcccctcacagaagatccgtgctcattaaaactgagtgagctctccagtgccaggagaggcgctttgctgttacagtggtggggagatggatttcacagactggaaagtatttaggagttggaaaaagagtcctgcaaaataagctggctagctagacaccaaatgtgctttgcagttgcccctggagtttgatttttccgtaaaggctgttttgaactccagattctttggatgaaaagtgagatttcttttctgcagatttatgagaaggtggatactgaaaatatgctccagtgctaaggaatggaatttcttttgttacttctagtggctggaagcatcagctcacagacttagagacagtgcatgaaaacagtcggaggtgctcctcctccgtgcttttttaaaaagccaattcagaatgatattcaggaaaatctaaaaaaaaaaaaaaagggggacagaatcaccatgtctctgaatggatgactgtagagatactatagagatatggatactgtagagataaccagttttccccaaattaatttagaaattgaattcaacttttcagtcaaagttctgaaagagtttgttttgatgataagaatttaacaaaatgattctaggcttatcttagcaaaaaaaaaaaaaacaggtaaaaagagctgaaacatttttggaaaagaataatgaagccatattctctctccaaatattaaaatgtattataatgtaaattaataaaaacaggatggtaaaggccaaagaataggtggatagagtagaaaatctaaaaagacaagtacatgtagatccaaacacatgtaaacatttagtggaatttccaatcagtatataatgattcattaatttaaaaaaaaatggttcctggacaagtgattgataacatggagaatgaaaaaggttagatttatactttacaaaccatacacataaataaatttcagaaaggttgaaaatctaaatatttagaatgaaatgatcaaagaactagaagataatttagatgaatattactgtaatcttaggtttagagcttttaaaacatgataaggaagaaaccataaaggaaaatagagatttgaatatattaaaattttacacttctataaatgaaaaataagccatgaaaaaacataagaagttacaataactattgccacataaatcactctcttaagattgattttcatatataaaaagcagtaaaagcaaaatcccaataggaaatagcctaagtgcataattcacaagagaaaaaaatatgagtcaataaatgaactaaaaaggtcgttattaatcaaagaaatgaaaaaatcaaacaatatgatttttattaggttggcaaaaacttttttaaaaattacaatattcagtattggccaatttgtgggagataggcactgtcatttcttactagggaaaatgtaaattggtgcagtctttctagacttgcgctgtccagtagaactttctaggtcggtagaaaagttctatatctgtgcagttcaatacagtagctactagccatatgtgactcgagcacttgaaatgtagttagtgcgattgaggaagtgaatttttaattttatataagtttaactaatttgaactttaatagccacatgtggctaccataccggatagtgcagacaagaagataatttggcgacacatataaaatgcttttaaaaaatgaggggtgttcctttccatcgagcaatttcatgtcctaaagaaaaaaaatccaaatagtcacaaagaagtacctacatgtatgtttatggaggtgctgtttataataaaaagctgaggattacatgtgtctaacagcagtggatttactaaggtatgatatgtgtatagtattgaacctgcattgcatgttatacaagcttgtaagctattttaggagaaatacataattcttaacatactatacacttttagatggaaatgcaattaccaaacgtcatctgcgttatgattccacctgtttaaaaagttaaacacacacatgtgtatgtctctatttaccaatatggtactactatttgtctctagcaggtagaattttaaattttgtttacatgtttttcttaatttttctgtactgaacatacattacttttatattcaacaaaaataagttattttgaatttgttttgaaaatcatgtcaagtgggtctctaaacagtgtgctcacttccaagccccttgctgttgtaaaggatgctgctgcttttatatttaatcctggagtaaatgtctgagtgcatcataggattctatgaagcacattggagacccaaaaatgctccaggaaaagaaatggtggggagacctttacagacattcaggtggatgcctctgacttcctttagctgttctgttgctggaagagaaggatatttttgtgctgaatgaaaaacttgctagaacttggtgcggtagtgcacactccaccagcttaccacctccatccaggctaatttatgagattgatgagtccagagctaggggatgggccaaaacgcagtggtggcaaacagacccctgggtggtcgctaaagacatgatcttctgtcctagagagaacctcctcacacagtgctgtccagcacccaaccacagccagagtggaaagtgaaaaaatgctgactcattttttccttgggcttcttagatcctttcgctggcaagacactgtctacagtctgaaaccgagggatcataggggactgaatccaccattcttctcccaatccctgcaactccttcttcccctgcaactggttctcttttcccatgacattaaatctcagctcatttcagctttaagcaagctgcatctctggcctggagggaacccagattatacatttaatggaacgtcatgttttctcaaccaggagcaaagacttcataatgataacctagaaaataccacagtaacacaatagggcattattagtggctttggcgactgggctggtggactgggctgcacaaggctttatactgatggaatttcatgttcacttaaacatgcttttctggttatagtcaggaaaaatagattgctgggaattcagtcggggatttgaaaagttagatttggaaggctctgttcaacaaaaagcaaagaaacagctagcctcttttaagtcttccaggggatcttccaagatgaatgcacccatttgaccaacccacagacataactaccttccctctctcacagcacccccccaccctctcttattacgtatatgtttatgtattacatattggactattttacatggagctattagtcacttgaatggagatagtggattctgcatcatgaatctcaagtggctggctatgttatgtgtgccctgaagacttcaaaaatagaatgtgggaaagagagcaggaggagtggagatggtggtctggaaggcaggagtaaacgctgagcagctttatttataggacttgccaaagccacagcctgtcattcattttctgcacctaataaatccttatatgtctaaaggccccccacaggctcaccatgtgctccttccccgtaagacctccgactccccctgccatttcccttctgttcggcaccagttttctttttcttccactgtacaaagggattccatgttgccactcccccagagttccaaccacagcacccacacctggatgatgccctgctggtgctgatttgcaggaccactgttatgtgttgtactccagggacaggatcatcagatagatttttgtagcattaggctggaaatttccccatcaggtatagtactggcttttttctgggaaaatatcttctgagttcccaactactaacttacaaaagaaatactggattgggaacttgtgtgagtcttgcagactcatgctctctcacaagggtcccaaagacaaccttgtttggtaggtagggcgaagcatgactgtccctaatttgaagataagaaaacctttgttcagtccactgggttaagtgacttgcccaaggacctaggattagatcacgacagagctaggacagtgtctgcccttgactcccagaccagctctttccactcatcttccctgtagagttgggccataatgagaagcacatggcaatacaactagaggaactgggtagattccaggaattcaaaatccccgcatcagagtttcagtaaatcatggtgcataaggcgattaaagttacttaattgaggagctactactctgctgttaaatcagctgtagttgatggaaagtatcaggaactccaaccccctgcaacccagagaaatgctccagagatctagggggttaattgatgagtcagactttaaggtgtgttcaggacattttattatgataaattcgtaatttgttcagactgaatctgatagaaaaaggaaactgaagtctgtaaatatgctaaaacacacagatgtagcttattttcagaaatacattggaagatggcttagtgtctgcaaaattggctctgaataaggaaagcaaagagttcaatagaaggcaccttgaaggtgctacaatcagatattttttatatttttggattttaattcgtataagtcttgtatatttattgttaatttcattcctaagtatttgatcattttggttattgtaatgggaaattttcttccattttaacttgtttgctcttagacatataaagagtataagtatctgtgttgattttgttgtgaattattttactgtttcaaataatttcctagttgattctcttgggttttctggatatataattatataacctgcaaataacaattttatctcctcttttctcatttcatactctaatttctttttttcaacttttaagttcaggggtacatacaaacctgcgcatcctgcatatgtacccctgaacttaaaataaaagatgttaaaaaaaagaaattacataagaatgtgtcatggagttttgttgtacagattatttcatcaccgaggtatcaagcctagtacccattagttatttttcctgatcctctccctcctgtcaccttccaccctccgacaggccccagtgtctgttgttcccctctatgtgtccatgtgttctcattgtttagctcccacttaacaagtgagaacatgcggtatttggttttctgtttgtgcattagttttctaaggataacagcctccagctccacccatgttcctgcaaagaacatcatctccttttttatagctacataaaatgccatggtgtatatataccacatttgctttgtctaatttatcattgatgtgcatttaggttgatttcatgtctttgctattgtgaatagtgctgcagtgaacatatgcatgcatgtatctttataatagaacaatttatattcctttgggtatattctcagtaaagtgattggtgggtcgaatggtatttctgtctttaggtctttgaggaattgccacactatcttttacaataataattttaaagggcatcagaaaaatagttatcaggggccaggaatttcttttattattattatttttgtattgaggtggacttaatgcttggttttaaatgctcctctaattaagttccacatttggagaaggcctttgaggccaggcaagagttggtagaactgcctgcaaattggatagtttggcatatgggtcaaaaataaaaataaataaggcaaaactgttttgttttgttttgttttgttttgttttgtgtttctgtctgggtcagccaagtaactacctctactttatttagctgtggagacctggttaaactcagtgtcaaggagtgttggaggaaggcacctgtcccaagataacctgtaattatgtccaaatgctaaaggattcctagtggtccagaaacaaattctgggatcaattagggagacttggctgtcacataaatgcaaatgggatttgctctatgctaatttagaatgtgtgtctatgtttggtatgcggccaagagactggatcttgcctctccccctgattactctgcaataaaagacaaagagaatatttaaacatttgttgacacgtttttcagacacgtcaggttcatactgaaaaagtaattagatttctccaatttgactcagcagattcttccattcatttggcatagatgacatactcagttttgatcacaagtgtgtactccaatacatgcgtggatgaaacaatgcctattgcaagcaatgtcctgctatgggaggtaaaaggaatgcaaaataaacaggaagaagtcccaggctgtcaggtttttatggagaaaagttagaggactctaggcagccagagctaaaggcttcagtgaggatttgggaaaggggccaagtaaagtcaattttagatcagtaagaaataagaagtaacatttactgaacccttgctacctgccagacgctatagtaaacactttgcctgtatgaccctgtttagtgtttacaacccccataaggtctgtacagtcatcattaccatttcacacgtgaggagaccgaggtttagagaggttacccaaggtcactctgaatggtgaaactaagtctcaaacccaagcccctctgactcataatctatgcacaaagttaaaaagaatctaaatatgcaaaagaacattgaatcaatcaaggtaggtcaggttatgctgtgataacaaataacccccgaatctcagttacacaaaacaacaaaagttttattctctgcatatactacatgtctgataggagtcagcagggctcttcttatggtgatggttctgggagccaggctggtggagattccttcctgatacctcctgccaccatcaaggctgcgagggaagagaatgctagatgatgtcttgctggccatgaaatgctccagccagaagtgacgtgcatccttctcctcacagcctgttggtcagaactggtcagatagcctcactttatggaaaaagacttgaagaataatcctccatgtgcctagatggaagggaaagccagatatgggtggacaataaaagcttctactgaaaacgtataattatagcttgctttggcttgaataagcaagaaagaagtagccattgagagagaataaagagataagacttctggagaaaggtcagttttgagccaagtcttggatatacagcattcatcaacctagaattactgtcagacgtgatgtttcaaatatgcccaagaggcaatgatagctccttctcttttcctcccttccccattctctgcatactttagatgaaatattcagtgaggtgggcgggggattaaattagattaaatggaaagtagaaatggagattagacatgctctcctgccacctaagtattacatgaatatatttgaaagataaaactctctttttccatagtttatggaatacgagggaatttgaaaggctggggaaagacagcagcccatggaacacagaccactgcagcagcagagctcagaggatgcctgtacactgcaggggctgattctgagtttgaatcaagagtatctgggctcctactagtgcttctcaatgagggtgctgttagcatttttgatgggacggtgtttcattgtgatggactgtgggatgctttagcattcctcatccttgctttctaaataccattagcctttctggtcattgtgatgaccaataaataacagcctctatacttatttctaaggttggtaccaccttggttgagaactcctgactaaaagaaggcagggcagagcagggtatgccattgatgttgattcctagcatccaagaaccacatctgggcatttgtctgaaggaagaaattgggaagcttccatgataaaagctccagtggaaattgtagaccttgggaatgaatatgctaaactgaggttctcaaccaagggccagatcacaacttcagaggcctgaggcagacgtgtattttggaaaagcttcccaggtgattctgattcaggtccctccctcagtgagtcataagactgaacaggaagacaagaaaagttgccccataatgatggctcatggttatggccttatgatgaggatatagctgaggcagcacacaccttggagctgggctataggcagagctcttattttagatggtggcagaagaaaccacacacaatatgaaggcagaagagcaaaggtcactgagaggccatgttttgcccttcagtgttgccaggtcctgctgtgtgtacatatacatttaagccatgttgtttactagccaggacactcctttgcttcctttctcataagtctccctacatgaaatgtgcctcatgggaatgcttaacacagggcttaagaaggccaccttcggaatcaggcatctgcagctttaaatatcagctcaatgcttcagcaagcattgtgaccttgggcaaattatttagcctctccgaacttcagtattgttaataaaataggcattaaaatgtctgcctcacaaaagtgttgtaaagattaaaacctttaattaaccatttggcacatgagtgctgagacgatagatggtgatggtgatggttatggtggtggaggtggacgtgatgataaagatgatggtgatggtagtggtgatggtgacagtgatagtggtgattatggcaatgttgatagttgtgatgaagatgatgatggtgataaggataatggtgatggtggtggtggtgatagtgatagtgatgatgataatggtagtagtgatgatagtgatggtggtggtagtgatgatggtgatggtgatatggtggtggtggtggaggtggagatgatgatgatgatgatgatgatggcagtggtcatggtggtggtggtgttagtgcagaaacagaatatggtcctctaacaaaagatgcctccatagattccaagcagtactgcctggctaggataaggaatatatcagttcaatatttatcaagctgtgctagagttctggaatcaaaaaatgcctaaaacaagtgccaagtctcaaggagctcaaagttttgtagaagacatggggaaacagtgaaataatttaattttggttgagatgagagggacttaggaggcttcatagaggaggtgactttggatctggaacttggaagttgatcaggattttgtcaggtgacaaagtaaagaaaaaggcaacatttaggaaagcaaactaacacatactctttgtaatatgagtgtgacagggaaataatctggaaagagtttggattttattccatcaggaataggttatgagattaaaggtttctaaggacaaaagtgtcaagcttatgtatgtgttttagaaatacatatctatcatctatgtttgcagtgaggatgaaggaaaaaaataataaatgagactgggggctcttttgtattaaggatcagcaggattggatgagccactggctgtgagtgaatgggagaggaaagggttgcaacagtaaggagcaggcatcagaaggaaagagaagttggtgtggacatgctgagtctgaacatgtagggcatgtgcatggagatgttgagtaggcagttggcttgataccctggagctgaaaataaaaacttgagtgttgtaagcccaagggtaatagttgaaaatgcaggtatggataataaataatatcaagataatatcaggatttttaaatgcccagaagaggtggagtttgaagaggaagatggccaaagtccaacccaaaggaattgctaacaggaattgtctgggcaagagaagaaattacactaaacagagctgagaagaagcagaacagtcagagaaccagcaaagaattgtattagtgaggcaaggagggacagaatttcaatggggggaaggggtgatcattcagatgctttctcctgaaatcatctcctcctcaatttatggtcttggtgaatggtggccctataagtccagctgcttaagccagagatatgagagtaatctcttgttcacactcaagtctgatgatatccactgccatatctctcccaggttgaccttgtactctaccttgtcattgtcttagctcaggcattcaccattttcacccagttattggtctctttgcttcatttctttacccctctccccaccttgtattcttgacaatcaattctaaaattgatctttttagaacacaaatctgatgtcgatactatcttccctctcacctcttaccccttagacatttccgaagctctttcaggataaagtgtaaactcttcagcaaagtatgcaagacccttattgctcaggtcactatgcatttccaaaacttcatatcttaccatatcccacatctttttaattttcaaaaaactgtactgcatagttccccaaactaacccatgccctctcttgcctttggctctaatgcccttcaccaccacacccatctttacctaggtgatgcctgcccatttatcctttgagacgattactagtgcatggtccccttctattactagttgcgggctccctgtggtaagaaaaaaaataataataagaacaaccacttttctatgttatttcttcattcaaagttccttccttattcagaatctcctaaccccataacaactcatattgcatgacaagcagtggagtggtccattttcaagagatggagaggaaaaacccttagtgtttgtcctatggggtttcatccagtgacctgacctgtttttcccctgatgcttaatgatatgcagccctaattaataaatacctgtagagacctcctggaagatggctttcccaacatcttgattgcaaaaggattatgatcagaatcatagtcagcctaccatcgctcttgacgttaaaaataatgcagattccaggtctgcagaaattatatagtaaataagaattctatagcaaataagagaaaagtgaagactcctaactgtaactttagaccagtcacaataataaacaatataaggtaaaatgaaacttcagatgctattagacaacactaagcataaataaccgttaaagttcattgttaacagagtgaccaaacatcctaatttgcccaggacaggcctggtctatgcttgttgtcccagcataattatgaatgtcttcttcttttactctcaaaagtttctcagtttggattttaaattatatggtcatcctgattattaactattgtaaaagacaatatcaaaaggaaaggggattgaaggtcaaacaggtaaagcaacttgcacactttgttccattaaaatgggcagccatttcagcactcctgcttccatttaagtgctctaattttaagtcttttctggaatcctcactcccaaattcccgtaacaattagcggaagttctttaatacctctcactatcttagcacctaacactctgaactgtaattgtacatttcctgacccttccatggggaggcagtgttgcctaatggttaagagcacagggttaaacccagaaagactttatgagcatagcgtttggacaagcatggacttcaacatggactctaagtctagaccacctgggttcaaatctcagccctaccacatactagctgtatgtccttgagtaagctacttaacctctctatgaattcagtctcctcatctggaaaaagggagataataatagtatgtgtcacataaggttgtgctcagaacagcgttggccacactggaaatgctagctgttattattaagtggcaatgaatgtaaagtgcccagcacaatgcctgctgcttagtcagtactcagtaaatgtgaagtgtcataattattcatctttatatagactacaaaggaccaaccaggcactcaaatatcagtttgctgatcaatatgtgcatactataagtaggtccagcaagatgagaactgaaaacaagccatatactttagcagaaataagggcattggtgacttttggaagtgctgttttggggcatcataagagcagaaactaaaaattaatgagctgaggggcttaatgggagatgagaaagcaagtttatgacttcagaaaaagatctggagcatctggagcataaacagttagcttctccctcattcctttcccctctatcatctaaaactgtcccatctcccaaaagaaaaagcctgaagaaagtgtctaggagacgctgcatcgggtccagagactaagggcgttgacactgacatgcaacacatgcgttagaaattcactagaaataaagcagacggactgagtatgaaagaggtcaagccagggtctactttcaactctgttgccaaattgtaaaaaaatatggagagaaagatcagtgaggagcccctagaataatcccagatctggaagtgagtttgcagtcgagtggggacctgagagagatgagaaccatccccttggagccctgttgctgttgggcatcagcatcatgcagtggcagctgctctgtgggggtcaaaggggaaaccaagccacaagagatgcctatgaaaaccaggcacctccatgactgtgatcctgtccagcgctgctgagtcctcccgccagatcgcgcgcctccagggaaacggcagagttttgtgtttaattatgtggatgtactggggatcaagatgaggccaggtatagcacaatgcgaacctgaagtagaggccaggccaaagcatcccctacatatggcaagctggaatgatgtaactgtgtccaaaacaagcaaacaaaccttgcaaaggtgaagttcctttgtggaaatgactggggttgattccattccccactctcccctaactgatggaacaacaacatgatcttactttagccatcaagactaactccttttcaccagattaattccttagagaagtttataagtgtgagatgatgcaagtgtgtgtgtgtgtgtgtatgtgtgtgtgtgtgtgtgtaagctattttggaagcaaatgccaagccaagttatacctttccacattcaaggatgaaaatagggcctacaaaagtttagcaccttaagataagtgattaaacaaaattcctgaggtggaagaataatatattcatggaaagcattttcagtagcaaaaaaaaaaaaaaggtcaattgtggcaccatatgacttcaattaagttaaataaaacagtaaatttgtgaaacaggagaaaaaatatgaagtgagaagggacttagaacggttaaggaaatataaaataatatggaaaaatttaaagtcaccaaagaagcagtaaagagcagaacagacaatgcagaaaatgaaataaatgatgcaggcatgtttaaggaattctcataatttcaggaggaaaacacagctagaggaaagtgatgaatgataaaatgataaataatgaatgaaaaaaatagctattcaaaggaccaaataacttttcattgctaaagtatagtctagaagaaactttcaatgctttaatagaagaaaactcttctgacttaagaaaaatttgaaaatgcagattaagtaggctcaccaagtgataatctcaattaattattcattaaaaaacactaatatttaaacatttcctggtgacaatctttaaaagacaaaagaagaactttataagtgggaagaaaacacatggtacctgcgaaggctctgaacattaaatggtgaattttgattgacacaattaatcttttatgatggataaaatttttgatgaagaaattctgatggatttatgaactaaaatgttatacctagccaagatatcacttacacatgaaaaaaaataaaaaagcattttcagatacatatggattctttctgaaaggggaatgggataattttcttcaggaaattatctgaaatgtgaatcaaagtttaaaaatataaaatataatagttattacacaaaagaagtggaaatgaccattgaatcaattttagcaaatatatgtctaaatagtattttcaataaattttgacataatattgcatcaacagacaaaaccagtctgtcgtgagaaaggaacaagctgaaaataagaagctttgggggaaaaaaatacactgtttctgaatattcaaatccattagaaataatgaccaccacattgaatattgcaaaaaagtagattcagttcatcagaggacagtttgagaaaattcctcagaacttaagctgaaaggatgcagagattaaaattatgagaaaagaggctgggtgcgatggctctcacctgtaatcccagcactttggaaggccaagacgggcagattacttgaggtcaggagttcgagaccagcctgggcaacatgttgagacccccccccctccatctctactaaaaatacaaaaataattagccaggcgtggtggcgcgtgcctgctgtcccagctactcaggaggccgaggcacaagaattgcttgaacccaggaggcagagattgcagtgagccaagttcacaccactacacttcggccagggcaacagagcaagaccctgtctcaaataaaataaaataatgagtaaagagaaaagtaggtcaaagactagatccaggatatctaatatctaatatatatatatattagatatatatagatatagatatatacacaataacaattctggggacagagaacacttataagagatacaataaaaaataataataaaggaagataattttcctgagctgcagaaagattggagtctttagatttggaagatttaggtaaaatactcagcctaattagtttttttaaatggtctacaacttgtacaatcttcgataatttcttaaaatataagaatagaaaagtctacattcttccaacaaagaaaaaaaaataggctcaacaaaaaggaaagtgagattcagactggcgttagtttttttactctacacattaaatgttccaaaaaagctcaataattataaggttttgagtgaaatgtgattttaaaattccttagtcaggctttaaaatgatacacattttaaaattgtattacttactgaaaaaattacctaaaaatattgacatcggaatggaaaatatatgtgaaaaaatatataagaaaaagacatggcataaaagaaacagaaggaatggctctagaaaagttaagaagtcaataataaggccatcagtgagactttgtagcaaaatataaaactgaaagaatggattgtcaatagagaaaatgaaaaatgtaaaatttttatgcgaggtagcaaaaatcactcatattacatttacatatgcaagaagatgcggtttattcttagctcccaaactcctcttttcttccaagtccaccttctgggtagcaagagggagggaaatccataaattttgaatccaagttgtgataatagtccattgtggtgattttttaaaatccctttaggtaaaatgctcagtctttcaaatgttgcctttccctcaccaatagaatctgggtatttgaaggagatggatttgtctctgtgaaggagtccttcgattctggaccagttggtttcatggaaagttctgtcacatcttcaaggaacagaaaatttcagtactagtgttaaacgcatacagacagcaggaaaaaatagtttctcaattcactttatgaagctagcatagatctaataaccatatctaccaaagataataccttcatacacaaaacttcccaccaacttctgaataaaaactttaaattttaaattaaatacatattgttaaaaaactaacagtatagtaaaggaataatatcctaagaccaagtaaaatttatcctaggaatgcaacagggcttcaatatttgagaaatgtttaagataactccaatttttttgactgctgaagataaaaactgtatctcagcagaatctgaaagacatctctgaatacttaagcattcaaggatatattcaaaatatattttgaaccctataccctacagagaataaactttcctttcaaatgcccatgaaatatttattaggtcacaaagaatgcctccatatatctcccaaggcgcaatttttccagtctgcattatcggcaataaataacaggaaatgaatagcaaagtacaccaaaacttcagctatcaggaaaaaaaatacagatttgtatattatcttgtcgtgagaaagacatgacagtgaatacagaaatttagaaaaaaacgagtctgaaagaaagtgattgtctgggacataagctggcgaactatggcctgcagcctgtttttgtaaataaaattttattgtagtacggccacattcattttgttcatgtactatcaatagctgcttttgtgctacaaaaagcagagttgagtagttgccacggagaccacatggcccccagaacctgaaatatttactgtctggcccttcacagaaaaagcttgcccacccctggactaagaaaacatttgcaaccgaatataaaatgggccaaaaatattgagaccagggtcagcttcatgggcatgggacctgtgcagtcagccacccagggcctctcatttcaaagggcctggcccttggtttaagggccatcttgccatcttgaattttgttaagttttgaacaagagacactgcattttcattttaccctaggttctgcaaattatgtagcttatcttaattgatacaaagaaaaatgaaccataaatgtgaaaaaattatggcttatagttaaatacatccaaattaaaacaatagtgaaatcagtttgtccttcctctgcccaccctcactgcacagtctaattacgttgatgtggggacagtctatagggtaattggctcctagagagccaaacatgaacccctcattcttagcatctgtccctccctctctcttttcttttcataatcctcagatagcaaagggctttctgtccctctgctgtactgccagcctaaggcatggatttcttcaccaaatgacacaagaggaaattatgtcctccttatattgtgatcttaatcctccaagttttgttctttaactgctaaaggaatttagaaaatctctctttgacaaagtcttgcttccaaaccagttgtcttgctgcaaaaatcatattttgaatttcaaatgttaactttttccccttttctgcatcactgctggaaaaacagaatcccccactgctccagggtggctcctgccagatggatgtctccgactgaccagggtcactttctgtgcagttgctaaagagaaaagcacagtacaaagttcaaaatattacccccattatgtatgtaaagatattgttaaaaaatattcatcagaattcttttataatggtgaaaaagtagaagcaactcaatgtacaaaaaggaattatagctattataaagttataattgtacaagttataaagtggagaaaatgcagatgttacaagtgatgttgggaaggattagtgaatgaaataaaaatttgttcataaccataatgacattaagtgaaaaaagcagagaccataacctgtaaatacacaaagtgaagatgcttggggaaaagtctgaaagtaaaatcattgcagtgaaggcaatggttctatctgagctgtgggatgatgggtgatttttattttcttccttttgtttgtctttccctcctctctacccacccccccaaaatttccaacaatggacctgctgcttttgtgatacgatatttgtaaaccctctcccttggtgccctcattctgcgtcacttcctcctaagtaacatcatccacagccactctcacccgacgatgttgacccatccccctttgatctttctgggggatgcaaagtggctactgtggcttcatctctgtgaatctggcgagtgtgaggaatggagccgcagctgtgcatttcaattatgggaaataccttttgggttactaacccattgtctgtattcttaacaacagtgcttttgtgttgaatctgcaccaaaagtaccaatagttgatatcagaaaatgtttttagggttctcctggtgtacatgtgttgtgtgtgtgtgtgtgcatgtgcctgtcgaaaaaggcagagtggagttgaaaggagtgcatattttgctgtaatacctttttgatcatgatccacaagaaaaatacattttatatcttgacacagtacatatacaatacttatgtgtaattgaacaaaagttaacacataacattcttttagttactgtatgcagtatattctggtatttctattctattctatttttttaatgttagcaatgtcccatgacattgctttcccaaatcactaataaattccattctgcagcttaaaaatcattgtttccataggcatcagttagatatactaacaggatatttcatcacaagtcagtcgagtggggccaggcaccctgtcctggggtctctgtgacacagacaggagcagagcgggcagccccaactcaaagtacagtgctcagtgactaggtttgggtctgtattgatgtctaaagaagttggagtggaggcaaaagtcaaggtcaagctttttgagcaagagggaggtatggctgtgacttgaaacagtaataggaggacaaagcctgaaggcctgggccaggtttaagactccaggcagtcagaggacagggcaaggctaggaggaagcagaggaaggcattgccctcagattattgttcagttacttccaagggtctaatatgcaaagagtagaagcaaaataagaactccaaatctcattctgacttgtcttctaaagggcactcttttctttggaagaagctggggagggagcacaacagcaaatgaatgcagggtctctgacagcagaatcaagtgtgagtcccacttacatgcgcctgaagctgctgaacatgtctgtatccttccaggattgggacccaagtgggttgctgaggacatcagtgacttcaactgggtggggctaaggacaagtagaaattggcagttttataatttccatccttagagctgctctgctcttccaggattaaaagactccttggtgatggttccaactgcaaactttctttttcccttttattctattctaatctgtgtgcaaaagaagggaggataatttaaattcattttggccaacttgattctttctgactctggttgtatgtgtggctaatggaaagagcctgtgttttctaaggagcttaaccacagggaggtttggaaactcacataaacagaaaagaatgcacttcagaaaacaagtcagaatgagatttggagctcttattttgcttctactctttgcatattagacccttggaagtaattaaacaataatcagagggcagtgtcaggttccatgcagaaccctgcactgggaacacacagtgagtgcaatgtcacaaaaatttcttgacttcttatcatgttccaaacacaagagagagcatagtaaaacaaaaataagaaagacactctggaactgctttcagcaacaaccttctgggtctagtagtgaagactggtggctttccctccccatggtctagtgagcccttctccaaggccaagtcagatggtagtgtgggaggacattgactctggttttgagtggacccaagagtattgaaagaatcttcaagcacagaactctgtaagactatcttcaagcagaattcctgggaggctacttgaattccaaattctgctgagatttgtgcagtgaaacacaggcacaaaatcccaagaagaggtctggaccctctgtgccattctgagaccaagttgacctataatagccttcaggggctagaactgcatttgagttaggatttaatggagtcgaaattagggaccttttacatccactgatttctagaacgtggcactgcaactctctgtgactacagcttgcccagcagttacgtgttaaaggcagttctggaaaaaaaatctacaacagagtccaatggaacactttctagtactatttatatttgggcttagaaggttttaatttccacctgcagctttggtgataatgagtgggtgggccatactatctgaagatggtatcaggactccatagccagagtttaaggtcattgacttataaagagactgacatgataaatggcatgttctatacattgtagggtggaaagaaactggaattggatccactttctgccatttcccccagccaacacctacctggttgtgaccaggagtccacttaggtcttcaggattgagaggaagcccagggtctgaactaccctgagtcagttattctggcagtagctactagggcagtttccacaccagaagatcagttacaaggccaagtgcaggtgagacatacgtgtttcaacagaaagtctaaactgagtcatagacccagcaaattcatccctatgcaagaaggcagcggggggcggggtgggggtctggttgaggtcccagtggtcatggataggaagtcagctgggattggtgggtggtggtgaggcaggggagaggactgtggcatcagacaggtaagcctcctgccactggggctttgggttaaagaaatataagcagtacccccaacaagtttgctgccatgctgaaaccataagcagcggacacagggctctttctttctccaagaggtggtttgatcttgcgctaggacaatgcctgcatgtgtgggttaagaagtttcggaaataaagagtagaaggagtccaaggtgcagatcgagatacccctttactctctttttcctttagcagctgaggccccttggaatcccagggtaacccagagaagacaaacccagtttggttcctagaatcttagaagtttgtggttttacctttgatgattgaggaggcaggctatgtacatctccagcgtggctcaaagggtgtatattttggtcaaggcttaaataattgtgtaaagaatgatcacttacatacatgaagtgacaaaccccagcagcgacagggcagctgttagcagaggagcaagcctgtcattgcctttttgcctccagttttgttttaaagctctcattttattttcttcttcagaaaattcagcttttgcccattagcaagagttttgatggatgtagacttttgtcaacacccaaggatatattttggatctttccctatatctggcatcaacaaatcaggtgaacatcaaaatggtataaactttacatcagtcagatagaagtatagtgaaaatgacatgttttaagaaagctggaagtatgaattatcattgggtgacacttttcaataagtaaaggaatgcaaattaatttgtggctgtgaaatagggccactccttgagaatgaggaaatattaacacaaaaaggatttacttcaaactcttgctccttaaacagggagtcaataatagtttcccaattctaattcaagttcctatttcaccaacacattgcttctcctcctagtataatttcctgattttattcttttatttctatgggtacatagtggatgtatatatttacagggtacatgagatgttttgatacaggcatgcaatgtgaaataagcacatcatgtaaaattgggtatttatcccctcaagcatttatcctttgtgtaacaaacaatccaattatactttttaagttacacttaaatgtacaattaaattattatttattattattgactatagccaccctcttgtgctatcaaatactcggtcttactcattctttctaattttttttgtacccattaaccatcttcccagtataaattcctcccggcagaaattctctaccgatgaggaaattggacatgggataaaggaggtttggagattcctctctaatcattagatatctcaccctaccccctcagtaaccagaatttcaaagattaatttttctggttgtatggaccaaaacacagcattgcatttcagaagtggccactaatggccagtctttaaggaaatctcttgattctagtggaaaggggttgtagaattctggattggcaatggcttataggcagtcatgtggcatatcttctgaggcacctggagagcattgggccatctctgccagatcaccacccaggacccccagggccagagcatccaccctatggctgaaggatggcaccctggaccagtctatgtgacctgaagtatacaagtgaaccctgtccaggaggatggccaggtctttatgaaagaagatttctaaagctttaagcccagggctaggatatgcagttctggtgagctcgtgggagactccagatgccattctgttcagagatctcctgatgatcatgtgggcccagtcaccaagcagctatgccctagaatcagtgacccatctgggaaggcttcttacttcacgtaagtcacgggaattggcgagagccatctgagtcccaaacccaggctgtttatccaagccaaggcagaatagttgaggttcagttggcaaaagatcaggaagcttccatgagcaatagaggcttttcctcttcatgctcttctttctttcattcaataaacaggtaatgcttgggagggaaatttctttaagaccgattgccacccagtatcaggggatgctgacagagaggtggacacggtggccctgagagcataaggcagggccttatgcataaggtagtgagtcctgtctgtgttggttaaaagcaacacggagagaccaacctgagtttgcttgtttttttgttttttgagatggagtttccctcttgttgcctaggctggagtgcaagggtgcaatctcagctcactgcaacctcagcctcccgggttcaagtgattgtcctgcctcagcctcctgagtagctgggattacaggcatacgccaccatgcccggctaatttttgtatttttagtagagacggggtttcgccatgttagccaggctggtctggaactcctgacctcaggtgatccacctgccttggcctcccaaagtgctgggattacaggcatgagccactgcgtccactgacctgagtcttgaatgaagagttgcttgccactgcggacaatgagtatcccaagcagatgcagtatgtataaaggctgagtaagcagaatagacaaaggggtgcttttgacaggaggggaccctggcacgctccttccagatcccttccccatctccccagctcctcacctcccctctacaggctgcatggtgctgcaccatgaaaccacttgctcttccccaacttccatgttttacaccaaggatgatccttctccccttgtcttcctcacaagtttctacctgtccttcaagaatgggattaaaaaccaccccccttcacagcctgcaccagcacagagagccattccccttttcttttttccaaatgcacagtcctcaactacagcacttttcatgacaggttacatattaattcttctgtcttcctcactcatctctgagttcttgaggggaaagcaccatttcttagccatctctgcaccttaggcagctagagtagtgctgggtgatgttatttttaatagttaataagaaatattaaatccccagtataatcttcctgcctctggttatgccaaatatcatctcaaattagccaaagtggggttcaagatgagcacacaaaaacataattataatgaatatctcctgtatgaggagaagaatccaggattgaatcattgcttttgaccctttttacagtgcctattataagattctagacaatctgtgttgttcaaaaaagaacaaaggataatataatgaacacccatgtgttctccacataaaatgagcaaatgttaacttattttcccatttttttaaagaaataagaatgtgtatgtgaatatattcatagaaattgtgtactggtggatttataatttttttctctaacagtggaacaatgactatcactgtaaaagatgcctatgtacattctctagaattgaatgtgaatttgaggaaagtgagacatccttatgacacagagtatctaatggtatgaccagagcatattgtaccactttttcaggtcagacagatatatcatttctggatatgggacaaagaaaaataaattgccctcctggaaatggaatacacccgatcagaatgagaattcttctgactatcattccattaaaaggaaagcaaaaagtcctcttaaatctctataaaatagtttgaaacaaaggaaaaacagcaacaaatagctctctggatgttaaaattgtaaacgagtgcataataaataaaaataatcagaaatcagtggaaaatgtttgcaatacacaatgtcagagtagaaagagcaaactctaacctcaacagttattagaatggcaagcagaaatgcagagcttgcctgaaattgatccttaggtgaaagggaggaggcatcacagctactaaaaagagtgggttcgaatagaaaaaactaatcggagccattgcaacaaactgaatatgagcactatggaaaatataagctgactgaagcagtaggaaatggtaccagtgaaacagaagtcaaacttgggaaataaagaagcccctttccaaatctaaaatctcatgattccgtatgtcctagggaaacagtttccttcttttgtcactaagaggattcctttttcgtataacaaaaagctgtgtcgtttttcttcttttgtttattaatacgactaaattagatttccttaagtgttcaactatcactaccttcctgaaataaacttcaccaattaattaattattattcttttggattcctgctgtgttcatttcattaatatgatttacagattttgcatctatatttacaaatgaagttggactctttggggaggggatgtgtttatcgtgtgtgctaatttcatttaaatggattagaacagtttttcttccctaatcagagaaataatttaatagcacaaaaatagctgtttctcgaagacgcaaaactcatttgtgaatctctttgggcccagcgtttgttgttgctgttgttgtttttcagggtttgggtgtgtggatttggggtgggggcagtgcgagattgggggagttcttttacaacatcttaaagaaccctaacagaaagttgaaacagcctttcaaataatttccaaagttacagaagtttcaagtaatgagtccagttattggagaggtcaaatgtaaaataacagaatgtgaagataaataatacaaggtaaagacaagtaaacacctgagtcacgcaacacctgcttttgttttcctagatcaggaagtgtgctgcaccactggaatgaaatctattactttgtggaacagttggctcacaaattcatcaggtgagaaacactatgcattttgttcacttgtagttctctgtcatgagtcaaactagtccatgtttgctattctattaattactacatactttggggatgttttttgactaagttgggctctcagatctcggaccagagactgtttgctttgttttcatctttgccacattttagaataacatttggctttatgtttttgggaggagccaaatctggttacgagaccaaaaatatttagcattctcccttctctgttgaatagcctattcttattacctttaacatttttcttgcacactgcatcatgcagcagcaattggcacattttagctggactcacgtgtagggtgtacagtgtgtaggatgaacaattcatcccagtttgcccagatctttcccagttttagcactgaaagtctcacatcctaaggggaaccctccttagtcctgagcaaaatgtgacaattggtcgctctctagctgtgtgtactattatcaggtagaatcctctgagcattttcaacaccactttcccaggcaaggcaatgcagttttgaacatagtcactgcaaatatcatgggagtcttggacttagtggtaaggaaatgaggtcacttcaccccactgtgtgcagcctccaagggataacacaacagtaatagctttcatagagtgcttgaagcaagttgtcaaagtctttggtaaaattggtctgatcatcgtaagttctaacacagctccacttcatgctgatggcctccatagagtcttccggttgataggagtgaccataaagttcttctttgagtaaggttctctgtctcagaatacaggttatcctctaagccctgggtagtgacagacatgttcccctcaaatttggttattgacctcaacgcatgcctacctgcctaattggagggaaagggttaggaggtagcttgtctgttatgccaaaaattggaagctacagcaggaagcatctaaacccagatgattaggaaaaacagatgctgagaggacagaagggagaaaaagtacaggaaaaggagagaaacaaatacatgggtggtgttagaaaatgtttgaaaggatcatagaaactaggaattaaaaggaacgagacttcccagcctatcctaggaggcattgtgtaactctctacttgaatagctctggtgaaaactcactgcctttgaggcaaaagtccaatagttggacaattccagttttcataagtctttttgtcattaggccaagatgtcctttcttcactcgcagccattggtcctttggagtgatataaaacaagtctgcctccacacccttcacagtaactgctctgtgtctcatttgctcttctgggcttctgttctctctgaagtggaggagtctagtgggataggctttgaagtcaggcagatgtgagtttgaatctaagttccgttgtgcaaccgtagcaattcaccaaccttggctgaaccctagtttatatatgaggcttataagagaaaacatgtgcaagcccaccagtccagcacctggcttagagtgggcacacaacatctttctcagttccctcagcaatcccagactcttcactatcttagaatcttagaaaattgtgggcaggggcaagggaggggattaagagaacccttaatccaattcccttgctttatagatgaagaaaccaaggaccagggaggttgacatggcttaatccagacaaggcacccttctctggttgtctccgctaaccctgcttggccatggagcccctcaaagtgtggagccaagatcttaccatcacccaaactccaccaggcagaggctgggctgtcgtctgttgacagtcacagcccaagtgcccataacagtgccagacacatagtacatgctcagtcagtatttttaaataagtgaatgaatgggcaattttcatttatttattcattttaataaaaagtctaaggcagctgggactacaggggggaaattcattcaataacagtggctgatgccagtacaagtacatcatttctaatctcagtgggatttttgacattttgagtccttttatttatctttattctgaccttctatcatttttctaataatgattcttatgctttgctgttttcctcaagccttcaacctacacctcacacccattgctgtcagcaaataacctcacctcctacttcaccaagaatccagagagtagtagacacgagttcaagttccaatctactcctaaaagatgcatatgtgtccttcccactagtctctgagatccaagtatccctcccatgtaaggccaacctctccattttagtctgactttatcccattgtctccagtttcctccaggtctttgtttctgtcttgtatttttctctacctttcccctggctccttccccacagtctacaaacacaaactaatctctcctgccccttgtcccaaaaaaagcaatgacagtgaaactcttgatcttgtcttcctatagatgggaccctatttctctactagtttctcactcatttgtctttaaagactggccatctccatatccttacttctcattcattccttaacccactgctgtctggccctcctccccacccttcacctgcttgctcgccaaggtctcacccagggatgacccagaggaaaaatccaggagcactctgcagcctttagtccactggatgcaggggtttcattggatccagacttatccttccttgaaactctttcctccactggctctcattctgcttccatctcactggcctcagccagcccttcccatactagtgttggttttgtatttggctcacttccctcctcactgctgacactctctctgaacaactttgcccacatcagtacgctgaggacttccaaattatgcctctagcctagacttatatgccagttgcctcttggagacctttattttccacatttcaaatttattatttccagagctgaacttgacagaaggggagcagtatataatgtggcagttaggagcccaagttctagaattaaaacacttgacttcaagccccaggtctgccactcccccactgtgtaacctcaaggaaattgtttcatctttcagggcctcaatttccttttgtggaaaataggaactgttagtttgatatgaactatcaggattggtactataggtaccagtctcatacagttgttcaagtataatgagatcatacgtgcaaatcactatgatctcacacatggtaagaactcagtaaggttggccattattatattattataatcattatgattgttgttattatcatttaggacatggtgtcctgctgccccagtgctggggaagtagtcccaggcagcacggggtcatggacagaaaactgagatctgttttagggaccaatattcaattcaccaggtattgcctgagctcctatcaaatattaaacaccatgccaagggcttccaaagatgcatcaggcatttattaccatgtggtaataaatgcagactttatcctggagacagtaggagtcattggaaattttatagcagataagtgacaggttctaatttttgttttaggaaaataattctgggagcagtgtgaagagtgaattggagcaaagaaccttcctaggcaagacgccagctaggaaattgtagtggtcagacgattgaggccaggatcctaagctaagatacgggaagtgaggcaggtttgagaaacacttggggaactggaactacaaggttcagagcccgatcaggtgtgggaggttattgcattgtgaagaaatagattgatgctatgacggaagaacaagttggacacacagaacggcattgcattgctgaatccactgcagtctgatggtccatcttgcagactgagaaacaagttcgtcctcaggtgagagtgcttctgtctccagagtgtgactcttacattgagaatgctcctgagcactgccatataaaaaccatgccaatttattcattaataatgagaagtatgactaccaagtggaatagatattcttatgaccagtcagcacattctctccttataggataatctccttgggaagccaaggagaaattaaaagttgatggtgatcccactttcagatcaaagggagtttgttatataatgttaatagctgatggcatcaagctgcaactcatcattagagaatacaccaggctaccgtggaaacattatcaaattttacctatcgggatccccttttatagacaccatacagattggtccccttgttgggacacacttcaaacagaacacagggcaacaatgaagtttatcattcttactcgtaatccacactcactaagcaatgatatcaggtcagaagcagcctcaggaagatccagtgtgtcttctctttgacccacacttcaagtccactgctggctaatcaacacccgcagcaccagcctaggaggccccctgtgggttatgggtcttcagttctggcagccgtgatagaaagggaaggacagggagggagcctgaagggagtggcatgcgcagtcttattgtctgtcctaatagagcttcttttcctttccagcccacagttgagaatgtcctttattgttttctccacccgaggaacaaccttaatgaaactgacagaagacaggtaaggatacttcttatctctgttgttaaaaagtccatcacttcctgagtagccctgagatttgtgctctggtgccagccttgacctgttgatcactttaatctaatagttccttcttttaccctaagtttttaaccttacgtatgggcacatgggtcctgctgctagttcactcttcagttacttttgatagaatttcctgatattggtgaaattttataaatgatgaaattacattaagataaatctcacatttgattgttgattccatctgctaacttggagcgaaatgttggcaaaccatattattgggggactatattttcttttacttaagttagacttattttggattaaggtttcagatacaagtgcactgtgagacaggtaagagcttgaaatatttactgttcataattacccaggaagggagtagaaagggagggcttatggtaccacaaaataaaaggaaatttaaatagtgtaaaagaatgttgttgatacaaagaagttaaactaggtagatctagcttaacaaaagtattttaggatttgccacattttacttgcagatgaaaactagcaataacagagtcatgtcatttattcatagttaggatggtatactagagagtggagaggatagtcttcccccatttatgaaattgtacactttttaaatagtgagatggcccacatgagagaagcaccatggggaacacatgtgggattattgggagactcatatatggatgtgttggaaaaagaaaaggaggaagggccagtacagggggggcaggaagactttattctctaacgttcttatagaaatgaatataggactaacaggacagagtaaaattttctagctgaagtcagcaaacttgagctagtccctattttttttcccatgactttgttaggatttgtaacagaaagagtgctctgtaccatgtaggagttttcaaatcctgttactccttcaacctgatctactatatgcatgcatttcattcaaaaaaacaggagtttctgatcccttattaacagaaggagaaactgaggccatgtcaccttcccaagaatagcaaacagaacccagaccagacccaggctccacattctttccagtttaccttgctgccttctgttcaacagagaatcataaaatccaagacacttgtgtgacttgccttcaatactggccaaggattttaagaagctctgagaaggtgtctctggccatctcaagactcctcatcttgctcagtctttagatgatgccaccccttatgcagagatgttttttgttctgcgatggggagctaaacacccctctcgcctgttcttcacatcctcctacaacccgaggcttcctagtgcagcttcatgctgtccatgccccatgcataagagtttggccaagagaccaggttcacacatcacttgcaggtgctttgtgtgctaatgctcacagcttctgggaagttgacagggtcagaggggtcagggatttataaacactatcagaatgccaagtcttccagacccattgtggtttgttatgcttgttggaattagtcatcctctgaatctactgggaatctaatttttgtgtaccttaacgtcactactgctagtttcctgttctgaagagaaaacagagggtagagtccctggtttgctggaagcagcattttgtatgggtcaaatgtgcatcaaacaacagccaaaaatgccttgctgaaggctgtgtggatttcatgtggtgactgcttggcctaggtcagctgggaaagcacagcatggtttatggacacacccccaacctcatcagcctatggaagaaatgtgggcaagatctctctgaaactctttctcaggagactggctaaaagaatcaggctttcagatcttccaagctagtactgcttctgaaatatatgacttgcagtgttttagttgggcacaggaatttgtatttttctatctcacttgattgtcacaatatccctataaaacagtaaagggtccattaagatacctgtataatacttgagagaccttatagaattaagaaaaacttgttcaaaagcaagacatgaattggcaaagactttcatttcagcaaaagttttgggtaaatcaaaagaaataatatcaaagatatacggctgatccttgaacaacattttgaactgaatgggtccaattatacacaggtatttttcaaccaaatgcagatcaaaaatacagtattcgcaggatgcaaaatccacatatatggagggctgacttctagtatatgcaggttctgcagggctgtctgcaggacttgagtgcatggatttggtatactcagggatcatgaaccaatcctctgcctataccaaggaatgactgtattcgcattcagttcttgggatcaaatacacgtagggtaaagctatgagaagatgaaaaaatagaatggaaaataaatataatgtgttaagatatagtaaagaaactccaattagaataataatgcctacgatttgtgtcttttatctgcaagcactttatccttttttatttatcctcatataaccattgttactctattttctaatgggaaggaactatgcggtcatttgaatcattgttatatatggaatgtgtcgtttttctctgttttcacagtttcttcttttttagttcttagcagtttgattatttgtgtgggcatggttttccttcagggtaccctattttgactttgcagagcttcttgaatctataaacttgtctgtcaccatatttggggagtttgcagctacttgagttggggggggaaattctggacctcatggtagtgtgggtcatttctctaggtttaaattttcctccccagtccaccagttttgtttaccttccagtctacttggttgctttttctgttgtaatcagcaggtgatataggcagtagcaagcatactctatcttggctgctgctacttcaattttacagataaggacactgaggttcaaaaagtttaggtaacctgccgaggtcagatagctagtaatctgccaaattagtattctgattctggattctaaatttggtccaactcctgtactttgtactgtatcatgttgctcttccaagatttcctggcttcatcagtttaaatagttgatagattgtaacaaagtttgcaggtcacttccttagtataatagagtatacaatgtcaatttaagtactgttagaataaaatgatgttaactactgcatatgagtccctggatactccaaggagagtcttgttcttacattaattgaaatacttcaaatgtgtcatcatttagaaataagaaataagaccacgtgaaggaagttcaactattcatttaaaaaaaaatagatgctcaatttaatcaaatgcaattttgccttttgttaagatggtgatatttttcctttacctactagtacactgaatgtcataaaaaacatttttaaatattggatcattctagtatttctgtatacatttggttatgatatattcttttaatgtatatctgaattctgtatttttaatattattcagaaatttagcacccctatttataactgtaattgggctgccattgtcctttttattactacctttctttacagtacttttgattcttttttatttaaattagtacttcttctagaatttattatgatataaggtacaaggtcaacatccagtgtttctttccccgattgattagccagttcttcccacaccactgtgtaataatcttttaccaacaacttgaacagttaaactctttgctaggcttgggttcattactggattttctattctgttctgtttttctgtctgtttctatagttggatcacattgttttaattagttttaacatctggaggaccaatctatcctcatttctaatcttgggtgaaaatctccttggtctttactggatttttccaaccacatacattttaaataattttttatgttcccagatatccctgggattttcactcgaactgtgtgaaaaatacagattaactcagcagcaatggcgctgcattttctctatacttattttcttatttagggatataccatgtctcgtttacgtccctcagtacgattttgtttttttcttcaaattagtctaattgtcaacatttttttcccaggcattttaagttgcctccattgtgaaagaaatgctttgctgttgtattctccaaactgtcattcttcactcttgactggtgaacctatagtttgtgatccatgggcttctactgaactccataaaatgatttacaaaaacgtgcatgtcagtgggttttctgtagaaaagaccatgcatgcagcccccatccccatcccctgccaaaaaaagagcttcagaaacattagttttggggaaaacaataggtttctaacaggttttttgttgatttcttttatttttattatttttatttttttaagagggagtcttgctctgtcacccaggttggagtgcagtggtgcgaactcagctcactgcaacctccatctcccaagttcaagcgattctcctgcctcagcctccctagtagctgggattacaggtgcacaccgccatgccaggctaatttttgcattttagtagagacggggtttcaccatgttggtcaggctggtctctaactcctgacctcaaataatccacccacctcggccttccaaagtgctgggattacaggtgtgagccaccacatctgccttcttatcccaccactttaatgaaacattttattagttctaatagttttccagttaatttttaagtggttttccaataaggtgattgtagtatctgtgattaattctgtcttcttttctaatatttatagctagtatatcttcctgtgtatcttcttacattctaaaattttcagactttaattcccaattgggttttacaattatgcattttattggatgctaacttcatacattttatctactttgttaaggaaggattcttcaaatgcgagattattaaaactttttatctgaaatagttgttatattaaatacccttttgccatatcaaaatagttatatctttcttctatttcctttgacctgtctgtaaaaattttaaatcaaaagctctcctaatgggcctggcacaatggctcacacctgtaatctcagcactttgggaagctgaggtgagaggatcgcttgagcccaggagttcaaggccagcctgagcaacatagggagaccccatctctacaaaaaataaaattaaaaattagccaagcatgttgtcacacccctgtggtcccagctactcaggagaatgaggtgacaggatcgattgaggcatgggaggtaaaggctgcagtgagccgtaatcatgccaatacactccagcctgggcaacagagtgtgctgtatcaaaaataaataaataaataaataaataaaagattttctaatgaaaaactaaccttacattcctacaataaactttatcatggtttgctatgtttttattgtgtttctggtttgatttaagctgaaagatattacttatcaatatttaatattgagagtattctggggctttatttcatacaatctctgtcagtttgggagtaaacggattacatgagcttggaaaaatgagtaggcaatcttgctgtaagctgcagaattgcttaactaataaagagagcaaacgtttgttcaaagtttgatataactcagaggaaaactatcaaagcctaaattattattgaagaagctctttgacagttacctcagctttttgtgttattgcttttatcgtgttttctaacttgagaaacagtagaaattaccaatatgttgacattttaaatttatcacgtatctttttaattttcaaaagctcttctgtatctttggttatatccctttcctccaattgtataaagctattttcttttctcttatttgccccattcagattacctaatggtttgtttcttaaatgtattcatcagttctgttttatatattgttagattttatgattcattattttatcttattactattattagttccttccttctgcttcttatattgcaagtttttctggtttctcgaaataaaagataattgcccggtgtggtgactcacacctataatcccaggactttgggaggctgaggcaggctgatcacttgaggccaggattttgagaccagcctggccaacatggtgaaaccccatctccagtaaaaatataaaagttagctgggcatgttggtgcgcacctgtaatcccacctacttgggaggcgagaatttcttgaacctgggaggcggaggttgcagtgagctgagatcgcaccactgcactgtagcctgagcaacagagcaagactctgtctcaaaaaaaaaaaagattattcactatactttatttctttctaaataataaaagctttaacagtataaattgtactttaaatctgatatggttgttgaattttatacattttgacatgtcctgttcttattattgttaattttttaatagctatatttactatttttgatttaagatgatttaggaaaagtgtttcacaattttcacatttttgtttaccctttcctcaatttctagagtcatggaagtttttaaaaattcaatttatataatttctattttttagtttattaatttttgttggtggactactacatgatcaaattttatttagtatccatggatgttagaaaatatgtacactttgatgattaaaattttgttataagaaacattaatttttaaatattttatatttttgtttacttgatctatgaagatagacattttgcattttccaccatgactgttttattttaatttccaacacattgctttttaatttacatcatcttacttggcttatgtgtattttcattatggagtgtgcatctaatcaatataaaataatctttttgtcacctttagtgcttttggctttatatcctttgtccaagattagtattattaaacttgaattttgtttgcacttcctgatatatctttttcattcatttattttttactttcgttgatattttgtgtaatttttcaatgatttgaaaagtataatttcatttgcatcctagtaacagttgcaagttaattttgcttgcctcgatagtgacaagaattgaataaatatctactgattcttcttgctgaatttctttttaagaaatatttgcattgtattttagaaacatatcaacaataattatctaaacttactgtaagatttacggatttcattgaatatatatgaatacacgcacacattcacacacatacttcctttccagtacttaagttttaattatatatttttaattcctcagtttgctaagtcttttttttaggtaagattttcctgaagaatatgtgactattaagacttataagtcaccatttatatgagaatttttttgtattcacctccaggtaaatatttccattgaatataaagctcttccatcttaactatctttccccttacattttctaaagacatagtcaacttgcattattagaaaggagagatgccaatttaatatatctcttctatgtgggtagcctgttttctcttcctggctgcttatagaacttttctctttatcatacatatttttttaaatatcaacagaatatttccaggtgtagtcccttcattaattttgtaaagtactttgtgtagtacttgagccattctatctgaagacttaatacactttttcagcttaaaacatttctcttttatgccttttgtgattaacatttcttctgtccattcgattcttgaatctatccaatatctctttatattctaagtataattttttaatctttctattatttttttgacatctgagagaatgtttcattcagatcctgtaattaccagtctaagttgtttattttgtttttgcttctgttttcacagtcacccagcttacttttcactgcttccattgcatttttcaattgacaatatctttcatccctatgaatactttcctgttcctaaatttttccacatgtgtatgaccttgctgttgaaggtatgtcttcaacataaatatacactagaatgtcttcaacataaatataaattagaattggttatatgtgctcccttgttttttatatgactttatttcaaagggggatattttctcaaattcctaaaattggtcctcttcttcccaactgctgagactttttctgagtatagtgacttaaaaatggaaccacatgggcttttcagtactgggatttgggaaaagttctgcagcagatcatgcaagatccttgttgaaaatgttaagagctcaggctaaggaaaatgaaaacatttatatgtagcataattttatcttaggcagagtagagacccagcagtctttccaaggcaaagaggaagatgaagctaaaggaagatggtcaggtgtagatgctggattattgtgttaagaactagtttccttcacttccccgccatccctcatgcttttcttcttgtgctctaggatcccggggtggtgggtccttcccttactctgacctcagcagctccacatcatgcagaaattcaaagtttctggcatccttgcctatttttcagcagtgaagaaacattttctctattatatcagttagctatttctacagtaatttggaaaaagaagcaaaagttaaaatatgcagaccaagatcattatctttgactggaaatttcacctttcttccaaactttgcaagattgaaaaacaaagcataacagaacaactatgagtcaaagaattattatatcttatccaacccactgacctcattttactgctgaggaaaatgattcccagagagacagaattctttgctcaaattcattcatatactcactggcaacaccatctttttaactcacaaaattaaaaagttttaactcagtgatttttctattacattacaaagctacccagtacatactgcctctgcatgtattattttgtttcttatctgtgtaatagtcaaatggaagccaccaatatgtgtatgtacatatatatgcatatgtacatatatatgcgtatgtgtttatatctaaatataatcttttattaagggcttattatatacctgtagcctagtatactttcctcatctataatcagaggaaatagtagtatccccctaatttggtagttttgagaattacatttattatatgtattatcaaagatggggattatcgaggtggagaaagctcatggccactgtcatgtgaaagtgtaggaacctgaatttgaactcaagaagcgctatcccagtgttcatattcttaattactatactgtaggatttcccatgattttactattacgtacagttttaaatttaaaacaaatctaagcatacataattcaccacccaaaccctctgacatctttaagaaaacagttccccgaggcagcctatgcccgctatacatttcatcttcatgggcttttggaaaccggaacttggaaatactcctcacaaagaggtaaagaggtagcatcagcatttcacagatgggggtacgaggttaagtatcttgcttattgcttaaggaggtagaatggaagccaagaacacttggctccaactgctgagtgaaaaccaagagaccacatgtctctctccttctcagtcatcctttggtttggttgaaagtgtggttttgctattagtgtcacaggggaaaatgacatactctgaagacatcacttgattcctggagctgaatgattacaggctgccattaccaagagacatagttctaaaggccttttctaaatttaaaagcaacaaggagaaagagtcttaagatatttagtgcttgaaagaacttggattcatttcattttgaggtactgttcttttagttgtgtgagggcttgatggtgaaattaagacaaatggtgagggagtggggcatttgtttattctcttgtcctgttgattgggagatattatgtggtctgagtccataggcaagtgtcttgcctctctgtgcctcagttttcttatctataaagtgaatgcaatgatgaccccacttcacagaactgttggaagggttaacaatgcaggcacatagtaagtgctcaattaaccttagttgttgttactattgtggttgttgttaggggtttttataaacagctaaggaatggccccaaatcctcctggacaaatcccacctcaaatcatcacagtaggcccaacagtgattcaaagggtgagtccccagctccccttggcccacatccttcttgaagttttaacatttggccagcctatccctatatagagggatgcaggtagaaaatattgcctcaacatgaggccagatgaaaattattgtttcttttgtgtaatagttgtagggagacttcttccagataaggggacacaggcaatgtctctacagaaggtttgtttaaggggtctccatgttggtcacaatgatggtaaaaagaaatcaccatggagcaatttagcaggtctgggaacagattgatttgtgagagtagtgtagtccactgcttctcaatcccttcctctggagtacccttgttagtagaagaaagtaaaattgtaccccctgaggcctcacggtatagtatgaagtgccttgttaaaagcaagaacttcttttaagttcttttatcttaaaaatgtgcatgcatgtgtattctattccataacataattccattatatgtgatgttacataaaaattctgttctttctcaaattttggagtacaatttatgctccagaaaaaaaacattatgtgtctcctgtgtctttgtatatagtacactgttacataccaagtttgggcaccacagatgtaacagagaaaacacagactttggaccaggacccattatggtttccaatttgggctccaccaccatgtgcatgtaattgcacttctctgagtctgttttctcatatgtgaaatgaagatagtaatgcccaccatatggagttgttatgagactttcatgaattaacatatggaaagcacctaacagagaccctagcacatcacagataccacccttcacctgctactactcatgtggcaaatacaaattaagaataaaaactgacaaagcagtgcccagaaacatttctgttgtctggatggagacagcaaggtaaactttagaagtagtcaacagaaccaaagaacagtagcattctcatatccaaagctagctagccaaaaccaacatattttttattgcccaacaaaaacaatcccagtactggtcaacatccacatttctacctctgaagccacgtggctgtcacctgactcagctcctttaccaccagtgtgggtgacctgttgagtcttgtatttaatgctgattctgatagcctccgaatgcctcctcatgaactccaggttcagtctttgctactcacttcaattttttaagtgactaaatatttgaggtataacaaaagtatagaaaaaaaaaaggttaatgaacactcattacccaccaaccacgcttgtggaataagaggttacaggcagcatctcctatgtagacctaccatttctctttcctcaccagagataattattatcatgaattagggatttatcatttcaatggatattgcatacttttatatgtgcataagctataatatatattcatattaaactttttttaaaattttatttatttttgagagggttttgctctgttgcccaggctggagggcagtgtgcgatcttggctcactacaacttccgcctcctgggttcaagcaattctcatgcctcagcctcctgagtagctgggactacaggcgagcaacaccatgcccagctaaatttttttattttattttagtagagacggggtttcaccatgttggccaggctggtctcaaactcctgacctcaagtgatctggccacctaggcctcccaaagtgctgggattataggcatgagccaccacaaccagccgaaactttattttttaaatggtcatattgtgtgtatttttcttgaacttgctttttatacttaatgtcatgtttttgagattttttttgtgtgtagatacatatagctggttggctcattttaactactgcatacttttctattttgtcatattttattgtaataacataccacctgtacttacctgctctcttattcatagacaatttgtttctaactttttgttattataaacaaagaggaaatgaatgtacttatacttgcctcctgttgagggtagggtgggcaaaagcaagaattgctttatgcactttgctttattgcactttgcagatactgtgttttttacaaattgaaggttcatggcaaccatgatttgagcaagtctgttggcacgatttctccaaaagcatatgctcattatatgtctgtatgtcacattttggtcattctctcaatatttcaaccttcattattattattatatctgttatggtgatctgtgatcagtcatctttgatgttactatctattgtccttgttttggggtgccacaaaccacacacatgtaagacagcaaacttaattgacaaatgtgtgtattcttactgctccatcaaccagctcttcctccatctgtttccctctccctctacttggtcttccctattccctgagacacaacaatattgaaattaggtcagttaacaacacttcagtggtctctaagtgctctagtgaaaggagtagttgcaagttcctcactttaaattcaaagctagaaatgattaagcttagtgaggaatgcaggttaaaagccaagacaggccaagagcaaggcgtcttgtgcctgttagctaagttgtgaatgcaaaggaaacgtttttaaaggaaataaaaagtgctactccagtgaacacacaaatgattaaaaagcaaaacagccttattgccgattttagtggtttggatagaagatcaaaacagccacaacattccctaagccaaagcctaatgcaaagtaaagctctaactctatttctagaaggctgagagaggggaggaagctgcagaaaaaaagtttggagttagcagatgtgggctcatgaggtttaaggaaagacgccatctccatgacataaaaggcaaagtagcaagtgctgattgagaagctgcagcaagttacccagaagatttagctaagatcgttggtgaaggtggctacactaaacaacagattttcagtggagatgaaacagccttctattggaagaagatgccatctaggactttcatagatagaaagaagtcaaagcctggcttcaaatcttcaaaggacagcctagctctcttataaggagtgaaggtagctggtgactctaagttgaagctaatgatcatttaccattctgaaaatcctagggcccttaagaatgatgctaaatcttctctgtctgtcctatctaaaggaaacaacaaagcccagatgacagcacatctgtttactgcatggtttactgaatattttaagcccactcttgagacctacttcttgaaaaaaaaaaatcattcttttcaaaatattactactcattagcaatgcacctggtcacctaagagatctgataaaggtgtacaaggagattaatgtcattttcatgcctgctaacacaacatccattctgtagcccatggatcagggagtaatttagattttcaagtcttattatttaagaaatgcatgtctatagctgccatacatagtgattcctctgatggatcttggcaaagtagattgaaaacctttgggaaaggattcaccattgtagatgccattaagaacatttgtgattcatgcaggagtggccaaaatatcgacattaacagcaacttagaagaagttgattctaactttcacaactgactttgaggggttcaagactttagtggaggaagtaaccacagatgtggtggaaacagcaagagaaccagaatttgaagcggagcctgaagatgtggctgaattgttgcaatctcatgataaaacttgaactcatgaggacttgattcttaacgatgagcaaagaaagtggtttcttgagatggaacctactgctggtgaagatgctatgaacattgttgaaattacaaggaacttagaatattccataaacttagttgatagagcagcaacaaggtttgagaggattcgctccaattttgaaagaagttctatggtgggtaaaatgctatcaaagagcatcacatactacagagaaatcttgtgtgaaaggaagagtgaattgatgggtcaaacttcattgttgtcttatttttaaaaattgccacagccaccccaccttcagcaaccatcactctgatcagtcagcagccgtcagtatcgaggcagaaccctccaccagcaaaagattatgattcactgaaggctcagatgatcattagcaatctttagcaataaagtatttttcatcgaagtgtgtacttttttttttttttgagaccgagttttgctcttgttgcccaggctggagtgcaatggcacgatcttggctcactgcaacctccgtctccctggttcaagtgattctcctgtctcagcgtcctgagtagctgggattacaggcacctgccactatgcccggctaatttgaagtatgtactttttaaagacatactactattacatgcttaatagactgcaatatagtatagcataacttttatatgcactgggaggccaaaaatgttgtgagagtcactttacttcaatatttcaatattcactttatcttggtggtctgggacagaacccacaatatatccaaggtatgcctgtagataaccaggagttaaattgctaagtcttaaggtatgtgaaggtctaacagggcttatttcaaaagccagatggtgccatagaaaaccacatggtgaaattactgcacaaatgtgtgaccaatgaaaatagagttgtataaagaagagtttggacaaattcatcttgtcctgtgattaaaccatccctcttgtcttttatgccagcttatgctgcaacctttaaaaattccttgatgggctcctctttgtcagcttcccttctggctctgcactggatcctgtgttacatcatggactattcctgtctgccaagtgtggcctctccagttcccagaagatacccaggttctatttctgcttgctcttttgttcccagttcaaatcagatgcaatattctaagctggaagaaatctggtagatcttagcattccacacctttgttttactttgagaaagctaaagttcagggaggttagctgacatacctagcacttggtagaataagatttccatcccgagtctgtcttcctccaaagctcatgcttctttgatggagtttggctctgaagtcatggaagaatgaggtgaccttgtaaaacagtgctgatgtgaggatgggtgatcttactgagttctggagctggaactccaatctttagagttctagatgagatggaacaacttacatagaaatgtgagaaagaacaggtggtaaggtagaaggagagagtatggtgtaatggaaatcatgccataaaacacaaatctactctcaaatctttcagagaagagagcattgcttaaatgaaggacatcaactgtgtcttatgctgaaagaggttgaggaacatgaagccagagaggtgaccattggattggtaacatagcgggccttgctagaagcagtttcagcagaggcagagttgtggagacaaaagtcagagcagagtgggttaaaaaatgaggacttccaactttaaaatgagatttttaaattaaaataaataaaaatattttgataagttaagatgttttcccctttctttcaaaaaaccaaccccaaaccaggaaaacttgaaacaaaagcacaaagaccatctttgaggaaactgagaaatatttaaaccataaaaacaccacatataagaatagaagggaaggaagagtggcaaatgatatggcactgtggagaaaagtcaaatataatcctgtggaaggaaatactgaagatgaacaaaccatgtagccttgtagaatcctagaaagctcaaaacctggatattgcaaaaggcaaggaagggttagagagtgaaaactggaatattgattgtttaaaagctcttcaaccttcagaaccatccctccttcccactagagtttgaaaattaccccttatttacctccaccagagaggagaagcatattttctgacaaaattgcacaagaatggtttcatagtcagggacaccaggcacagagaaattatagagacatctgcaaaacaaatgttgctacttccagccttcttccttgtccaatttcagacttaaaatctaagaaaagagtttgaaaactacttctctgtagaaataaatgtcttagagggaaaaatacatacacataaaatgatatttgagagtcttcaacaacaacaaaaaacaactgccaaaaaaaaaaaaaaagctggtcattcatcaattggcatgcccaccatgcatgcagagcttccaacaaggcttttagtctcattcatttgatatggacagacagccaaagatcactaaacatttgaagaaggactccaccagaaaagacaaggagtgaggagacaagtttcaagaagctgtgtcatatagagagatgtgaataaataggtcagtagctagagggagatgtgggatcaaagaggactttaaaaaatgtttttaagataagagatactagagtgtatttgtatgctggtaatcagcatctagtatttttctttctgatttgagacaaatgtgtagtcacaaacatttagaaaagaactgtaaagtatgtctgcttctgtttatgatattcagagatgtgaaaagccttcatttccatggtcaaccagaaaagcccagacaaaataaaattcatatgtttccgtgaggctagtagagatgcaggaagcactgattaactgaattagagagaaacaaaccctttatataatagctaagcagagaaggttctgcagaagcttccatacttaaaggtggatgcgtggtctaggtttgggtaattggaggagtgggtctgccatagacagacactctgcagggataaggaaaagtcagctgagtcttacataaacatgtgtgccagaaggaggctttagaatctgaaatgaaaaagaaatatctcagcctaagttatcccccctcacccacatttctgcatttttccaagaaagcagcagtggaggaattgcctgcagagtagagataaatcacataattaggtggattctcattgtgcttggattctggagtcctaccagagtgaaatacaaaggtcaagcaaaaatatctgaagctgcacctagccatctaccaattcaaatactgagaagatcacaaaggcagggcagggcaaaagtccaggagttggcctaataacagggaacatgaatctaacaaaaggtgcagcccagcccaagctcaccctgactcaaggaggaatctaatgatcagcccctcgccctagctcacaaagaataaaagccttatgctctgcagtgagtaaacaacacaaatcaatattataccgaagtctccactgctttttttatactcagtgactgaaatgtaaactgttatgaaaaatgggaagaagcagaggaatattactcacaataaagaaaaacatagttaatagaaacaaaccacagatgactcagttatttgaattaatggacagggacttttaagcaactattataaataggttaaataatttacaggaaaaggtgaatacaatgggggggaagatatgggtgatcagaaattaaaaaaagaaaactcaaagaaagaaccaagtgaaaactgtggaactgaaagatacattatttgaaataaaaaatttatcagataggtttaaaaccagattgaacaccacagaaaagggattaataagtttaaaaacaagtgaatagaaatatccaaactgaaagacagaaagggaaaagtctgagggctggagggagaaaatgaaccagtcctgtgacttatgggagaatatcaagtgatctatactacttgataacatgtatttgtgtaattggaataccaaacgtgatccacacacagatccaagaagctcaaagaacctcaagcaggacaaatgcaaagaaagcatcacctaagtgcatcatagtcaaatttctgaaaaatctaaaaagcggccagagggaaggcaggaaagatatattaaagagaagcaacattaaaaaaataacttactttttattaggaaaaaaaaatgcaatccagagaatgaaggtccaatatctttaaagagataaaagaaaaaaatcaacttaaaattctatatccagttaaaatatttaaggcagaattagacattttcagaagggggaaaatgcctaagagaatcatcagcagcaaatctgcgctattaaaaaaaatgctaaaggaattctttagggtgaaggaaaatgataccaggtataaactagatccacaaaaaacaaatttaaaataaagaagaagaaggaagagtaccagaaatgataaatatttaggtaaatataaaaggttattttttatcttttcataattttgtaaaaagacaattgactaagacagaaataacactatttttggatttgttacaaacagagaaataaaatgtatgacaataataacacaaaggataagagggaactatatggaaatataatattaaaaggtttttctattttgtgagaagtagcataatactgacttatagtagcttgtgataaaataaggatgcatattataattcgcagagcaactgctctaaaaaagacaagacatacagctttatgtttttaaaagctaatagatgatactagatgaaataccaaaaaatacatgatcaatgcaaaaggatataggaaaggagaaagaaacaaagaacagaagtgaccattagaaagcaaatagcaagatagcaagatggtagactcaaacccaaccactccaagacttacattaaatataaaatgaactaaagattccagataaaaggcagagaatgtcacactggctaaagaagcaagatccagcatatcattgatttattactgcataaaatataccccaaatattatagcttgaaacaataatttcttatgctgatttcacctggacttatttatgcagcttatatataggattcagctggggattaggctcagctgggaaatacaatgcttctggaacagctgaagatctctctctcaatatggtccttccttctcaagtagttgaaaagaccaggttttccctcacagtggctgcaacagtccaacaaaacaaactccaatattcttgtgctaatggagccttagtttttgtcatatttacagatgtcctgtgggctaaagcaagttacatggccacatgcacagccagtatgggaggggaccatacagggaccatacagtgggaggagtgatctttggggacattagtataacagtccaccacatacaattatatatggtttacaagagacactttaaatataaatatggtgatagattaaaagtgaaagaatggaaaaagatatactgtgcaagcatcaatcataaaaagttagaatggatattagacaaagctgacttcaacataaaaagtatttactagagataaaaagttatcgaagaaagtctgtgtgtcaaagacaatccatgggttaaagaaaaatcacaagggaaattagaaaatgtatccaacaaagaacgaaaacccagcatatcaacatttgtgggatgcagctaaagtcacgtgcctagggtaaatgtatagctttaagtgtttttcttagaaaagaagaaaagattaaatgatttaaaaccaatgaaaaagtaaaaagaacttattaagctcaaaataagtagggaaaggaaaataataacaagtgaatcaataaaattgaaaatagacatataatagaagaagacaaataatacagaaaatcacaaagctcaaagttgagtattttaaaagaataaattgataaaccactggtaagagtggtttttctgggctgggagcagtggctcacgcctgtaatcccagcactttgggaggccgaggcgggcggatcacaaggtcaggagatcgagaccatcctggctaacatggtgaaagcccatctctactaaaaatacaaaaaattagccaggtgtggtggcacgcacctgtagtcccagctactcaggaggctgaggcaggagaactacgtgaacctgggaggcagaggttgcagtgagctgagattgtgccactgcactccagcctgggtgacaaagcaagactccgtctcaaaaaaaaaaaaaaaaaagtgatttttctaaaaggagagaaaatacgacttacagataatatcaggaaagggaatattactacagatcctacaaatgttaaaatataataaaggaatattataaacaattttatagaaatatattcaacaattataagggaaatgaacaaatatctgggcatgttactgtgtataaattgtatttcactaaaaagtacacaagaggagctttggttcagcatgcatcttgatattatgttaatcattttggcctatgcttaggtaaaagtcccaaagagactgttttatatacattgtaaacaaatgattacaattggttgtagaacttcataactcctaaaataacagcaaaatgtctttaattaatctgtgttcttctgttcactacactgttttcttatagtcaacaattggagccataaggccatctgggaatgttccaggagtggcattagtggtaataaatagtgataggtgtttactgtgtaagttgagaaccaaaggcaacaactgcaaagcatttgagaagagtccaattccacagaaggaaaatgataccaggtgtaaactagatccacaaaaacaaattcagaataaagaagaagaaggaagagtaccagagatgataagctcttttacaagaagactaggaagttgacaatgcagagctgatattgggttatttttggatggtgatggaggttgtttttatagaaccaaaatatgatagccattgcagaatcctaagggagattttgcagtggaaacctcagtagaatacttgggataaaggcttgttgaagcacttcttgacattctatgtgtgtccatcttttatttttttttctttcttttatttatttttttagagacggagttttgctcttgttccccaagctggagtgcaatggcatgatcttggctcactcaacctctgcctcctgggtttaagcgattctcctgcctcatcctccctagtagatgggattacaggcatacaccaccatgcccagctattttttttaatttaatttttttcttacgtgttcatcttttaatgttttcatcagcaatgttatcaaactgtcataacacaaccagaatcccagagagtaatcatgaagagtagagcaattcctagaacaacagaaagcccagaagacattgtgactgattctccccaccttctacccctacaaaccagcagagtgctgggtgcatggtgtatgctcaacaaatagcagtggccattaatgaatgatgggtgaatgcacccaaactggaatcattcatttgacaatcacctgcttgaggtcaatcattaagtgtagtgggagttgcaaaaggaacacaaaacaaatggcctaaaacccttagcttctaagtaggaacactggcagacatgtgaaaccaccaaggaaaacaggggctctgtaatagcagcctctcttcataggattccctgcctctttcatttcccaggaagataacatttcacttgaaataaccaagtcctcagagaggttcttatcatcccctaaaagatctttctcccaatctccttcagtttccaagagaaaataagaatagacccttattaatagtgctgttgtcccagaactaaaacacacccacaattcctatgaaaccatccattttgtttgcttagatgttgtgggtccttcaagaagggcagagagtagggagatggggccatgtgttatttgatcttttgagcagcaagggtggtataatggggaggttgtgatcaccactcgcaactagtgagttcatatcttgccagatacaaagcatcaaggataaggacattttccaaaacagcctttggttgttctggtacaaaaaaaaaaaaaaagtcaagaaaatacttgtaaagaaagggaaataggcttagagaaaatatcccagttcccagactttatttggcagggaaaaaatacagtgaagccaagcaaatatttccacacccccaagaagcctttttttttttttttttttgctctctttttaaatctcaagtcttaacacaatattccacttttagtgttacccaaatgtcccagacttcactagtctgtgaccaaagaattagatcatatttacttttaatgcccaagcgtctctcacctaactgtcagaaattatccctctgccccatagtgccccccagctattatgaggggttccatggtgccacctctgtgtgctcacaaacagaccccagttttcctatcccagcctccccgtcatgtccccttgccactagctctgctgctcggaccctcatgaaactggcaactcacagggcagagctgccccctgcctggggattgctggtgccatgcactgcccccagcatggccttggtgggggacactgctctcatctttattctccaggatatatgccctttctcattaccaaacaacagagtttgaaattaaagtatgccttttgatgggatttattggaatattagaggtaatataagaaatacaacctagagaatgatttttaaccaccacatgggcccagacttgtcaatgaccagatctggctaatgtccagatcaggtcctgcttggcctccttccatatggccaagggaagctcatccctgccccaaaatggtttcttcccagaatgagtaacagtggagacatccattccctccactcaccccttcagtaagtatttgttgaaagtctattatgttccaggcactgtagtaggcacagaagatataatggggaccaaaacagccatggcccagtcctcaaggaatttaaagtctagaactgaaacaaacaaaacctaaataattgcataatgaaatgttattagttataaaatatcttaagtgctataaagcaaaattgtggggtaccaggaaaaagtctaatagaggaagacaattcagattaggaaggtcaagtaagactactctgagcaagtggcatttaacttgggactgaaggctggataagaattagccccatgaagagctggtcaaatagtgttcccgggcagcagtgattgccgatgtgaagtgcctattggagaaaggggcttgggaagaccagtatggctgaaggcaagagagtgggggcagaatgatgtgagatgaggctggacagggaggcaagagccatctacataggcactggaaggtcatgaaaaggatttgggatataatcccaggtgtaatgggttggtgttgaagggctttgagccagagtgaatgccatgatttcatctgtactttaaagacattcttgcagccttatggagaaagaatggaaaagggggcaagaggccattcaaaagatagcaggtgactaccccagtggctaagcaagagatgatggtggctgggacagtggtgttggctgaagagatagagaagtagtccatttcaagatatgtttgaagtagaactaacagaatgtgatgatggtgagaggaaggaaagtcaagttagtggatcaaggagggcttccagtttctgacttgggcggctgggcatgtggtctgatacacgggtattgaaaagagaatagtcagtttccaaagtctgagttacttggtattaaatattccacctatgaagcatcagcagcccagggacaggcaaaccccttttcagtttgtcttttaaaatctccagcagtctggcaagccaccctcacccacggtctccccatcatatcagttttaacaaaagattactattttctttagaattccccctccaagcaatgccaggataaatatgagagaaaaagagagtatttatcatactgattaagaacagggcctctgggattaaatcccacctctgtcttaggtaagagtggccttgggtaagttctgtaacctctctgtgactcagttttcttatctgtgaaatggcggtaacaatagtactactgcaaagagctgtcataaggcttaagtggatcgattgtatttcatgtatttagacagagcctggcaccataagttctcagagccataggttcccagacagtgttaggaactgccattgcctttcactgatgccaggttcccacttcctctagcattgttccatgctagaggctgctttgcagaggagaaagccttttttgagtcaggtagatttgacttcaagtctccactctcctacttaacctctctgagcccaagttttcttacctgtaatgtaaggacagtaatactcactttcagtggttattatgagggtgaaatcagaaatctttggtcactaccttgtatatagcggatgctcaataaatgttagattttttcctatccaaaagagtttctcttcccaatttaaatagagcatctccaccctgtaccactaaaaagaccccagcaggaggaaggcaaaatttcaaacccttcatagggttacagtttatgaataaggtatgtgagtcagaaattttactttattgccctttttggcacaatatggagctatttaaaagacagaaacatgaatgtagacttcttacatcccagagagaatggtccacaaagattccatttggcccccaagtcatttatgtttcccactgccagttgaactcttcctgcccgcactgtcaccttgaacaatcagagtaagaaaacacaggcaccggcccacagaaaacactcttggctgtcctggaaagcggagattccttgggtttttattttccgtttcctttggcacacccgtgcggtggcagtttgctgtggatgccaccctcttccacctgcgtccttgtggtggcctttccctgggttcttggttctcacctctttctggctcacatgagccatttgtattgctgcctaagttgctgtgtgtcccatcaggagcagcatttagagactcatttccaatgtagaaggaaaacattgtgttaagggaaaggaaagtgtttacaagcagatggagagtcctgcagaagagtctttccccttaatccttgaaatctcactcatcctgtgttatggttgaccctgaacggataatataaaggccttccctttgataggcttttggggaattactgggactagacagcagtatccacagaggtaagaagaagactagtacttatgactacaacagcaaagtaaaaaatactcaaataagactaacagagtgtctttggatttcagagaacaaatccgtcaaggcctagaagaactccagaaagttctgccaggaggagacacttacatgcatgaaggatttgaaagggtaattttaaaacagtttgaaatccaaatataaagcatgatattgaaatatcaacatggggtgactgatgagataaggcacttatattaagagggctgactagcacccaatagcaagagagtacattttcttcccataagcttgtacactgaccactctagccaaaagaactaaagaaatggattcccttccttcttccctgaccctgatgaatggtttgttagctaatggttggctggcagtcacaaattcacgccacacacaagtcccgccactccaaaaatgtcctttgttggatgtcagcttcagtgattgaggcagaatttcagggacttcagctttaagggaaacaagaccataaggaataagacatcaatccgtgctgacaactacagtcatctgtcacttaacaagtactaggccataaggaataagacatcaatccatgttgacaactacagtcatctatcacttaacaacaaggatttcaacaaaatgccttgttagccaattttgtcattgtgacatcatagtgtgtacttacacaaacctagatagtatagcctattacacacctaggctatatggtgtagcctattgctcctaggctataaacctatacagcatgttactgtactatacattgtaggcaattgtaacactaatgatatttgtttctaaacatagaaatggtaatgcattgaactacagtgttaccacagctacgatgtcactaggtgattggactttttcagctccattataaccttaggggaccactgtcatatttgtagtctgtccttgaccaaaacattgctatgcagcacataactgtatactacttaaatgagaggtaactttacatggatatcagccactgataattgagcaaagcctgggtgaattacataaggaatcaagactgaattggctgcatattcaacaacagagcccattatccactatggtttttggagtgacaaacagtggttataagtctaagggctctttcatatgtttttcaggccagtgagcagatttattatgaaaacagacaaggtaagactatagtatgaactaccattatgaattatttaactttttccgtgtttgttgctgaaaaagtgcttcagtcatttcatgtttcaaaagacatgtatgatattatctgtaattcttagacacacatttcatcacaaacaaggaatgcatagaaaggtggcatgtattgggtcaaattccactgtcctgttgatgccaagaaaagttatataaaagtaattaagatcccattttggccacagtctaattcccatgaagagttttgcatgttgaattcactaaattagtaaatacttgcataggttagtaaagtcttggatttttatgtaaaatttaattttgttgttcttctctgagctccaagcctcttcattactgtgactgaacataacattaagatcaaaataccagtttgatttaaactttcctatatttaaatgaaaaaactgcataaaatatactcagtagagtgcctagcacatagaaatttttattattttagctattattactacagtgtctttcgtgagtagcatttctgtatctcagtcaaatctcttaaaaaagagattcaatattacagtagagactttcctcccaggcctatagaggtgtccatttcttgtttcatcctaaactgcaacaaacagaacagactcaatatcaacaccaaatcttgctaatgtaaatcaaccgtgaatgttgatatgagaagcctaaaaatcactgaaataattctagtaggttttgccaactgctataattcttccagtcaacttgtaaatcatgatgactattactttcaccaaactgtcttcaaggggtggtgtatgtggtccattacagcaggtgacaaggacgtctgaacagcccaggtgggagtttgctcacagcttgggcaacagttatgtgtctgctaatagaaaataatcacacttgattcaccggtgctactcccaaatgttggtttagtgaccatttcatcaggtttggccatttttcaagatgaggctgaaaaatgagaaagcaaaacctattccccctaaagtctgtccccatgggggatccttcttcatgctggagttgcttccaggcccaaaagaaaagttggtgattctcacaatattgactttgggtggttgaactcgtaagaggttgaatcctgggactgagagggtgtttccttgggtggagcagggtggactgagccagtctgtattgtgttaaacagggtacaggacagccagcgtcatcattgctttgactgatggagaactccatgaagatctctttttctattcagagagggaggtaagcaacggcctggctgtgtctaaacatatacatggaacggggcttctcctttctaaaatgggccacactctctctattcatgtgataggtgttctttgcaaatcccctgaatgaaatagagtttcataagtagaaataataataataattcgtgttctacaagtgaattttcatgttttacacatggtaaatgttttcccctttcaaaatttttacatattactctgctttgaaggattaaaaattctaccctgcctttattgatggcattatattgctctaacagtttttaaatactgtatatcacttgtaaacaaataaacattgatataatttttccttatattttctactaaaacaggaggaagggaaagaattacttgaaatatgtaagagccagtcttgtcagaatgtatcaatcactgagattttcactctaagaaccaaagttaaacagcagttggtagcaaagttaaattgtcatctctcttttaatagttcctttttttctttttctttgtgttctcaaaaattattcctcaaggcaagtggaaaaattctctcaatgaagattttaccttgtataaatagacttagaaaaataagtttgctgatgaattgaaaactaatgtttatacttacgaaattcttttctttcaagtttcacatttgagctatatgcataattagtataaaaggaaacaagttaaccatagaaatgtactgaaactatagccttattagtgacaaaggttcattcaggcccaaggtagaaagaaacaacatcccagagatgcaggctctagaagaggagttaatggtagcatcacactttcctcaagctcttaacaactatttactttaaattcagctctttccacaaacacaaaatatatattcattcatttattcattcagtgttaactgagagcttggcatatacttgaccatttgctagaaactagaggcacagaggtgagtgagatacagctgctgccctcgtgagtcaccatgaaataatggtcagccctttgaagcctacactggcagaggacttagagaaattatgtaggtaaactctcctcccactagtacaaaaagtaactctaatgaggaaatacacaaggtaatatgacagacactccctgagcatttggaaaataatacatctctatatttgaaagtagaaactcactatgtgatgggaatgcaagatggcttgattgggtgccaaataacagtcaaataaagtaaaaaccctaataaggaaagaattgaaactaaaataaatgatggggtgtcagaggcttaagatagggattagtgggaaggaattttaggtatggcacatacaaacttgggaaaatattcagagtgccagtagaaggagaccttctgaaaaagaaagataaagctcaagatataaagaaattgaacttttcccttcttgacaattctatataaagtccaactggaggagaagaatcacagagttgttgcaaataaagttgaggctacagtgagtctaaaagtttattttatcctaaaagcagcagggaaatttctaacatgaaggaaaaaaagacataagtttttgtcctttctagaattcagtgttaaacagaaatggatttgagtactaagaaagggaaaaaataacacaatcaaaatcaatatgcatatattgagcactcgctctatgtttgctatcagttattaagcacccactgtaagtgccaaggattttcaattttttttccattctgaaacacaggagaatctggaaatcagattatcagagactttaataaatcaaatattgaagttgagccaaaatctgggtattattcattatgttgccatcccaatgcttaattgtagagatcatggatttacctattcaaatatggaccacaatttccataccattaaaccactttattctgtaggaatgaaagggctttattcacaaaatatgctgacgtttatgagtatctacgtggttctagccttgtgtgaggagctctgtaaatgttctcatttaatccccaaaacacaatacagagtaaagccaggggtcaaactcaactatatcaagttccaaaggccccattcttttgtgatatcacgcccccattacaaagaaacgtatgtcagtaaaaatccatcaaaggaatggaaaaggtaatcatttccccagaatatttaacttagtctgcagttttcccttcctcccctcatctttaagcccttcatcaagactctacttcagtgtgtcttttcaagtccaccatgtgttatgttagaatgtgatgtccactgaagtctgagcttcctggggacagggattgccttctccagtatggcaccaggcacatggtaggtgctcattaaatacctcatcattgaagttagtcaggtagctccaagaggagttcatttgtcactgcttctctttctaatgtcctttctttccttttcccaggctaataggtctcgagatcttggtgcaattgtttactgtgttggtgtgaaagatttcaatgagacacaggtatggtaatggatttcctcaggtttggagcatactgagcttgtgaatcatgaagaacatgttcagtcagtgcagagggaagatcaatggaataaatgcccctgaaataggttatttttctagaaatgctaaacaggaaggaattactggttgtgtaaggaatatgaagtcatttgctgatgctcttgaggtcttcaacacagaccatcaaggcagcatctttcttggcaaacattaaattgccaggatgtcaaaagatatctgaattaacttggaaaacgggttttttctgtttgtttgtgttttgagacagagtctcactctgtcacccaggctggggtacagtgagctgtctcagcccactgcagcgtctgcctcccaggcttaagtgatcctcccgcctcagcctcctgattagcttggtatacaggtgcacatcctgaatagctgggactacagacacacaccatcacacttggctacttttttttaaatttttgtaaagataaagcctcactgtattgcccaggctggtctctaactcctgggctcaagtgatcctcccaacatggcctcctaaagtgttgagattataggcatgagccaccacacccgggccaaatttaatttgacaagtatgattttcttattcaaataacaaatgttccttttcacccatgaaaaacgcaaagtattttcaacacaaaaatatggaaataattggacaagtgggcaaaaaaatgtgtataggtgcatataataagcaagttgtaaaagcttactagcaatctaaatacatgtacctcaatgtagttcatcgtttctttttgttttaatggcataggaaaatgctcatgatatatcattaagtgaataaaacaaaattacaaagcagtgagaatagtatgtgctcacttctaaaatagacatttgtatgttcacatagaaaaagtatgaacagtgtctatcaaatggctaataaagatagatagatgatagatgaacagagaggattatgagtaacgtttgttttctttttgttttaactctcctggattttcctaagtttttacaatgagtaagtattacttttgcaatcagtaaaaacaataaaacatatttttttagaagccatacacaacagctgacactgactctgtggcagtcacagaaccacacagagatctgggggcagacaagccctacatcggcttctcctggccctcagtttcctgctacataaagcaggagcagccaaaccaactgcaagggccctttccttaatgggcagtttgggtgaaaggtgaaggtggcctcacccaacaccaaagcttgaatttaaatttgctctgaaagggaacttgaatctgcttgattcagataaagttgccaacaggaatttgggtgaaggggagaaaaatgagcccatggcctgtgcccaaatttataaacatatcaacccaggccaagcgttcatcaagctgggcgctcttacctctgctcccgaggagaaaagtattgaaacaaatgtaaaagctggagccaacccttggcctgctccagagaggccactggtgagcttgttattactgatggcttttcagggcagcccctgagcccagtgaaggcctcatattcccctgggttctgaatataactagagccccttagccccaacggctttcctaaattttccacatccaagcctaacagtctccccatgtgtttgtgtatttgctgtgttctcagctggcccggattgcggacagtaaggatcatgtgtttcccgtgaatgacggctttcaggctctgcaaggcatcatccactcagtaagtagagctcttcctctgagactagacattcaggcaccttccgtctctgatctgctattaataccccaattccatctctcaaagcctggtgtttttctgcttaagagaacatcatttcttcctatatctttgtgtctgccacgtcccatctctcccttctgccttttacacatcttttctcaattgtaccctgcagtggaaaattaacaattgaaaggggcgctactctggcagtgagccaggcttcaggaggccctctccgttctcctaactgggcagactgtggctggtggtttacgcttgaccacctcagctttcccattgtgactgaacacaagctgccttcagagcacttgtaggcttggacttatatcacttggccattggatgcactttagaccaggctgtccattgaagtcatctgcagagatttaaaaagcactgctgcctaggcatctggtctggggtgcagcctggacctcaagagtttctttaactctccccaggtgattttaatgttgagacccactgctttcgacctataatccccaaatacatgggctccagtgttgtccagggtttgcacggtcaccagtcctccttcacacataggtgattttcttcacaccttttcctgaatagtaaacaggacactggcttccagggcctctattctccacctcccatacacaggcaaggcccttggtccaaatagaatattggatgctactgtcttaaagcctcagccagcaggtcagtatgtgtgctgcacctgcaatgatgttcagatgctctgcagcctccaccattaggttttgtgatcaggcaggcatctgtgatcttcactggcagcttaccaggctacagacttggggtccaggatgcaaattcagagctcaggggatcactttcctcttaagacatcaagggggtcttgatccaggggttaccggccaagggctcagcatctgccagccctcccagaccaacccaggaaaattccagcatggctgtgcctccatgctgctctcccttcagggtttgctaggagctccagcagagtggaatgcagagtgggaagtaagaagctcagagcccggcaacccagagtttcattggcccacgtacttaacacttagagatccttggacatttcttgtttggaaacagggactgatgatgacttacatcataggcttgtttgaggattacaaggattactggtgaaaatgcctaatacttttccagacatacaataggcactcaaggcatatgaattattgcctcttccacttctcttccctatcatatgacggatattaatgtcagcttcctttgatcccctaaacattcttgaatatgcataaaaatcacttgagaattatgtttgtaatacctattcccaagagattctattgcattgagtttcagatggatccaagggatccatatatttcaaatctgcttttttttttaagtgccccaggtatgcttttagaacattgacatatctgaccttaagaatacagaattgcaaaaattcatcccacctcaggttgggaatttctgtcttaattatgttccaatgacagttgttttattcaagaagtgcttgtttgcaaagaatatatgcctcctcaagctaccttaaccagaaagtggaaattattgatagcatagagaattatcagacccagttgtcagtccacaggtgaaggactcctactctaaattatttctggggtcactgtggcatacttgacagtgtaagcaacaagaactacaataaccatgtaaaacaacaacccaagggatgcaaaacatgattaatagcaggactgggggccgatcatggatccttaagaagctcagaggtggattattctgggcaggagtcctcatgagaaggcagcgcagacccgaatcattgaaaaaccagggaaaggtgatgggtaccaccaaaggagagatattatgacctcaacctagaggctggaagacagaaaagcatactcaggggtcaataataataataatacctatctatctagtgggacagtttgggtaaaggagtcaggagtaatggaaaataagcctagacattgggttgaaaccagattaacatgagcctcgaaggggttttgcctctaacctataggcagtgggtgtagttactgaaacaagttaagaaaataatctgatggcagtgcttgcatacgtgggagggagactggggatacccagagactgtaggccaattaggaggcaatagtcctgccttaagatggctagattctgaaaagggacaactcttatctgttcagacgttcttatgagccgtgtgcctaactccaagtgttgtttcccacatagatgattggactctttttgtatgcataaatcagtgttgtccttgaatacatcagccttagcaactcacccaagctcaacatgagcccaaatgtttgtaaaacttcctccatccccaaatggaaataactgcaaagatctttaagaaattttagcgaaactatcgttcaaaatagaaagaaaactaatttgagactttagtctccaaacttttagctgaatgataacattcctgtgagcttttatctgtgagttatgctagtggttttgatccttccagtactcgaaacccatgtttatggcagttgttcattcgtttgcttggacagagaaacagggacaagtagagcgagctcatctttcttaaatcagacagaaataattacggcctaaaagttggctaactatttttaagaagtagattcatttccccttttggatactgaaaagaaaactctcaatttcccccccatctgaagcctctatcccagcttgttcccatgaatgttgttttgtggctggttattttctcataataaaataggactgggcttaattatccaaaataagattgcagagcagcttctgataagctcaaattcttcacaaagttttctgcccataatgctcatatttttaaaccttaaattaatatgcaggggctagtatttattcatacatcaaatacttattgaaaatcttttatggcaggctctgaccattcagtaacaactaaagcaggtagaggctctgtcctggtagagcttacaatccagtgggagagacacattaaaaacaagtaaataaataatcatgtggaattaaaattgtgataacaggaataaaagaaataacatggccatgagattaagagtaaaagggttgacaaagaacccaggttcctttgaagagatgaactgaaggacgtaatggagccatccattggaagggcatggatagaatgttcttggcagagcacggcccagtacagtgcataggagaatgaaagaccaatgcttaaagtgaagaaaggcagaagatgacatgaagaagcaggcagaagctaaatccaaggacaataggaaactatagctaggtacagagtctgacaatagagcaatcaggcttgaaatcaagactcaggaaatctagacatcatggcactcagaatcaatagcatttcggcctttgaagaagaaaactcactatgacttgaacacgttctctctattagcgcctctgccaggcacttaaccaccactctctgaagaaggatttattatccccattttatagatgaggaaactgaggtgcaagaaggttggagaaactgccctcaggtctgccctcttataatggtggagtggggaatttgaactcagctctggttccaaagattctgctcttttcatgacatttggccataaatgtctgaggaaatggaaaatcaccactggattaccagaagccagttgcccagggcttggattcatcaaatccccagatgctctgcttcctcaatctgatgctcatgttttgatctttccactgttcttcaatcctctctccttcaagaggaagtacttatgtgtcagattttttcaaaatgttcccacttgttttccattttagtttcttaactgagagggataggaaaagggcagaaggaaattaacagctgtagagaacttactttggaaccagacattatccctttttcccatataatattatttcatttaaaaatcataacaatgctgcaaaataaatattcctattccaatgttacagatgaagaaactgaagctcagataacctgcccaagaccacacagccctaagggggaaagcagggttagaacccactttttccttgactctagagcccatgatttttcctacctctattttcttaggaagctaaaaataatcaaaaccaccattcagtgagttcgtactatgtgccaggtactgtgcaaatcatttcacataatcatctccttgaatcctcacaggtgccatttgatgtagaaatcattaccccttttatagaagtagatactaaaagttcagagagattcaccaacttgtccaaggccacacagcacagtgagtagtgatcccgaatagactcaagtctttctaatgcccacgatgtgaatgcccactgtgttctactaaacaatgcaggcaggccaggaagtagctccatttcagagaggaagacactgaggactgaaaacgtgaactggcttgacagaggcaagaccagaatccatgtggcctgatctgaatacaccgtggatgggcaggggagcactttgcctcttactaccaggtagagaccacctccagaaatcattactgcccaacggatgaagtaccatcgtcctgagaagctggagaattgacacaggctgcaaggaacatctccccttccacacttgcacaggactctacctctgagcaccacgacagttttcccactcgcttctgcagaatatggtgataaaattacaagaagaagtctggatggctggaagattgtagcccttgaagccagtaacactgtaaaggaagaaactattcctgtgccttctcatattgtggcttcttcagggaatttccaccgaccacaactggtgaatttagcaccagccctcgagcaaaagtatgaagcaaaggtccagcaaggctcctgggtctttgcttgccttttcaaaagtgtttcaggcagtgaaacaggaacccgcataaaagctgggttcagataacaccgagatgggtcagcagctttgaatcccaacactcggcctggttaccgtgatgccagctcctcctcccagctatccccacttggtgtgcaactgagggtggtgcctgaaaccaaggacactgtctgaaaaggagagcccacagctgctggcaccaagccatctccatctaggagaatttccctcgaataaatatttaagccgacatcaggcttcctgttaaggagagtgagtcagcacatagagctttctgcatgtttgatcaacaataaacaacaagcattgagcaaacacaactatgtttgcaaggatttctcgcaagctgtggcatgaccatccttgttatcagggaaactgtgagatcaacggaaccgaggaatcaatctattccatggtatatataaatttattttatttatgaaaaccagatcctgtgctgatttgtcccttccactcatgggaagcaatgtaatcccctaatctggcccaggccctaacaaagctgtgataaaaggtgaaatctgtcttccaggcttgcctcccagctactcttccaagaccccaacaggaactgcaaagggttttcctgtgatcagaattcatgtcacattcccaaagtcctggaaagtgtctgccttattgaactaatcccttttccagggctagcagatggggaggcacatttcagcagcagcagctcttctcataaatcaggcttgttggtcactggaggcaacctccttcccttccttcgccccatctgaatcctgtccaaaggcacccttcagtcttcccatctctacaaagcctgccctgctctctcctcttccatgagctctccctgccttggactccagtggcaccaattttttgaagctcttgcttggcatgtggatctgttccatgcctctgccattcctcctggtcacatgctaagttgtgcaatcccaaagactgccctatgtgtcatatttcccatgatatgcagccctgtgctttgcatatttattaattataaagcaacccagagtaccatagagcttttgtgacccagggaagacctacactgcacaacaagagggcagtctgtggctccgtttcttgtaaaatcccctcagcctctcccctcccctctcttccaagattgcatctgtaaaacatggcattctgggcaccattcacattagcaggcttggatacgaaacataaatagaatcaattgtaatttctgtagtgggcagagaatcttttttcaaaaaaatcttttgcctcagcagtcattaattagactcagattttgcagacactcagaccaggcatttctcctacactattatttctattcagcttattaaaaagtccaaattgaacaagaattcccagagcttgaacaggctacaaagattgcagaggggcatgttcagttaatcctcagatcattcctattcttcctgcagcccctcctcctatattgaggaatctgctgagacccactataaaagcaacagcagaattttagaacgaaatcagctcccaagaaaggccactcacttttccagtctgctcatcttactaaataaaccacattttgaagttcccagctctctgagcttttctcctgcagacatgagaagaaagtggtttagtggggaaacaaatgaatttcctacttttagaaccttgtttatcctacactcctttggatcggattctcattgagtgtgaaactaacagagtagcatctatttaagtgagtggggtgccctccctcagacaaaaactttggcatgttttaagaataagctttattgtttaagatacacaaactgcttcaaaatgtgttttgttgcatgtaagcgtggtataatgtatttggtatagtgtattagtgtacataaaatcatatatgaatcccagaaatacgtgtgtataatattccatatttgtatttgtaaagttttttttttttttttttttttagagatggggtcttgctatgttgcccaggctggtctcaaactcctggccccaagcaattctctcaccttcacctcccaaaatgctggacttacaggcatgagccactgcacgtggccatattccatttttatttaaagtcagattctatagaactgacatggatctggggtaatgtccatggttaacaatatgtgtgcctattaaagtgtggagaatttagttagaaaaggcaacttttttttttttttttttttttgaggcagagtctcgctctgttgcccaggctggagtgcagtggcgctatctcggctcactgcaagctctgcctcccaggttcacaccattctcctgccccagcctcccgagtagctgggactacaggcgcctgccaccacacctggctaattttttgtatttttagtagagacggggcaactttttaaacattttattaattagagattaaatcatttcaaaattcatggggacaacattgacagtcctgaagatgtgtttgagccagttgtgtgtcccaagctgcctggctatccccaggcttatccaatgtgctttctgccatcagctgtaataatgtttgtggcgcttctgtgggaggctgggccccacctgccaactacagttctctatgtttttcccaagaaaaggggttgaggcctttacaaagcggccgacctaatacaggggattatgatatgcctacaacatttttttttaaggtaagcaattttttaaaaatgaggtgttgaaattggcctcttgggaaggcagcaagtccccaaagatggtggtacttaatcagacgaggggagtattacaagatgcagcatatggacttgtattcagaagaccctgaggttacacttatagggggaaagggagattaatacataatatgctacaatgccagtttattaagacgtgcaggaagtgtgtcatttattcatttatttatccaatatttatttaatgcctactatgtgccaggctagtcattgtgaatataataagtaaaaacaaacccagtccttctccttgtagagtttataatctaagaagacagtgaccaaacaataaaaaaaaaacactgtaaattataaactaggataagttatctaaaggatggcagtttacattaaaatgtgcatggatatagagatatttcattggtcaaatcaccagcacttaggtggcagaactcatattggatttggagagtgacagagagagcaaggctaacttaaacgttcaggtttttgtcttagacaactgaacagatgtaaatggtcggtagatacttaaccatccttgacaccagcatacttcaaaccccatacatctttaaaccagaatttgccctttacaacaaataagacaccaaggaacatgctctgaaagactttctgaaatatgtgtgaaagcaaaagacacctataccatcaagggataaaagagattggtccattataaacacacaaaaaagttctccaacaggaaatggccaagtaaataaagattggttgtttattaaagcaagaagcagagcaagtagaaaaaagaaatgccgtgcctatgataagggagggattccttataactctgtgcagatattcacagttctgtaaagattcttgagaaatctctgcataaactgagaacttcatgacaaaggacattagatttttagaatttgaaaaaataaactcttctatacaacccggactggtccacagtggatttcactttaaatatatcaaacagctcctgtaacttggcaaagttcttgtacatccgctgcctctcttactcgtcctcccaccaataatccaatgagatgtacaaaagtcaacttaccagaaacaacacatgacaattatttagctctttatggatttcaaacatacttttccatctattttctctttgaaatctgtccaaaagttggcaggaaaatagcattaaccttggttcagcttttgtcagcaaatatgattaagcagaaggccaggggtgggcgatggggcgtaagcacatgtgaaccacggtccacgcccaaaagtagcagcagtagcaatagtaatgacaaaggaagagctaacagccactgttgtttgaatacatgccagacattctcttaagtgctttactgccaaggtcattttgaccactcttcttggtgccttattttcataaggtgctcatgctggctggtgacccaagggttattaactttctgtggatcgatcacatctgtctagttctgtctataagacaaaaaccttgtcagttttccttgatctcatgctctccctcaccgtccaatccaatatgaattttattacctaaatctgattgattttccaaacaaaatatctctgcgttcatgactgttattttatttaaccatcatacagccccttgaagttggtgtttttcttatcccattttacagcagaggaaactgagatttggaggtttaataacttgtccgagtccacatggccagtaagtgatgggacttggatttgaatataaacccattcagagtccaagtctatcttctcagtctccagagcttaagttcttgatagtaatagctaccattagttgattacttatcaggttttaggcactgtgctatgggctctgcctgtgtgatctcatttaatcttcccacacaacaactttatgctcgtacttcaggtagatactattgttatcccacttttatagagaggaaacagggactcagagaggttatggaacctgcccaaggtcacactgctcatgagtgagttgacctcagctatttgattccagattccaagcaattactcaggatactgaactgctttccaaaattggggttcagaaaagttaagggatttgtaaaggagcataggtcaggtaaatacggaccagggccaagacccaactcttcacatgggattatacttgaggcatgcagttatcttatccctctctcctctgcagatcaatcataccctcaccttaaagcctcttacctctaacatcagccttaccctgtgtaagtctcttccactgcatctagtgatttcccatcagcgattccccagtgctgtgtctacacctctgccatggctaccactgcccgggcctccctacccccacacagtctccagtccctgagctgatctgctgtctgctacagttcagacaggctgattaccatacagtcttggctgctaagaaccacgagaacccttcaaatccaccaactgccattgtgacttcctaccttttgaaaccagacatttcaaatgagtaggagccccagtcccagacaaatcctgcccatccccctcactgataaattttactctattggctgtattgcatccttccagatgttttaagttaagattgggaaagctgtgtttttactggattgaatcacagtgcttggctggcattttttggccctccatacaccccttagatttatcagctaattgcagacactttgagagaataatacagcatgtgtttattatgacaacccctgttagtgtgcctttgtggttaaagatccacggatggttcctttaccaatccctggttaaggatcagagttggttcaaaaaggttggttgaaactcgggttgggtaaaaatttcatgtgtgtgtttggggaatgggaacaggactagtccaaaagctctttttaaattcttggactgttttgaagtctttagttttggatgataaaatgatttattaggagatgtcaaatgcctgaggaattttatttaaaacatcaaaaaacagctttgtgttgttctaatatcactgtttaataagtttctccctctgggctacctctatttctcaaatgtgggctgtctggagacttgtgcctgaggacaagtcaaagggggtggcttcctcccttggtcatggcaaccactggctgaagtaccccatcaaacaggaagagcccaagagcagcaagttcagggattggcaaatggacaatcttcacaattcaggcagggctgtctgggatgaatcactgtgcaccaggatgctagcaagtcccagtcctaatacggtgctatatgcgcaagagaccgaaaagactagatcaaccataaggcactggggaagccagcagggaaacacaggtgcccaggatatatccttggggtccttgttcccaagttagactgacaatgagtggaaaacaggagctcagtgttttccccaggtgcccagagcaggtgtgtgaggaccgctgactctaacagagatgggcaagggacatgggagtccggagcattcccttcatgctacagtcaggatagacttagggaccagggaggaactgaggctgcacctgtgtctggggtgggtggaggtggctaggtaagccagaggctgaggaaatgaggcagaagctgaaggaactaattacttccaactgcggagtcagaaggatgctgcaaacaaataggggaatcaaagtataaaaatgccatgaagttctacagagtgaaggaaaagtagtcagaaaatctgaattttagaattgtcaagaagaaatgttgcttttggtgacattcaggtacatagagttacctaaaatacatggttgggagataacctatttcaatgaatgcatcttaatattttcttaagcatgtttgttcattttctttcgcaatgcttctctataaggatgcccagatttctctctggaatgggtaaatattacctcttctgagaaactgatttgttttcattccacagattgagaaagctcataaatattggctgtccttttcgtttgctactagaaagcttggaactaagtccactctagcaaggaaataagctcctcagcatattttttctatgctattctcacttcttgcgtcatcttccctttattttccctttagtcagccccacattttcatttattctctttcatttgtgtcttgtgatatatcacttaagctgtaacaaagaagcatatgtaaagaaatacaacgatgcaaataaatgggcgtttcccaatgctaaaagatgctttcttctttcacagactttaaattttataatcatatcgtcagttgttttaacaaatgcccttttcaagaatagagaaagggtttccttcagccctctaaaccatctcaaattccaaattaagtaaagatactgcatttggttggtaaattaactcaatgtcttatacttgttaaaaatacttgattcaaattctagaatcaatattctcaaggtaggatttataaatggtggagagaaacttaggtgctaccagtgagaaaccccactctagccagcaaaagtcttcattattaactcctgtgaagtcacagtgctctgctgactctccactcaaccctataagactcatttgtggacaagtgtacatttccatttaactaagtctcaggaggtcttcctgaagagtgaggcacaaatgccccctttgaagctcacattttccagactttccaagcaaaaaaggaactcttggtcatctgactatgcagcttctgtggagagttgaccatttccgtcctatctctccagctctatctagtatcactctcttatttctgcttttcaagctgcctttgttccagttcaagaaatctatgtactttttccttctcacctttgctcataccattccctgcctggaccctaatcctcccctaacccactccctttcatttgagtcccaccctcagctcccagctcttccatgaagcctttcctagcatacctgccccagcatctcctccatgaactctgcagctcctactgtctactctttcacccttgcacctaccaataggagtggccattggcatttatcatttccagagttaagtcccatttccgcaaccctatgttaaacctctgcaaaaactaggactggcatagcataggctcagtaaatacctgccaaaagagcaaatgaatgaataattcttagggcttttaggatacccaacagcatctagcacaatctggcttaataaatgtttggtattggtactagtcaagatgttagactcctcgcacccccaccgcaaccaaatgtccttgaaccttcctatctctatctcagtagctaaaagcagaaccctgattctgtctttgaacaaaataagctgtgcattgactcttttatttccgctcctcctagattttgaagaagtcctgcatcgaaattctagcagctgaaccatccaccatatgtgcaggaggtaaattgaaatgaaatgctaattgctttcatacaattgatgatattttgagttcaagtcacgtatgtacttcattgttggtggggtgggaaagaggaacaggaaggggtagggtgaaaagaggagctgaaattgctaaccaaatttgctccaaggagaaaaggaaagaaagaagccacatgtcagttgtttggaagttaaaaaaaaaaaaaaaaaatctgtccaaattctcttctttcactgggcgcggcgccttatgcctgtaatccaagcactttgggaggccaaggcaggcagagcccttgaggtaaggagtttgagaccagcctggccaacatggttaaaccccatctctactaaaaatacaaaaaattagccaggtgtgatggcgcttgcctataatcccagctactcgggaggctgaggaaggagaatctcttgaacccgggaggcagaggttgggttgcagtgagccgagatcgcaccactgcactccagcctgggtgacagagcaagacaccatctcaaaaaaaaaaaaaaaaaaaaaaaaagttatcttctttcatgggacctaattagaagggaattgtagaaatactggattcttatactgaatactcagtgactaccaacaccctacctctggatagaaatggaatcacccctctttttcatgaggccctgcagataccagacaatcatagtggtcataggccatactggaaatactgctatactaaagtttttagttggatgctggccttttcacacagttaatatatttatcttaattgtttaatctgccagtcctcacacaatggtagtggacggctctggttgtccctgtagagggccatatagttttgtcattaataaggaagtctctatgtaaagaattagccttcttcgagtcacaagattttctctaactgatcaaaatcagggtcatgctcgtttcatatttaatggactgcttaaaacttcaaccacattggcgcttctcgtataattcttgacaggttccccatcactcttctttcattcatttgaaaagtattcttaagtgcctgctgcatgccaggcactgtgctaggtgctggagataaggaaggaaaaactgtgtgtgtgagttcctgtcccccagaaacttgcatctttcaccattgagagtttattgttgatatcaccttttcagcctgccaaaatacagtgccagttattaatttaccaacagaaaatatgtcatacaacctgataaggtaggaagcattaaaggaagaactttcaggcctcttcaaacactacacacatcaatgtttatggcatattttactggtataaatgagggaactccttaaggattttattccagtttctggcctatagtttagaacaactgaaagactttcagggagttaggtgcactaaaaaatcggtgccagcagcaaaacatcaagtatatatgtaaagatataaagttgttatcaatacttggtaactagttatgtacatacataaatatacagcatgcatacataaatacatatgtacatacataaatgcatacctacataaagttgttagcaaaatacttggtaactaactattcagaaatatgtgctaatttcccaaagaaaggcaatcccaaaagattacctactgacctttaaataaattgctacctgaccacacagatggcaggggtaaatgtgattgccacagaggtagatcggtgagaatctctttaagaattcagaaatcttacctaggcaaatttgacaaaaacatatgaccacatgaatgcagtgccagggcttcataaggggcctgtgcagtgaggagcctcagttaggcttcatgaatttaccttgaagataaattcacctctgggctttgtgtgcttcaggtagaggaattgagtaggatatttgattaattaaatctcatgtagtgtgtgtgaattgttttataaacacacattttatagttctgtaattttaaaacaattagaaaataagggagttccttgactgcaattattgctttcataaagaaaacccagactttgagtttagcagtctaattggctgtgttgtgcaaccttggaatgaatcagaaagtctaaagacaatgaacacaatttctgttaattcactagtataatgaattcccttcctgtaggctccttgaagacagagaaggaaacttatttctctctacttcccactgcctagcagggtacccagcactcactaggtggccaataaatgttgactaaatgtcttgattcatgtattcgttaaaaaaacaatgccactgatacttgcctatttgacccttattaattcctttcaccaaccataagaagttaatatacctttgaactgcaactaaaatgaagcaaaatctaaaattaatagacaaagatagagtaagaccaaagtaaaaggaaaaatctccaccacttagacaatggaaaattgcctttgtaagtaattttaacctcaaaaagtaaacaatatcccctatatgtcattaaggtgttcaagacaataaaaacaccacaaaaacaaaaatgacacagaaataccagtgtccacaggatctgatcatatcaaattcatagatttcaatgtttctcatcaagtgaaaaagaaaaataaatgaattaagaattaaaagataattttggaaaaggtaaggaaaatacaagaaacaaatacacaatccactaataaatttaaacaaattaaagcaattcaacagataaattattccaaggttatttggtagaaccaataaaatagacaaatctggtaaatccaatctaaggaatctttctttagattttcttaaaatctctggcttatgtgcaatattacatattttataagcaaacaacagttatctgtatcagagtaaactatccaatcatattatctttatttcttatagagaaaaaattaaaacaagacacaatgatgaaagctagaactaggttttgtaaaaggcaagctcccacctctcaaattcaagtcgtaagggtttaaacatgctgattacagaataacatttctaagaagagaatgaaactcccaaaagatatccttacatcaaaatttcttccatagatttccttgaagatttcttgttgaccattctctggagtaaacatagttttcaggaagcctgggagcccatttcattgtccggatgcctgtcagatagagcgaggcgtagcccctctgtgactttcattaagctagttcaaagatataagtatttacgtgaaagtgctttgaaaagtataaattgttatgcagaacaagatggcttgttatcagcatcatcttaataaggattaaaggccagtgttagaatcatgatgttgataatgtcatacctagatgagaaaagcattcctgtatgtttctccgctgaaagaaaattggggaagagtatctgcaaaatgattaattaactcaacatgtattgggggagagagtaaaaaggaaataactgattgttcacatttctaacatataatggtgggaccaatccctagacagatatgtaaagaaggtaaactttgccttcatcgaaaacctttcctcttagcctcttcccttcactctgtgaattccttcttttccttggcccctagaacagcccctgctgtggagccctacccaggtctgtcctgctcaagacactctatgctgatgattgcattcctctaagacagtgatctcagctggctttcaaccccagctcaacaccagcaatggttctgacagcaaactgagctctgggcgaggcagcgagataatgacaacaaagccaaaatctagcacaggcctttatatgttgggctgcacataacaaggtgtaatttaatgggacaaatataaagcgttgaacttgggttcaaatatccagtttcacatacaggcaggtttaggaaatcctgacttagtaacaattaacggtaagatagcagaaaagacaagaatgatcatagttgtcttgctccccaacaagaatgcctctgactaagaaaagctgacacaaccttagggtgcatcaataaccatccagtgtccaggtcaggagaactaacagtcctattccatgttcagaccatggtttcaagtcccaaattttaagaatggtattgacaaaggcatgtccataggcgaagaggtaatggatctggaaatcacattataattaattcatggattcattctttctttcatttccttctttccttgcttttttctttccttttctttcttctttccctctttttcttcctgttttcctttcttcctcctttcatcgattcttagtgtcttttatgcaccaacccacatgaaaatgtatcaacacaaaaatgcataagacttagtcccaaatccacccacacccctatgaaactcacagttcactctgggagatagtcatatgttcaaataaattacaaaaccacgcagtaagcactgtagcagaagtctgcttacagagtagtgagagcactactgagatgcctgtgcgatgaggaaatactgaagtcatcacagagactgaggccaggaattgagatactcacaagagcatctttagatatttggaggattcccatgcagaaagaaattattaggcttattatgtatagctccaggagaccaccatggaggggttggggaggaattcagtgaggcagattttggcttaccacatgcaacttgtacaactaaagctttccaacaatggagtggatggtctgagctctccccccatagaatcatgtgagcagtggcagaatggccatctgtaagcagatgctatcaggagaaaacctcctccgggtctcctttacagcttcagatttctaaagatttaattcagtttccactaagatattaatggatgattatttctcaataactgaggaaaccagtattcctggaactgtttcacatttttaactggaactcttactggggagagggaatggagagaatatgtaatctgctgccatcaaaaagaattccagccgggcacggtggctcacgcctgtaatcccagcactttgggaggccaaggcaggcagatcacgagatcaggagatcgagaccatcctggctaacacggtgaaaccccgtctctactaaaaatacaaaaaatgagccaggcgtggtggcgggctcctgtagtcccagctactcgggaggctgaggcaggagaatggcatgaacccgggaggcagagcttgcagtgagccgagatcatgtcactgcactccagcctgggcaacagagcgagactccgtcaaaaggaaggaaggaaggaaggaaggaaggaagggaggaagggaggaagggaggaagggaggaagggaggaagggaggaagggaggaagggaggaagggaggaagggaggaagggaggaaggagggaaggaaggaaggaaggaaggaaggaaatcaaaaagaattccaatcactgcattggtaaacagagtgacactccatcaggaaagaaagaaagagagagagaaagagggagggagggagggagggaggaagggagagaggaaggaaggaatccaatcactgcactggtgaacatatatagggagagagaaccttcccagaactcctccactctcagaggttataaactggcagcctacaagtcctatctgatctgcatatatattcttcttgattcatactgcattttttaacttaaatttattgctaacatttagaaaatcggatttcacctaaaaatacagattttcatcttgacttgaaaaatcagaactgacaacactgaacctgtatttattacaagttaatgattattgaggactgaataacttcctttaaaagaaacgtatacactttccagttcaccatactcctcaccactctccattgtcaccccagtacccaggccaagcatgtggctgccatttagcatggtgcttatgtcactgtatttacagtccctgttccaaaacatgcaggaagtcacctgctatgtggaaaccctttgtagcaactttgacattacttgtatttcagtaattctgctcccaatatagactcttttttaaagtttctaattaaatatttttgcagattagcctctgtttaattaagaatatggacccatttggccctgtctaatttagctcctctctggaaaatgcaccctgtgcctgagcacagtctttctgtggtcccactcagttggcctccaacttccacagttcacaatgtgctatgtaagcaaggatgccaggaaggaactaattggaatcaagtgtgcaacttgccaactgctctacacttgaagttcttgtactccagaactggaaggaagttataattagctcctcacactgtcatttcagcagcagttgtattcctactgtgtttcccactgtttctgataaaactgggtgagctggcacaaaaggaaggtcatttaaggtgtcatgtttaccatttggaaatttcgatgtttaaaacagacacattcaagcaacatcagatagtggtgtattcctctcacttttcattgtttttcgaagcattcatttctgacctttggccacctcttctaaatggattgcttcattctctgctcaatctttcctttcatttaaagacatttctatgtggaggaaggactctcatttacaaatacaaaacagcacaacactttggaagagttttggtagtttcttacaaaattaaatatacacctaccatatggcccagccattccactccgaggttttacctaagagaaaaggaaatctatgtccaaacaaagaaaggcttgtgtacaaatgttcatagcagctccatttttaatagccaaaaacaactaaaatgttcatccacaggtaggtggataaacaaattacagtttacctgtagaatgcactaattaatactcagcaataaaaagcaataaactatgtataaatctcaacataattgtgactgtgtcctaaaataattatgctgagtaaaagaagccagacaagaaaattacttactgcatgatcctatttacataaaattccagaaaatgcaaactaatatacagttccagagagcagaccagtggttgtgtgggagtggaggtagggagggctgggaggagagattacaaagcaacactagggaagttctgggggtgacagctacgctcactgtcttgactgtggtattatgattgtgtacatatgtcaaaatttatcaaatcatacactttatgtgcaagttattgtatatcaattatgcctcactcaagttgttataaattaaaagctataactgaaaaaagttctagaacaattcaggcctcagaaagcacccattatatgtcagtccctacattttatttttgatgttccataccacattaagcatctaagaggagagcaaattcaaactgactcacaagatgaaatatcactgacaataatttggcacaaaaatcttgggtgaccagaacaagtggagaatatacagatgtctcattttcagacacagtgaatgacatgcaatctttattgaggtcatctcaaagctatgtgttccacatttccaaaaagaaaaaaggaaaccaaagaaataaaaggagagaacagaatggaataaatctatcgaactacttactgaccttattttttctttttttaaattgagctatattttacatgctataaaaatcacccttttaaaaggtacaattcaggccaggcgtggtggctcacacctgtaatcccagcattttgggagtctgaggcaggtggatcacttgaggtcaggagtttgaaaccagcctggccaacagggtgaaaccccgtgtctactaaaaatacaaaaattagcccggtgtactggcacatgcctataatcccagctactccggaggctgaggcaggagaatagctttaacttaggaggcggaggttgcagtgagccaagatcacgtcactgcactccagcctaggtgatagagtgagactgcgtctaaataaataaagtacaattcagtggtttttaatgtatcacaaagttgtacaactataataactatctaattccagaatattttcatcactccaagaagaaaccctatacccattaagcagttattcccccatttctccctccctccagtcctggcagccaccaatctactttctgtctctgtagatctgcgaatctggacataccttataaagggagtcatgcaatatgtggcttttgtgtcttgcttcttttatttagcataatgttttcaaggttcatccatgtcatagcatgtatgagaatttgatttcttttgatggctcaataatattccattgtatagaaataccatacttatcagttgatgaacatttaggttatttccattttttggctgcttttaataatgccactgtgaccgttaatatgtaagtttttgtgtggatataactttcaattctcttgggtatatgtctaggaatggaatttgggggtcataaggtaactgtgtttaactttgtagaagaactgctaaactatttttcaaagaggccacagcattttacatttccaccagaaatgtatgtgggttataatttcttcaccagcagatgccattgtccatctctttctcttcagcaatcatagtgagtatgaagtgatatctccatatggttatggtttgtacttccatgtgactaatgatgttgaacatcttttcattcatggaccttattaagcctcagaaaataaacaggattagacctggttgggacctgaataaatgatcaccctatccttcccctttattctctttctatgccaagatatgttatttattcaatcactcaatgagctcatcctgagactgactcagtcctgggttaaggcacaacccagcattcagaagaaatagaaatcttggcctctgccatcaggaagctttcaatgtaattgggaataacagtgacaaaagaatatagatcttaaggaaaccttaaaggatagataacttaaaagattaaatcaaagaccattttcaggtggaaaattcctccctaaagccctgcaatcttgaggtacttcttataggagctgtaagccaacatacaagttgcctaaaaacacagctgtacatattttgaaaggtgggttcagggctttgtagattagtggagttaaatcactatgtcctggttctaatgtgtcctggttttcacttactggcagattcattcgaaagggttttgttacataacgtctatgtgtgaagagctgacattctagtcaggctgctgggccagatgtttgagctcttctggtaaccaaatgtgtgcactaacacagaaaccctatcaggcaggatgggagctcgcctctgccctggtgcactccccagagcatcatttcctccaccgtctccccctggcctagggggttaaattgtttggtttccaccattgccacatcatggattcctgctgtctttcttcctaaactccctgaggtggggccaagcagacatgcaggcagcctcttttatagaggatttagcaactcaactggtaatgttagaacatggtgttagagaatagagtttggcatgtggcctgcatttccacagtcttctcttcctctgctgatctttgaggaaacaagagaagtaggcacagaagtgaggcagaaaacatttggaatcagcaaaaacatcaaacaacagatgtctgtatgtctggcattcaaaatggacacagaaataggtttctataggcttaactgagcaaataagagaagataagattcttctacaagtgcttgacacgtactaaattgcttattgagccaaccaaggaatctgtcagatgcctgacagacatctagagaaaactactaagcccatctttctaaacgtagcaattgtgcatttgcatcaacgtgtatgtataaatccttcatagtcataggacttatgctcctgaaaaaaccataggcccgtcaccttagcttttggatatgagtcccagtttttctgctttactaatgacatgactctgagcaagtcattcaaaatgtcacagtctccatttccttattgtgaaggcctcttatacttctaaaaagcattcttttctaacttatactccttgtggcacatgtagtgtctctgtattcttttacttaaatttcagtttcttgcttcacatccaggcctgttccacttttctgcaaaatgagcaaacctgcctaaaattaaaataaaataagctttaaaaaaaatcacaacttcaactcctaaatgactcatctgtcagaaggcagtgagtcccccttttcgcatggtggttcagaagctaatggctgagttctaagggcatggcatttggtgcctaacagacctcgattccagttctgattctgacaagttaccagctgtgtgatcttggacacattacttaacttcactaagatcagttgtctcatctgtacctccccaggctgtggtgaggtttaaatgacatcagacatgtacaatatttcacagagggcctggctcacattgagggagcaattagcattagttattattgtcttggcaaacatggcctctaaattagtttcctgggactgaaggtggcatatactcatgacatttattaagcttcgagagtcccatatactaattctctaatttcattattcctccaacaacaagtctacatttagatggcaatgtactgtgtaagatccatattcacaaacattgcattttttcctctgaccttcagtctatttctcttgtgatatgccacatagcattatcccgagccccaatttttagatacaaaaggatgataaaagtgaaataaagtggaacactgaccattagataccaacaaacttaagcaaatattcccaaacatttagccaactaattattgggttttttccatggtaggagtatggtaaaggagagttgtttttacttaataacgattttattcatgtgcattaatcaaacatacattatgccaatgagaaattaatatgcaggccaggcaagatatatgatctcttctatgcagagacaaatgagtactacactgaggggctgatatcaattcaagtaggtagtgcttggcaactgaccactgctaagaaagactttgattcattcctaagtacaattattcctacctagcctatgtactgttactgtgtgcccagtagagataggaatgccatagtggtatcaaacaactcctgacctaaaggaatgtttctccagctggggaagaaaagacaagagaacaccaccagaccatacataatgacagtcctacattgttcaggactagctgtgaatgccctaaggcagtgactttctaaaatgtaggcaccgtgggctcttaagaaatcctttcaggggagtacaatgtgcaaaacagacacagaggaggtgagttgattaaagaggaagtggaggacccctcccctgtggctccctccggctactgagatcacagattttcaaactgcctggatttgaaaactggctaagatttgaatggacagagaggagggaggaaggtgttctgcgttaggaggaccagtaagcccaaaggtaaaagggtgggaattcaaataagaagtgataggcccttcttgggacacctagtgaggatgcactggtaagtagtgaaaggaacccacctggttgcttttggtgttcaacctaaattaatttttgaatattttaagcctggtgaaatagtgaacaaatgctctaaatcagggcagatgcgaagcttaaggttattggccaagtaacgagtctcgtcattattctttatttcagagtcatttcaagttgtcgtgagaggaaacggcttccgacatgcccgcaacgtggacagggtcctctgcagcttcaagatcaatgactcggtcacactcagtaagtccttgcagagtccatgggtttcttcgacaagtggcttcaaggaagggaattcccacccttgtcttccagcaaggccacacacatgaaaccagcagaaaagagtcttatttgctggaaagacccccagcaagggcatagtgagcccttacagtggttccagtcagaaaaggcaccacttgggtgggcacagccccatgggtgtccagcttggtaagcagagcaaggctggacttgagtccccgtcctccacaaaacacagagccacaagccccagccctgcagcagccctccggaagcagcggggcactggtttccttgtcccctgccatctaccgagtggctcactctcaggtgggagtgctggtgatggttaattaggactgcagaaacatgagcctccttaacaaagtattgggactcttaagggtaagtgtgaaaaaggaatggtctaaatgcattaatcttgaataaaccgaaaaccaaaccattaggcttgcacatgtagattctgcagcttttttcaatctggatgattcttgcgtggagtagccaagaaactctcatcgtggtgaatatcttacatgaaatacaggaatatggagtaaaactaagtgcatttcatgagaaaaaatgaattatcataacattggcttcttcacaagacatttgtagcagtcaagttcctaatttaaagatgtacgtgattcatgtggttgaccaggagagatggggaagatgattatatgagggacagatgccagaagcactggttatgatttgcatctggcatccgtcacacagataattatttattccacatctgcagtgataactgtcataatatactgcattttctgtaatgctatgtaccttctaaatgcttcacatctttttgctacaacagccctgagaggtaaagagagcaaggaggacaggaggacacacatttgttgactaatcactcacactagttttctcctcctgatagcctattttttttttttttttggagactgagttttgcttctgttgtccaggctggagtacaatggcacgatctcagctcactgcaacctccgcctcccaagttgaagcgattctcctgcctcagcctcctgagtagctaggattacaggtgtgcatcactacacccagctaattttttgtatttttagtagagatgggtttcatcatgttggccaggctggtctcgaactcctgacctcacatgatccacccgcctcggcttcccaaagtgctgggattacaggtgtgagccaccacacccagctcctcatagccttttgaaggaggttatcttgtttttaaagaagaagaattgaagggctatggatatttccttcttgacatcataaaacccactttagtagttaaacagacacatgctgtgtcttcctcacaaacatctggaattcctggccttggagtaattccaaacattagaaacattcggttagttttcttaatatttggaaatgctctcacagatccaaaaagtacgtgctatttgaaaacattctgaaatatccctgagtagtcacagtgtgaaagttggacgtgtgcccccagcagagttctttcttttttctccctgtcaattgtgatgtcacttaagtcccccttttctctttaaccaaaatcccaagtctaacatcagaaactcctgaaggtttaactcaaagacatcaataccttccaaagaagacttcccaaacaagcaggctttcaggcccaagctctctgaagatacatggaagtgggctggggagagagagaatctaccctatgtgccgttgctcaaaggttacacaagatgctgtattaaataagatgtggccaggcacggtggctcacgcctgtaatcccagcactttgggaggctgaggtgggtgtatggcctgagctcaggagttcgagaccagcctgggcaacatggtgaaaccttgtctctaccaaaaatacaaaaaattaactgggcgtggtggtgcacacctgtggtccccagctactctggagcctgaggctgaaggatcacttgaggccaggaggcagaggttgcagtgaactgagatcatgccactgcactccagcctgggtgacagagtgagaccccatccaaataataataggaagaagatgaaatgcaaactcactatggatttgtcaagtgagtactcgaaggcctattttccaacttctttgggaaattttatttctttcttgggaaaccagtccatccctctctctcctttcttcctttcctaatatatagttgcaaacatatgcacaggcttgtcacctcattcatattcaaaaagaaatggaggttgttggggtagggatttggcttaaatcacaaacccgtgcctttagcacaatactaagtttggagaagatgaaggcagtgatttgatcatattctatgctgcaagcaacaccccaaaactcaagcatacagctattaaaaatattctaaggggaaaaatagcgtttgaggaaaacacttggcctttagttagtaattcacctgttcatttccatggagaaaataatatgaacaagaacctgtggaggtagaaaagatgaacaaattctaaaatgcagcacgtttagatctacatttttctgtcaactttataaatgtcatagtttctactgattcctccctgtaaaataaaatacacttagattcctttacctttcccattttccttccccacctctataccccaagttttaaaatgttatctgtttttatttttatatcacatatttcttttttcaagattttttttcctaagtgctgcattggaatttgtgacaaaaagagaacataagtgccattattaatgagaaagacttaattgaaggcccaataatgaagctaaggctgtgtggctctagccacttcaaacatgaggcagacctcaggatcttcagcaaataatgcaatagcaagctatatgaagcaaaatctgtcaaaagaacaaattaaaaatgatatggatagtgggagatattaatatgatttttcaagtcttaaaacttaatttaaaagttagagatatagagcatatatctttatgctctaaagatataggtagggcatataatacttttttaaatgactgtgaacaactttgcaaattgatcatgctaagacatggataaaatgccaatatattaatgccaaaagtagaaattgtttagacacattcttagatgataagcataaccagaagataggttaatacatgcttctctcccaatttccttgcatttgcttaaaaaatcaaccacttagaaatccaagacagtttctagatttgtggtcaacaaaatagatccaaaaatctggatgaaatatgatttttaaaattacattgtgtggcctcactcaaaggaaagaagtgggaatctccaagtataggaaacaaaatgggaataaaaacctaagtaagaaacaaagtcacaggggctccaggccaggctgcgggctgtgaccccgatgctgatgcagatacaggacaccagatctcaggtctgtgccaaggcatcacacaaaaacagagccccctgcagaaatcaggctccagcaggatacaccaatcatttaattgggcaaggaagcaggcaggggatgaaaatccacaggtgtaatgatgttacaccacccatgtgatacagaagcaccaagtcaagaaactagccccaaaatgtgtccgtgatcttcctgatctctgtggccctacagaggccatgcaccttcaccctgtgggagtcttccacatagcccagccccacagcatgcctgcagcaaacaaccccctaaaggtgggctgatggcacaaaatgacaaaccatgtcaagatgaatgaaacaaacagaacaaacaagaagagaggatcagagagccaatctgaaagagaatggaaaataaatgtgtttaaaatgtgtgaagacatgaaacagatcataggggaaagaatactcatcaaaagcagatttgcagaagaactgagtataaattctagatttgaaaaagtttattcactgaaataaaacttcatggatggattaaacagtgtgattagacacagatgaacaggaaatatatgaacgagaagggaatttgaggaaatttcatcccccccccgaacgaaagcaccacatccagatttttttcacccaagttttatcaagttttaagggacaaatgacccatatcagatatgtactgttccagaggaaagatataaagaaaacgttttgttttgtgtggttttttttgagacagggtctggctctgtcacccagactggagtgcagtggcacaatctctgctcactgtaacctctgcctcccaggctcaagcgatcctcccaccttagcttcctgagtagctaggaccacagatgtgagccaccacacctggctaatttttgtattttttgtagagacaaggtttcaccatgttgcccaggctggtctcgaactcctgggctcaagctatctacccacctcagcctcccaaaatgctggaattacaggtgtgggccgccacacccagccaagaaaaagcatataaattcattctatgataataacataatcttggtttaaaaaaaaaaactggacaaaggcactaaaagtagacaatatttgagatcaagctcgctgatgacaaacatctaaatcaaatattggcaaacaaaatccagcaatgtatttaaaaaggaccaagatagctaagacaactttgaagacagagggggaatttgttcctcatatagcaaaagttactgatgccaagaagatattaaaattcattatctgttcctaattttaaaaatatatttctagtaaactaggaataggataagacttctttaacataaaaatgtatctacatatctgaattcaaaactcaacatcattctaataataaatcactatgtagaggaattcactttaaagttcagaagaaaaaaagcaggacaatccatttcaccactattatctaatattgatctgaaagttctagcagcactgtccaatagaactttctgtaatgatggaagtgttctaagatggtagccacaagccacatgtggctgctgggcatttgaaatgtggctagtgcaattgaggaactgaattagtaatttcatttaatttttattaacttaaatgtaaatagccacaatggctagtgactaccatattagacaatgccatgaacattataataacaccagaaatctgataatagatataaatacaggaaaagcagccaaacgtcattgctctaaaataatgcttgtgtcttcctggaaaactagagagtgaacagaactactaggctaccgagagggtaattaagttggatgacttcaaaataaataccttgcttataacaatcagtagctttgccagtgttcagcaacgaccattagaaaatatcacaagaaaaatatagcaacaacaaataaattcttttatttaactttcattttaagttcagcgggacaagtgcaggtttcttacataagtaaacttgtgtcatggggatttgttgtacaggttgtttcatcacccaggtattaagcctagtacccattagttatttttcctgatcttctctctcctctcaccctccaccctctagtaggccccagtgtgtgttattcccttctgtgtccatgtgttctcatcatttagctcccacttacaagtgagagcatgcagtatttggttttctcttcctgcattagtttgctaaggataatggcccctagctccaaccatgttcctgcaaaggacatgatctcgttcttttctatagctgcacagtattccacggtgtatatatacattttctttatccagtctatcactgacgggcagacaaataaaatgtaacaagaactaatttaatcaaatttgtaaagacatatatgatgaaagtcacaaaactttctgagggatataaagcaagtgtgaagagttagaaagccatagacttatggcatagttacaagctctggagccagaccaccagggaaaaagagttctggctctgtcgtatctagctgtgcgactgtgacgtcttatttaacatctccatgcctcagtttctctctctgtaaaatgagtatggcaataatagccatactatgtcttgggttgttatgaggtttaaatgtggcaggcagggcttaaaatggggcccgatgcacagttaagagtcagtcagtgttggctgctggtactaccatatcatcgtcactgttattaaatggagcagtaactgagtattgtaaagatatcaattgtcttcatcttaatatctacttttattacaatccaaatgaaaattccaaggggactttttaagttaacaaaataatctgaagtttatgtggaagaataaacacacaagaatagccaagaaaaatgtggaaactcgccctggccgattttaagatttataaaaacgctgcagtaattggaacaatgtatgatcacaccacagtaggcgaactgagctttggaacaaagcccataaacagaaccaaacacttaggtgaatttagtataaaataaggcagcctttcaaatctgtagggaaagagtgggttattcaaaaaatgatgttgagacaactggccaaccacttggaaaaacagttaagttcatttttaatctcacacctttcatccaaacaaattccagatgaaggaaaacttttaatgggacatgaagctgtaaaaattctagagggaaacaaaaaaatgtatataatcttccaggtgggaaggatgtgttaaacatgaaggagcataccatgaaagaaaaatttgaatgtttgagtgcatatttttaaattctcttgttaaaccctactacaataaaacaaacaagaaataaaactggaaaaataggatatataacaaacatagggtcaataaacttagtataaagacaattcctaaaatcggttaaaaaaaggtgaatatatcagtgagtaaaagatatgcaaaggaaatttttaagaaaataatgattaataagcatatagaaaatgtttcatataaccaagaaaatgcaaattgaaataatcaattgccatttttactttgtcagactgacaaagattaacaaaactacaacacgcagtcttggaaaacctgtaggaaaacaggtgttttcattcatcatcagtgagagaccattaaatcgttaggaaggaaattttttaaatgagtcaactgcttttatacattttgacccagaatttcaatttcagcttcatcaaaagaaggtgactgggaatgtttacaaagacttggccacaaggatattcatcacagtattgtttataatagcaaaagaaaaaatggaaagaacaaagggaatgagggagagagggaaaagaaaaacatctaaatggtaacaacctaaatgtctgacaataggtaatctgttagataagttatacttcacccctaaataattaaacaatgttgtagaagaataattactgatgtggggagtggggaatgttaataatatggcaaaaataaataaataaataagttacaaaacaggccgggcgcggtggctcacgcctgtaatcccagcactttgggaggcggaggcgggcggatcacaaggtctccggagatggagaccatcctggctaacacggtgaaaccccgtctccactaaaaatagaaaaaaattcagccaggcatggtggtgcgcacctgtagtcccagctactcgggaggctgaggcaggagaatggcgtgaacctgagaggcagagcttgcagtgagccaagattgggccactgcattccagcccgggcgacagagcaagactccgtctcaaaaaaaaagttacaaaacaatacactgacactatttttgttttttaaacacacatatttatatgcagacagagactggaaagatactcatcaaaatgttaacagccatcacctctgaatgaaaccactattaatttttgctttcttctttccatctatctgtgttttctaagttctctgggatcatatgtccctgacgtaatcagaaaagaacccacaaaattgatttaaaacttaatttttaaattcttgctaactattgaggtctagaatacatcttaagtttaacatttggttagttcctcagtcaccaggctgaactctgctggccaagaaaatatcttggaaatcttcacacaaactgtatttactctggccgcactttttcctcctttagtattcagtgtactgtgccaagaaaagatccactttcaactggagatccactttcagagagattcaaatgctaaaaaggagacactggagtatgagctgagaagtgatccattttatgcactgtaaattaaaaatggatgttttactaatgcaataatgaaaaacatgctagactatcctagtgttgcatggagatgcatgaggtatgactataaacaaaagaaactgatttttaacaaactcactaaaattgagtttataggccatgtgagaaatcagattcattatattataggcacactttattttttgatgcaaaattttatttctcaacttgattttcaatcctattcaccaggcatggctctggtttacttttgcacactctcaaaggataaagctttgtcccatttgaacatatttccccaaactgaacatcggtcaggaaggcagttctaggagttctgaggagggggctcaacttcctagggggaagagagacaacactcattcgaacgtagacgttccagagggtgttgttttcaaaaacatgcccaattttccagaaactaaacttcatcttagaaaacacctgggctccagggctgctgtgggcaccctaaggagatcattaaagtgcagatggggagggaggatcgagggcaggagaacataaacttcccaaaaaaaagcctattgtttcctttgttatgggttagagtcttgccatatgttggtcaaaggcacttaacgcaatctcgatacatccctagggattttatatcatgtgaaggtgatgaaatgccattttgtgtaactcagaatgaagagacgtaaaggagcgtacagtctcatgttcttcatggggatgcccatcagaatcaccagggagcttccgccaagtgatagcagctactgattgttgagtacctactctgcaccaggtgctgggccaagcaccctcctgtattatctcatttcatcatcaccgcagcccaaagagggaggagttatttgaatccccattttgctgatgaactcagagagatgaagtgcccaagttcgcgcagttggcaggggtggaaaggacttgaacctgggcagtcggactccaaaggctttagactgcttccctacattgcctccaagacacagatccccaaagatccctgggaccactgactccaaatgcccaggtgacagatgtgtgcctgattcagagatgctgatttcaatagatccccctcattttgcagaaagataatcgcagatcagagagatgtaactccttgccaaaggtcacaggacacattagtagagaagtcaagacttgaacctaagatcaagagaaaaagcccccgaccagggtaggaagaaccccaggcattagggtgtcagtgtctgcagctggctgtgtgaccacagttaaggcacctctcctcattccccgagtggccctttttcttgaacttcaggagcattttgtgtatctggtggtgtttcccctttggccctctttcagacagaactctggtctttgcccactgatttttgaagtggctcctgcagagactgtgttagtggatgttcccatctttcagttctagaaaaatacagatacgttgaaatttactgccataatctagaatggttgggggacaaaagggaagtcgccaccagaggtaactaggtggcaaggttttcagttgggagtaaaagagtttattctgggggtgagttgacacagtccaaagttagctgcaccagtccctggtggacagtcatccttgatgtttcccctgctctaccaagtttgaaattgactccacgtgaaaatcgtgagctccacgaggactccaggcatgtgctgcatttgttttatgcatgtctgggagagatttgcttgtgaacttctctgaaacccaccttccccctagtcctgctgtcctgcgggggtaagttggcatccccctctatttctgcaccccatggctcagttttcatgtaaggtgaccagcaggtggatgctgcccttccccatgcaatactgctcctctgccatttcagtaggatgatggaagagaaggtgattaactcagagacaggccatactcctggaaccccaggcaggctaatagtctgtgtcccttcaaactgacattctttaaatatttgttcaacatccattgagagaagttgggtactgctgagggaaaggaagaaagtgctcctggtggctctgtcccccatgccattcagctctggcagccagcaagcatcccacagcactttagtggcccaagtgtgtgcccaagttctccttcccacctctcctctgagtttctctgtaaatttgtgtcctttaagagcagtcagcatttgccataacccgtggccatgagtgtgtggaaggctttagccattttggtagacttgccactcagttccaattccaaaggtaaaattattccaaatttgtatactgccacaagggttcgtgtgtcaggagacacataccttgtgcatgaatcctgaattatcctctaccaagtgaaaacaaagctttgcaaatatttgtattcttagcaagttatagctgttttaagtgctgcagttattctgacctcaggattacaaaatcttaaaaagctgatgctttacttagaagataatttgtaagttctataaatgtcaacagtcaagaattgttttgggtgtggatttattgagaggagaaaatactttgcaagaacgctgaaccccattagcttcatttcatttccttgtactgcctaaaactaccctattaacttcagataaatgccaaatgccacagaattatatgtaatctcaattatgttaaaagtaatatgcatggaaaaattctgaaatagtatttcccaagacattaattttaccactggaagttgagattatcaaggattttaatttcttttttatatacttctctgtattccccaggcttttatactaatatgtattactttgtgattaatacaaataacaacacatatgggtagataataatttacatcctgagaaggcagaccagctgtgctgacaaacagttctcaatgctggtgtgcccagagctgtgaggtcacaaccttgtgcagaacttggggtgtgtagcccaacagacaatccagatatctgcagggctgctagaccctgggcctgcactcctctgggaatggactcatggtccctcaccttttacttcctctccatctggggctataatgtaatcttgatcctcatgaacacagtaacaataataacccacttcatttccttccaagactgcccacagctctgagtcctgtattggtatttgtatgtaaggtgttctgactctacagcacccccatccatgtcatgtcagagccttggcggcaatataaggcccattgctggagtgccccatttacattataaagctccaccaggcagagtggctcagatgcaattccatctacccctaagaaaacctggacccattcaagcctgcaaggagggctttatcaagagacattctcttactccaaccaggactggtctttcaatgcctctctagctgttacctcctcccttttctacccatcacctctaaacttttctgggcattacaccagtaccctgcaggcatgaactacagagttatatctgtaggcccctctacattgggctaaagaagcatataaagccatggtagacattacgccaggttttctaacctcaacactactgacattttgggctggataatttatagctggggagtggggaggggcctgtcctgtgcattggaggatgttcagcaccatccctggtctctacccactagatgccaatagcattcctcccccagttgcagtaaccaaaactgctcaggcattgctagttgccccttgaggggcaaaatcaacccccatttgagaacactgcactatattcatgtccaaagatcctatttagataagtaacttgcttcttatcacaccaatattgtaaagccctgatacaacctaacagacaggttgcaagactcactcagtttgtgcacacatccacaacttgtgttttgcaggtgcctcagtcgatgaccccaacagtgccccatcttagtaatgacagttatatgttgagtgcttattaagtgctaagcattaaatgatatcttctcaataaaatttacaaaagcctatgaagtattactcccatattatagatgacaattttgagttatgaatagagtgaaaaaccttgcccatggtgacatagccagttagtggcaaggctgtgttgggtctccagagtccaggctcttagtgttctccattctactccagccttcctcagagaacagaatgggaaatcaaaagacatgtcctgggtatctatagaatataggaactggtaaaatagctacagacccaggaaacttacctggaatgtgttggccaagcccatcccctgatctcatggcaactagccagggagggcttccaaggaaaccctgtaacaataccaggtcagggaaaaggtgagttgtgagcgagggtatgggccatgtctaaggaaaaggatggtggccagcttggttctgccactttaaaggcatccctctggctttagcccaagataagaggacattacagtgggtatactcattctgaggatgtttcccaacttggcccaaccaacctacatttcactgccatccattcccattcggctttgaatcttctcatttctccttgacttctcaaccactgttcagcctgtccaagtaaaagccattctctccactttcaaaatctctttttctagagtttaatgtcttctatcaaaagcttgttatctcactcatctctgaaaaccttctagcccagggcctgacacatagtacattcctttctactctcagcaatggctcccattttgctttgtaataagacccccctaacacacatttgtgaattatcaatgaggcagccccagttgggcaatcagtcatctccattctctttggagctccagaaagctcagcccggattctttgaatttcaccaacttggagtcctgctgaatataattttattacagatttttccacagtattttacaagtctaacttttttcaggctggttacttttggaggcagtgaggaggtagaaatattcagcctaactccggcctgtctgttgttccatcatttggagacacattcccaaaccagctgataatttggtgctgaacagttatatttggctctggaatgccctgaaaatgctccctagacccaagggacactaggagaaacagcaaggcgagctcatttcagtccctaacctccactgtttttcccactacctaatgtgaatgtcactatgggaatgtaagctctgcttcgggcttacatcagctttggagggttctaacacaccctcccgctgcctccataagactagggattatttttctcttcctatttgccagaaataaatatttataacaagaaaagattgccaagacttgaaaagtatttggattatttaatccacccttataaaaaggattttctctgattggtgtttgaattggctaatgaatttcaaccctggttttatcccagatccatgagccaccaaactgcagggaagaattctgggaactttcttctttgccagtctgaaaaggattacattgtcccaaggtctaaacctgtaaatatacacttatgagtgtatggttccagagcatggcttcattctagttggcatgaccagggcctctcaaaagacacctgaaccttttcttcaagctcttcatccctagacccctctcctggaaggcaagctcctgttggtatccagccttgcccattgaagatcttggccatgtgcctccagagctgtcaatatgaagagcctcagctcctggtgtgcttccagctacattataagactagctgggcttacactgggcaagctatttcaacaaaacttgggtttgaattccggctctgacactcacaagtggtgcagcactaactcaattaactaacccttctgactctcagtttctcaaaatgtaaataatctctctctcagagggttgtagaagcatcaaatgagatcgtgggtatatgatgttagaaaaaatcaacatgcatgcacctgtgtgtatagatatgcatatgtgtatatgtgtgtgtatctatacacacacacaaattcactaaagcttttcatttccctattaattcctgatgtctacaaagatgttaatttggtaaagtgatatcattaagcaatcaggcattttgaacattttaatgtttaatccctctgattttaaaccatacatccatgtagtctattttaaaggtgtggaggcccatgtaataaagaagaataacatctactgaatgctcaagtgctaagtatcatgctttgtacttgaatgcgatattattgactccccacacaatgtcatcaccactgtttatagatggagaatgtgtgtccctagtcacacactagtaagaaaagggctcagatttgagtcggtgtgatctgaaatatcctctgcccctctctgtcccctcggtatgcagcttgagggatgcctagctcccaagtctggggcgtttagcactctgagataatgatactcattggcccccaaatcctgataaatccccaaatccttatcaagcttgtcagactcctatagacagatgccttgggtaaacctatgtcataggtacacacagaattctaaaatatctttggtaatggacaaaagaaatttatatttcaagatcatctaagaattacatttggctaggcccagtggctcacacctgtaatcccagcattttgggaggctgaagcaggcagatagtttgagcccaggagttccagagctgcctgggcaacataggggaccttgtctctacaaaaaaaaaaaaaaaatttaattagccaggtgtggcactgcactcctgtgatgcagtgactagggtggggtgggtgagggggacaaggtagggggatcacttaaagcacagaagattgaggctgcagtgagccgtgattgcaccactgcacggcagcctgggcagcagagggagaccctgtctcaaaagaaaataacaaaaatttaaacataaaaataaaattttcattgaatgtctgatttcaaactcccacccctccctaattttctccccagttgcaaacaaaagccaagtgggccagtccgagctcctggccttcattttccctgcccacccggtgctagtgagcagcgaaatggccacctagagggtggaccagcaggggcctcggctgtcctaggagtggatcgcggccccacatatgtcacgacaccactggctttggcacacgctgcagcgaggctggcacggccctggggccaaacgtggcacggccgaggtgcagcaaggaaggctttgtgccctgcctcccaaatggagttccaggaaggagtcagatgacctgagttatggaaaccaaatggccctcctttgtttagagagagagagaaaaaagtcactcatttttgtggtaaaatgaaaacaggctccaaaccaaacaatcctctcggagcagaaaatgccagctccacagagcaggcccacagcctgggaggctgatacactcggatggaggaaggtcttccacagcctcagcgaagcctttgcaggcctcccagtgagattttcctctgttttgctccagaaatatttggtctcccaagcagaaaaggaaaaggaaaggagggggaaagtgagaaatgtctgcctggcctgggccacactcatcctctcactcctttccagttgggatggaggaaggagagaggagttgtccagaggcagccggaagtgaggccaggcgctaacccaggagcagggcatgccagcctggagtctccctggctgtggcgctgcagtgcgctgcctcggatgctctcctcggcgtgacccagctctccccacagaaggcagccagagtcacatggcctcctgtggctgctctgtggctgccccgtggctctgtgggctggctatgtggacaggaatctgtactcccaggtactgctggtgcatgtgcaacaggataagccatggccacgaggaaataaatataggttcgagtcagccacgcctgtccccagttcagtttattctctaatacaagcctttcctggaatggagaatctcttagtgagaaaagagtaatgcagagttcatttctagtcttggctttgcctctggcttgcggtgcaaccttagctcactgtcatcccgctcagcctccattttgcatctgaaatatgagcctaatgatccctgccctgccttaactcacgaggttgtcattacaaggaaacgaagcacagcttctatcaaggctggtgcttatagcctattagataatcatgcagactctgcagccaggctgcctgggtgcagatccaagctcccgtgtgtaaccttggacaagctacttaatctctctatgtctgttcctcacctttaaaatgaaaggaataatacaccatcctgatagctctgctagaagtttaaatttgactaagtgacatacaggaagtgcttagagattgcctgcatgcaacatgcgctggcaagtctggctgtcattgtagatgctccttgacttaagatggggttatgtcctgataaatccatcgtaagttgaaaataccataactcaaaaatgcatttaatacacctaacttcccaaacatcatcgcttagcctcgcctaccttaaacatgttcgaaacactgacattaccctatggttgggcaaaatcatctaacgcaaagcctattttataataaaatgtcgaatagctcatgtaatttatttaatattatactgaaagtgaaaaacagaatagttgtatgggtactcaccattaatatacacaactgaaagcacctttataaagtcacagtattgtttaagtcgaaccattgttaagttgaggactgcctgtattatcatcaccgatggaaggacatcttgaaaataataatgcttgggccgggtgcggtggctcacgcctgtaatcccagcactttgggaggccgaggcaggcggagcacaaggtcaggagtttgagaccagcctggccaatatggtgaaaccccatctgtactaaaaaaatatatagaaattaggtgggcctggtggcaggtgcctataatcccagctacttgggaggctaaggcaggacaatcacttgaacccgggaggcagaggttgcagtgagccaagattgtgccactgcactccagcctgggtgacagagtgagactctcagaaaaaaaagataataataataataataatgctcaatttaggtactacatgatcctacactgtcatcataagctttataattttactcaatacagcgtcaccattcctgcaacattccatcatctgccaacagctgattccaaatatgaggataacctccagtagttccctgttgcgcttagaaaaaatttcaaaagcttcatcatggcctatgtggccgtggtcatctggccctgctgccttttctagcctcatttggagccattgtctgtctcacttagattcaacagcctcactggccctcttttagctctcaaaagatctggggtccttcttgccccgggatctttgcagtgcctccccctctcccactccatcccatcacccaacctcaggtttcagcttaaatagcctttccttggggaagcatttcctgacctcccagatgagggccagccccctcctccttttgtgtgctcatcacaattataattacataacaatttgtgtaattactagcatgttggctccttggacaaggtactttatctgtttcgttcattgcaagccttagcacattgcttggcacatggtacacactcaaagaatttattttttaattatgttaaataactgtctctcctgcctcctataaaatccatgaaagcagagactgtgtttctcttctcaaagcctgcatctctagtatatagtaggtcttcaataaatatttgttgaatgaatgaataaacaaatgacctggaataacctccctaacttttcaccacttgaagattttcctgtacatcttcttcctcctcttgccaatggggacgttgtgcttagcactcagatgtgtcctctatctcccatcccaggcagcttcctaaccttcactcaggcaagagtttaatgtcagctatattctgcagtcatgacttgcagatatcataagcgacatcagtgtcacaacaaaagcagaatattatcctttaataatatatgtattcctttgtatcttctagttataggaacttgtagtcacagcctgattaatgacatagatcttattcatcttcatttcacctgtaggccctaccacagcctttttgtacagcacatgtacccaatcaaagctgaggcttgaagggatgactattatatacttagtataataacttctcaaccctgtctctggccccagaaactgggatacaatgaagttcttagtgagcttgaattgaagccactttaagctttttcctggtcatccattagaagaagcacaagaacttccctactccaagagtccccgactctgattcaccttctacagctacatctgctatgacctccaaaatcatcacttcagttttactcaaaaacccaccaaagttctttctataacttacagaactttgtgcaaatccctcaggctaactcaaagaacttgaccaaactttctatactgatcttttcaaattcttcttatatcctaccttggaacatgcctttagtatgccctgtctttgctcatgccattcctccaaccaagaatgtctcttccccatctctgcacaaaagcatagctcatgttttgtgctttccgaagacctgactatgacagccatgtacaggaagcttcctgtcttatgaagcccaatgatactttggtgaagtcatttgtcagcaaactttttccacaaatatggcttatctctccaactacccttagacgtggaactccttaggaccagtctaatattttcttgtttcccctcagtgattcctgctctatctaggagttcactcactattttctcaccagttgactcaactgcacataccacaggaagctatgattcaggcaggagcacttgagttcactgctaatgggttttacagctcaagagttttgtttttgtttttgtttttttattattattatacgttaagttctagggtacatgtgcacaacgtgcaggtttgttacatatgtatacatgtgccatattggtgtgctgcacccattaactcgtcatttacattaggtatatctcctaatgctatccctcccccctcctcccaccccacaacagtccccggtgtgtgatgttccccttcctgtgtccaggtgttctcattgttcagttcccacctgtgagtgagaacatgcggtgtttggttttctgtccttgcgatagtttgctgtacagcttaagtttttaagctcaaaaagatttttgtttttttggtatctccctggacttggttgatgttctctagaagtcattgaatttgaaattataaactcacctccctcttcttaatccagtgatttcctttttgcagatgagaagcccttttctgtggaagatacttatttactgtgtccagcgcctatcttaaaagaagttggcatgtaagttttcaccagcaactgaacctcccagccagggaagagagagaggaggtgtacggggacaggggaaaagaaagcatctagagaaagtggagcctttctctaggttcctccagcttatgacggagccagtgtttacagtgacccagacgccaggataagtgttttacaaagtatctcacttcattctcccaggttccccattaactaggtattcccactatcccagttttacagacatagagactgtggctgcaagactttaaatagcttgcctaaggtcacacagcagtgagtggaagagctgggctcaatccaaggtctgtctggcttaatcacacctacacttctagaaagttctcacacacttgacctcgctctgtcatcaccattgccccgctagataattgttatctcctccttagagaaagggaggctcagaaaggccaagtagggccatggctggttcatggcgagccaagaccccagactcacgccttctgatgtcccacacggtgctccttccttgactctgcgcagcatcggatgttcacccagaccggaaaaaattccctgaactaatttataggggaaaatctcatggtgatgcaattataataagcactagtgagatgagatcaaaaccatcaacagaagaaagagaatgggcaccctgagcaagaaaagaaatacatgggaaatgaggcaatgctggtgcagagaacaataacaacaaaaataacctctccaaaaccgtgtctataataggctagacaaagaatggaggctttaagggaaaaaagttgaacttgttcatctgaattttgccttcaatcgtgtgttcatattgtgaaacctccaactctggttgcccagcatcaatctgtgatgccactgatttcacaaattagctcagtgtccatgctgcgaaatgcaacaaaacaagaggtcagtttccagcgagtgtcttagagtgggaagagatggaagacaaatgcatcttctgctttacttctgtgagtctgttgaatggtaacaaagccacccccatcaaatcactgagagtccagataacagcagaatattgcatttatagttagcccagtctacccccattgacttggactatttttgaagaatactttgtccaactacaatgtgacaagcaagttaaatgaaagtaagctttgcccattcaatgccactcactgcaatgccggaacgtctgaatgcactgccttaatataccagccaagcatatcctgacacttctctaaactttaaaggaggatgggctatacagactacccccgacattttacaaaagaggaaactcagacccctcctcccctggagaagagactccagtctcaagggtatttaagagcagagcccaaaggagtcctgtgtgtctggctctcagcctgttgctcattgcacgccctgctgagagtctgcttcccttgttgtcattgcaggaaagctgcactccaggtcagcatgaacgatggcctctcttttatctccagttctgtcatcatcaccaccacacactgtgtaagtcataacctttccctttactaaagatctcattatcattgtcactatcaacgtttcttaagcagtaatcttctccaaaggtaccctggaaagttttttggttcttcgttctgcttgctgagctttgatcccagcactgctccaccagccccaggctggattggggtgtgctgtaccccagagtgtatcaggcatgtctgtgttaagttctccagcttccccatttctgctgaaggggagatctaaagtcactggcctgaccagacggtaagatgggctatgtctgtgcagtaatgagggtggagtcccagatagagtgggtttaggagagaatggacggaagggaattggacagcatatacagaaagaacgtcttagggagttcatctctaaagggatgcaggaaaatgggtatgagctgaaggaaaatgtggagtttggggaggtcattttatttaggatgggagaatttgcaacttgcttattattgtggaaataatccaggagaaaatggaaaactgatgaagcaggagagagagtggggaaggagcccttacaatagggattgtgaggcaagagcggggactgcattctctctcccagctcctcagatagcccttctctggagccttcgcatcaagtagttttcattcctggctatatataaaatcacctggagagctttttaaaaagattggtgccctgaccgcattcgagactgactgaacctaagcctctggcatgagccctagctttggtggttccacggcatccccaggaggttgtcatgtgcagctgtgactgagaacccgtcagcctctggagttggtcctgcccactgtcaatgtctcagagctcagcctgtcagggggcagtcagggcttagttagcttgtgtcaagacctcaaccttgtctgggcacagtggcacaggcctgtaatcccagcactttgggaggctgaggtgcatggatcacttgagcccaggagttcaagaccagcctgggcaacatggtgaaaccctatctctacaaaaaaaacaaaaattagctgggcatgatgtcgcacacctgtagtcctagctactcaggaggctgagatgggaggatggcttgagcccgagaggtggaggttgcagtgagctgagattgcaccactgcactccggcctgggtgacagtaagaccctgtctcaaaaaaaaaaattaaaaaaagacatcagcccctaacatgagcatttccaaaataacctttgtcggcgtattcagtttctttaactgaatacatttctccattagctcattctagaaactaatgtttggcctgatggtcagcttaggaagttattatactatagtcacttcctcgttggcctttggaagctgtgttgttagaacctctcagtaactggagttgtgtccttaataccatcacagttggataagaaagagcaggcatgcactgaatgtagataatatagaaatgggttatcataaaagaacaggaagccagtcctcatgatggacaacagtctccctcctaatgcccccaacaccaattttcatcttgtgttaggagcaaaccaattttcttgaaagcagggtaacccattgtaaaggtacagatgatgggaaagttttacttgaccaaagcaagaaactaggattgtgtcagagaagtgttaccactgagaaatgtccatgtctcagacatctggtcaaccctcagtctgtaggcctcagtaggacaccaccaaattttaaaaactgtatgcagaagtgttgaaatttcttcaagtgtatcctgcctgatcctgttgaaaattgacccttctgggacctgccaacctgcaggaaatgattaaaatactctaaatcaaataactccatttcagattcctgccagcttttgagtgatccaacagttggatctgtatttctcattatgtctgaccataccaccaagaaacagccactgcccttgagaccacagagcagaggaagtgggaagggaagacatctcaggactaaacttgtggtatggcaaatacagggctacaactttaaatcatgggcctctaattaagaagaaaaggtgtccttgccaatgcattgcaaaattagaagaattcccattgagtcccactacaccttcccaacccacggcagcctccagttacatcttacatctccctcatctgagcacatgccactaaatcttctcttcacttgacccttgatcaagaccacctcataatatattctgcattattccattttcatgtgagaatgctgtattcgtttacaacaaaattataaccactctaagatttgtgatccaagttctttcaatcatgtattcaacacatatttattgatcaccatgtgctaggtaccactctgggtgcctgggttatatcagagaatgcaacagataaaaatacctgtgtgatgggggaagggaagacaatgagttataaacatagtaaacaaactacatgctatggcaaaaggtaatagatgctataggataattagaggagagtgagaggatttcctactacctaagcgagtaggttccaattgtaaatagagtaatggatacattgaaaaggtggtatttgagtagcaacctggatagtgaggaagttaaccatgaggctatgggagtgtggggaagggtgggatatcccaaaccaagagccctcatgctaagaccctgtggccagcgatccttggtgttcacagaagagcaggcagggaggtgccatccccaggcatctccacgcctgctgctgtccttattccctctcaggatagcagcaggcagtgaggtgcctggggataggatgtgcagggttgtggaaggactttggcttttgagcagaggaaaacatggtctgacttatatttagaagattacttggctgaaggcagacagagacaaagatggaagcagtgtgacttgttaggagggttatggcaatatttcaggcaaaaggtgatgatgggttgaatcaggggagggcaatggaggtggagagaagttgtcagagttggatttattttgaaagcagagctaatgaattttccaaagcattgaatatagggtttagagagagagaagaatcaagaatgtcccaagggttttggcctaagaaactgaaaggatggagttgccatcagctgccagacaggaagaagacagagggagaagaagacttagggaggagggggaacaatcagggaatcagttttgctgtgtactggttatgtgaccttaataagttgtttagcccctagccaggtgccatggctcatgtctgttatcccaacactttaggagacataggcgggtggatcacttgagggccagtttaagaccagcctgcccaacatgacaaaactctgcctctactaaaatacaaaaattagcctggcatggtggcacatgcctgtagtcccagctactttggaggctgaggcaggagaatcagcctgaacatgggaggcggaggttgcagtgagctgagatcatgccactgcactccaacctgagtgacagagcgagactccatctctggaaaaaaaaaaaaaatttgtttagcccttttgtgctttaatttcccaatcgataaaactaagataataaaaaatttatatcagtattgtgaagattaaatgaaataatatttgtaaagtatttggcagaagacctagcaggtagtaagtgctcagtaattattagctgttttatagtggaagcttaatgaaaaaagttttaactaatttgagattcttcctagagagctggctctttaattcagagtctcattataaccaaggggctcctctgagacaacatgtatccgggggtacatgtttatcactagaccaagcccaggtgattgaaagggggaagaagagatggccaaattcatccagaaaaggggcctcatattcaaacataaaactccagtccccaaccaggtcctacacagcaactcaaattaaaggctgaaactatcattgggcaaaatagagatgcaggtggaacgtgtgggtatccaaaatatgaagtaaggtcttggactttcgtttgtttcttgggaagctggtttggaggacaaggtttttcaatcaaaagtgatcccctgggtctgagtaaacggatattgtcaatgccagtcacagcctgcccagttcatcacctggaaccaaaaatatttttaaaatatgtagttgagacttttcttttctcactttatttggtgcccatttggacacctgtgtcacaagttttcaaggtctgcaaatgaataactgttgcctgagccagaagcagaaattccatggagttttacaggaaagagatttttccgtccaagagctaaaacattcctatacaaatggtaaactttggtgagctccatgactatagaaaatggtcaaacatccagagtcctctctcaccagatatttaaatacacccatctctgtagtcttaactgcctcacttttcttcaccaaactccagccagaagttgagaaaattactaatatagtgctgctttcagtaaagtattgaaaagagatttgtccttttgaacaaagcaagcaaattttagaaacataaagaacttttcatgaagattgttttcttttaggtacttaaaaattctattatttcccacccaaagtgtccaaaaatcaagaaatcaatcaagtatgtcttgaactcctactgtgtctcctagtcactgtccttaaggagcctaaaatccagttggagaaagagtccaacaagcatataaaagagtgtataataggccgggcgtggtgtctcacgcctgtaatcccagcactttcagagattgaggcgggcagttcacaaggtcaagagatcgagaccatcctggccaacatggtgaaaccctgtctctactaaaaatacaaaaattagctggtgtggtggcgtgcacctgtaatcccagctactcaggaggctgaggcaggagaatcgcttgaacctgggaggcagaggttacagtgagccgagattgcaccactgcactccagcctggtaacagagcaagactccatctcaaaaaaaaaaaaagagtgtataaatgtataataaagaacaagattgtatgagtcaggtgtaaatgccataggatttcagagcagggaaggataagtgaaggcaagaagagtcaggagagcttcatggagagataacacctgagtgatttgaaacgtagtaattacaggtgaagaagtgggacgaggccatgccctaaagagacaccaacccgaaccagggatggatatatctctgagcatagtttgttcatgggctctcccagaccatgactttgttgttgtttttccttcttgttttgcatccatttctggggcctttcaatttggggacatttctcaagttggcaactatctttgtaggatgtacgctctacacccttgatcttgaacacccaagatgtggcagtgcggcccagttgatgctcatccctgttaaccctgatcaggatttgctttgtactggctgctgggttggaaagtcacaatctttgaagaaaagaaaatgacctaaagttagacacaaggttccaaattcaacattaaataaatgaagacccctgtttttttctcctgatttatatgaaaaacagcctgactgcagtagcaacaaggttcaataactttgagcggatccatgtcatatcactgtttagagaaatgccatttgaatgaaacctgaaattcaacaaactgagacctgaaacatcaaagcgaaaacaactgctctataactgcaggataatggaggaattaagaatacaggatattgagtcgaaaatctttatttcacatcccagccccttgactttccagggtgatcctggacaggtttacctggagtctgtttcagaacctgtctcgcatttttatagtaaagattaagtatataaggggcttgaggtacataatagtctgttcaaaaaatgacagctgtgtattaggttattgacctaactttccttgccaagtaaaagtctaatgccctgccccattagattcactgtacatgtcccgtggcttataaacaggctatctccccctgattaagaagcatgctccttttgagtctctacgataagactgtattttaggagcaggctggaaaaaatctttgaagatgttgcccacaagataactaggaagaaaaacaccagtaaatcagatgtggtgataagtcaaacaagactgggtggcaggctgactctttgctacttttgaagagttttcctcaataaatgaatcaagtaaatagtaacatagggaaatatttagacaaattaaacacatgaattaaagcaaataaagttgatacattattaccacatgcaaaatttctgttgccacaaaaaaaaatctatcatgcattcagaatcttgggattcttaaatgttcttttgttctattctatatgtactttctttggggcccctctttctgatataaagataggaatttgcctaaaaaaataattttagctcaagatgacaagcctagggaccttctcacttatatgttgccagacaaagactccaaaattttgtctccaaattcctcttttccatattccaagtcgtgccttcacttcctcctctcatgcaaaggcctggagagccacagacttgttcattatttcaggaagaaagaccctcttaacatccgggttattttcaacacttcatgactaccaatgtttcacaggaaggcgggcctccggctgccatatagaggtagtttatagctttggaaacaactagagagttgtcataaagcaaacgcagacattggaaagagcggttgtctctcaggcatagtatcgcccctatgtttcttgaggcaaaacagaccatcttgttcaccgtcacaacccagcacctggcacaatgtctgcacatactcattactcagcaaataatgatggttgagtgaataaatgaatgaacccaatcaagggtcatactggtaccatgatggcacctactggcaggaaagaaaaggagccagaaggaggtagaatcagaacagggggctctgagttggttgggaggtagacttcagaaaaggatggccagcaattctatcttcatatccaaggagcttgagcataatttaacaggggaaaaaatctgccaggtaagaaactataaccagcgttcccaggaagggcaatagtcaaagatatcatcataaaagcaccagctccagtaggagcagacccctgcctggggtgcagacttggtagaagggtgtagaaatagcccactaactggatcaagattctgggcaggcctctagtctgtgaggatctgcagcacaaggttggaagccaagcagaaccatagagactgatagactcaagatcactccagaaaagctgtgacccagggaacattggcatggcctgagctcaccctggaataccagaaacatagattacagcagttcagctaatctggatgctgccagctggggctgaggatgcacagtctgctttagtgagtactggctcagaagaggatgtgctggagcccagagatagaggccacagtgactgcaggtaaaagacagcagaggagggcagtgaccatcccccgcacagtctttggaggaaatttccaggtgtctgttttctaagtcagttcatttccattaccagttgctttaaagcgatgagagaatacaaatccagcctggttttgtagtcattatgactctttaggtaaacagacagctggcatggctgcccttgccaaaatctcttgaatttcaccagcccggtagggagtgaattcagtagcctgtgctgagtggcaatctcaccttccaacataataaaaaattattgcgtactcttcagagaaagtagaaatcagagacatttttgtcttctatttcttttccaaggtcagcaaacagtccatcaatcaagtgggtagctgtctttgggacagacaattcattccagtgctttatgcatgtgggcctctttactaaggaaagaaggatggggaggaggttgctggtagcaaatggagccaatgatatcataacaatcaggaccaacgtgttttaaatctatactctgggcaaagtgttagggactcgaagaatagccagtccttgccctccagaggcttacaatacagttgccaaggcaggatatattacttaaagaggtaaatattatacaatttggggtataaaagcaaatatcacacaggtaccctaaaattccccacctgttccaaagactcgtgaacctttagataagtcaatggacacaaacatggcacgctctgaggagtgtccacttcatgggcctggtgagttacttcccagttacctaagaaggattttcaccccttctgcaaagcgaagctggacagattattccagaaattcaggtataacaagtaggcagctcatgattagctcagtcccaaaactctatcccatgagtgtattttccccaacaaggatctccccaaactgtttctcaataccaggaaacaacctctgaagaaaagaagacccttccaaacaaccagttgcagagaacagaatcaggactcactaactgactttcccctgtaggttccttcgccccaacaatattattccacttcctgtccaactttcccacacccaccgcttcttactcattcagtgtcacataacctggaagaatgaggcaaaactgaactggaagggagattggagactcaccttgaagagggtttgaatgacagaatatggagtttgggcaacgggaagccatttgagggaagcacaatgcattattttaggaggcttaatttagcatgtgtatgctttaagtatattagtaacaaaatggcattaatttggatgccactgatttgtgaatttggtcatctggaaaaggagtaggctctagtttacttttccattatttgagctaaaggaacttagtaccaagagtgaccaatccacagcattggggctacaagtgaatcagagcctcatactcagcccttgaaaaagcatagccactgacgcactttgttattgctgtaattataggtgataggtcctttgaaatatgtggcttagcaaaacacagaggaaagacttgagaggaaaagtgggctttgggatcagatcaatgtggctaaaatcatggttctgctgcttacagggtgtatgactttagactgaaataatgtacttagaagagctgacatggggcctggcacacagtagatgcccaatcttagttttcttgtactgatgttgtggtctctatatgaatttgtgcagtgagatggtttccaaagcctctgacttctggttgaattagcagaagtatagtatctgaaactaaggaggtgatgggacctctcaacttggtgaagttaaaatctccgttcgaatattgtgttcagtaccaaggacactccaagggagaacatagagaaactgagtgtatgagaaatactaccaaatacggtatgttatgtagaatatagaattggggctctttagcctggggcatacttagcatagagacaatattcaaagggctgcgctgaaacacatgcagctatacctttagagccctaattctacagattatttgttgtatagatccaaggggtagaataggctcaaaggaacagtttctggcttcgtttttaaaaaggcctttttaattagctgcattgggtgggaatgagctcgctattatagttgcagtcaagcacaggcagcaggacaacttggcagaataatgtaatcaccattcatgcctcagagtggggattggaatagaaaagctttcagactccttatgctgctgagaggctgtgactgtagacctaaaagtatgttaggaaaggagtaaactaaatactaccagtcctatacagtatcacaaataagtttggttcttacatcttgaaaatgaatctaagagagctctgttggtgatactggagacaacttctcttagtgcagttcagattggccaacctccacctaatacaagtgggatcatatttcagaccagagtacttcaaactcctgagaataatctgttttcaagtaatctcaaaacacaccctgtaatttacaaacaacacattagtcccaaatcagtctcctctatttattagccagtctccatagagccatacataactcaaggtattttttttacaatgtcccagtatttttattattatgattactattattattattttaacaggatggcttgtggttttacatacaatcattagagacggtaaaagaccacaggaatatcagagtgcggaactcagatctcaaatattgtttatgaactgaaataaaagtagtttgccaacatctctattttgacaacccttgtaacccttatatgtataaaaatatcttttaaaagatgttttggatgatttgtgctgatttgtttttcttggatgtttgagcaattgactttcaatatgtttatatctaagtattttaaagaatgttttccctaagtttgacatttccttgttttgagagtaaattgagaaaaaaaatatttttctgaatctatactttagaaaacactgagataagccaatagtaagatggtagaactagaagttaaatcaaaataatccacaagcaaaataaatataatggaccaaactcagcagtttaaaaactcagattgacagattgtgtttttaaaatatccagctatgtgtgatttacaataaaacatatattcaataaaacataaggacacagaaagattgaaaataaaagcatgtgaaaagttttatcaggcaaataccaaaagaaagttagtatagctatattaatatttgataacaaacttattggcaaaaaattatcggtctaaagaggaccattacataatgttaaaaggaacagttaacctggaagttataataattctgatctgcacttaatgacatatcctcagcatatataaagcaaaaattgatagaattgcaaagagaaattgataaatccaccatcacaggaggtttctatacaattctctcagtaattaatagatcaagcagccaaaagaattaataaaatataaatgaagaatttaattaaatataatctagtggacacatgataaagcctcagcgtaacattcaaaatagggtccaaagttttttggttgcgtacaatgaagacttatgcaactataagactaatgacaaaaatatcatacttcatcaaatctaagacacacttttctttccacattttaacatctctaaaattgatatgtttcagatcataataatatatcatgatataatgggcagtgttttccctaatagctcataaaatagtgagacatcctaccacagatacatctgaaatgcaatgaaatattctctgtcagtctgtactgtaccaaaagtaaagataatgaaatatatcctgaatgaaactgatcagtcacttattttccactgcccacccccattcacagtggaaaataagaactctagcctttcccctttggggaatggcttactgtatataggaaatctgcatccaacagagaatatctattcttttttaagtacactttcacactttaaaaaaagcagtcatgtactgtaagccaagactcaacaaatttataaaaatgacatatagatcatattctggtgccaaataaaaaacaattgaaatcaatagccaatcaagttaccaatcaattttgaaaatctcatgttttgaaatttcaaacacacacccaaagcatttgtgagtcaaagtaatatcataatgtaaattagaaaatacttagaactgaccaattatgaagatgccaaaaccaaaacttggaatgcagctaagtggtccttacagggaaatttgtcatcttgagggtttatgttagaaaagaataaaagtttaagacaattagccaagcatagaacacaggagattagagaagaatgacagagtaaaccctttcaaaaaagagaaggccaagaccaagaaagaacagaatagaaaacaagataaatggagaggtaacaaagaaaactattagttgggcatagaagaggtgaaaagagaaatagacatgtatagaaagaactgtgtacttgcttgtcaatctggatgggaagataagctgaagtcaatgctgtcatgggttctgggtagtactggagagaaatcattgatcaagagaaccaagaaagcacacgcaaactgagttcatcccccacctacccctttccttcctagaaagcctttgtacacaaaatggttgctataaaatattgtaaaatgtgtacattttattctcccccatttttatcaccaactaaaatttggcggattactatgaaactctcaatttgcaaagctgtttgtccctacagcagtctttgatcactatgttgtgttttttttaagtttatggttctactttttctggtctctcgcttcttgatatcatacctgtgttttctaatctagatactcccctctgcacttctaatttgacagtctaagcttctgggtacctgaatatcagaaaaccaagcttacataaattgcatatgaaataaggattcctagtctctaagaacttgagagaaggcatatggcctaagaacccaagctttagtgaatgaccaatgtgtccatttatgccacctcctgggttattgaggctattccagatagtcttttgggttgagcaccctggttcagtgaatccatttgagagaagcacaattataggaagaagtgcaaaattgaaaaaggatctgaaaagtcattgggagcctgggcaacaggctctacaacagggtcttttgtagagaccctatctctacaaaaaatagaaaaattagccaggcatggtggcttgtgtgcatgtagtctcagctactcaggaggctgtggtgggaggatcacttgaatccaggaatccaagtctgcagtaggtcatgattgcaccaccctatgctgtgcaagagagcaagaccctgtctcaaaaaaaaaaaaaaaaaaacagtgggcgcggtggctccgcctataatcccagcactttgggaggccaaggcatgtggatcacctggggtcaggagttcgagatcagcctggcaaacatggtgaaaccccaaatctactaaaaatacaaaaattagccaggtgtggtagcggacacctgtaatctcagctactcaagaggctgaggcaggagaattgctagaacccgggaggcggagattgcaatgagccaagattgcaccattgcactccagccgaggcgacaacagcaagactccatctcaaaaaaaaaagaaaaaaaaaaaaagaaagaaaaaagaaaaaaaaattggtagaggggggaaggagttgtcagtgggaaagagaaatgggaggaggaggaagaggagagatttaatagtttggggaaaaggaccaaaaagcagagaaaatctgagaggatctcctttctaccaatgctaaaataattgtcaactctttaaatagtccaacattggcaaaatcagtgagctaagttatctgagaatgggagatgacccaccaggatcatattgtcctagttggcagcttacagtcatactgcactaaattacaagtcaccccagagtcattacgtgtattttctaatcaggatagtatttgggactgacaggatttatattgtttgcattcccagaaggcagtcaaactcctccctctgttccctacagaatgacaaggtcccatgagggtatataaacaccttcccttttgcaaagcagccatcttctcacctatacattaaggcaccaaggaaatgcgaaaggcagggagttaatttatttctcctcgaaagaagagtcagccacaaacgatacataactaacattcctttgccattactgtggctactggaacagacgttagtttagtcagtgcccaaagcagtgggcttcatgttttgtttcattttttaaaaaaataaaaagcacttgaataagtgacaactgaaatattactgagtttcttttcaacacaacccagcatcaggaaaactgtttcatttgcaggctgaggaaatatgaaagagcaattttattttacctgcattgcccaaatttatggacttagaatactttataggtatctataaagctcaagattcttgagattgtatataaaaggtgcaaactcagccaaagtaaatatctacaaaatgctccttatgatggagcttgacctggcagccccagttagctcctacctactggccttaaaatttgtgaatgtactgatccctaacagataaaaatgttgaatggcaattttgtatttcatacatcctcactctaaataaaattatgtccatttctactctgtgcctttgatcacatttcattttccttctggaatgccctctcttctttcacctatccaatttcactgtggccttaaggcctagcccagtgctttctggacctgccccaggatgactcagtggcctctgcaagcctcctaactccctctgctctgagctcaggcactgcacattgcagcacctttgagagtttaactgcatttcaccagtacggctctccaggcaagccctgagaatcagtcctgactttgtaattggactctgacaacctctttcagggttagaagttgatgtctatctttctatgcctcctactgttgagcatgcattagaaactcaatgggaaataagttcttggtttattgacaccctattacacagtttaatgacattgctttaaggaattgatcatcatggttacctctggttgatcatggatgatagattcatggttgatcatagatgatagatgctcgggtagagcatctatctttttgaggcaccacccaaattcacctttccaagttcgtaatctaaagcaacagcccatggtatattgtaggtggtgtttacttaccaataataggtaacggtgatgccaactaatacatgagggatgatcaatcagaccaattgagcatatacattaaataaatggctacattaacggtaagtaaacgaatcactatatttagtaaaacaaaaaatgaaaatgagacaccagcctttctcttccagtgtcataatatttgagcactactaagtaccttctctgtaatcctatttcaacaccccacttccaagaactaaagtactccaagtactaacaagctacatcttgtctggattattctctgaaaactggttttgattaacaagctccatgcattttatggagagaaagggaagtgctgaatgaatccaaaatttactttaatcaccttcaccatcgtaagtaacatgaaatgtcatgactgggtcagggtgacaagagtaccacaagagtacttatcaccttctgtgataagagcctcaaagcttgagtttgtgggagtatgtcatcaatcttccccttaactgcatattaatgatggcttatctcagtccttctggtattattcatataaggcataaagtaataagatttatagcaaactaggatttatacatccatatgatttctgctccttcaacggatttgctttggaaaaccatatgctttctccaacaacgctgtcactattccaaatatattctgcactcttgctttgaaatggtcataactttaaagccacaatatttgaacatcctcagtaggggattaggggaatatcatcatcatttgatttctaaaaccccaaaagctgtaggaaccagttctggtgaatgatggattatcaagctcagaactttcatgaatgctttcatgaaaagcaaagcatgactaagagattataagattttcttttgggggcctataaactgactttagaaagagtcccaagggaggtgtttcagaattgctttgggcaatggctgtatcactggaggtagtctccaatctccaaagccactagtttggagataattagattcatttggatgtgggaattcagttatgttcactacatgaacagcctcattgctttatagccatgctttttagaaagagttccacaaaggtttaggtacctaatactttttctatactgccccactttgggttaaggaatctactatcttcagtgtcttatcaatttaattgccatctctagcccaaattacctctcaggtggccagaatgaatcacagtgtttcattatgttaccctcatttatggttgatcagctttgatcaaggatattaaatttaccattggaaactccacttgggtttcccttttcttgacacatggatggcaatcttaagggcctgaatttctcaaatgtgtaatctgggaccacccactaacaccatagctctagtcagagtttgtacagggttgttcaagaaatcaacttcatttactttggccaagcatgggcacatcaccaggaacttggcttggacgtagaaggaaagggaggatggaaagggaagtgccattttttgaaggctggccatgtgccaggatctctgcatgccttgtctcatgtcatcacagaaccaatctgggaagcaggaattatctcaatttcacatacataaagaaaaagaagtcttacattcacctgtccatcattggaaagatttacaatgattctgaaggacaggcagtggagttttaggtttcaggggcaagagcagttttcaaaagtctttgagtccagtgtgcgcaagtcaacaagcagtacctggtgtgcaggagcactcgtgagtgagtctgtctcgggtctcgacaattagcaattgtgtgacagtcattctgtttccttctgcctgaccctgggagacataccagtaatggatgtgcaaaagcaggtctgttttatgtcttaatataatttaagattaactgtattgaaaaaatgctgaagaatgaatgtgtcaaaatgggttaactgtgtacattgactttcatgtcatcatccatctgtcatgaatgagtgatactttgcaatgggctggtgtatgacagtgaggaccttagggcatgaaggctttttgcctggtcccagcagcatctgccccatgaagtttgttttctctcactgcctccaggccccactgatacccccaaatagatgctgggttatgagaaccagtgaagtcccccatgtcgtcagtcttaaaaataattttacaagtccacatatttgtcccattcttggagtagttttagtgtatgtctttaaattaactactaacagtataaataacttgacatcataaaaagaaaaggaaggcttaaagaggttgtgcaacttactcaaagcccacatattagtaagtagaagtttaggatttggatcatcttttcctgcctccaaagcccaagctctttgccatgaggttgatgcagccattaacaggaatgagaccatggaggggaattgagcagccacaggaaacgtaggctccaacgccattcctgctacccactaactataggcggcatcagcctgctaaatccttattcccctcattctattaaacacttgaagggcatttagtggcaatttgtgtttgaaacactgtactatgtctcacaggtacaaatatgagtaaagcagatatgtgtcttctaggggcttctaattcagtggcagagacaagaacataataatataatttctataaaataaagtagataagacagagctatgattatgataaaataagagcacaaatgcagagttcagtggtggtatttactggtctctgtttcccactcaatgacaagggccatgattggcaaaaccgtgtccattttatgctcttgttctccagtacttggagagggcctagcacatggtaggtgttcaataaatatgttaggtatgaataaatcaggtggtacctgagcaaagacttgaaagatgaaaaacagctagccacgcaatgatagttagaaagagtgtctcagggagaagaagaccgtgacagaagagcgaggtatgtatggggagctaatgccatttagttctgtcaaagcacaaagtgtgaggagggagggggaggtgctggagagataagagagggcttgtatgggctaaagactcaaagccttgtacctagcagtccacgaatagattccagggatttcatggaccccctgaaatggtaataaaaaacgtgtgagcctgtgcataaatgtgaatgtatactttcattaggaaagggatgtatcacttccataaaattctcaaatgttaagaactctgtgggcaatgaagagctattaaaaagttcatgggcaggcaaatctatcagaatatcattttagggtttagagccataagtggctccaactgcagtgtagaagatggaattcctggcagtaatactggtggtggagaaaccaataaagagatcattgcaataatccaggaaagaaagaatgagatcctaagtctgttcaatggtattagagatgaagtagacaggggcagatttgagaagtatttagatcagaggatcaggatatactgatggcacgtgtcatattggggaaggaagagagggaggaaaaggcacctgaggttgacttccaagttttcaacttgggctgataagtagtgccatcaaatgagaggagaaaatcacgcagctttgaaaaggaaaacagtgagttcagtgtgaacggttgagtttgacatatcaataggacctactggacaattgaatggtcctgaatacaaccctgaagaatggggagagatctaggctagagatgaagacttaactcatccatatctagatgagagtttaaactatgggaggaaatgagacaacccatcgagagttttagaaagaaaactggccatggacaagaatggatccatcagtcgcacaatatcataaatgtacttaatgccactgaattgtacatttaaaaataacaaaatggtgtatatatctccacaatttttaaagaggaggaaaaagatgacctcctagggcatgctgacctttaaaggtcaggtacaagaagaagcccatgaggaaagtggaaaggaacggtcagagataagagggagattgggagagtcacagatgccagaggaatagaatttcaaaaacatgcagggcagagtgggcggatgagttagatcatccctaaggtgcctaccagaaataacagaatatataaactctgggagagagagaatttagatctctaggcttgcccatctagaactgctcagcagtaataaaatggcttaaatttcatctttcaaaataaaaattgcccatgctttgccagttttgtctgggcaggaaacagctcagaccagctgcttgggatggttctaaattccactcagagccctggaatgtgatgcctccaaggcgccagtcctgtgaatcccttcctggtgctcacagagggacagcggcaggtgtgcagaggcctccagcctccctctgcccagtggctgatgtgcctctccctctgccctcagggtctctccttggagcagagtgaagtggacatagttccttgatctctgctgtttctctctcaccaggattgagtctttgtaattagaacaagcagattgctactgaagtcaccaggttagtggaacagagctgcccccgctaaaggtctctttcccttgaaggcactccaaagtgcttcataggcaccctcactctgtaccagagaaagggggagagagagtggatggcgggcctctggggagcctcacatcatcagctgcatccccaggtgccccgtggaggggagaatccagagaaagacctttgccagctctcaagaagctctaatggatcctcagcaattttcctgtcctatttctggcagagaaagctaatatctcttcattgtggcagaatcaacctactaattcattctttcatgttaaatgcttacaagatagtctaaccgtgtgaaagcatccaagtatcttcagtggcctcagtgattcagtgttgctactcagaatctgcacaacctagcaaagactgtagaactacagcaaacccaccagccaccagagaggcttctgataacctcttccttcagaaattgaccatactgttgttgtagaaatataattgttgtagttactcggacctatcctggggttagttaaaatagagatattggggtcactgtcgtgggggcaataaagcatgcctctttcctgccttgattgtgaataaactgaaaaatgaggccaaaaaatgatacatgaaaacctcagcattgcctttattactgtgagttggagattttggctgagtgtggcagcaaacaggctggaaacggaagcccagagttaaatagatttaccagtctgatggcaggcagggggcctgtccagggaagatgcacagccagaggcagagttacggggggctgattcgcttaaactttagggaccctcacttgcatgggtccctgctaggcccttctaaggccaggggagtagcccttataattttgcatttgtatttttatgttctctttcttaaagagcctccacaaaattgcatcaggccccacaacagctgcttgcatggaatagcagagaataccgcctgctccctccggacagcacactcctgaaaacggggagagaggagccaaacatgctcggtttacactttccttatttactgaatgagtggagggcagagacaggcctggagttacgcacactgagtgccccaacatggaaagaaacatcaggagggacaggaaacgttccctccttaaccaacagttttcaagaccttactggaggcactttattggctacataatcactccatgcggtgggcatcaggcagaatcctggtgcagacccaactttgaggtggaggatttcacagtttctttattttgaacttcccccaggctcccactaattcctctccattctatcctcctccctttcccacaaaagaaaacagaaaggagcagcagtgtttgataccgtatcatccagaggcctggttctctcccattatagggcaaacaagccctggcaagatatttcactcccgccccatgccatgcattaaaaatccaaaattgcctatattccacctgccaagcaagagatgctttcattattgaagttccaaatgtatacctttgagaacagtgccttctcgtcttaaaagagaggtcctcattttgtgagttgggagcagagggaattaaagaaagccatgatgcagggatttggccattcaagccgggcagccttcagagaatgtcatccctaatgacacatgcccgaatgaaggagcggggctgagcttgtcctgccttcgtattgaatgttgcctgtctgcctccttaatagcgggcctctgtgtgagcatttgacaagacttaaaactattcattgaagaaaatggatgatcccccaacaggaagatgcaaccccatgggctgcctgcttgaccacagaagtgcttccagctccagttgctcatctgagaactccccccaccacttgctgttaaaattgttaaaattaaaggccatgttgattgattttttaaactttatttccattttttttaataaaataagaattggacttgggttgatacttaggctattgagaaaataacattggtaagactccacgtgtggctgtttgctgtttctccccctctggaatctttttcaaaggtttgtggtgaactacatgcaggggctacctggtaagggcaggtggcactgccaagggcagcaaacactgagagtctgctgggctggacaggtcagcttccgctgtcatctgcgtcataaagtcaggtccatgcaggtccccactccagattccccctgcccaatgtggactctcagaaggatcatggagaatgagtctgaacttgtgagtcagggagcacccattctcagaagctaccttgcaccctgccagctctcatctgagatgaggcctgggcaggcacaactccgcgagggggacctctggcccagatggtcccacttagttccagagtggtatctatgtggccctatggtctcacctgtcctggccaccctttcccctggtgaagagggaggacagaggccaagctcacacaccagtcccgagttaggctgtgagcagcagtcccgaccctcctggggtgcaatccgggaaggagatcttggaagcaggtggcagttagcacggagtatgccaacagacagtgaatcaggggcacaggagggcagcatggaggccagaggccaaggagtcgaggcagtctgccccagagcaaaacagtgcagagcggagccaggctctatgggggtcaggctatgccatgtgagccctgctgcattctacatgcctcccagccactggcaaagcctgttccttagcacctgagtgtcttcatcttggaacgtggtaaagatggaaaaggactgatttagcataaccgaactattttgtgaatgaagcaaatactatttactaaataatgcagatgtgcatctacttctattctaatattgatatacattcaacaggtaactagagcctttctcacattagctgttaatcccccttcacaaggtagttgattaagactccaagccaagaatctaaagggaagacagcctctgccatggtccccctccctctctgactttcctctgaagtccatgttcacccatgctatgtgcacatccacactgggccatgtaagtgaactgcttctgtcagagtggaaggagcaactgcaaacatggtctcaacttctgttgcatctgcttagtctttaaagtatagatatttcttaactaaattgttataaatctgaagttatagtgtaatggttaagtgtgcatgttgggggtcaaggttctaaaattagaccacatggattcaaatcccagttttgtaacattaacattgtgaacatataaaaataaatatgtctgtgggtggtatgtggaggtcttgagtgagttacatatcttcactgagtctcagttttccttacctgcaaaagggggtaacagttcctacaaggctgttttaccgaggctcactgaattaaatgagagaatgcatagatagcactgagcacggtggttagctgttgttaagtaagttagcattggacacagccgtaaaaatgcaggcgtttcaagagtgacctcgggaaatgacactgcccagaagaattgggcagaattgcagctgtcctccacctgggtcttctattctgaatctttccctcctccagtccatactctccagtgtcaacagcatttgctttccaagaagcaaatctgatcacgatgccccagtgtcactgggttaaagccactaagggttcccctgggctcaggatagaagccacactcctcagcctggcttgtgtgtcctcccacagtggggaccccacctcctttccacccgcactcatgctgtgctcccagcatgtggacctccactgcccctgccctaccccagggacttgtgcttgcctttttgtgcgggaatgctgacacctccttggccctgctctgcagagtgtcacctcctcggtgaagtgctagttcccagacactcggctcttcagcacttggctacttgctgagaacaatagcccgctggtctgctgggagctatggaaccaaactgcccacgtttaaattctggcttctccacgtggctgtcagcaagtttgtccatctctccttgccttggtatttttagtgagatgagaaagagaatattattgaattcacaagattgttaatgagaattaaatgagttagcgtaaggaaagcatgttagtacatagaacactgcttggcacacagtaaatgctcagtgaatgtccgctgtgctaacaacaatgttattaccatcattgtcattattcttattccaccaaaatgtaagctctttaagaataaagactgcctattttgttcactacctgacacaaaaggtacaggatatacagctgttgagtaacacgttgaccactgcatgtggttaattgtttatacgaatgcccaagccccatcagccagcagaacacaagcatcttgactagccaatcaatcctgtatttcctggttctgctcaatggggaaataatagaccctcaataaacgtttgctgaatgaataaatgaatgaacctctgaggttgcacgtacacgttatctccttctaaaacatcagctttagctctaagtttatcaaaaactcatgcccttcattcttttaaactggatatccaggggcttctggaagatctcaaaaaacagacagtgcattcgggggctttatcccagagcagtcttcagaggaggataaagttcctcaagaagtgtctgcccctgtgcatttccacccaccaggaccccctttcctgcacctctccccttcctgagccccccggctgtcctccaccacagccagagggaactgggcctcattagggggacagtttgttcctcattaggggcaccaagcttggctggagaaaagccagctatcactttatccaaagccaggaaatctcccagtatggaagccccctctctcccattctgcaccaagtccttcattctcgctacttcacggaaaaccttcctctagaaggaagtaaaaaaattcccccaaaatatatcagcccttctgctttagttcatctacctaaagtgaaaaaataaaaccagggagaggggaaattgtgtataatgtgaataaacgtagtctgtagactttattgaagtactgctgttttgtaagcctcttactgaccagaaccacttattattccaaatgcacatagatttatgatctgaaatgctcaccatgttttttaccctggagaactagagggagagcgagttccagctcagtgtttgacaagatagcttacatcattttatccccacgtcaatgcagtgaggcaagtgaggtttattatcttcctgttatgaatgtgggctgtagagactgagagattaagagggttgtccttggccagccctaagtttggagaaaacatgtaatttcattctgtcactactgagcccatcgctctctgccatcacccatgtataaatgttgcagcccagagcatcccgtcggccatggcatgtccatcgtctggcccctgtgctctcttccctcccccaactacccctgggctgcccagccctgcaccggcacttgtgaggctgcagctcccctgggggcagtctggcattcccaagctctggctagggaccagaggtgtttagttccctggctttttggtcagagacattccagggagtttcagcaagtaagagctgcctttaaacagcttccagcagcccctgctgagcactcagagtgggagtgagccacatcccagctctgctattcacctgctgtgttaccctgaacagaccacccagcctcccttccctgtaatggagaagagggagcagctttgagaatctgatagtgctgtgaacagtctcccctgaagacacttgcactaaacatcacaggtgtcatttcaggagggtcacagtgtccatccattgagcccacctgggtaccccatagatcccctgcccctggataagaatccctgggcccagtgagctctaacaccaaagtgggaagcccccagatacagatttttttaaaggaaacttcagtagtttattttctcactatgaaagaaagaaaatagattttaaaaggaaaattactataaaaccactaccagtaaaattactattaataatttagtaaatataaatttaaaaatttagtaaatatcagacagtctttatgtctctctcactcttgacatacatatacataaatccattataccaggagtgttttgtcatcttatttaaatatcatttaaatattatttgacaatatggctgggcagaatggctcacacctatagtcccagcagagtgggaggccaaggcagaagaatcacatgagcccaggagttcaagacaagcctggacaacaaagtgagactccatctctacaaaaaacaaaaaaaaataattagccaggcatggtcacatgcacctgcagtctcagctacccaggaggctgagatgggtggatgccttgagcccaggagttcaaggctgcagtgagctatgatcacaccactacactccaacccaagtgacagagtgagaccctgtcacaaaaaatatgaataaataaaattatttgacaatgtaatgtctacatagtaaccgattgcgtagtaattctgtaatgcattatttaactttccccaattgttaaccatttatgttttcattattattattattattatctgtacaaacatatctgattattttctttttttttttttttttttttttgagacggagtctcgctctgtcgcccaggctggagtgcagtggtgattattttcttagactaaaagtggaatagccagttctatgcagaaggaagcttttgatacctatcacaatttgccccctctctcctagaaagatttgctgatttgcactcccagtagctgtagggaggcagggtggaggggacttagacccgtgttcctaagcagcttccttgaaccagcaactcagaatgttgacaccaagtggggtctctgtttgctaaaagttagacatcgcagtccacagaaactgtgtctaggactggcctcgccacatttttaggtgggtaaaactggtcttcagtgccttcctccctccctcattcccatgtagccacttgatctgactgtagcccctcgcctcccaggttcagcagccgttgctctgcccccaccccctggattcacagaccctacaaggcatcccatcagcaggctctagactttccatccacagctttatgaatctgttacatgcacctgtgtgaatgggttcaggggagcaggctgaattcagagtacaatggtcctgagtcagcccaggcagagactgggacatcagacccagtgaggaggctgtcaccaggcaggggatggtgttccagggggccagatgagcagtggaagtccatgttcatgcctgctctgtctcttatgcagttggtctttcaaaatgttcctcaaagggaagaacagggcctctctgaaaagataaattcatttcccttgaaaattggctaaacagagtgtgttgcagggccatgagccccagaatgatgggcagagtttcaaccatttgcttggcaaactgtgctgctctctgagccttaaatctgcatatcagtgatgggagtttggggagggaagatcacacatggtcccatcccgctgctgaccgcctctctcttggccctgcagtctgacggttccatcctggccatcgccctgctgatcctgttcctgctcctagccctggctctcctctggtggttctggcccctctgctgcactgtggtaagtgccccaaacctcaggccatgcaaggtgaagggtgacataaagttcacagaccatgagtagagagaaagggatttttaaaaaactaaagatgggagacaaatcttgcattttttatacaatttatacaaaattgatgtgaactgacattgatcaatggaaccatgagtcaccagcagtcagtatgagttagggtgtgagattgccaatggccgtgccccttgggtggggcaactggggtggccgctttagttctggtgcttagggaagatccacaggacaacacaaatgatgagtgttattcgacatgtaatgaacatatatgcctctgtgtacggtacacacacatacacacatacacatttgttgagttgcccaacctatactcttctaaggccaccctggtcttagtaactagtctacctatctgagaaagtgtctctggcctgacctctttattttcaacaatgaagaatggcatttacctttattcattgattttggcaacttttataggacacacctactgtgtgaccagcactgggctaagcactttggctacaagatcaataaaaacctgcctcctccccatcagtgtcatatggagtcatcacatgacaatgtctccccagaatagcttagggcctggaataatccaccctgacgataatcccaaatggtaaatgtctggctgtcaatttctgttccctggcccttagactgggagaagtccaaacaaagtaatagccaaataaagaaaaaaaaacattccctgtgacatgtctatttctagcctgtgccctgcctttcaacaaatcagtgtgtgctgtgaagcccatgaatgtgaagtggccactgctccactgccatggcatcttcatttcctgtattttagttcttccatggaagggccggcaaggcacaatagacagtgagcctctccaggacagggactcatcttcattttccctctgaaacttcagcatttagcacacagtgtgagggagttcacatctgtgtgtacagctcaactgaaccaagaccacagagagacagagcactggacttgaaaagcaaggggaaatggcttcggatgacatgttaaagaggtggcaaatgagtgagatgggaagctcaaccaggatgtggaccatatggcagggacttctggaaagggttgacttgcagcagacaagtatggaaggagagacccaggacaggcacaagtcttgggttaattaggaccctgcaggctgggctggacttcaccaagattttaaacagattcttaccagagcagctccaagagttaaatgttgttttaaacatttaaggctgcaaaaccattttattttgagggtaaaaaatcctcatgagtcagcccaagtgctttctatggagattcaaaaacaagcacattttcaagtctagaaaaagaaaagaaaaaccttacagtgggttcttaaagaagagtcggcaggcctggtagcagcaggcagtgaacactattatagttcctttgattatttacagttacctctgggtgaggacagctaggaacattagaacagccaagcagtgctccaccaaatactggctgtgtgaccttgggcaagtttcttcacctctctctcagtttcctcattggtataatgaggacaataagagctcccacctcatcgttagatggtgaagactataaaggagtgtatatatatgtgcttagaaagcacctaacacatagtaactgctgtatattattattatttaaaagtattttactgtaataggaatctattatgatactggatggcattcagtttatattctttggaaatgtttctcaaaataaaccttttgttattggaagcaatgtcacccaaggccaaattgagttttgcaatattcaaaatatttttcaatgaatttatctggttaagtccctgttgctttggaaggcagccaaaatgtcttaatgtggtctgactttgtaagtcgtgaaggatttctttatgagggttgatcttcgggattcattttcctgtttatgatgtctatttaagctgcctcctctcactctttctgaaagctggcttgggctccagtgcttggtctgccccctaaaactacttgctgatcacttgcttccttgatgaggggtgatgctccagagcagggcagattaaggtcatatgtttcctaaacagtatactcaggaatgaaggcaaacatgggcctcccatcagagtttcattcagaggacacagggaagtttctctcccgagatacagcacccctcaccacagtccccagattaatagagggcattcttgtaaacaatggtcctcaaaccttcctctgtcactcttcctgcatctaccccaagggtggggaatgcccctcaacctactagcagagccgcatctccgtgctggaggaaaagccagaaagcagaaaagacctaaaaaacgtggggtacgtgtctgccgtgtgccttctccttcctgctgcaatcttttctttaggagtgatactcaaaatatttaacaacctgcaaggcccccacccccgctgagccacacattaacccacagtggctgggtatgtgaaggggtgggggatgaagtcctgcagggtggctgggtaggagagcaggcccagttactagctacaaaggccagttttagatgtactggccaggatgagcagaccaggcacaggggctgctatcaggcctgcctctgctcagcatcctcctgcttcctgctggtcctgtctggaagaagaaacctgatgggtgagggtgacagatgatgcctacccactgcacttggcctttccctaaggaccccactcccccatttgggctcttaacttccagccaaatggaacctgaattaacttgttgccagcctgccagatgtaatctaccagtaatgactgatggggagagagaaaactgaccatatcctgaatcaaacctttagtgtttcccagcttgttcctcagtatcgccaggtggacctctggcttttaagattcctatacctattcattggcacaaaacacccaccttgaaggggagagaggtattggactatgcacactgggcttattcgcattttcaaataggtaattcaaggggttaatattttcccaaataataataataataaagtcctgcctcagttccacaagggacatttccagaacccttcaagtcacgccatgcccactccagctactcataagtttggtccgatattattgaaatctcaaaattgaactttaaaaagaggaagactaggaaatctaaaacagaaaaggatcatttttttaaaaaaagttgcaatgtattagacgagtaaatgttatgaatggcttgaatgtgtaggggggaaagtcatcaatgaatcagtgacattagggcactaaaaagttgtagaaaatgcaggtatccctgagagtctcccctcaccccagccaagagccaatgccctgatgggagcctgcagcccaggtagggggtggctttatgtatacagagaaaggccatcgtatcctgcctaaatttcagcaggtagcaagacactggaggattccgattagcaatggggactggctgccccaaatgagaaatctggagtatcgaagaaatccctgttggggctctcagtttcatgactccatgttgacactctgataaacaccccaattcccgatctcccctctgtccctatacctacaccttcccggtggtgtgtgttctcccctcccgctcccaagatatcagtcacctcagaagagagcagcccagcttgctgatggggccactgcacatttatgagggcttcagcactcatactttagcaaactgctaacttacctctatggataagaactcctcccaaactgcaaccgtttctctgaagttccctgtactacctctggctgtctcatattcagcagacaacctgctgttctatctccgtgagaaaacagaagctgtgctgtcagaaatccttgcactccagcaccctcatatgtgcatcctcctccagcatccctctccctccctttccacagaagttcttcgtttcttcctttctcacccagcatcttcctcctttcctttccactggcttcctccctctgcctacaaacatacgccagccaccttcatcctttaaaaaatgtgtctatgttaatctgtcctcacactactacaaagacatatacctgagactgggtaatttataaagaaaagaggttcaattggctcacagttctgcaggctgtacaggaagcatactagcttctgcctctggggaggcctcaggaaggttccagtcatggctgatggcagagggggagcgaggcatctcacatggtgggagcaggaggaagagaagaacgaggtgggaggtgccacacacttttcaacaaccggatctcaggaaaactcactatcacaagaacagcaccaaagggatgatgctaagccattcacgagaaaccccaccgccatgatccaatcacttgatggatcaggtgatgactgatggctgcaatcagccaatcacctcccactaggcccctcctccaacattggggatcacaactcgacgtgagatttgcgtgggaacacggatccaacccatgttaatctcatgccttatttctccttcatgctactctcttctccttaccttcctttcacccacacactcctttgcggagcatccactgtccacaattcctctccttccctcttcctcccactgcaccctgagcaccattgccattatttctccaatccttcgcttgcaaaactgaatttcccagccagtggtctccattcacttctcattcttctttacctctttcagcagtaggcactgtcgacctctctctcctttaaactgtctcctccactggtgtctgctggctcttctcctacgtctctgtgcagtttctccctgtctccctcatgggctctctttcctctgcttgccaattgttctccagggttgccttccaccctcttctctaacacattgttcctggtcagtgtcaccagctcccacaacttcaactacttaatgtgtttacccatcactggccttggctccagaggaccagcccacattaaagggaccaatggacatctcaaatgcaggcatctcaccctcaacataccccccactgaactcttcacgttaccccctaaacctgctcttcatcaatggatgtgccattgttctccaggctgcccagactagggactgcagagcaaccgctgatgtcttcttctgtccctccttgtcttatctcactttggagctgcctacagcacatcctttcccacacctcatcttatctcacatctgttcacaccttctactccagcacagtcacagtgtctgtcactcagtagttgcttaagaaatatttgtggaatgaatgaatggataccattgtcttactctaggattccgcatctcccacctgaattatttcagcaatttcctaactgctcttttagtctttctcaccttcattaaagagacttttcatttttaaaaaaggcagccaggtgatgagcctactcactaccctgcctagaattctcttgagtgttcagcggccgtaaaacagagttcccgtcccttgagatggcatgagtagggcttttccatcctggccccacttctccagcctcacctcttaccttcccctcctgtgcagggtctcccttagcacctgtgcctgcttctttcatagcactgatcatgctgtgaaaattgcctgtttgcttgtctgtcttcctctgttaagctgaagctgttggaagccaaggctgtaggtccccagagcataatacagtgcctggctcaaagctgctgctcagtgtatctcaaagttcattagcagccaagtggatggaggaccaactgtgggcacactctactctttggggctcattaaacatatcaggtacttccttatcatgatctttttgctcatattatttcctcttgctgaaatagtttcaccttctttatgttctctatacaattcttccttcaaagtccagcttgttgttcagtccatttcagtagcatcctgcacaccttttcctcacctggggaggatcagctgctatctcacttggtttccatggcgtttttctcacacctgttttagagcatttgctcattctatcacaagtatttatgtatatatctctcactgtacagacagtccccaacttatggtggttcaacttagaatttttcgactttgtaatggtatgaaagctgtgtgcattcaatagaaagcatacttcaagtacccatacaaccattctgtttttcactttcagtatagtattcaataaattacatgagatagtcaatacttgattataaaataggctttgtgttatctattttgccgaagtttagactgatgtcagtgttctgtgagcacatttaaggttggctaggctaagccatgacgttcactaggttagctatattaaatgcatgttcaacttatgacatgttcagcttacaatgggtttaatctggacatagtcccatcatacatcgaggagaatctgtaccatgaactcctccatggcgaggagaaactagtcacagaaactaatcccaaaatatggtacagtgcctagtacatattataatttgtgtattttccaaatcaaactaaaaacctaagtcttcctaggggaagagtgttcgatgcagaaggagcccacagacctatggaactgtaatgagtggttgtgtcatgggggtttgtattatcctatttcatgacttacatgtatgttatatgcaatattttatatgtatctaatattatataacaaggacattcaaatcagtttcttaaataaaatcctagaaataggcccattttattgagaggttaatggtatatgagaaaccccaagtgaaaagatcttagcatattttgcaaaatgaaaaagttctgagcagggcacagtgactcgcacctataatcccaacactttggaagagccgaggcaggaggatcacttgagccctagagtctgagactagcctaggcaacatggtgagacagcatcactatttaaaaaaataaagttccggaaattagttgcataattatgtgaatatatgtaacactactaaactgtacacttaaaaataattaagataataagttttatattaagttcttttaaccacaattaaaaagaaaaaaaaaatcctgcttttaaagctgcaatttttctgcaatccaactagttaaaacaccacactatttaggtcaaatcaaatcactgtatttctgttcatataacaacaattttttttcagtattttgggagaggctcatgtccatgcattcagaattttttcctatataaacaaaattgttctccctgtcttgttttcagtggccttataggtatcttatgaacagcttttaaagaattacgtaacagatcacttttaattcatttaattgaatttcaaggatagttcaacaaataagcccactggacatctccaatgacaaattgcaaagggcaaaaattaatcaaaaacttgatataccttaagtggaaataaaaataaagcattaaaataatgttcttcgcaccgttaagaataacatttaatttgtagggccagacaacccaagcctaacatcaccaaaaggatttactgacagtttaataaaaacacaactgggacaggcaacttctgatgcaggcatcttgggcctaatactgattgtgccttcttgatcctgttccagcctccacccattcccatatggacacgcctcaggctacagctgacaagattatttctcgttagcacacagagctctgccatgacctgccctcacctctggagggcaggtacaccacacacctcacacacccatttttttctcatctctggcttccctcatcctttgtgggctgcctgataacccccaacccccatgcttatgcctgccggtgaaatggaaagaggcgagttgttgtcaaagtcgactgggtttcaatgccgcatcttcctcttctggttaaaggattagtccaatcctttaaccttaatttcccccgtgtgaaaaactagaaaattggaaccatattgtctctaaggctgcttcctcatattcgtaccttctttgagtgaatctgcttctccctttcaagattccctggtctgtggttttcaaacctggttgcatactgaaaccatctgaggagtttttatatgatacaagtactcaggggcagcatttccaaactatgtcagggcaatcataccctgcaagtatgaataggggcacttcagaacaagaggtatttagacagtgagttttaaagacatccttaaactaagttgaatcactgcctttactgcaggacttctcagagtcattaataggataatttgcatgtgactcttcaaatttattttgaccctagaactcttccttggcctgtcactacctgtactctcccaaacacttattaacatactgacatctggaaggacaccagtattctgccaaatactatttgggaaacacagtcctagagaacgctgaagcagctaaaagagcaggttcctggatcctaagatgcagcctcttttgtgccctccctggaggctgtatcaatatcaacaagcttgaacatcttgtgaacatcatcaactcacccttgttccttctgtgccctgctcagatcccactgacactactagtgtctaaaaatcggctttcccgtaacccaggcagaggccagaggctgctccttcaagcctcagggaatctgaaatcatggatttattttgctgtttcacttcacagacttttgcagtgacactggcataccatctgatggagaccatgcacagccattctctcacattaccatgtgagtcccttaggccctgtggactaatggtaaagctcctgctgcaactctcactttagacagtgatgaattgggccttttaaatagtctcagtcttaagggagatgagatgagagaccaaaaatcatttgaaatctgagttccaaattggagggaaaaaaagttgacctcatttctttgaaaatttctggtaccacattccaaattaacacccttggtaccatcctttgctaaacttttacagtgtaaaattactggattcaggcagtccttggccagcattaacccaccccaatcagtcatgaggtctctattcaattgatgctgtctatacagtggaaagattcctttatcctccatcaactagcatctcatctctcctggatgttttccatatcaagttgcctactttcccttgatttcttgacttcaattaaaagaatacttacaaggtttgggagccagaatggaaggctagaatgtaaaaagggtcagagcaagcatctccttctagctgtgacattaaagcccttattagatggcttttcagatctggattggcatttcttctatacataactctgttctggtggcttctcatgcagaatttaaaaggccaggggggcagcagttgagccggctttaagagatcaacccagaagtcccccaggacatacagtgctttaaatcaaaggcttcaaaaaagacctttgtcatctaaatacaggcacatttatttgagctaacctctgagcgtgcaggaagtcatcatttgtggaaaaaaaaaaatccattactattgactgacaatgcagcagactccacagcaaaagaaaaacaaaaattcctggaaaaaatagaatagaagttgccttaaatgcatagccaggctcatgagaaaataggagatgtttccagggcccaaataaagcaggatctggaaatcagatggtcatctgaccctaaagcagtggcttcctgcctgagattttcttatctcagtaacctagatgtttggcttaatagcctttcatgggcccataaaagtttgggagttgaaattgagtcttctgcctaaagctgcctaaagccttgagtgaaagatgggctatgggtttgatgtgggtgtgtatgtttgtgtccctaagaattcataacctctgagaggtctagagttcaaacttacactacttgaggttttgtaaattggaagctgagaaaaagtttggaaatgcttagggatctgcaagaggaaacctgaaacctctggcaggttcgtccctcaacccaggcctcatagaatttccataggtaaatgcctactacacatgagctcacaatcccaaattaccaaaaacccaaggaatattatttattacttgggcccttgggattttatgatacacatggaaagcacaaaagaccagagaaaggatgaggaagtcagtccctgtcagcactattccctttgctctgtccaaagttaacaataattgttaaatagcagatacactgaaaattctctgtgtatcaccatttctcctgtaacatgaaatgtgttcctgaagatatgactgcattatggaattttggcccatgaaaataataggactaatgggggaaatgggttcagagcagaacattcaaaactgtgcgatcttacaaaataatatattaggttggcgcaaaagtaattgcggtttttgccattgaaaggaatgacaaaactgcaattacttttgtgccaacctaacgctaaaaaataataaactcaataaaaatgccaccgttttaaacaccttaaattcttaataaaacatacttcagtaaatatggctctttaccttgattttttttaaataaacaggtgaagtttcttagttgacgtgagtctgatgcagcaccgtggctttgagctacagaaacaagacggaaggaaggacattcttagggcaaagtgtcacaacacaaggggagatggctatgactcagcgtcttgttattccttctgcactggcttaaaatagaatttcagcttttgttgtgttgccaggttcctcttttcatgtaaaaaaaaaagcaatttgcgtggttccaaataagactgaaaaccatgaaagtactattctgctgctctcggcattacctccttttcttcactccatcacacatgcctctaatcccctctaaggcaactggtggctcctgtgagttccattctcctttctttggtttttcagcatggtctctgaggaagctcatttgggtttctttatgcccattgctctcacagtatctcatcttctcttatatctttacaaacatctcctgcacaggctgaaggctttcctccctcattcaacccctgcatttttcgaaccaggacacacgctcctattgacagtgctatgtaaaaggtttttaatgaggaaaagaacacgcattcaggagcgccatacatgctggacttgcacaaggacacacctaagtgagaaagcaaatgaggtatgcctggtttctgcatattcctccccaggtcactactggtggctgggcagcattttcacattcacctgatgttactcagtggcgccgaatactgtcacctcacacttttaaatgtgtaatggttaatgttatatgaagttgactatgaagaacaaaagacgaaaaatgtacattaccttctcctttaccttgcaaaaatcatattttgagctggcacagttttgcagtttagtgattttaatgccctgtttaactaccacatatgaacagtcacaagttacatatctgtgttggaacaaaacagactgtgcgtgtagttttcaaattttcagaaagtcttcttagaaatgaatttcggatacaaaactggaaaatggagtctataatcacagggcaagtgaatttacatggaagcctgggttaggggatgaaagggggtataggtggtatctaataagatggcacaattaaccgtaaggccaacccgtgactctgattagattcccatgacgcaatgcatccaagcatcacagcccactcttggcagttgggactttcagcatcttaactactgaagaaacatttatatggagggttaagagaccagaattgaatcttgtaacatgtattaagtgcttatttgagaggcaaggaagtttattataatcagaaatgcttcctttatccctcccttttcaggaacacacactcatttattccagaaatagtggccgagtaacaaacactaagctgtgtgtcaggagataagtatgcccatgtcttcaagagcttacagtccagtgcggaagacagaggaataaacacagttcagtgagtttgttgctaacagtgcagacagagagagataagatccatgtccctaattcccagggagccatctggctgggattgtttcagggctggatctagaaatccaggccgtgccagccttgtatgcagatgaccacaaattcacatcagtggaagccaaggagtacctgcatgcagagctgaaaatttactccagaaatagttctatgtcttccccaacacaggacgggaggcagtggagagcccagagttcctgacaatggagcggggacaccaaaatttttagaatgaaacagcttcaaagctggtctttctaatcagctataagcaagtctcaacagaacactcatgggaatgtctgacttgaagctaaacatagcccctgcatatctgacagaggtatggggctccaggaaataagctaattcacagttctcaaagtgtggtccctagaccagcaggtactttgtcagaaatgcaagtgcccctccccaaacccactaatgaggaactcaggggtgtaccccagaaagctgtgttttaagaagccctccaggtgattctgatactcaataaagtttgaaaccactgagctaattaaaattagaggacaaatgcttcatttcgttaataaaggagttatctgaagcagctctcttggactttgtctaaacagcagagatgcctgtgtgtcaaggaagtgtctcctttgcagcaagagaccagcccttcggcagagaggacttgcaggaagtgccctgcattcagctcatgcaaaaaggacacggagacacaaaaatacaacttaagaagaaaggggccaaaaacgagtcccctgttttgttccatttctcatgccatgagatgagcatttgtcaacaatgagcctgtctatacagcttatcctattaaccagtcccagtcacagagtgaggagacaagaaagatgaggaggggagatgtgaagttgtggtggaggatttctcaacaaggtgacagaggcaaaacaggggaccacaaggaatcactaggcctggcattcttttgctgctaaagcagcatgtgggcctgactcgcggcttcaaacggaacgtctagtgagcctgtgcagccgtcatctggtaggtgggaaaggtgcccatgttgagaactagaatgacagcatcctttcttccactgcacaagactgtaacagtagagttagcaagtgacaaacacaacggcaaggatcaaagcctacacattaagaatcaaacttcaatactgctagagaaaaaagaaaagcaaaataaactcatcaggtgctttatctcactttaacaatttctaaaatcaatttataaagccatttataaaaaaataaaatgaattattagagagcgctttacagagacccaaatggttgaacttaattcataaaaccaaaatagttcaacttcccaggcatgaaacaggccctgagaacacgcaatctttctactctattcgtactatgctgactgcatctccacatcttccatcattactatttccaacagccaaactcaggagtgcacataaaaactggaatttgtttgactcaatgagaatttgtcagtaacatttcaatttgatcagattctacctggtcttttctgactttcctttatctatgcaatgatcgtcatcaaatctgaccctacctcatgtcagcctgaacagagacggataaagtcagaattaaagtcactggtaagagaggagaggagatgcatctcccaacacacagcagtttcaagaaattctcaggtatcagagaaataccaatagaattcaggagttccatattccatctcatttttcccgtcccctttacctcaccagcccatctcttagtgcaaaagggactctagggcagctatcccaaggaggcaaatggtcactttctgcttctctaaaatacccagtctaaaggtggtagtaagtggggaagtggtactagcctgcagagtagaaatgtgaaaaatgttctcagatttactcccatactaccatccagttcttccatgttatgcttatgtttattattttccattaaaatattttattaacgacccttcaaccctatccatcttctttgtccctcctaatgaggaaggcgccaaagagcccacccataaccaggaggatgctcacataacctgagaaaaaggagagtgggccaaaccaagcctgagcttggaagctgattctagcttgcattctagttggaaacagaggatttctagtcatgctggttggaaacaaataattatgcaatttgcctttcaattacaattcaaagtgctacagaaaacaaacatgatgggagcccacaaagagaaccttgtcctttctgtgagattcccaggggaggtgcatttactggagatctgtttgataagtaggtgttcactggggaatgtgcagggctgtggactgagcgtggaggaggtagcgagcatttgggcagaagatactgcacttgagaagcagcagagcatgtggaaggaacaagaaggtgcccaggagactggagtgcagaaagtgaaggagagagacacagtgggagggaagtaaggccacatcatgtggaacctgtgggacatgggggcagtttgcattatatcctataagccatgggaagccattagcaggggtgcactggttttaagtactgaagcaaccacggagatatctatttttaaggctactctgtgtgtggccgtgttgccatggtgccgcaggctacagagcaatgcaggcttttgcccaagctgctcctccaggcaacacagactctggccctgaggggagtggggtgggctgagaaagctgacatgtctctgtgctcagagcactcctttgggtggcccatgtgctggtcttggcacaaggatttggcccactcacggacagcctatccaactttactgcttggaattctcatccctgactccaagcttagcctgtctagatcatacttttaaaagctgtcctgccatcctgtggtgagctgcaccctgctccccaggggcaagctttcggtgcatgggcttgaagcaatgagaagacttcctgcccattcctgctgaacataaccagaagccgaaccagtgagaccaggttggaggtgcttaattcctgtttacctgaacagagtggcattttttccagaagctcaggtgcccaacttacagtgcgtcaatgtgaaatctggatcataaaccagcccctctttatcaatatttaataaatcatggattttagcattgtgttttgggttccttagggtctggcacattgcaggatgtagaatagatattcaattaatacttaatacattaaattaaatagcaaccgcattgatgggttggtctgagtgttgggccacctagaactgcattccccagccagtgtcatatgctgacacacatgtggccaggcatactgctactgactcccccaaaacccttggccactgtcagaacaccagcctcctgtctcactcagttcatgaaatgctggccccttggcatctctgtctggaagccaccatgcaaaggcatttagtatatgcagggggggtatgaaagatgtaatcaaggtaagagacaaatacaacaagaaagggaaaggagagtattaatagcatgcagcatctattgagcacctactcactaccagatgcttaacacacatgatcgctcatgatgactcagtttctgcaaggttcatgttattacttcatttaacaaatgaggacagtggagatcagacaggttaagggactcatcaaatcctgacagtcaggagaaggcaggtctggaattcacatataacatctatgctgtgcttagctcatagcaccgtggagacaaaagccctctgctcagcaccaaacctcttcacacccaggggccttgccacatatgctgccctctcaacatctgtctcttcccaaacatcctgttccccctctcactcccttccctacccctgccccaggagaacagatgcattccagatcttggtccccagatcctcacccctccctccagtttccagacatttcctgctgtaaagtaatttactgcttctgggatgatgggaaatcagtcctggacaggagcgatcctccccagagatttccttaaggaactctgagccagggttgagtgggtgagcacaatcatggctttgcattttccagagactttcaccaggcgtctcacagcagccaggaagtggaggcagatgaaatgagagtttgaaacccctggaggccttcacttctgcctcttcaattaatggaataccatactttcagaggactggagtcttgggccattggctaaggttaacagaacctgcagtgggaagcctgcctcctcatgcagagatgacgttatcaataatggtagggtgggtaacagcgtggggattggagccctaacaaggtcccagaataatcatcaaaccagaggagacatgtgctgagtagggagagctgaagaggtgcttgctgccagctaagcagcctggcctgcagccagagcccggctccccgactggaggaagaaaaaatgggtcctgtgggctgtgcccgagcacccaactacaaaggcagcacctgatgttaaggcatcaagagatagggaatgagctttggatttgccagaagtcctctaagtaaaagaactgagtaggggacccaaaattctgataataagtttggggtgagaggaggaagccctccaaggcacagagtggaattatagtagataattgccaaatgccatgtaagagactctaaatccatttaacggtgagggctttccttttatgacagaggggtacaagttggggtcaagagggaggagggactgctcactggccccagctgtccctgctctgtccttatcccatgtgtcatcattctctcatgggttagactgtctcccaattacttgcccatccagagtttccacatgtctctcttcagccccaaagatgggacagtcagaatcttataacactgttagttaaagctttgtgcccctaagtgtcagtgccctgaaagaaatccctggacactcctttgctgcctctgttgggactcggtctgcctgggcagcacatccaccctgcaaagacacccgtggggaccagtgacagctgaaggactgccagcagcccgcgtggggtccacgcttgacacatccctaaagcaccatgttaacttccattgtgtgacaattctttgttaaatgtgtagacgattggatagatggatgaataaataatctgatatgtgaatgactcggtgaataaatgagtgaataaatttgcatgatagttatctggggtaggaaatgaaactgtgacctgtggaacatttatttctctatacaaaaccagaagagacgcaaatgagactggaaccctcagcctgagtcatatgctaactagcagagctactctgtccagcaaagacacctctcatggcagtgattaagcccgacttgctggggccattgccatggtaattatggcagcaccaccacggtacctcctgacagcaagcctcttaggaggcaggtagccagagatttttcactgacctgttctctgttttcttttcagattatcaaggaggtccctccaccccctgccgaggagagtgaggtaagtgaccacagcaggatggcagtgggtgggcagggtggcagagtagggtggagagctggctgggcagctggacacttagccccctgcagagcagagctaagtcaagctcaaaggatttaatgtacctgcctgtgaagcagaagggaggaaactgtctggcctttcctaaccagggatgaacaagaaactgaactaaactgccagaaaagacaatgagttttggaggtttttctccctgcagagataaaatgtgagatggaaataaatgtttttatcagtacagttatttggagctttgagatactgacttttcctctcaaacaaaccctaagattctcttctcctgcagagacttaatgctttatgtgtgtagatcaggcacagtttgctacattctccaatcattggttctaggaataacctgatgcccaattcttcatttttctttcatttaaaaacaatattacctaaagatgggccaggcagtaatgaaaatacgctggagagggatatgttaatatcctggccttcctctcaaattctcgtcatctaaagaaaaaaattcttggactctaccactgaatcggccagtaaactgttctgatgcaagggtggcctggagtagaatacagtggaggcattaaaggctaatcatgagaaaggcaagagtgcctagcaagtggctttgctaatctgatcactcttagtacagctggagtctctagaagtaacatccacccattcagaagccagggttacatatctaaacactcaatgagaccaaaagatagattgataaggtttcaagttcttgtcctcaatccctaacgtctgttgtgtgcaaatcaagtgccagttcctcacccttccccttccaatgcatttgtcaagtttcctacatacagaaagagtaatgattaaattaaaaattccatgtggctcttatatcctgaaccatacgcatgtaagccaagggatttaatagctgcaatcaattaaagtgcatcttgttggaatgctaactttctgcccagaaatcaagggaggaaattacattgctgtgcaaagaagaagaaaaaaccttctttacatacattaaaacctttccttaatccttcaagagaaagtaccgtggctagttccacgactgcaattggctttgcttctgttatgtgcagctatctcttagacttccaaaacataaaaaataaaatagagcaaggagctcccttattaggactttgtttgcctggaggcaaataacattccctcccttgttgtgttcagttagaagggttgtggctttttcttttggctcttgctctgtatttgcctttagaaggtgacgtggcagccatagtggccaaagtgcacctggggatgtaggttaagactgggctctgacttaccccagatccaacatctagcctagggttgcacacacagtacaagctcagcagggacttttaggatgaaggacccagcaacacaattttggagccaagtaaaaaagcccaaactagaaaaccatctaggaaggatagctaaaagcaaggaagagaagtagttgagttttttctgtttcataaaagttgtagttacacccaaagaaagctgacttcatttcccaaacagaatgacaacctcagaatgcttgaatctaaagggttatgttaggcttaaaggagtttttgggctgaagcttcctcacctgtcccctgtcactctatcaaagggataactcacgtgaacacctgcagttgattatacttggtcagacgtgagctggacagatgactagtacatttcattggctgatgaaaaacaaaacattcccttcctggagtctagatcccctcccctccatttccctttgaaaccctctgacttaatcaattaaatatgacgtcagaaataaatcaagaaactacccaaactggagacctaggcaataaaaatttaaacattgtactttttagcatcaggcgctttttggcatgtgctgattgccttagcgtgtgtgttggccctgtgagttaggccacctaatctccttcctaatgtattttggcaggaaaataaaataaaataacaagaagaagaaagaaagaaatcccacagaaacagataacctaacacagcccgtgcaacgtattttatacaatgctctgaaaatcatagtctcaatctagacagtcttttcctctagttccctgtattcaaatcccagtgtctaacattcaataaatagctatatgaaatcaaacactctctgccgtatatatgaagaccttcagtattatttatcccaactttcatcagctctatcaacatcatattctgagagaggcatgtctactatttaaataactaaacttagagaatgaagataactttataataagctctcagtgacctttttaatagaaaatataaaaattcagaatggaaaaaggaactatatgctgagattctatgtaaccaacggtgacacacttgtatgaagagggtacaaagagaaattacttgaaacttgaagagctcaatagaagcaaggaagctcagttttaacaactaagagggacatttcctgggttaagaatcttctcaagtggcaccagtggggatccctccctaactctccagttactccaaataactggcagttcgtgggagaatgcagtaatggagcacttcatgtgacggttttgttctgcatgtaatcaccttccatggattttatgaccatatttgagtttttatcagcctcattcgcctgcaaaaaacagagaccagttcaagctagtccaagatgaaagaactcaggtagactgtggctggggaaagaactgaggcagctctagacaccaccctcatgggctttcgatttcactgctagcagctctgcttctctctgggaatttattcccttctgccttctcttactggccgcctctctgcccttgtaactctggtttgtacagagccctctctcctgactccatctgatatttctagtcttcatttcaccatctgcccccagtgcttatagctgagtctctcagtttccatctttcagttcccaataggggaaaatacttggtccagctcatcttttcactccagaccatagatcatcagtcacagctcacagccaaccaacagactggtgctcttgggtcacatctggccaaagagaagcttcctagtaagccccgtggccatggtgagaatagctcccctcagaaggaggaatggacctggtgcaggccctgtggcctctctgaaatagtattgtttcagaaactaaacttcggtctcattaaatactatcaaaataaaagctacacccaggaatccataccatattcttccaacatctgccacttttacaggctctcaaagatcctatcgttcccaatatcaagcatatttgaaaggcaatagatagcaggaagccccatgactgaatggaaagtgggttatggcttagccccaagcagctccatgtctcagacacacacagacctacatatgaagtaaatgtactggaaagagaagatgcttcctttcccatgtcctgtctcactctatcaaaggcatagctctggaaacacctgccattttcttccttaatcacactgccttggccagacctgggctggacagatgactagtacattttatttgcaatgaaaaacaaaacattcctttcctggagcctagagcgcctccccttgttcatttccctttgaaaccctctggcttaatcaactaaatattatgtcagaaataaatcaagaaactacccaaactggagacataggcaataatagttaaaacattgtactttttagcatcaagcaaatcaaggtcttagaatctgacttgagggacattagagaagtcaaatagggtagaggtaaaaggtatgtaagtagccccaatgttttttgatatttaaaaatcttatttattcaacaactctagaatgagtgctcctgtgcgctgatagcaagtgtgagattctctgccagagttgccttaagagagtgtgtaactgggccaggtacagtggctcatgcctgtaattccagcactttgggaggccgaggcgggcagagtacttgagaccagcctggccaacatggcaaaacactgtctctactaaaaatacaaaaaattacccgggcatggtggcacattcctgtaatcctagctgatcaggaggctaaggcagaagaattgcttaaacctgggaggtggaagttgcagtgagccaagatcacaccactgcattccagactgggcgacagagcaagactctatctcaaaaaaaaaaagagagagagagagagtgtaactggacatttataaagttggtgacctaatcagtcctaatcaggaagaaaggcagagattcctggtggatattgcatgtgaatgtatgaaaattaataataatagtggttaattactgaagatgacatttattgagcatttataactatccaggcaattatgtgaagcactttttgtggtacatttcattttatcattcagcagccctgaaacaaaagtgtgctattatgaacccctaccttatagatgcaaaactgaggtataatgagattaaaataccagtggccccaatatttcagttattaagtgatgggactgggattcaaacttgtacctgaaaaagaagcatagagcagtctttcctcactggtccctgaagacaatgtagctcctgcaaccaagagcaagtcttcctgatgctcattgttgggagcatcaggtgctcctttcttgagtggcagtgtcacctgtctctgacccgtgtcactcacacagggcacacagccccttttaagactgacgtaaagatggttacttattttctgtgctctgtccatggccctagtgtgtagctattctcattagctctcttatccctatgtttcccgcctgtcttctctttcatgctcccatgtcaccatgtctcatcatgaagctttagaatatatctgggagcttggtatggtgactcactcctgtaaccccagcaccttgggaggctgaagcaggattgcttggggccaggagttcgagaccagcctgggtaacatagggagaccgccccccgcccccgccgccgatatctacaaaaataaaaattagcttggcatggtggctgtcacacatgtggtcccagctactggggaggctgaggctggagggtcacttaagcccagaagctggaaactgcagtgaaccatgttcatgccactgcactctagcctgggcaacagagcaagaccccaactcttccaaaaaaagaagaatgtgtcttcttgttttaatcatgggttagtatatatgcactggggggcgggtgagagtgggaaaggatgtgaatatgtggacatctataggttggtattttgtatctgaagggagaggggtgcctattgaaagcattgatgcccatccagtgaacaataggcacctggctttgaaggatgagcttattttcagatttattattatgctcactgatcctaaaaatttctctgtggcaagaaatgtttagataggaaaactgagctatggaaaattatacagggccagataagttgaactcctaatagcaacaggtctggcatccttccagccatgtctacacagacacccagagtagcctccaccctggagggatgaagggccaagctactgtcaggcatcttcttgccagtgaccattaaatacacatacacagacacccccccacacacacatacacacacacacacatacactccaaacagaagtcctagagaaggcccaaaattccgtattctatgttttaatactttaaaaaaaaaaaaaaagaacattgctgctaggaaaataaacaccttattctttactgaagaatacaggacaatccttgtgttgtctttaatcactttgtttacgtaaacagatataatggtgccatgacatgtgaaatgcggctcagaatggtgaaatcttaaatcctctggagtgttgtatttacaaacagaagtattgctggatctttctgacttgccaattcactcctaggagtttacctccaagactgacattgaggggatctccctgacttctccccaaagaccaaatgagacagtcctgccagttctactttaagttctgcccttcgaagcctcccagacctgggagtttctgtagccttagtcctttaattcatgtcgtcattctcacgaaactcactcctctataaatgtaaacaatattgtcgacagctgagttctctttattttctcaaaatataacactgtgctggcaggtgatggggactcaatgatagttgcttgagttagtgaaataattgacaaataaaaatctcttgttgagcttatgcatttaagatgtgctccagttcaatgacatttaaaattaatttaaaagctgatttaaagctactgccttgggtttgattctctttcagttatgtgctccttttcattgatagttcctattgaaacctgcagtgaactgggagttgtaagccttcttgagtcaaaccggccatgtggctcttctagtaaatggataccagagaagcaggaaagttaaagaacttatcaattgagtctgagagggccaccctttgcacaactccaggggacgctattcacatcaagtctgtggagttgtcccatgcacagtatacatgcaggagtgaggcagtcccagaatctggaaaattcatcctttctaccctctggtttgcttaataactaacagttaaacgtgttgagtgagtggaaggtggagttgtggaaactcatgaggcgagagcattgcattctctggggaacccgggagttcttggcagaataggttacgcttaaacaacattaagggatgggtagaagcaatgggagaagggctttccaggcatgtggagccctgcatgttgaagcgtggagctgcacaaaagcctggcatgattgggaaagatgggaaaagttcagggtctgaggacagcacagggctaatccaattacaggctaaccaagtgagttcacagacttcatcctctacagctgtttcttcctcgaacagcactgtgcctgcaggcacacccaggtctgcctgaggacacgcaggtcagaaggggcctctaccatctgaggaatgtgctgccatttgtgttacccaagctccagccagctggacgtctggagccaccacatcctttcagatttaaacacaacttcccttgatgggaaaccggcctccctccccaatccctgcggtttctcccaggcaccactgactcctactcctcgcttcttccgcgttatctcatcttctcggtttgctagacacgatctagcagctctggcacaaatccaactgcgcagcaaattttactgaaggtttaaaagtatagtgcagcccacaacccctgacggaatattaaagggactcttatttaccaccggccacccccaccactcggggggattgggggtcgtagctgttcactggtagctctgccccactctgttctgctcatcttctcattccccacaagcccctgatttctcattcacagcaattgggctcatccagccccatcctccaataaccatagaggacagcaaggtttttgttttgttttgtttactaaaggaaagccagctcacactgaggatttctatactggtgttttctccctccctgctaccatccttgaagggcagtgtaggaggaagatctcaagagcctttatgatttaatgagatgtaaaaatccaccctccagtgctgccgagtttcttagtggccttgctgaggggctgggattctactccgtccatttttggccaaatggaaagacacatcaaagattcccttctcttcctggggattgcaaaacccttctgtctccagaatgtgtaaacagacccatgctaactgcaggggaaactctgactctcccgtccgtcagcccctgggcctttgtgctgcctggtgctgttgtctgagcttggcaggccagctccggtcaggggattaagcgacgggctcggtggcgcggcagcgtgtggagattgcccaagccctaggcatttcctgttgcgagaaggccaggccctgcccttgagcacgagggcggcgcctccttccccaggccagggacaagagggaggagccagggactagagggaggggccagcggcaagagggaggggccaggggcaagagggaggggccagggactagagggagaactgcccccgtgtgcaagtggaacctggaaagcggggaaaccggcttcatgcatcttactatatcctgagcactcagcggggttgcgaattagagaaagccagttgtaaatccttctttaagttcttttcgtaaaatatagggggagaaaaacccctggacaaggcatcagaaaaccacaccagaacttcacctttaggggtcacttcatttctctagatctgactcctcttctgtgcagtgaaaagacttaattagatgagctcctaaaaaattaagaggctcatgaacctagttgagtcccctgtggaataaagcggctttattcttggagtttcttaacgttcgtggtgctgctgtgttcagctttaggggatagaatttctgttatctcctttggaaaactgccccagactgggaatgcccaggctttcagagccatattttgtatatctgtgttcacagccacttacacagaaacatacatccacctccaatgtaaagtttaaccacatataggacatataagattcctgctttcacatcataaggtgaaagaaacctcggaaattctaaggtaaagtaatatgaactataatattttattgtgttggggactttattttgttatattttgcagttataaattatcaaaattaagtccatgtgcggtggctcacacctgtaatcccagcacattgggaggctgaggtgagaggatcacttgagcccaggagtttgtgaccggcctgggcaatatggcaaaaccccatctttacaaaaaatagaaaaattagctgggtgcattgatatgtgtctgtagtcccagctactcaggcaggctgaggtgagagaattgcttgagctgtggtagttgaggctgcactccagcctgggtgacagagtgagaccctgtctccaaaaaaaaaaaaaaattatcaaaattagcaggtacaaggagaagtcaaaaatgagcgtgtatttgttgccatcaaatgattggaaaagcaaaccacaaaagaacaaaatccagactggccaatgctgagaaacaatcaaaggagaatgaggttgcatgagttcaaatccagctctgtcacatacaagctgggtgacctaagtcatttaacgtctctattctcgttctctaaaataggaataataacaccatgtaccttcctgggtggttgcaagattaaaggattaataatacatttaaagtgctcaaaagagtgactggcacataacatgggaaaggctgcataaattcaatggtgtgttatcatgaatgcaatatgtgtttatcgagcacctactttgcacttagaatacaagggtcagcagaatctgagagcgagcaaccaagtaagagagagagagacacccaagtgtcagctgtcagaatgttgtacgtcctagtctgctgtgacctctctgtcctttaagatgtattaaattttttgaaaatcattttaaagaagactgcccatcccaagcacaacatgtaactcagggagtcttaatgtgccaacatgtttctgctttgctttgtcaccttttgtcctgacctctcctgcctttgcttttttgcaccttgcctcctgcatggggtgccccatcccacgcagtggtgccctgcataggacttcacccaaatgccaccaaaacaaggctgtgagaagcaggcttcagcattgtgagcaatttctccctcttttgttcattcctctgctttatcaaccccttttccagcttcctttctctacccaggagagaaatcatgccacttccttataatccatccatgactataaatggtgatatttttctccccacaacaagaataattacagtgccaagatgaagagcagttgctacatctcctccctttttccatccacagttacaagttcctcatcttctttcttcatcttaaaaaatataaacactaacttcttgtcactgagctaagttgcagacacttaattaactgctttatttgagtcatcttatttaacttatttgtaaattcaacagataattcttgggcacccaccacatacaacatagtgctattctaaagactgggaatacaattgtaagcatgacaaacaaaagcctctgtggaacgtacgttctagtgtggagagacagatattaagtaaatatcaagccatgatgagatccttaactaaaaataaaacagattgatggaatgaagagaccgcggctactttagaagaaatttccaggggaggtttctctgaggagtaatatgaaaatccatccatcagaagatggggtgggggaagtgctttcctagacaaggggacaaggggacactgtgcacaggccccaagacaggaatttgcccagagtatttgagagagggcaggcaggctggagctcaggaggaggggggcacatgataaggaagaaggccagaaaggtgagcaaaggccagaacacacagggcagagctggcgtttgcacttactctgctgctttgtggagaacagatcataggtgagtcttagggcagcaggaggccagttgggaagctaccacagtgtccatgagcaagtgcatgggggcttgggcccaggatagtggtggtggggatggagaagtcaacagattttagatctttaagtagtagcaacagaactagctggcaagttgggacaagttggggagaggcagtaaagaagagagaggcagtggggaagactacaggaggagcatgtttagggtagggaaatcaggacatctctgctgtggtgttgttgagatgttttttagcccccaaataatgtgaatgtcaagtgagcagttggagttcagaagcatcagggctgaagatgtaaagtcacaagtcattagcatgtaggtggggttagatgcgattcccacaaaggagtagagctgtagaagagaacaagagaacaggactgtaccacaaacttaccaggtagcactgcttacattcccactctacagataaggaaaacaagcttaggtggtttcagtgattggcccaaggttctaggaaacagtagcactgggattgcacccaggcagtctgactctataagctctactcctaatcacttggctgtagtaggcaggtccacacagcagtgctgttttgcttccttcatgtgccacaatttctctgcaggaagaagatgatgatggtctgcctaagaaaaagtggccaacggtagacgcctcttattatggtgggagaggcgttggaggcattaaaagaatggaggtaagaggacagcttcatatacacttatctatgtgctgactactcccatcgaggtaccagccgggcctgaccctgcttagcctctagatatcaggcatgcccagggcagtatggccgtagaccacactgatgactcaatgtcagaaacccaaagcaaattgctgaaaacctccttgaggtctggtggggatatggattgtaaggcagacggatggagagataggagggacagcctttcactgtgcgtttccatgtcttgcccaccgtgagtcagagcaggtcacacatcagctcaaacgtcctcgtgatttcttttctcactggaataaaatccaaagttcgtacctgaacctgcaaggtctttgcatgtgctgtccccgctgcctggacaattcctccctaaatatccacccatgtggctcagctctctgctcctttggtcctccccttttctctttttccacagtttccctcttccctggccctcaaaacccaaaggaatccagggttgggtagcattcacattgcaactcatgcatgtatttgtcattctcattctcgaggggcagcatattttgtcatttcatttcattgtattttgtttattttaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaaggtgtgtctctttactcaaaaaatctatcatcagtcctgataaaacacttacatagtgaagaatcaaaatctttccacatgataaaatcccaacctaaaacccagcttatcacaggggaacaattatctaaaattatggacttgaaagtactagtaattactttgtcaatttccacataatctgggttgaaaactaggctttttaaaaatcaccgtggtgctcacttctgcagcacatatagtaaaactggaacaatatagagaagattagcatgacccctgggcaaggatgacatgcaaattcgtgaagtgttccatattaaaaaaaaaaaaaaaatcaccatggcaaggtactggaaaaagcatggactgtgagtcaagtaacttgggtagtaaccccagagagtgactataaatttccatagcatctcataacttcacttagcagacaatctactatctaagaaaaatggcagccttctccttaatgctaatctctactccttttgccataatataagcccattcccttttatttgcgcctcctgccagtgtatcagggcccaccagcaaatctcactggtcatggatctaggactcactctttctggttgtaagcaaatcttttttctccaccatctgtctttcccccacacctccagatcttaaaatcctctttggtttattgggaagtgtaaaccgttggaggcagttaatgtttcctaaaggcctcttttttattttctatttatttattttttgagacaggttctcactctgtcacccaggctggagtgcagttgtgtgatctctgctcactgcaacctcgacctcccaggctcaagccatcctcccacctcaacccccaagtagctgggactacgggcacgcaccaccacacccagctaatttttgtttttttttttttttttttttttttgagggacggatttcactatgttgcccaggcctgtcttgcactcctgataaagcagtctgcccacctcggcctcccaaagtgctaagattacaggcatgggccaccatgcccagcctgaaggcctcttttctattcttcttggtccaaatggctttgaattcacatgattcagttaacaccttcaatctttagccatgcccataaacatctgcactatgccacttgtcagagagcactggaaaattatagctgaaaagactctagacataatctgtccccactctctgatttcatactgagataggcaaagtccttgttctgctgaggtctggaaaacaaggcccccaactcagggctacagactccagtttcaagctgcaaacagaaccgaaccaactccaaagcctcaagtcaaagactcaatagagccagctcccatcaccatccatacacatacacacactcacacacacacacacacacagccttaccccccttccaatagcaacaaagattattttcatcattcgctgagttaatttgctaattttggatcagggcttctccaacaaatcaaaagaagtaccatttcaggcagtgtagcgaaacgttattggtggttacctttcctcagctgagctagctcaagctcacctgaattgccacgcatttctattttggtttgccatgtttgaagcagtgagattctttttttaggataagcctgccctctggggtaatggattgaactctggaaagatgtgggcaaaatgcagcttgcttgaataacagctgtttgcttctaattattttctaatgaagaacatgcagtggcgtgcatgcatgtgcagacaggaaggagccaagcagattctcagccatgaagaagaaaggggattttctgttatgccgttctcaggaatctgtaccttgtgactaacgccacatctttggttacagccaggtttttgtttctgtaatcttggacactgagagaacattaattctgtttgaaaactccggtttctacttgagagcatagtcctctattgactggcggtttaggactgaatttgatgagataaataagtatatgggccaatacgtttagaaatctaaaaacattcccaacacccacttggaattagtatcaattcagtgagtattcattgtgcagctactgtgtgccaggcactgtaggatgttgaatatacagaggctttcaaacccggctgagtgtcagaatcacctgagagtgatttaaaaaatacagattcccaggcccagtgacccagaatctcacaaaagtcctccaaaagcacactggctctcagcattcgcccatcttttcctatcaagtgaaactccttttgttcacaatgcctcccttctctaatttcacttccagactccctgagtgataggcctctgttgccccaattatcacttcatcagtcctgactcttgagcttctttttagtctctgtagtaaagcactggctctcaaaggtggtccctggaacagcagcatcagcatcacccaagaacttgttagaaatggacattcttcggccccacctaagatctactaaatcaaaaacgctggaagtggggcccagccatctgggttttaacaagctgagttaagaagttgtcaccagctgggcgcagtggctcatgcctgtaatcccagcattttgggaggccgaggagggtggatcacaaggtcaggagtttgagaccagccccggccaacatggtgaaaccctgtctctactaaaaatacaaaaattagctgggcgtggttgtgggtgcctgtaatcccagctactcaggaggctgaggcaggagaatcatttgaacccaggaggcagaggttgcagtgagctgagactgtgccattgcactccagcctgggcaacagggcaagactctatctcaaataaaaaaagaaaaaaaaaaaaaaaagaagaagagttgtcaccaaaggtcccagccagcattccataggaagtccttggagggcaggaactgtggtgcctggattgttaaaataggcaaagaggccatgattgcactgcggtgatttttcaggcatctcagcaaggagagccacattaatgttcacactgggtccatttttaccacaaacacaactgctgaattaatgttaagtggttgggaatctgagtgtcttaggagtcaactaaaaggccagatggaaatgacctaggatgccggtggacttgaagagctcctcggcaggactccctcgttaggacgtgcagagcatgaatcctccttttgcctggtggaacagccaatgccaatgcttactcagctccttctactgtagaggaaatgcatacatagccgttggtgtgattactcatgtttatgagccttctctccactagatttgaccccccgcaggcaccagctatgctttgaatccccagtaaacagtgttgtacctggctcatcccttattaaagagctgaggcatgaacggtaattatgaaaccactccccagagcatcctgccagtcaaaccacacagaccattttggcatactctatccagaaaactgacattcttcatgccatctctctgaggagagaagagaaaaagagattgttttagatgcaacaagaaggatagaagcacaggaagaaattcaaaagtaatcatgtgtgctctccgtccagaagtaaggcaggcttgcttccagaatctcagggttcatcctattttacatgatgttcgatccacaatgagtcccgtgctagccacaatgcctaaggacatttgctcagccttggacaaaacatttagccttatgtggtaccataaactctgcttccctttcccgaactcaccgtggtcctaataggaaacagaaagcacactgaaaagagttgaactaacagagatgtgggcaaagcgaagggaatccccagggatgatggggcaaccaggggctggcaacagcgagagctgttacacctgaagagcatgtggggaaatggtgttactgggttccagaaagagctgtagccctgcaaagagactactcgacaggaactgtttctttagttgacaatctaaatccacctgtttttatatgatctgcaaacaaagaatggtttttacatttttaaaaggttatataagtacctatataatgttgcctcttgccctgcaaatccttggctctttacagaccaagaccaaagggcagctaggtgatccagaggcaggcttccaaggcatggagaaggcaggcagagaatggatgggggccggcaggtcagggagagtgacccatccactcgctgcctgccttgtacctctgctataagcaaggagaacaacagctctacctcacacaaaactgtcagcaggtattggaaagactcatggctccccagtgaaaggagccagaatcgtgtacttactgaattgcattgcattagacccattgctttacatgaaatggggtttttgagaagcaggtgagcacatttgccaagcaaacccagagagaacacacggagggaagaagtccacagtgggctcttctccacccaccatctccccgtctaatttaaggcaccaaccacaccaaccacacttccccccttcctcattccagactcatgatcgggaaattttccctgatatttagcctgcattttcctttgcttggttttcacccccggatttacaataccccgtgcttctcattaaattggagctgaccatttcagacaagtgaagtcatgcccagctatatgggcaaattttcttaaaaaccaaaagaagaaaaaaaaaagcgcaacaaaatctatcctatgcatggcatgcacacactcatgagtgcatgtgtgtctgtgtgtagggaaagtttctgacgttatccgttaaatccattaatttatttcctttgggggaaagctgggtcacactatttatcatgtatttctttttttttttttttttttttgagacagagtctcactctgtcaccaggctggagtgcagtggcgcaatctcagctcactacaacctccacctcccaggttcaagtgattctcctgcctcagcctcccgagtagctgggactacaggcgggtgccaccacatccagctaatttttgtattttttttggtacagactgggtttcatcatgttggccaggatgatctcaatctcttgacctcttgatctgaccgcctcggccgcccatagtgctaggattacaggcataagccaccgcacctggcctaccatgtatttcaaagtgtaaaaagtcaggtgtcagtttatagtggccttataagttgaactactctcagaattctcaatctctgactgtcttccagctggctaaggcagacaaaccagaagaaaagatacaactgctgcctggcaaaaaaaaaaaaaaaaaaaaaaaaaaagaggaaaccccaccacaaaagctgatgacccagggtgctttgggttttttgtttgtttgatttaaaaatagggtcttgttctgtcgcccaggctgtagtgcagtggtgcgatcatatagctcactgtagcatcaacctaggttcaagggattctcctacctcagtctcccaagtagctgggactacagatataagccatcacacccagctaatttttttaattttttgtaaacatggggatctcactgtgttgtccaagctgctctcaagtgatcctcccacctcagcctctcagagtgttgggattataggcatgtgccaccgtgcccggctccctacctccagaatgctatgaatgctggctgcataatcattcccagcacagtcttattgcttagaaagaaaccaaagctagagtttacatagaacttccactttgcctttgtgaattggcaggtattttctgtggctaagatacagtttgggagcatggaattggtaaatttctcattttatagtcaaaatttgtcaacttcaaatgaaagaaagctatttataaatgtcagctaatacaatctgccagagggcttgaggcttgtggataaatctttgtcctagcttcacagaagcagttgggcattttgccagggagtgaggaccagtgtcttaagtgcatgctgtggagaggtttgtgcatgacagacatccaagtctgagatagataaagcggaggcaactcagaaggatcctctaagactttaggtgaagcccagagactgtttagaagactcttctatggcacatctagccccaaagggttgttattaacgagcccactactactgtctttaaatgacagacttctgcctacattcagaaaaatcaaggttccaagagcctttgtcatgcagtgctcattgaattttgagagttattttttattctgattttggttgtaaacactgttttttctaaagcttacttcttggttgcaaacactgtttttctaaagctcttgcataaaaactacctgttgtaggagtagaaagaggttataggttgtattgattgcctggattgttttctatgccacagactggagagtttaggttcatttgtgggacaatcagaactcagaatgctaaggatacacctggaactagctaatctcgccttggccagaagagcccaatgacagcagctcacccggatcaagcatgccctgcaagtcgggcagcgctttctatgcactaatgcctttattattgataacagcccttgaaagtagaaagtacttatccatcggtaaatagacacccagatcagtagaaactacaaatgcaaaaccagagcacagaggggttaggtaacttacccaaattcacactggccagtaagatgtttcatggttcattttattgactgcagtgcatccatttgggctcacagtaaaattctttattaatcaataggagagaggacaggaaccctggagatgaaaggccaatcaggaaactattcccagaatgagtgacagatgatgagggcctgggcccaggcaggagctgtggaggtggtgggtcaggggtggatgggaagaggcggcagcagagctgctacagagagaacattaacgagacacggttgatgttggacatgagcaggtggcagagagaagggaggttagaatgattcctggtacccagtgtgcccatctggagagattggtggtgccatgaatcaaggcagggtgtgcaaaaggaggagcaggtttggggagaagagttagttcagtttataatgtttgactttttgatagctgtgatgtgatatgatacatccacattacaattaagatttaataggtaaatagatacccagatctggagctcaagagaggactgggctgagtatagaatttttgagttgccggcagataggtggaagttggacccatgagactagatgagagcactcagctgagagatgagaatagaggtgccaaatgaaggccaccatgtcaggtgtaggcagagggggaggagcagaagaagctgaaaaggacttggcagagaggtcggagggagcaggtagaagctcgtggcacagagactgagggagagtgtgcaggggagaggcccagcacagcggatctccccaaagaaccaagcaaaatgagtgtcaaggcatttggcagtcgggatgccgtgggtggccttagcaagagcaatttgggtggagtgattggggcagaaggaataaaaactgtggcttgggggtaagaggaaaatagtcttggagaagcacagaatagaagatggacagatgcatgcttacaaagttcaaattgctggattcctacactctgtattacattcttttccatctctctacagagcctcccaaatgatcattttaatgactttactatgatcataggtaacatttaatgaataccttttatgaggcaagtacctaacttcaatatttaattttaagtcttatagcaagtctgtagagtagacagtattatcatctccactttaaatatgagaaaagtaaggcttagggagatgaaactactcatctaacccatagagctggtgaaaaggagacccacagtacaaactggggcaggctggcttcagtcactttgtgcttaaacactacactgtagggtgatctgttgccacaaagaaacatcattttctactcattctcctggtattatacatctaggtggtttctggtcttttgctatgcatgtaactttaaatttctgctgagttaattaatgtgttccttcaacagcccagtgttcttctttctgccccatctcattgcccatttgtcacagagttgggtgattagcacacacagctctgtgggtgggctgatttacaaacccaaatgctgggagtcctctccttctgaaaacgaaggggaaagaaaaaagaggcattcatccaggaaacccacctggttacatcctgaaatataaatgcttatccaaaagaaccttaaaggaaaacatttagctggtgattggaacggcttaatacagaaaaccatgcagcacacagcagcagttctatccagcattctaaaatcatttcaaaatatttttcaaggcgtttgtaaattccttgccaaaatagatgagaaacactacacttggcaagacaaagtttaacccacaagacaaagttaaacccacaagaactcaaacaacagtttataaagattaaagaacacaattttatatgtgtatataatccaccagaaaatcatttcagaacatgaaatatttgagatgcttcttaacactgcccctatataaatgctttgtgtccaggaacttaaactctttagactcctccagccttcccagcactgtcattcaaagacccctgcaagatcaggattttcaaacgttcctaaggcttgggtaggaaatacattttacattttggcccagtttgtgcacacacagtcatacacacacccatacacacttaactgagataaatttttcacaaaataatgcttatcctcaccatgtgcaattactattttctcttctattctatttcttaaaagttctggtcccatacaaaattgatttcataagggcttaaagggttgcaacccacagctgagaaaccctatgttctaaaggatctaaattaaagcgctttcaccagaagatctgcatgaggaagaatctgcaattggtgtaatagaaagcatatgtgatttggaattagacagacatggattccaatctcaactctggtttataaaccatctgcctttgggcaagttacttgatctctctttgaccctccatttcctctccacagccctctgggactgctgggacaattcaattagagaacactcatggaagcacctaccacttagttacattcattcctccaacaaatatatattgagcaccagatgttgtcctaagggataggcagacagaagtgaacaaaaccatcaatacccctgctttcatggagctggcattccagggggcacagacaatcagcaaattaacatagaatatatcagggagtgagaaggactgtattaatttcctcttgtcgctgtaatgaattaccagaaacttaaaggtttaatcaacacgaatctattatcttacagttccagatgtcataagccccaaacgggtctcactagactaaaatcaaggtgttggcagagctgttttccttttggagactctagaggagaatttatttccttgtcttttatagatgctagaggctgcccacacccactggtttatggccgccctccatttccaaagtcggcaacattgggttgagtccgtctcacacctaatcactgtgactctgcttctatccgcacatctccttctctggatttgaccctcctgccaaaagccaccatgggtcttctaggaaggacccatgcagttagactgagcccaccggatagtccaggatactctccccatctcaacattcttaccttaatcacatttgcaaagtcctttctgccatgtaaggtaacatattcacaggttcccgggaatacaaataaaagtcacctgtaggggcgttcttggtcatcagttgtgaaagcctttgtgctgacatagtcactcttctccgtttcagccaattacatacaacctcaaaggggttgtggtttttggtcatctgtaatgcttggtaatttgtctctcaagcccaggcttcagagcaagttatagctgctgagcaagcctagaagacagccagggatgtgcattccaggggcctttaattggtcttgccctgtcaacacttaacgtttagtaattttccagaatttatcattagtgtctttactaatgagctctgggcaccaagtgggaagaaaaaactttagtgaaatttggaaagattgacttgtggtctgaggatatgcccagaaatgtgataaagacaaaagcccaaagcttgaatcaagttatgtttgcaaacttggggggcactcaaacctcagggtgcgtccttcacaagcatcagagtctcctgtgtgtctcttcttctcctccattcatgaagctccagttttgaattaagggactgcagagtcactaatcccatcatgaccatattgacagtgttgtgttgttcacatgactgaagaagcacggaaagttctgtgagcctacggcggctagccacaggtctggtttcatatgtaatcttggtgcatttgttttatttcagggaaaactcgatgccttgtgggtcctactgaggaaaggatatgatcgtgtgtctgtgatgcgtccacagccaggagacacggtaggactcgttaattcattaatggtgtctctctctctctctctcacatacacacacacacacacacacacacacatattctttttctctctccatctttgtagagctaaaataactttggattctaaaacagagctagaataactccagatttacaaatccagctattatttcatgttgcaacaaatcagacattgattttcaaaatgttggttattacaagatcttgagttttgatttgcttttctgaaaaggattttgacagtaatatgttgggtttaacttcctagaatttgagcttctcaatgtataggcacagtgagagaataaagcaggactggcccctacttggggcagtttcaggagggagctctgctggccactggccacacaagccagtggtgcatcacagagtaccagcactgcaaggatggggtgagggcaaggaaggggccacagaaaacacctaccatcttcccagcaggtgtggggcccagctagcccaggaccagagggatctttcaccccaggtgaggatttgtcttggcattgtcaaggctaagcttggaatatctctagtcaagagcagtcctgaaagatagagccaggggagaccttagaaaccatccagcccatggcttcattttgtaaatgaagaaagaaaaacaaacaaaaacaaaaatcacctaattgcattctccaaaaaacaagagaagttgaatagcttgttctgtttcaaatagtaacaagtaacttacactggaaacaacctcagttctgccgaaacaacactatcactatttcttcatgtaagagctagtctctcttcctcaagttttacagatcaaaactcaggaccaagttttccctcaactaccagcaacctgcatcttccatccatttctttgggaatcaggcacattaatccaaaaacaaaataaaagtatctcatttagaactcctttcaaatcaagcagacttgggtttgaaccgcctttccttcctggctggaaagctccaggcaaatcacctgacctctctgaacttcatccttataaagtagatggcacggacttcttcctactgtggctggttggagaagtaatgtttgtaaagcatttggcccactgttgaacacacggaaatgctcaatcaggatgggcaccgtggctcatacctgtaatcccagcactttgggaggcaaaggcaggtagatcacttgaggtcaggagttcaagaccagcctggccaatatggttaaaccccatctctactaaaaatacaaaaattagctaggtatggtggcacatgcctgtaatcccagctactcaggagactgaagcaggagaattgcttgaacccaggaggtggaggttgcagtgagccgagatcgcaccactgctccagcctgggcgacagaatgagactctgtctcaaaaaataaaaattttttgttaagaaagaaatgctcgggccgggcgtggtgtctcacactggtaatcccagcactttgggaggccaaggcgggtggatcacaagggcaagagatcgagaccatcctggccaacatagtgaaatcctgtctctactaaaaatacaaaaattagctgggtgtggtggtgggcacctgtaatcccagctacttgggaggttgaggcaggagaatcacttgaacccaggaggcggaggttgcagtgagtggaaattgcaccactgcactccagcctggcaacagagcaagactctgtctcaaaaaaaaagaaaaaagaaaaagaaaaaaaaaaatgctcaatcaatgacagatatccttatggtcatttactctgtgctgttctgctgtctggggatggttgatacagaacttcaagccatattgcagttggtgtgtatggtctcctgactgtccagcatgacacagctaacactagagaacactagagcagagcccaatagacaggccctgctaccccctccccttgcacctggtgacagtgggtggtttgtagctgagaagatttggtctaaagtttcatagtttatgtgagccactgcccaattagctgttcttgctgtgactaggatggcaggcaagtaaaaacgtgaaaccagctcatataaatgctgggttgacttggccctcatcacatatggaatttgagcttttgtctgtgacagtcaacaagaccaaatttctatatgaaattttaaatacaaactctacagttaggagaaacaagcataggccatagttagtactctgggaggtgtttggtcttataaagtatacatttgctttctatgggaaatgaagaaatttttttagcatgcatgagactcctctgacagattgagaaaaaaataataataagatccctaaactaaggttcagtagtactatttttttgtgacaagatgctgatacagtgtatgaccccatttttttttcacagcaattgaaaaacatctccactaaaatatgttaacattccattttccactgaccagtttggcagaaaccaattcataaactgggtcaacctaagaagtgggagggttataggaaagaggctggatagaaagaaatattatcattaataagacagaagaatcaatgctgtttgggagcaaaatgctggttatataaatccaagaacaatggaatgaaaataaatggaacttcctctaatgaatcacacttaaattgaatctcttatttaccaattctgaatgaaagtttgtattaacagctgaagatgttccatctgtttttgagagacataataccaccttgaacttttattctccagccatgcaaaataatagatttgagatataagaagcttaagaatttggatacatttgaacacactctcaacactgttacaaattatgattatccagtttacttttaagtgccctttctttatggaagtcttgctaaaataagatacatgagagaaatcgatacagaaaattgtgtccttgttgccgtggcaacagccacacgatgtacacatggagttacacaagaaaggtcacagatgaggtaagaaccagaattcatagctgcctatggctactcaggaaagaattccaggcgaggcagggggggcaatattgtagctctgtctatatgcttcttctgttttgttttgcataaccttaggagactcactagagaggcctgccttgcttgcatggtggtgagtctgtaagaattcttcagcactgatttatggagctgaccacattttccataaactcaaaatgactccatccaggcatgtgctcatgaacaagagtcacaggttctgaattttttctttaaaacaaaacaaaaacaaaaatcacctaattgcattctcggttacattctaagttgcttcagacacatgttgacctcacagaaacctggcaaattttcctccttagttcctgtctccttcatcctccccccagctactccaccccagccctccagatgcagacacaagcccaccaacagagcctctgaggctgctgaaaggcctccagctcagcacagagcaggggctcagggagccagagcctagagccaccgcccttccctgggattggcacccacctcctcagaaccatccaagccccaggtcaggggtggcagcagggaacacgagtgttttccatctgccatcacccgtctccctctttttgcctgcggtgggctcatggtcccattgttccttggagcccaccaggaaatgcttgggccaacttaaaagggaaagtgccaaaggaaaccacctaaatagcaaaccagtagcacatctgattctaagattgttaaaatttactaagcacatggtgtcccctgctcccagtaggtagccaccacagtgctccttgtaaaaccaaacctcaacacaccatgcctccacttcagacttgcaaaaactgtgggaaaacccagaatccttagcttgatttagaaaggcaagcctttccatttcatacgctacttaccccagattccttcatcacctccaaatgggctctgagcacgtggaattaattgctggtcatgccctgaacatgccaggacattttgtgtctctgtacctttgctaggtttctctgcttggaatgcctttcccatcctctctaccgagtgaacctagcttggtaatattgttcattgttcccacagtttcctgtaaatacaaaaagttgctggccagactcatgcttgaaagggggcattgcccaagcagaacacatttgacagagcctaggtgagaaggtttggaagttagaacctctgtcccaggatggtccaggatggtccccaaggcttcctgcacagcttggccactctttgagttcagaaaatttgctcatctttcaagggcaaatggttgaaggaatttagaatgttctgagaaagaacgcttcaaggggtcatgagagctttttaacttacttggtccatgatgatatggcgtgtcattccactttgcaagctgtttcttatcacgtcaccattgtcaaggaataatctttccatgtcactacatatccttgaataatatcattttaatgaccatgtcatattacattgcatatcttccctttttggagattgattttcaagtatctattattataaatgaagctgcagtcagtatccttattgccaaatcattgtgcacattcacaaatgtttccttagaataaaaggtccagctttctactggatcaaatagtgtgcaaatttttaaagctttgatacaaatggccaaataattgcccttcaaaagattatacaaattaaccctcacattagccccctatgaaacgcccatctccccagatgctcctcaatattattaacgtacctatttgattgataggtgctaatttgtattttttattattactgaggtagaacgatttttttaatgtttattttctcgtttgtcaattggtttgacttggctcatttttccactggatattttagtgttggtttcctgtgatcattttcttaacccatcttcattcatatattaatcaaatgttttgaaagcctactatgtatcagatcctgtgcttgcattaagtatgtggtacttaatccttatgacatttaaagtctaaccatgtaatatatgtccaaagttttttctagtttgccatttaccttttaactttttagaaatatattcaagttttctacaattttacagtcaaatctataaatatttatgattcctgccttttgtttcaaatttagagaagcctcccctacttcaagagaacatacattttcacaaaaattttcttccacacttccaccccctcggtctgtttttgatggtaatgcgaattgtcaccttttctgcatcttcctgagtattttagtgtagatttgggaaaggctcctttggaagctatgggccatatgttatattaaatgagaagtcctagaaaattatcttgaatgccttgaagtggatgtattaatagaaagtgacttggatttactctgggccatcccattgaacagagctagccccataggtagaaacaatggggaaacaaatttcatcagaaagaattgaaggatgcaagtttcaacaacacaacgggctgccccagagactaatgctccaggtaactaatgttaccaaacacggataagacaaattaaccactaggccaggacacaggggattcctgtagcagatcaatggttctcaaacttgagcatcagaatcacctagaaggtttgttaaagcacagcttgctgaacccatgctcggagtttctgattcagaagttctggggtggagcctgggaattagcatttctaacaaactcccatgtgatgctgatgctgctggtctggggattacactttgaaaaccagtaagataaggaaccaaacaaacttcagagtacctctcaccctgagagtctggggtcctaggcaatatttctatactgctttggccaccaagccgccccttttctatatttctccatagagcacctattgacacaactggagaataactagtctaccttaaatctaaatattaagcctcagtgagttgtgaagaaatctcccatcttcacatattctgttcctagattactaatttcaaacacagaaacataagggaattcagagatcagagcgtggactccagtggttttcaatgtgtttgcacattgttatcacctagagagctttcaaggtccccccctaaaggttctgtttaattgttctgtgatgaggtctgggcacttataggatcacctgggaatcacaaagcctccccaggtgattctaatgggcatctaaggttgagaagcagtgaggtggtccaattccctctttttcactcagggcagcatcttctctttcctttttgaaacaatttaaaggcaactccccatgttccttcagaaaccccaagagtaagataggctgatcacactcttcatgggcttttaacagtccctttcctatcaggaagatggttaatctagactgaggctgccatgtcattgctactgcttgagtaaagaagatggaaaagagaaaatagaactcagcctcatatgtcttttctggatggaattcaatcatctaccaaccagcctgagccctccccagtcacttttactccaaatcgaactccatcccacttcacgtgctcccagagaacccactgggtttggatgtcatctgttttcagatctggcatcaggaggccggtacattccattactatctgcaagaacaaaatactaaagctcactcagggcttgttttgcaagcctggatctccttgcaaccagaagagacccagggaaacacacacgtaaatgtacataaacaatgtttgaaactcatctgaagcctcagaggttgtgaaatcctccccagctgtttccaataagggcgtgaggccagtcacatgggcaccatgtctccctactgtcgcagaggcgagaatagcctgggcaggttatcctccaggagagaggttatcctctgcccagtccttctaaagcagataagcctcctgtagcaggcctcagagaaagtgtctgcactcttgcattctctctcctctcttctctctccttcacatttcctgcattccctctttcttctaacccctttcctttttttcttttccctgttcactgccaatttctaaggcctgccatggctgctttccctcaacaaaaaccaattgcactcccactaagaatccatttctgggctgagcactagggatatccattagcagaggactaaactctggcttccaggagttcatgtatgtatgtatgtatgtatggtgtgcaagagaagagagtgtcatgcactgtatgaactgcaaatgtttacagaagcataaacccattcacagtaacttggggtaatgatgatctccattttaaagaacagaaattgaggctcagggaaaattactaacttttccaaggacacacagctggtaaggaggtctggggcttgaatttaggactttcagacttgaaagtcaacactagggattcctgaactccttcatgcattcaacccatagttgttagatgtcttctaagagccaatgagcactgtattagtgcttgatattcaagattaatgaatgagccctgtccctgccctcgaggaacagggacaaacaggaagctcccaaacactgcctggtgtgaaaggctctgtgatggagctgagcacatgaggtgtgggagctatacccaggaaaggcatctcaccagccttggagtccaaatgccttcttgaatggacatttaagctaagacaagaagggggaatggagttggggaggtagaatattctagtgacagggaagcttgcatacagatctgcaggtgagactgtggctccttcagggagacacaaggagcagggtacagaggaggacagagtgggaggcactgagaggagggactgtggtgaagaggaacctgagttgccggccgtgggagcctgctctgccagcctgacgaggctgtactccaccctgaggacagtagagacttactgcaagagttttaagcagaggcgcaatcggatgtgcattttagaaaggtcgcactggctgcagtgtggacatagcggcagtgagagaggctggcaccctgaagtgcagagtggtgggcaaggaagacagcttggattcacaagatattgagcaaataatcacagatttggtaactgcctgggtgtagaggatgagagggtagaaagtgtgaaggaggacctccaggatttggcccaagcgacattgctgactgtgctgcctgccattcaccaggatgaggacagctttgcgagggaagatgaggacgtcactttttaacttgtggagttcacagtgcctgtgggacatccaaacaaaaaggacctgcagcaggtcaggaccagggggaagcatgaaggcatctagggcaggaactctctgggttgctcactgtcagggttgtgtgaaagtagggacctgcgagtacatgcctccttaaattttgtgccctagacacctcgcatgcctcaccctagtcagggggcagttttgctccagtgagagttttgggctgcaggcaaagatctgagagtcattggccatggcagttgagaccaatgtgactagaggggaaaccagggagaggggtagagagaagaagttaagcactgaaccctgagggtcacatcctttaagtcagggtggagaaaagaaatagagcaagaagacgactaagaaggaccagccaagagaaagagaagttgtaagaggaaagtctggggtcatggaagccaagggaaaataatacattatggaggagggtggagtgtcaagtgatgggaaattaagatgcaaactgagagcaatcatctaataagattagcagtaaggaggttatggtgcccttagtgacccgagctctgtgggatgatggggttgggagcaaagcttaacaaacaatgggagggagagccaaggcagtagctggaggagatctagaattggaaagagttctttgtcttagtaagacttgagcgtgattaagtgcgtgtggcagagatccagtagaggaaggggttgaagacaagaactcactgttagactgcaggaactcttaggagaaggggttggagggcttaggaggaagtgccagtcctccttagtgacatgggttgtagatcccaggtatgagtgagagggcaggaagtgaggacatccctgtgggaagtgatgggctctgttctccctgtgatgtggctggaggagtggaggagctggaactggagctcctggaaacagccacaccttgggaaccccattgctcctatgctggcagcacttctccacattccagagtgaatgtctcaggattaaataaaatggtaggtataaataatttgaaaagatgggagcttattttcttcccttccttctccctgaaaactgccattgatttcagagaattttaattacctcttaacctgtaggaaaaactttttctcagaattattttatgttcaaaccagcaatgaccaaaagaaccaagttatctacatattgaagtcttacatgaaagtcgtttttcttgcacaataaacaattaagtttacattagctctttatgttgtgtaaatggacatcttcagaattcctatctgacaccaggtataaggtcccaacagatctggagggaaagtctcctgaccttttataaatttttgtaagaaacggatcattttaagaaaaaggaagaaaaaagagcaaattataggaaatgttcctagagggtgtgatttattctggcacagccatcttccctggatgtttgaattctctgtagtattcattcagttctcacccttggaagcctctcctttgctgtctcattggagggggacatgagtacttagaatttttggctgagttagctgaatttaaggaataaaaagttcaaaacactctctgtccacagcaaaaaccaactgtacccaaaacctgcaaagttaacttttttcagagatgttaaacccaaagttgatgctgcaaaatataccatcttgggattttttttgcaccaacttctttctcccatggtaggaactgtctctgagtaaatacgtatgaaagcaattgctatggttgagcaatcttcctctccctctctctttccccctccctctccctctcttccaatcctcacaatctgatccccctttttccacaagcattacacactcacattcacacacattcctcctcctccttattatcaccatcatcatcatcatcatcatcattttgtagcttctttcaatttcaacttgtaggactttcaacttcagattgtctcatctcccaaacagctgcaacaacagaaggtcgagtcctggaatcaggttgcaaatagcaaacagagaagtaaatgctaaggctgaaccagacagggatgggaataaagcaaccctgttcaaattctccgacctcattttttcccttccaaacaaaatcaggattgagggaggtagggattagctctagggtcagaattttacccaagtgtgtaatattttaggaggtttgctactttgtctaagcatgatgatcatgtctagccacttggcttctgcgggcctgctcctccagctgatggcaccaaaaaagatcatctcgagggacattcagcatctccgtgatgggcctcaattaagaatcatcagaatccatgctggtgggaagttctgttctggccagaaagtattgggttagattatagatggcaaaatctgacctaggaaataggcttttgaacagtgtggggaagagccagcctgctataaaacatccacacacacccatcttcgttcagcatctccatgaccaccccaactcaacctgaccctcagtctcggagttggactggcagttcctcataatcccagacccttcattttagaggcaccaaagctgaggtctggaaaggtggtctggagagattcccgagccctcccaggtccattatcttatctgttccccatcaccttcttactttatcctctttttaatataggaaagatgaggctcagataagatctctgctcttttcaaggtcacaaagagtgttggtggaaatggcaagactggaaacccaccagctcgacactgcctggctctccttgagtcctcaccccaggccatgagaggaggataagcatccagactcagccttatctcttgaggagaaggcagagttagtccttgccgcccaatcccttcccttcctgtcctcctacctcttcccacctcccagtacctttccatttttatatcctgcccaagatgacatacccattgatatcctcccacatggggctgctctcctgcacaggatgctgtgctcccagatcacctcatgctctccctgattccacctctcgctgcctcccactttaccaccaacactgtgtctaggacagaaattccattcatccagttaatacatcctgagctcccactctccagcaggcaccaagctaggcagtggggatttagcatgaacaaggcgagatccctgcccttgtggagtgtacactggagtggtcagaaaagatcactaaattacagctccacatggtagatagtatgagggggagtttggagttctctgggagcatagagccagaagatttaacccaggctagggcatcagggcatacttccaaagagaagagaccatttggctgagatccgaaggacaaactctcccagtgcagggagagaagggccgccttctagttggaggaacagcatgtgtaaaaggccagaagggagaagaactgagagaggacacacaggcctgcaaccagggagggtagggagtgcagcagcccccacctgcaagctccaccttctccagtctttgtccacccaaatccttcaggcactcagtactcagccaaagcccaagaccttctcccagtcaaggctcattgtctggcccttccttcctcctccgcttacagccacaaagtttagcaccaagttaattttaaccaatactgacttttcactccctgaataagttgtaagcaatttgagggaatgaaccatggcttttttttttttttttaactttccctcacagcactgaggacctagctcaatttgtttccttgtcccagggagtatggtttttttctgcaacctccaggccacagctgtttgcaaacttcataggaaactgcatttgagtcacaggcaaggggacatctgaatgaatcctccgtctcttaataaggagagagaattcacaaggtcttctagggacatgtccagataaaatgaggctgattaaaactttaaaacactaaacttttattataattgctattcatactttgtcattgccatttattaataacttttctttaagtttgtttgaaaatagaaaattcatttttaaaaaactctccaaggctttaccagtctcactttacaaattcgttcctataacatttgtttaatattagtgtttttccattttttttctttttggctgataccattgagagcagtgtcacgttgagaatccacagtgatgacagagctagttgtgagggtgctcattccattcctctagcattcagcacctctgtccatttctgtgtttgcccccagcgtctgaatttggttgcttcactgaatggtgtggccccaccagctgacacccaggcattgactggcctcaattactgcaacacctatgtttcaaggactctgtggccctgacttaagtacaagctttaaatgggaataaatcttttataagcctttccatttactttcctgcttattaaaggtgaattgtaatggaaaaccctaaatgtcacagagtctggaaaattgaaataataaggggcagcattctccttagtggtataactagtaaaagtgggcctaatggaaagtccaccgtggaatcatctgtgtttctatgcaacaaaattattttccttctttctctaacaagggaagtagttctgaccaacaaggttggctgtcttaggcatggtggtggagagcaatggaaagatgagtgtgtagtgggagcaagcttagcagagttcctgaagccattgctttagtgtcccaccacatctgtaggcctaggggatgccatgcagtcctccagagatagccaaggaagctgcagagctgaggccaccctctgtgcttgtaaacaataagcacaccccccaaaatcaggaataagcccatgagaactgcccatatcccatggtcccacagcacctcatcagctgcactagtgtgttctgcagtagatccactgctggtgggcctcaagttgcaaatatatttagtaatggatcaaaatagaatctcttagcaaaaactggaccttacaagcaatttgcatcaagtcagaaacccatacatctgtgtcccacagcaggccacccttaagcaacatgaaggcttccaaaaaggttaccctgcccatatgaaaatgccaattttatccagcaacattgctgtgttttcaaatttctgtagacgccaatgctgtaatgaatgttctgaccctcagggtgtcatccacagccaggctttgtgcctgtcttttgcaaaacttacccaatttctgtccaaaaaaaaagtccaagactaggtcgatagtagatttatgtgtcaaaggagaacacatagactttggataactttactccaaaagaattctcttgctctctcaagcctattctgttaataacatgtttagttctattcctaagtttgatttttttatggcaacagtttgactattgaaattctttagctttgtaaaaccatggcacaaactgttcccccatgaaaaaacgcagctttccataaggcttccccagaaataccaacattagaatgggggatgtgatttgactttttgtgagtaatcttcctagcactgcccgaagagagagaaaaagagagagatgcagtttcacgtacagttttacatgtagtaaagcatctgtggagatcagaggataaaaatatttccatgacaggaacttaaaattttaagagaattttcttttaagctcttcactggccagtggaagagttgaccatggctttttccttcatgtgtagaaaaacactaggcaacttggtagtgaagcaggatttttctcggccaatttgccaactgggacctccgctggcaacaccccccacaccccaccctgtgttatagcttgtacccacattcagcggttcccaagctcttgtcccacatccaagaagaataaagatatgctgacaatttgaaggtggagaagaattttattgagcgacggaacagatcttagtggagacatagtcaggtggtttctctctcccccagtgtggctgagtctggggctttttatgaactcagaatgggaagtgcatgctgattggtttgtgagtatgcaaaaatggttaaagcaaagacattcaaaggtaggcacaacagtgtagaaaaccaattaggaaagggtaggtatatgtaaaatagataaagggtgggatccatcagaggaaattgtgtcaaaaaggaagaggggttctcaatccggtctgtggatttgacttgtagcttggctttcaggctttaaattcttttcaacttggaggtggggttttgctggggacccacccctgtttgcctaggcatttgtctgccccctgctgctgtcagtgggattacaaactgactcacatttttaaaaattgtggcctcccttcttacccccacaagtagcaaaagatgtttttagatcctgaacatctcaaaagtaaaatctagagctgactatccaaaaaggcagccactagtcacatgtggctattgagcacctgaatgtggctagtgagaaatgacatgtgctataaatgcaaaatatactctggattttcagggaagtaatatgaaaaaaagaataggaaatatttctttagtgatttttatattaagctgaaataacattctacatatattgggttaaataagatatattagtaaagttaatttcacctgtctctttttatgttttataaatgtggttactagaaaacttaaaaggcccatgtggtttatgttatgtgtctgttggacacgctggtccagaggactggtctggaagacacttgtgagaagggggaatgacatgatttccatacaggccctgagttcttcaactattttggtttttattcacagtaagaatttcagaaattatggatctctgccctttctggttttctattaggtcagctgtgactttgcctttctgggccaattcctatcccaaacttcttatttttaggcagaagtcctgcatgctctaagccagcatgttaggtgtttggggtgttttcttttgagatggcatcccattctcttaacccaggctggagtgcagtgtcactatcacagctcactgcagccccgacctctcaggctccagtgatcctcctgcctcagcctcccaagtagctgagattacaggtgcctgctaccacgttgttttattaaagcaaacaagcattcaaggtctctctactgcttcttccctgcaacatcatcacagagaagaacttgcatcctttaaaaccttgttctaagtatctgtacatttattggattatctgatctactttatctttgaaaaattcctgagaagcaaatattatcctcactttacaaaaaggaacctgagttgactagagcaataatgatggttcatgtttgacgagagccatataatttacaattattttctaatatatttattctgaccctgtgacacagttgttcccattcctgttttacatactgggaaattatctttacagagggctcgagtgcctgtgccccacagctgataaacagaggaactagcatttattctttcaacacatgtttatttgttgtgctaaacactagtaaacaaggatatggtcctttcatggagtttgtatcctaggattcacagcacccaagtgttaagtgctctactaagaatcaaaacagtgtgatgagtggaaagacaatagatatctaggctgcatggtgggaaaagccctctctaaagaggcgacattgaagatgagatctgaataacaagagggagctgctacgttaagatcaggggacagcagcaggcacaaggcctgcaaggctggaaagagcttggcatgttggaggaactcagaggccagcggtgatgggtgggcagtaaggtcagagacagcaggggagatggccatgcaggcaggcttgtaacctgaggaaagacatttggattttactctggatgtaacatggaggggagggcttagcaggggggagacaagtgccctagcatcctccacacttgaatactgcctgcctctaattaacattctacaaagatgaccagggatgaagtgggaagaatcagttatacagagaccagagtgaagccgggagatcagtgacaaggttggagtcccggatgagaggcgatggtggtagatgagtgtggacccagtagaaatggtgagaagtggatggagtctgaagttttttggagataaagccaatgagactggctgatggatggcttatccctctttacacctgactgtccctccagctctcttcactcctgcagtgtccatccaaaaacactctgcccagggaaatctaatttctgttcaccccgtaataatgcccagaagacaaaatgaaacactgacagattgtcattatttatcacccctttgttttgctttgttaattcattgtcctgcctagctgttagcgtcttaattgttcatgttgacctttagaaacacattcaaggtgaataaggaggccttgctatattccaaaatcgtgtcagtgggaataaccaaaatgattttattctttcactctccttttggctggcaggaagatgagctgttcacatattcatatgacacactaccatttgaaaaccaaaaaaccagaagcatgcaatgtcatatatgcagtcatcggcaaatgtacaaagcaccctgcagcacagcatagttacacactccttagtagggaatgggggaggaaaattgtacgtaagaaccagatgttggctgggtatgctggctcaggcctgtaatcccagcactttcagaggccgacaggggtggatcacttgaggtcaggagtttgagaccagcctggccaacatggcgaaaccccgtctctaacaaaaatacaaaaattagccaggtatggtggcacaggcctatagtcccagctacttggcaggctgtggcacaagaatcacttgaacatgggaggtggaggttgcagtgagctgagatcgtgccactgcactccagcctgggcgacagagtgagactccatcacaaaaaaaaaaaaaaaaaaaaagaaccagatggttgtcacaaagtgataatttgtttgccactggcagtaagataaagaagagagagatcttgggtggaagtgacaagccagaggcaagggctggtccgaaaaggctacagagaggaggtgttacctaagattttccttagaggataccctcgggctctggttaaacaaggagaaacagggagggtatgagatcaaaacaggttgccagtcagcaaaagtttacacatgcatgcatatgtatatgcaacttcttctccagccagtgaaaacattttcttggcatataggctgaacttcattaattcccaagggcaatacatgctgtcagtgctaaggaatgcaaacccacccttcttcacttaccagcacaactactctcttccccagaacacagagcgggatcaactgtgccagcaggtgttgggcacatctgtgtagactccacatgcatctctctctgacataagggaatttttactcctacacaccaaagaactacactcccttaaacaccttcactggttcccactgcctgcccacacaaggtgtgttttgtggaataattattctgcagctgttcataggtgtcaaatacatttggaaattgttgcacttagtgttaaagagggctttttctctgcaggacttcaaagatgctttaataagccaacatgcattgggaatctccaaagggggaacatacgcagcatttcccaaacttgtaaattactgatctgttttcatagagcatcacttgggactaacagtctgtgaaaggcactttgggaaatgcgggactgactaagaagggcttcccctagtgccctccacagtcagacgctgcctgcttctcaggagtcctgcacaaggcagactgcccccaagacgctatttcagcctactcaccatatgtattcccacctgtggacctctgctcacaccacccccggcccaaattatgctgttccttctcttctcattgtaagtcaacccactcctctcgttgtaagtcaacccaagtcctttcttctctggaaagctttgctcatccctaccaggactggagatgccttgtgcctcagaccatcttaatattgctttatgtcacactcatttagcttttgatagctggcttctacctctatctctaataccttgcatatggtagaattagtaaattctttattaaagaagaagaaaaacaggaaggagataaaagaggagaatcacaaagaaagaagtaggggaggggaggaggaggatgggaggagtagagaaagagaggagaaaaccagggaggtgacagtgggaaagagaatttcacaggaccttggacgtggtactttgattgagtgtaggtaagaggcaaagcccagggagcgcagccttgagtacttagtggaaaagaagatccatgaggttctgcgtatatgaccatccaaggcagctcccaggaggtgttcctggcaccatgccacacttagctgcagggcagtgcccattcataaggtgtcagctctaaccagtgagtgcaatacctaagagcaggcgcagactgtgaccccttaacctaacctatgctttatgataaaatagatacatatttatatttgtactattcagaaaacagcatatgtatccatttcttgggggttttcttgtaaacaacataatacaatatccagttagtactgaggtgtttttgagacaaggtcttgctccatcactcaggctggagtgcagtagagtgatcacagctcactctagccttgacctctgggactcaagtgatcctcctacctctgcctcccaagtagctgggatcacaggtgcatgccaccaagcctagctaactttttttaacatggggtctcactatattgcccaggccagagtgcagtggtgaacatagctcactgcagcctcaaattcctgagctcaagtgaccctctcacctcagcctcctaagtagctaagactacatgtgcacatcacctttttttttttttttttttttttttggtagagagagggtctcactatggtgtccagtctggtctcaaactcctggcctcaagcaaccctcctgcctcagcttctcagaatgctggtatgacagacatgagccaccaccacacctggctattactgttaaacaaaattaataacatacaaagtgcaaattatataaccctaaagcaatcactgtcaagagacctaccactaaagccagtgccttcgtttcacagaggaggggcctaaaagccacagagcagattgagctgtgactagaacctcaaatctatggcctagtgcactcactacatggaccatctgaagcgctgcttctcatggctgggcagcctataatctctttgtcagccagatggccagttgcctgagatgggagacacaagaaacattcccacatctgcttcctgcttttaactcacataaaaatggccagtcggtttaacaaagctattttcctaaagggaccagagcttctattttttctgtacatttaaaacgtgccaaacaaaatgacacatgttgtcaacaagatgcaacagatatcttcccacaaagcctcttctttgtaagctgtcatgccagttctgttgatgtagttaccttccgcaaagaccagcggtcttgccagagctccaccctggaaaagctcatcctgtggaagcacagcttggtggggtcgccagactcctgtctctaacacactgttaaatgcctagatgtatttctttcatgcttgtgcagaaattccatttcagagtgtcggggcaacacctaagtcagtctcccacatgtgggtcatggaaagagccagggcctggacgccaggaggcctgggttccagtcaacattccctgtgacttttacaagtcgcaagtggatgaccatgcccccattgccagcagccttgggacgtatgtgggggcactaagcataatgggccagtgtggggcatgggagggggtcagcccagctgctgtggtccctctgccagcccccagggcaacccacagccaggcagtctcagccagggcaggacaggggccagggccagagcagcgcctccacactgagtcacagccagccctgtaggagaaaaacagctgaatgtgggtgagaacctgaacatccataacagcctggtccaggagagcatttctgggtcctgtgaagaggaagaagagaaaatgatgttggaatccccaggttaaggaaaaccaagccattccctggcctgcaagctgtatcacttcctctgtaactgtttctctccttctgagcactggtacctggtttgtgggacaagaagacaagtgacatgatcaaaacaaagctttggtttgtatttccttctactccttgtaaattttattcattgagagagatttttctcctgccaccacatacagccatggcaggccctgtaactgttcagtgtattcttaggctataagcaggtccaccctcaaaaacaaactccaaattcagtcatagaaagtacaatccgagagattaatcaaaacctccaacttgagccagggtaaaccttccttcctcccccagctaggctaaactccaaccccaccctgtgaaaaggcaggatgaggttgtctctcccctgtttctccattttgctcttctcctcctagtccccacccaagtctgttagccaatttcttacccctccttggtaggggcaggtgagcagaggtaggagaaaaagtagaccttccttgaactagtcccattataagctggtctgtgctctgtgggcccagcctgtgtttaacactgactctcttttttcccctggggtgctccttggagctcttttgggatcttccttccagtagtttccttgacacaggcagatgtttctttattcccagtgtttgcttgtggtgctttcatagcctctgggtctagcagtcacctccagcttgttactgccgaagtccctctgtcctattacatagcctcttggacagcatccaagatgactctgctctgcacttcctctgcacgacccacatctggtccacaagaaagacttacaggacgcatggatgggcgaacccaattgcagcccctccatcctgctgcacaggctgcctccactttctcagacatgagaactctgtattcgccatcttcagggaacccattccaagctctccaagtagccccatggggacagcctcactgcactggaggggaagcccagggaagccctgatgaaatctctactggaagggtctctggagactcacagcacagcaacttttctctccaagaaatcccttcatacatccttcgccctacccaggccccttttatagccttcatctggctgaagagtccaagcatcatgaagccagtttacagatgtttccctattaggcaacttattagaatatcttacagctcagagcatagtcaaaacttccattttaacattcattacatgcttatctcagattttaattatccacccatttaaagatatgccccatggggcatagacatcatctggtttattcactactacatcccagctatgataggcactcagtgaataattattgaattaacaaattaatgtttaagtaaagtagcgtcccctcctcagcctgcaagccatatgggagtgggaactgagattatttgtactcaatatttgcccccagtagagtctagtagaatgctggcccatagtaggtactttaaaagtggctttgaaaaaaattaatgaacctgggcaaaaggccacatttctctaggtaagattaatggaggctctactgacccagagcctctctcccattcttcttcaaattcttcacttggctacattgcttaaaactctgctaatcagatattctatcagttcaaagcttttttaacaacaaagatatcaccactgagaaaatggaagccagtcatttacacttaagaagacaatttgatacaaggaatgtacaggaacactgtcaggggcctgaagagtgctaggaggcacttaagagaaaggagatggcaggcccagaggtgggagctcttttagaggcttgccagggagaccgtgtgtgccaggaggtgaaaaggaagtggcagacaaaaccagtattttttagagtttgcctttagcaagcttccttctacacaatttttaagaaccaattaatttttagagctagaaggaaccttttatatcatcagattccatggcttccaaacatttttgagccaaaaaacttcttctttcaatgaaatcttaccagaaagccaatatgaaaaacaggtaagcggagataatctggttctagataggtggttttaggtgggttctagatgtttgggctgggaaaccaaacatgcacatacacatacatatctattaatacatacatacacacatgcatatacatacatatacacacatacatatatgtatatacacacatatatacatgcatgcacatatatacacacatgtacacgcacacacacgattttctcagagtagtcttcaaacctccccctcagaatcactaagtgctcctgaaacacagtgtgtccagatacaatgaaagacccacagtcatcctcacccatcaccatgtcccagagactgggctccagaggtcaaaagaaaatgaaagacactagaccctactgctccctccccttgatcaaggagcaagaccttgtcccctccacttcccaaactctttgtctattctgtaaatgtttgcaaatcaaagaaagagccctttcacgggaccactgaagacttcccccatgagtttaatactaccaacaaatatttactcagttcttcctacattcttgacccgtgtttggcactcagaacaagtgaccattgtcattgctaagttaaccagcactctctgggtgctgcctgttcaaccttctctgagccatctcaattgcagttaaatatcccacatctttccatctttcccctaaatgtgctttgagacactgtgtgaactgatctgctgaaatgcagataaactacatctgtcagcccccatctatgaatctagtgagacttgcaaaaaaaatgaggtttggcacaattcgctttcggcaaacctttgctcccagggatgaccactgtttcctgtctttggaacttataagccatctgtttaataatctgtcctagcttcctgccaaggactgacatgcatctcaccagtcagcagttcccaccaaaagtgcttagggcctcagggcctcccatccctgctgctggccagtgtccagctcacacaagtggccccctcatccctaatgaggccttactggagaggatgggccactcgcctattgcaagtgcacaatgtgaatctgagagttcagtttcgtgtaattatttctgtatcaacaacatcaactcagggctcaagatcacctaggtgagagtgtaagaatagagactttccaattagcagagctaggtttgaaacctaaccccaccactcactgtgtggttttgactaatgacccactctgaacttgtaaaatgagcccatgggagctcatggttgtgattactaaatgcaatatagtgcatttagtatatgcaatattgtgcatgaaatgctcagcacagtggctggtgcatatcagcattgttattattaaaagaaaatacccttattaattaactactgcaagtcaggggtgggaatgggacaaggagcaggcctgggtggagggcctgtgtgtgaggggactattcataggtacccagttcaattctttttctaggcactagcggtatatggaaaagatcctcttccctgtagagctcgaatttcatggagaagaaattatgagagaatgtctgtctcctttcagtcacctggcttgtggatttgctatccccaggtgaaaccaaggccctactggactggccccaggctgattcctggaggaagctacttttcagaggggcacacaggttatctcatggacaggttcttcagggtgtcttctaacccccagagatctgaggacaaaggattcctatcatctccttgagcaactgttaaggaggcagagaggagccgggtggaaggtcctcaaatgaacaaggtcaaccaagcggcaaaggttctaacagttcattctcctggccctcgtgtgaaaactgcagaaaagtcaccccatgcctttgtagattaaaattaagctggcaagattcagctgtagtgggctttagatggtctgggtcactttctgaagccaatttcttttaaaagctctcaagctgaaggcaataatactaaatgacagctgagaattttaagttttattttcagttctggaaaaaaagggggggatgggtatccctttatatttttatactgaggacaagtcagtagggagatttcattgtgttgtcggtgtaaaagtaatcaactcagtgtgccatagccaggaattcaaactgcttggaaaatgcaggtgtagttagcccttttcactggaaaatacactggacagtgacgtgggtaggttaagagcagagagctgctgggaagatctgcagaaagggcaaggttgtctgccacattccttcttcctaaagcacttatgccatctaggtgaaactgggctgttctaggaggggtagtacttcctgctttaacactaaccaacttgaaaatcacactgggaacaaaaccatgacagccaggaacacagcaccagaaggtgaaacccagcccagagtatgtagccgctgtaacttacagcattaataaaaggcttacagaaaaccaaaggcctattaaatatccctgccccacctagactcaccacttaattggggtgggaagcctcaaggcagaaggagtataaatggttccaaaggccggagcgactttggtctgaaaggcccaggtccaattaaaacaaaccaggagccttaataactgctccgttttgacatcgggaaacccactctaaattctgtcaatggctatgatgtagagattttattatgattattatttcatggacttaatgaatgcttaaaagaattaagccacgataagacccaaggtcataacctcctcatccaccacgaaagggcagcttgccccagagccagcctcttcttgggaggcagtccccaggtccctgggttctggtggtcctactatttgatttggggttgatttagagcatgcacaagcaaaatgggctgtaggcccttgccgtgactgtaaaggcttctgtgtgcgtagtcatctcctcaacctgccagaaattccccaaaaggagaaaggttaatccctctaacttaaggaattttagcctaggtaacatcacagtgtccaccagaaggaggacacacacacacacacacacacacacacacacacacaccctactgatgaaaattaggttatctatctcccttaaccaactggctatgagtacatcttgttcttttatgcattcaccatttttttgtattgctaatgagccacaataagcaatattgagtatttcttactgagttgtattgagtccttcaccatgagccaggcactatattatatgctaaacaagttcattttctttgtgtatcacaaacctttctgattataagcagtacttattaagtgttatgttatcaacgtatattaaaatgacaaattctcttggtaatcatgattcagtagatacagggtggggttttgtcctctgtttttaacaagtggcccaagggatgcttatgatcaagtcattgtcctagaaagcttcccagcttgtccgaaacctcttgactgaagtgcccacagactcctccaccatcagaagggtcccctttcccactgtgttgagccctcccataagcatctccatccttcctgatttttttttgaacaggcttttagctgctgaaaagcaaaataataccctcaaaggaaagttttattggagggaaactgtctcaaactgcagacagtatctttttgcattttattaaacctgcagagctagagccatgatttaaagcaatgggtggccaagtaacttgaagtctattttagttaccatttttgttactgatggttccacctactcaaaagaaaaaatagtgaatagaaatattaatataggaagccaaggcagtctcatggctgcaaagaaacattggttctgtgccctgaccttcctctttgtggctcagattttccacctaggggagggtgatttttgctctctcctcatcatacagagctgctgaagggatccttaagagaaggctcttctagactttgagtttcctgaccaaaattaaaccgttgcagttgtagtatctttctcttaaagtgggtttcctcattcaccagacattaccattagagcctggagtgatgagaaatgtctaaatgtaggtaaatagacaaagacttccagagttttcccatgtattgtcaatggggcaacaaggcattgccctgaaatctctgggtgtgtgacattaagattacagcttgtatgtagaacataaaaggcctctttatactctatgattatgaattatgataatctttcttaaagcaagtatgtatatattgttatttattctttaaaacaacttttcaaaacatatattctctatctcagcttaagttgaatgtacttcttagaatgaatttatgtagcaagtcaactctgctctgtgcagacagggtcagttgtcttctctctgagcagattgttgggggccaatcctagctaactatgaaactaaaggatggaacagttgacccctggaagtccctatgctccagtgatctctctccgtgtatcaaatggtcttgaaactcttaaaaagattgttattacctcaaatagaaagggtgattgtatttgatatatcctgggaacactgctcgtatgcaccatcttaataaaatgaaagcctattaaataagacatcatttaaggaatagaggagatggatggaatgccacagaaaaatgtaatgaatattcatttatagattgagaagtggaaacatatgggaaggcttgtttggggtttttattttttgcaacaatatggggctcttaaatgacactacacatttataacagctacctgttgaccaagagctgtaaagggactctccaattacagaggagcagagcccagtggatgctgttcctcaaaatagtcatctcccattgagatctatttaagaatacctttcaaagagtatctttacagttttatgcacctaaaatacagtaaaatctcacataaggagatatcagagttggggggcttattagctcatatactgatacaaaagtttatttcttttcagttctccagattaagccccattttgtccctatatcataattcagctttcatttgagtgagagtaaaaggggatctaagaataaagtaaaaataaaagagactcagtagcatcttagttctgagacccagagaccatttaggaggctactgtaatgtcaggcagaataacaaagcagaaggtggctgggggtgaccctggagtcactggatggtgaagaaggggtggagttctgatcacagaacaaccagagagagactctcagtgagtcaattaaattttgcctaaacttagttttccccactacaaaaaaaaaaaaaaaaattcctgttgcatcacctcaaaataggagatccattgaaatgtgaaaatgatgaaatgtggaaataaatatgtactttgcaaataataacaatggctgtgtggagttagtgagcccaggattttctcttctcttttttccatagagtttttagtgcctttaattgcttttatttaataaaagaaatggtaatttaagaggagagagagagaagcagatgtgagctttaagggatgactatagaaccagatctatgatgtctgagctagactccttagcgggtttcggaaaaatgttccagcccattaattcaaagcctgagtgaggaggtgtgagtgactggtcacaccaggacacagtggttctctgcagtggccacttccgctgacattacatccaacaccaccatcacttctgtggcccaggtctcccaggacactcatttgcaagttcaccattgttaaaaatcactctcctgtcttcttgtcattctccttgtctagtgatccccaaggtttctggactcagagctttggtatgaaattcaatcttcacttagtttacaatttttttcttcacccagtgacagtgtgatgaggtaatgttttctagcagaccggctcaagatttgaacctttaaaagtgaaaaacattgagagcttaaaaggccagtgttcaatattccttcagtgattttaagtggacagtaatgtcttcccagatattaattccagagtgacagaactatcattgtctccatctgcccccacagcaaagttgtagttagtcattctctgtaacagtagtaatgaactctctagttataaacaagcaacccaagaaaaatttcatttccccagagaccatttaggaggctactgtaatatcaggcagaataacagcagaccggaagggggctgggggtgaccctggagtcactggatggtgaagaaggggtggagagcgaaaagatgctggaggaggaggcatccttatccaggttgcctcagactcctgcagaagggacccagccccagcccttgcatatcaagaagagaaactcagaggactcttctcattcacaaggaaatgttctgaagctgtgagactctgacatttgtggtgtataaaccactttcgcatggcccagaaccttctgtgaggttccattctgcataaattacagttttgtaatcactttttctaactgatgctttttgtgctctttaatgtgcattcagatatgaggggaggtggcatccttttatttatttaaagaatgcacgtctttatgatttgccttcagaaagaggctctttactatcagcatgtcccaccttttggggaccctgaggtccagtgtggagaagcaaggagctggctctcctccagcctggagtagctgtgatcagcctcaagtcacctctactcagaaggtccccagaggcctgtgcaggctggcagatggcccaggacttgagatcacttcaagtgtgcatggatagggaggaaagctatacagactcatgtgacctataacttggacattaacagaccaaaggaaatgccatgccttactcagagccaatttctctttagaagagaattctaaattctaaattctctaattcctgtgtcactctccaagtcccctgcagtcttcctcccattgtcttttctcttttgtttggtaacttttctttcctacgaatttaccagcctgaagagatgaaagtcctgagttttcctacttccttattacacaaatggaggaataaggaaagctgttgttggaaggatagcactcagtagatgagcaaagcaactcaagattgtctcctttagctccagtaagtttgatccaaactgggaggtcaccgatgaagcttagatcaaacaagggccaacatcattgtcatcaacaccatcactgtcatcatcataatgacaaaaatgacccaaaaatgttctaatttttgaggaggtttgcttaaagtgaagaaggttttaatatcttcattgtgtgctagattctttaaatcagaataatcaaactgaggtgttaagagaaagaatatcagaaaatcaggcaagaccttgcttaaggaaatatgaattgcctaaaggaggaaacggctaaaaattacagatgatttgcttgatctcgaatgtaggtgtatacccaatttcagttaacctttgggtatgtgataagcaaaaaccacacctccacccttcccttagagttttcaactctggcatataaactgtgttctcatctccacccggtcctgccaatgacaagttgaatgctgtctactataactgcatggccagggcccctgagtagcatttaaggtaatagaaaaagccagctagtgtgccaatagcctttgagagatgacctgtactgatacagattccagtttatctttggcataagccagccaaaaacacaaataggatctcctcagaagcactttcaaggcttacagactgggaattttccttttgataccatcctcatcaatcgtcagattgtgtatgatcattatttcagagactcaaaccagaagtaatgttcatgtaactaccaaccttctgaaacagaaggttgagatcactgttggtttttgttgacagaagattgtggcaacacactttgaaagtaggcgaaaggtaatccagaaggtaatcagccgtaaaattgttctgtttatgggaagaatgaagtaccatgtcctgctgctgctcttcactttagttttatcaccctttttcctccctattccctttccctgccctcaaatctctacctccctgcaagtgccctacttccaagtttcagaacttgggcttgcattccattccatccctagggagagagcctgcagggccccaccgttgctcaggccctctcttgaccagagcataaaggattggcagacactctggcaggatcctgcacagcagtcttcagatacagctgctcttccatccccaaacatgaaaatctgtggctcctggcagcttggaaaatgtcattttcccatgaaaatgacgtaagaggcagaagagtctcaactccactctctgttacaaaagtattcctcctaaaatattaatatttgcgcttagtccatattataccatgtgactaacatatgaaaagaaatcttcttggagattaaacaagtctctcttgggctcattgcacagtttggggaggtaagctccaggtcagaagctgcctggagacatctagagtgtcaccctccctccgttttctgtggtgttcccagcctatgtgaatgagctcatgtgctgacctcctggccagcccctctcttcccttctctgtagtgctctgcacactttggtccttttgcctccccccattccctcaaaatttgacattcctatgtccctttatcccgatcaccaccactcaaatttcacagtcccgagcaccctttccctggcctcaaaagaatagatctttatgctggctaacccacatgttactggatgccagtgtccagggaatttctctcctgggtaacactctggcattttaaaaggagtctccatgagatgcccacaggggatccctaatgttgaaaatatcagactgagccggggacagtggcatatgcctgtagtcccagctactcgggaggccaaagtggaaggatcgcttgagcccagtaggttgaggctgcagtgagccatgatcatgacaccgcactctagcctgggcgacaaagtgaatttaaaaatttattttttattttattaaataatttaaaaatacatatatcagaccaattggtagtctggacatgtccggggtgcagagagtaggaagaagacacctcaaggcagggaaattttggtgttctgctcagctcgctaccagaggcactcattaacctcatgggtaggggagaagcaagggagatgggatgcaggagagaggcgagctgagaaaaagcaacaggtttagagaaactgatgatgcaaacccccaaactccctctccagcttcacaatgtagttctttagcctcttcagggagcttatggattgaacactagcaaatgttgggtgctattccagagcttcttttaggccaaaaccaaataatatgacaaagtccctgccttcaaagaaagaaggctgaaaggcaagaaaggaccaggtgggaattgtgatggccggaaagaggacaaggagtattgctgttactattgggctttttgcttattcataatttcaaccactgcatagctaagactcccagaaaatcagagtgagctgttcagaactgcagtgtgtccccacactgcctctccattgcattcctctgcctcagtcccagccacatctctcagcctcaagaatcctgttcctcaatgagggggttggtagccatagctcgggggagtgggccaaaccacgagcacccccactcattgcagggtctttggagactgaacagagattgttcttactaagcatgaggtcacctttcttttcctggactgtctggattcacagagtttctttgggttctctggctgaattcactccagggctgatctctgtgagcagcccctgggatctagctcagagagactcctccagggcccagtcctcatcccctgtggaatgggacctagtgaaagaccagtcaattggggaaggatgtggagcaggtcatgaggccggaggaaggcaaaggtcaagctagttccaaaggcctcatcaagcggtaggaaatgggagagcctaggagccaaaatggtggttgagaagtaagaaatgctgcaagccaggagcagcaacaaaagcagtgagaggaggctgagaagaattcgggagtcagaggcccatccaggtacttggggtgaccttgttatcctggtaagggtttgtgcaactaggaggaaccattgaaatagaagaaatgaagtagaggtcataccgtttgtcatctctccaagtggagctttctgctgagtccacttttaatgaacaaataaaattcgttggtaattagcgacattctttatttataatccaggtgctgaaatccccccaaagctttaccctgcctctttccaaaagatttaacatatatattttttttcctcttaaagattcctcttacagtctcaatatgagtccaacaaccatttcttcccagatcatacagaacacgagctcagcccagcctggggagaagtatcacagacatttaattagtgcaggctggattcgtgaagcatttcgtgcaccatgaaaatggggcattttgatactggctcatggtcttatttcagatccaacttctacatggtcttgcaattaggaagagtactggggcccagtggaagcctgaaaacagttttgaggttggataacttcatgcttttttttactcctaaatgaatcccagattttgagtgctgtaaattttctgtttttctgtctgacatcagccagaatacttcagggttttgactactgtcttcctttagttttatctgagaggcactctggcaggatcatggcagcccttacctaaaaagcagataagtccaggaaacagtccagaggcttctgggagccagctgggcaggtctcacctcttcaaaggtgggcatccaactccatggtcaaaaagtaagaggctgcccaaagcccagcctaatcccagaagatcaccacaagagcctaccacagcaccccaaatgcccagcactggggccgctcctttagaataaaatactgtcatcagaaggttcctttcttgaattatattatttaggttagaagttcagctgacctaccaaaagcccaaaataatacaagcttcaactatcgaacttttttttcccctctcacatataactctccgggaataaactgtccaggatcaacatggcagctccatgctgtcaggtgcccaggctccttccatcttgtttctccaccaccccaagagtgtggttcttgtcagcatagtccaagaatgaaaagggttagggtgtgccctttaaggcacagcttagaatttggacatataatttctgctcacattcagctggccagagcatagattacatggccacaccttgatgcaaaggaagccacacccacctgcaatccttgcaccacactaggtcaagctcagcatcatttactgcctcttgaagcagcttttgcaaggaaggctgggaaatgtagtcattgctggctggtcatgtggccagtgaaactcaggggttctactactaaaggaagaaagtgaaaatgcatatgagagacagttatcaatctctgtcacagtatatttttgtgtctatggaaagatagagcctattaagaaataaaccactatagtggacccagcttgtggatctgattagaggtttgtcccttagaaagcacagaggattataaggggagaggcacataggacaagtaaattatgattggaaaaagggatagggatacacaaggcacttctccaggaagggttgctgcagggcactgaaatcctaaagaaggaagaaatagagacatggaaagctggaacagaacaacggaggctgggtaagtgttgggacccgtggaaacttctcaaatgggtaatattactggtggccaactcttttcatggctatgcttcttgattcattctgccctagattcattccaatctaaaagcacatgttgctcaaaagaaagagcatagagtctaaacagacctcgatttatatcttcactcggtcacttacttacagagatagcctgggaaaattacgcagcccctgagccatttctacatttttgaatcaggataatggggatattaaccaatggtgcttttaggagaacaaaatgagttgatgaatataaagcagctagtaccaagcctggcatagggtaagcactcagtgagtggcatttgggattagtatgaaacttttcactccataacaaacaacttgtccctcaaatgaatacatatgagtagggggcttggccagtgtgacaatgttgtgggataggaaaaaggtgcatgtgtgaagtgctgagaacctagcagacacctacccatttaggatgcttctcttagtgtgctcaggctgccataacaaaatactatggactgtgggccttaaacaacagaaatttattttctcacagtactggagactggaggtctgagatcagggtgccagtgtgatcaggttctggtgaggcccctcttccaggctgtgtgctcacatagccatttcttggtgcatgtgtgagtagaatgaaaacaagccctgtgggaactcttcttctaaggggaccaaccccatcatgagggaggcaccctcatgacctcatccaaccctaagttcctcccaaagaccccaccctcaaatactatcccactggaggctgaggcttcaacacatggatttggggagacacacacattcggtccataacagtgccactcactggcaacaatacaggaagcacagaagcaaacttgttcttttttaaaaaaattaatattccattttggggaaaaggtgttgacagctactggcataggaaaagaactcatcctgaagatggcattcctcgattggtgcaaaagaagaaaacaaaccttcatccatgagcttgtatatatggagcgggatgatatcagcgctgtgcaccagatgaatcagtaatttttacattttcacatccaagctaaatagtgctcttgaccaaaaaatcttagtcggtttatcttctggcaccaatatttaaagcaaatacctcaacataaataaaataataaattgaaagactatactaattgtcgttctaagtagttagagtcatttaactggggacaggaaaaatatcctcaagattcttaacaggtgagacagaaagggcaagaaggaagactctaaataatattagttcatcctgggtcagactttcactcactcagcatgaccatgccatggtggttttttttttttttttaatcttagaaaagtgcattaaatctaaagtattagtgagacccatccaaaatgttgattaaaaccaggctctttggagaagtaattgctacactgcttggcaggacccaggagtgtacattggacttgatgccattgatgaagagatgatggtcagtaccaatggctggttttaagaagagcaaagttaagaaacaatatttaggatgtgccacactgggtcaccactcagcatgatttgcttcctcttaatgttttcaactttctctaccacctctaaagtatactacccagggtatctctgcataattctttgtcttgcccctttgaaaggtttgaattctcagagccagtccctgtttagtgacagcactttggccacctgatcacttttcctaaatctcctttctccaaccctattttgtctttattttttgaaatttgtcagaactaaacaggtgcaaacaaaacatgccatgattttatatagtgctatgagatttaaagaagggatttaagcatcagacaaggaggttttatttccttatgtcatctagtatatttttgccttttttagctacaatggtttatcgaccttcctcaggggccatcagagtgagtcctttaccacttggccttacagtttcattcatttgtatggcaagtagttgtaactttacgcgtagggtagacatggagagttagcatttcatatagccttaggacagagtttgttcatccctattttgatggcacggctactttatcttactgtgtttcctctgtgtccaagtatttattaatattttttaagattttcaagtcaaaatggcaatttgagtatatgtatgtagcctgacttcagaatcgggagagacttttcaaccttgagctacccactggcagcgtgagagaaggtgataggatgtcataggctcagcttacacaagtaagcatgcacaagtgtgtaaataggcaaaaacccctttccagattgcaacatttttcccagtcctgagttcagccctttctcaccaacataacaatctatatttcttttaacttttattttaggtttgggggtacatgtgaaggtttgttacataggtaaacatgtgtcatgggggcttgttgtacagattatttcatcacccaggtattaagcccagtacccaatagttatctcttttgctcctctccctcctcctaccttccccactcacgtagactccagtgtctgttgtttctgtctttgtgttcataagttcttattatttagctcccacttgtaagtgagaacatgcagtatttggttttctgttcctgctttagtttgctaaggataatggcctccagctccatccatgttcctgcaaaagacatgatctcattcttttttatggctgcatagtattccatggtgtatatgtaccacattttctttatctaatctataacctacatttcaaaatgaacactgcaggataatatccagaggacagaaaaggaaatgtgtgatggttacctttggggttatatctttctgtcatccagttatcccatctttctcctggggaccttgggttccagtggcataaagtcctagtccatcaggcaatgactaaagcacagatcgggatccttcgcagcaactttaggaagggtgccaagttcagagtccagaaaaaaaaagggaaacctacaactcatactcagcttccacacaccatgaatgaccccactaggcaaagagatgagttgcttcttgtttcagtattattccataacaaaccatccaaaaacctaatgacttaaactataatttgctatttttcctcacattttttgggtcgattgggctcagttggatagttctcatttagagtctctcatgaagctgcagtcagatggcggctggggctggaatcactggaaggttgattggacatcccagagggcttcttcactcctttgaccgccttcattgtacctcaacaggcctccctgcagtaggccagccaggatttcttacatggaggctcagggcaccaaaaacaggaagcagaaactgtcaggcctcagaggcaggctcaaagctagcacatcactttcattatattcaaaacaatcacagccaaccgagattcaagggagtagaggcatagacccctcctcgccacagcacatgtgtactacagggggaaaagatggcagccacctttgcagataagctaccaccaccacaaacaggaagcaagaattatttgggatggaagattttccttctgcccagagagccctgaaagagcaccctctgtgctactcttgggtggcccagtgattaaagagcaaagtttgtgcaaatataattgtgtaaaacgttggagaaaagtaacttaataaactcacaaccacccttggacttcaataaagcaagcagatgaaaaagtaaataaaagatatagaggctttaattaaatcgaatcaaaaaatgattaatggatatttaacagcacccttcaaataaataattcatattattttcttaacttgtaaaaatcaactataacttaggccacaaagaaaacctgaaaaaagagagaacatataatttttagagtccacatataccaccaaaaataaaaataaaaatctacaatttagcaataagggattaaactcttgcttcaaaaaagcacttagacaccactgcactccagcctaggcgacagaccgagagcttgtctccaaaaaaaaaaaaaaagcactttgaagttttaaaagcagtcttataaattactattcagtccaagaggaaatcaaaactgcaattaactgggatcctagaaaataatgacaattggaacatctcaataaaaacttgtgggatttggaaacatcatagccttaaattctttcattattaaacaagaaaaaatgaaaacaaatgagataagaattaggtaaaacttagaaaataatatgaaacaaatctacagacagcagaaacacggaatctatgaataaaaaacaaattaatgaaaacaaagcaaaatcagtagaagcaagaaataagtctttaagaatttctttggaactaccagtatcatcgatgaatctttgaaagacaaatccaaaaaggaaggttagaacatgaaaatatgtaattattaagaaagacaaaaggactatcacaacgaaggagatttgtttacctgtaagaatgccctgtgaacaaagtacaaatctatgcaaatgcttctaaaatcttgatgaattattttctaagaaaggataaattacagaaattgactcaaaaaaagtacaaaacctgaataaatcaatatctgtggcaaaaatttttaaaggcatcaaagaactatacttttaaataacagcatgtctagaaaatttttgagagaattatctcatgcttgtgtacttgttatacgacaagtaattcttatgctatttcagaaatacagaacatataaaaagatgaaaatcctcccaaattgttttgtgaagttaacataatcttgatgaaaagtagctcacaacaaaagaaacatggccaaattcacctgtgaatttgggtgcaaaaatcctaaatcaaagagaattaatttcagaacttttcaaaagtttgtttcagaaatgtgcagataatttttattagaaaaaaatttataaaatatatatcagtaggtgaaaatataggaaaaatataatgatcttgatatcaaaaagattctgatagaatttaaaatattactttttgaaactatcaactgtgaataggaaattatttccttaacattaataaaaatatctatcaatagggttatcttactttatatcaaaaaggtgtttgatatttgcttaaatttttttaaacacttaaactggaattaaagtatatttttaacagaagtaaggatatctaaactattatgaaatactgaaggtattcccactaaagacaagaataagataaggacacctgacatcacttctaatcaatgcaataaaacaagaaaatgtaataataagtaaatattagaaatggaaaatattaaattatatcaacagaaatactgtaagagaattcagtaaaatatttaaatacaaaataaatatactaagagtaggatgctaaaatagagaaaagaaactttacaatagcaacaataaaataaatctaggaataaatgtttaaaagaaggctggaacttacattcgaaaatcacaaatttggaatgtgctattgatggatgagaaaacataaaaatataaaaggccattttctccaacttaatttatgaattacattattctaagttattgtttggaagaacaatcagatgagaatagtgcagataattttgaaaaataataaagatagacttataagatcaatattacaatatgttgtggaactataacagtggaaactgctgctacagatatagagagacacatcagagaagtggaacagagatctgaaaacacaaatgaaagaacaagtgagaatctgccatataaggctggcattaaattagttggaaggtggtagattatttaacaaatggtatttctaagttagcacaattggctgatttagaaaaagatgaaataaatttgaacttgcacctcacacctcatagcaaaatatattccagatgataatagttaacatttactgggtaattttatatgtcaggcaccattcaaagttatttatagtctgggcacagtgacttatgcctgtaatcccagcactttgggaggccaaggactcctgaggtcaggagttcgagaccagcctgaccaacgtggtgaaaacccatctctactaaaaatacaaaattggccaggtggtgcactcctgtaatcccagctacttgggaggctgaagcaggagaatcgcttgaacctgggagacagagattacagtgagctgagattgcaccattgcactccagcctgggcaacaagagcaaaactccgtctcaaaaatttaaaaaatttattattttcattaatccttacaataatctcatgagctaggatcaattatttaacccattttacagaaaagaaaacagaagttaattaatttgtccaagataacacagtaagttgcagaaccagatctcttgaatcctagtagtttggctctttagtccacattctataaacattctataaacatagaaaagtgaaactataacataactaaaaaaaaaaaaaaagaatgatgaaagctttttttttttttttttttttttgagacggagtttcactcttgttgcccaggctggagtgcaatggcacaatcttggctcaccgcaacctccacctcctgggttcaagcgattctcctgcctcagcctcctaagtagttgggattacaggcatgtgccaccacgcccagctaattttgtatttttagtagagacagggtttctccatgttggtcaggctggtctcaaactcccgacttcaggtaatctgcccatcttggcctcccaaagtgctaggattacaggcatgagccaccgtgcccagccctgatgaaggcctttctaagggatatgaaaaaatagactctatgggccaggggcagtggttcacgcctgtaaatcccagcactttgggagaccaaggctggtagaccatctgagctcaggagtttgagaccagcctgggcaacatggtgaaaccctgtctctaccaaatatacaaaacaattagccaggtgtggtggtgcattcctgtagtcccagctacttgggaggctgaggtgggaggatcacttgaacccaggaggcagaggttgcagtgagctgagatcacaccactgcactccaacctgggtcacagagtgaaaccccgtctcaaaaaaaaaaaaaaaaaaaaaagaatagactctatggattgatataattggctacccacataaacttatttaacttctgtacatcaaaaaataccatcagtaaaattttaaaaatcacaaaccaaaaaaaaaaaaaaaatagcttacataaccagtgtattagtctgctctcatactgctataaagaactacccaagaccagataatttataaagaaaagaggtttaattgactcacagttctgtatggctggggaggcctcaggaaatttacaatcatggcagaaggggaagcaaatatatcttacatggcgacaggtgagaaagcatgtgagcgagcacaggggaactgccctttataaaaccatcagctctcatgaaacatattcactatcatgagaacagcatggggaaaactgcacccataacccaatcacttctctttctcgacacgtggggattacaattcaagatgagatttgggtggggacacaaaacctaaccctatcaaccagtttcatcattactctataaagagctcttacaaatcagtaaaaaagatcaataaaaaaagatcaaaacctcagtaaaagtgggcaaagtatatgagcagacaaatcatatgtagtgtgtgtgtgtatatatatgtgagtttgtgtatatatatgtgtgtatgtgtgagtgtatatatgtatatgtatacacacatatatctttacatatatacacacacattttaaaaactttcatctcacaaataataagacagtgaacagggaaacaataatacaattccttcagatagtcaaattggcaaaaatttttaattctaaaactctgtaattgaaagtgtagggaaatagaaattctcataaaatagtattggaactatgaatgaatatcactttttctagaagacagtttgacaatatattatcaaaaactgttaaaatgtgcataaactttgacccagaaattctacctcaaacaatttgttctaaaacaattgacagatgtatgaaaatatttatggataaatagttttatcacagcactgtttataatagagacaaattagatacactcttaatacccaacaacaaagaaattcttaactgcatttggtgcttccatgtgatagaagattatgcaaccattgaaaatgacaggggagaaatggtcacagtaaactactttaaaactttcatacaggatgatcccatttttgtaaataaatccaccactgggtgtgtgtctgtgttctgtaaagataagcacaaaatattaattctgaatgctataatttaacattcccttctcccttcctttttttgtgtatttttcaaattttcaacaaagaactgtgtaatcagatggaaaaaggggattttatcattaaataagtcatatctcaacattaattcttgacagaccttgtatttacacatgtcccactaaagagatgccatttttatttctaccctttccttcatttttctagtttcctcgtgttaccaaatatttcctgtgtgctttcatcttaccctcagttctggcatccaaagacattattatggagaacgtgccagtatgtgtgtcagcaaaatgaatcaattaaaagagttgaccttggatccctttccatgaacagcacataaaaggcaggctattatgagatttataggcagggcaagttttaagtggagaaaagggagccgagaaggatcagagcatcaccactcacaacacacccttctctttgcccgtggctccagctttggggaaggggaaggagcaagacagggtctcactctgttgcccaggctggaatgcactgcagcagtgccatgatagcccattgcagcctcaaactcttgggcatccttctgcctcagcctcccaagtagctagggctaaaggcacacacatcaggctaattttttttattttttgtagatacggggtctcactgtgttgccaggctggtctctaactcctgggctaaagtgatccacctgcgttggcctcctaaagtgctgagattacaggcatgagccacctcacctggccagaaagataactttgaatgcatctgtgtatctacacatttttatatatacaggtatacatacattttatacatacctctatctatacatatgtagacatgcatatatatgtatgtatatgcacatttttatttatatatatgtgtgtgtgtgcacacgtgtatgaattttacatggaaagccaaaatatcaaagtgaaagggaaaggctgaaagcaggaagactggtttacttggtggccaagtgttagaagatgagcaacaatgagggcagggcagaatgaatgagtatgaaggatctttatgaaacagaatcagagctttctctgcttctccctgactgtggcagaagatggctgctccctcatccccagcttcccactttacattccctctattcaaatgatcagtcctgactaactaactacctgtcactcagtggtcattccaaattcgcaggagagagaatctgattggtctagctcagcatagttgtccaatcaactggtccaatcaactgtggccaagctcagggtcacagatcacaaatgtggttgctggggtccatttaactactgtctgtcttcacctctagactatattcttcatgaggacagggacctcaacatttgctcaatactgtctgcagcacctttgaggacatagccggcacttaaaacccatttgtcaaaaggataaatgcataaataaattaacaaatgaagagaatcatagtgtagaaggctaactattaagtcatccaatccagccatccattcattgttgatgtgtttaattcatcagtagagcaccaccttcggcaggattatgtcaattgccttcaatatgtcgatgaggttttgtggtctagcctgagtttacaagaatgatttaagttagaaactatgctcataattccaaacaactgacttgggaaacctaattcattagtaacttgagaaatacctacagccctccaaacaaggtaatcaatgggagaactaggccagagagaaaaggtatttgtcagaggaaacttggcatgtatgttatacttttacgatctaattattttagtgttcttcctgtggaatccattttccttagatgacctctgttcataggaaactatttggtttaatctgtggaagccatagcatatttttaaccatctccaaagtccagctccctctccacggagcgtgcctgatgcccaaacagatgtctcataacacagcacacatgagctcaccactggcaagtcttttgcacacaatcggcccacacctcttctcacatctccctgtcatcccacaaacccaaattcagaagttgcaggcaagctcaaactcttaccacaataatagaaaagcagaaggcagacctccaattttgaagtttcaatttattaatatttttaaaaatctaatgaccaaccagaaaaatatgcaatacaaagcattagccaaactaattagtataaagaaatgtgcaaactggctgccccaaaagaattcagattaaattatccaaggaaaaggtttcaaaggaattcaaattttgatggaggccaggtgcggtggctcacacctataatcccagcactttgggaggccaaggctggcggatcacctgaggtcaggtgttcaagaccagcctggccaacatagcgaaaccccgtctctactaaaaatacaaaaaaaattagccaggtgtggtggcacacgcctgtaattccagctacttgggaggctgaggcagaagaatcgcttgaacccaggaggcagaggttgtagtgagccgagatcactctcacagagtgagactccatctcaaaaaaaaaatgttgatggaattatagaatattagggctgaaaggcccttgaacgtcatctagccggtacaacttaattggacagatgaagaaaccgaagcccatagagagaaagtgacttgccccaggtttcacagtgagtatgttagtggcagaactagaggtagaactctgcctcctgactgcaacccacaaggcagaccacagcccccagcaccagtgtcctgtctctaaatgcctcagaccatcaatgcctggagttcaaacccaaggaaatccagaacctgatcaacaagatctttcatcctgaccatttcatcataaccatttcagaatatgtcacctccaatttaggcaaagctttttgttgagaacaatttcctttaataaagcaatcgaaggtaacccaaaaagtatttttagaggtaacattaacctttcaagtgtggaagccaagggaagtacataggattcttgctatcctttctccaagaacctaggagatgtccaaggagaccatggggaggtgactgagaagccctaaactcatagctgtgttcctggatccttgacctttggagagcttaaacctgcagggaaaaatcagagctttctaagacatcttgctgcacctcggagctccggtgtgtgagcagtacttgttgagtgccaacttgaatgttgggctctttagagcaacactaggctccacaggagaagcccttgagggtgcctcagaggtgctcaccaaccagttaaggagcaatgtttctaatgggaaacatttagagtagggttccacatggcaaattatattcctcattgaacaaatatttgtggagggcatagggtggaccaagctggacatcttgcaagaaaagagtaagacatcaattgaaagccataagcacgcaccagatcccaaagggctgtgtatgccagtggaggtgtttggcttttattttaaaggtgatggggaatcactgaagaattttgagctggagagtgaattgaccagacttaggttcgggaacaatcgtttgactatgtcaagagctgctggattgtggtcaagtgctacactgtgtgatgctatctacaagtctttcaagaaatcatttgcacttttagtctatattcaggaatacagtataaagaggatgagttcctgaggcaaacagagctgggttttaatcccactctgccacttactggctgtgtagtctcgagcaagttatttaaataggtgtgagactttagttttttttctgtacaatgaaaatactgatacataactgacagagttttgatgataagtaaagacactaatgtacctggacgtttcaaatagtcctcccaccaccattagatacacccaaatcaaaatggcactttcaagcctaggaggaaggccagctggcatcctaagccttcatttagctggagatattgttgcattttcttcttagaatttaatctgagaaatttttgctaatgtgtgaaaataattggcattcattcctgtaaatgaggatgctgaggtaaactgaggtcaaagccaaatcttggatcggaatcaaaccacccaaaaccaatactgtggaaaataaaactgggtcacaaagaccagtgttatgaagcgagagttccaatcgtcctagcaaccttttaaccaaacactggtgcagatttgctggcctacatgacggtgagaacatctggcctttctattatcctcttgcaagcaaaaaacgatgttgtgtaaactgatctttaggccaattatatggtctaaatgttaccgtgtttatgctggcacctctgactccaggttttaagaacttattgtaaccacacccctcttacaaagactgtgggtcttactgtatattaccccagggatttattgatgccgagtctgcaccttttttcaggaagataaattcaacatcagtcaaattgtgtgcagtgcactgtgggaggtcctataagaaataagttacaggacttggtggcaacaggaggagagaacaaacataagagtgcaggctctaggggctgctttgtttttccctacaattttgctacattttttcctatttaccagttgtattatagaagccagatgtggagtatagaagctctagtctgcagctcactcagaagacactaaactaggagttggaacacctgataccacctccaactggcctttccaccacagacagggtctgattgtgtctgcgcatccccacctgcagagagacagcattagactactaaacacaatgcgccaggcactgttccaagcccttcataacactgattaagggagtcctcctaatacctgtaagtgacaggcggtatgattacccccacttcacatcacactgtggggtgtcccacagtgggggccacgcagaagctctgagcttgcccctcccctctggctgctcgatgagagctctgggcttttgtgctcagctctaaaggaccaggtggtggggagtgaggggagggtctataatgaaccacagcacaatgctctggattaggtgacccatgggcgtacccctagggtgttactgaccagaggaaggaggactctttgcctccaccatcaccattttaccccaccccatctccatccctctgctgctctggccaagacaccacggcggcagctggaagtgctgacctcaggtcttcctccccacctcactcccccacagcccccactgccctctttcatcccatcttcaggggacagatgtgagagaccatcttttagtctgtggatgctttcaacttttttgaaaacccctgggaatcctaacatggattatgaacagagatattggcagaagaaggctgggagctcccgattttgtctctggacaaaacagcctctggtaaaaacagtagagtgacttatttcaattgaagagaataagtacatgagcttccggattcattaattaattagcctcccctctcggccagcctggtggccagctctagaagacatctgaagccagatgagcactcaaccccaggcaccagcagctccttccccaggatgagggtttcccttcatctttcaaggacatgaatctcttgagcctctctgtctgactttgcatgtctaggaacgaagggcagaacagatagcacagtaaatcccagctctaaattgtcgtcatgggaattcatcacagatggtaatcattagggccctcacatcttaaaggaaagctttatccagaatcataaataaactgtaaccaaggcttagatttataaagctataaaagagggcagcttgaacagccgggaatgtacagtactgggttacaaaatcggcatcatgcctgaaaggctggacataaacccgggagctctgggcagtgcagcgaggagggggtaaattctttctgcagtgggtggaaccccagtcacagcctccccggcttagcacctggtttaatcacatgaaatgcaagctcagagaaacaggggtgctggcatctaaacatagcattgcaactcctaaaccaattgcagtcccatcaagtttggcccttcctcaccaagatgccctctgactaatgctatgtcctaggaattaattttcactttattgctaaggtttcccaccccctacttttcctgagtggctcaaacaactccgtttttaccaaaagtccctgtaccatgcagaacaccctgtgaggctgtgagttgtggagcagcaaagcacaaaacaaggctgcagccttccagaagtttcttgtctggccagggaggcaaggcatttacagatgaaacaactgtagtatgcaggctgcaatgtgtggtgtaggctgtaactagagaactcaaggaagcaaagggtaagtggaggctggagtcactgtgggggaaatgtttgggggaaaagggacatgatttatgacttgaaggatgcacagggctgtgcacaaggagggaaggtttgctcagcatgtggcttgtcccttctgtggcccatcctgagccaagtctctaatagcacactctcattttcctcttgtcctagagctaatttaagcagcaattgttccccaaattccacacctcaccctcttcattctcattcaagctcatccctaaaaggcctggaaagggaaactctgtgctctctggacatatctcgttcaggctggacaccacaggataacttccatcctggagcatgtggccaggaacaattccacaccccagccccaggcccagcatagagggcagcctcagagaggagcaaccccacctcagccgctgtggggagcaattctgtaggcatccagacatgccagagagagaacaataagataccccacaggcatgggaagtgagggaggccaggagccctcagaggggtgggtacccacccaggcaagtggccaagcgaagagagctcacgccagcatggaacatggtgagcaggagaacccctgtctcccctccgttgcagagctgagtgttgcacagaagttcctgagtaccagatgagactagtgggtatctactgggggacagagaaagcatgcctgtgactctggagagcagagcagatactataggggagacagggctacttaaggctggctttggacgctgactttcaggaggctgctttaaggggttccagggtcttctctgcattgttcagttgagtacccaagaagggtaggagaaaagcagaattcagggcagatgcctgcttggcaatagaatgtccccaggttgtatttcttaaggtacacaggttgtcagttcctgtgacaacaactaaggctacctgcacaggtgcagccgcgtgtagaagagggattcccacagccagaacaagggcaggacaaactgtttattatttactagcactttggagaaggcaaggcgtggatgaggaagctgtattgatcacatcagtagagatagctgcctccttcattcattaccgggaacaagtgtttgagggggcacagacgaggtaaatgcatcagggcctccatgacaactccaatcacagaatctagctacatccttgaattacaatataggagaagctcgtggtgttaaccttctgccatttccaggcatgtaactgaactaatcaaaataaattacttttgtttatgaaatatgaggatcccttccagaaggcaaagtagcagcaggaagaataattctggagtctattttgggttagaatcaccaaccccatctcttcctagttgtgtggccttgaaaaagtaactccgcttttctgaacctctgcttcctcatctgtgcagtggaacagctaataatacccggttagcagggctgttgaggagattcagtttaatgacctctgtacacagcacccagttaaggtcagtctcattccctttctcccacttgagagagttagactccaggaaaagatgaattttaacagttttgcaacacagtccaggaaaaggaagtggggagctcacttgtcctcaagttctactatgtgccactagagagttgtcaccaacaggggccagctttccacatattgcttgcaagccgcccaccacagcaccacaggccctgatgtgaggccgtccgctcacgtttccttctctccaattcttttctaggggcgctgcatcaacttcaccagggtcaagaacaaccagccagccaagtacccactcaacaacgcctaccacacctcctcgccgcctcctgcccccatctacactcccccacctcctgcgccccactgccctcccccgccccccagcgcccctacccctcccatcccgtccccaccttccacccttccccctcctccccaggctccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttttttgtttgtttgttttttgttttttttcttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaatatctcagccacctgcagtgacattgctggacccctgaaaaccattccataggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgtttttttttttattaaagccaaatttgtgttgtatatattcgtattccatgtgttagatggaagcatttcctatccagtgtgaataaaaagaacagttgtagtaaattattataaagccgatgatatttcatggcaggttattctaccaagctgtgcttgttggtttttcccatgactgtattgcttttataaatgtacaaatagttactgaaatgacgagacccttgtttgcacagcattaataagaaccttgataagaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaactcttttttctggttgtctgtttgttataaagtgcaacgtattcaagtcctcaatatcctgatcataataccatgctataggagactgggcaaaacctgtacaatgacaaccctggaagttgcttttttaaaaaaaataataaatttcttaaatcaa

SEQ ID NO: 675 - DNA, 2581 bp, Homo sapiens
gtctccgcgcccggcgctcggcggcgctcggctgtctccggccgatcgctcggcgctcgggtccgcggccgctgcggcgccgggcatttctccgcagctcggctcgcggccgcgcccgccgccgcccggcccgcgcccatgcaggccatcaagtgcgtggtggtcggcgacgggtgagtgcgcggcccggaggccgcttggctgggctgggcgggaggggggctcgggggctcggggcgcagccggggcggggcgggggtggcgcccgggtcctcgcgaggcggccccgccgtaccccgcccgagccgcgtgcgccccggggtcgaggagggcggggtggggcggggcggggtccgcgggcctccagctcgggcccacctgatgctgcccggctcccgcttgggctggctgcgggcgaggcggggccgccgccctgtcctcccagtgggtggggccaggcctctcacctgggctgaaccctcagccggccccaccctctcctgccgccaccctcggagtcggggcctctgcctggggccccagtgtggggcgccctgcgcccttattcaccaccccagcccccggagcccggcctgcccaggtcgtcctccagccttaggtcgccacggatctggtgggctgggtccccctctcgaccccagacgcccctaactcgcctctggctccgggagagggggctgcccttgctgggcagagggtccgaggccgggcccgggagccacgtggcttgccctgtccgcagcgccgtggggaagacatgcttgctgatcagctacacgaccaacgccttccccggagagtacatccccaccgtgtgagtgtgggggcttcccgggagagcacaggccctccgtgtgagtgtggcatgggggggacacgggcagggtctcctctgggcttccacgtcggctcaggtggccctgtctctgggcttcccggctggagctgaggtgctggccagagttctagttctgtgcagacttgtgaaccccaagacacaggccagcagggctgggggtttctgggacccctcccaagccctgaccctgccctcactgctctgcagttttgacaactactctgccaacgtgatggtggacgggaaaccagtcaacttggggctgtgggacacagcgggtcaggaggactacgatcggctgcggccactctcctacccccaaactgtacgtaacaatggggccagccccgggagctgggggggtccctgagatccgcacaagggagggagcagggccctggggagcccctgaccactccaccaggtcccacctttttcccaaggacgtctttctgatctgcttctctctggtgagcccggcctccttcgagaatgttcgtgccaaggtagggcaaggctgggggcccctgtggggagagggcttgccccagtacctgccccgacaagttgtcctttagaggcaattgcgatacgggttctgcctggggtaggcacacggagtggggtctgaagatgaccatgggggctgatggggtgccgtggtggtggtcacagctctcagaatggagggttctgagggctctggctgctggggatgggccttgactaggaggccctgggaggtctccaggttccctggctgcgtgtttgttcctggtatctccccaccaaatccgcccctggtcaccccttgaaggaagaagagccaagtgtagctctggaacagtggggaaagtccctgagggccgtgacttgctcaggtggggctggggtagccgactccgggcctagggatcagagcgtctgtccctgcagtggtacccggaggtgcggcaccactgcccccacacgcccatcctcctggtgggcaccaagctggacctccgcgacgacaaggacaccattgagcggctgcgggacaagaagctggcacccatcacctacccacagggcctggccatggcccgggagattggtgggtaggcgctggcggcctgcaggggaggggtggggaggcgcagtaagggcctccctgtaccccaccctcactgtctcccctcctcactgccgctaggctctgtgaaatacctggagtgctcagccctgacccagcggggcctgaagacagtgtttgacgaggcgatccgcgcggtgctctgcccgcccccagtgaagaagccggggaagaagtgcaccgtcttctagagccctggcccacccgagcctgagggctggcggggagcagccctggacgtgtccgctgttgtgttgagacgtgtggtgtccctgagtcggctgtggggagcggtgggggtgggccggggggaagcatggggatgaggctgggtggcaggatcctgtcctctctgccgcctcattctggggtgtggctccagccttccctggcccccgccggaggccgggagggagcagggtctccctcagggctgcaggggcaggtgcagggaagccccaggatgggcttccctggagggggagggtgggggggagttctgttccttgtgccccgaggtggggcagccccttctcattttatacaataaacattctccacctaca

SEQ ID NO: 676 - DNA, 44482 bp, Homo sapiens
agcttccgtaggagcctttcattccaggaaggtccatcgtacttgcgttttcagggcctgagcgatgactttagcaccagacacctgctcctcgctgcgctctgcgaagttactgtccggcatcttccaccgaaaagctctaagcactcacgcagccggcaaacaagcggaatcatccagcaaggcaaacgcgaaatcggcagcacgccacctctggtactgcacctctgacggacaggagggcaaccaactgccttaaacaacgggaaggaagaggcggtctaaattcgtccacttcccgggagaggtgagaatgtaaacacgcgcgttctccaatcagaactgcgctctcttctcggctcctccattcgcgcgccagaatgccagagggaggcgggactagcaggagattgctgcctatgcaaagcaggtaagaagccgaactctgaggcctctcgccattgtctccgagtcggccagctggagcgttttcggggctgtaaagggagaatggcgcatgcgcatattcagggcggaaggcgcgctaagagcaggtacggagggggcgtggtgcggcgcggagggggtgtggtaagggcgtgcggtccagaccccgccccgggcgcccagttggacttggggagggctgcgcaaaggctgccgggagctgggaagcccggcgcgcgtcgtttgctggggctgtttgtgcgttgctgctgtgctaccgcgttgcgttttctaggcatttacttacacgctttgtggtttacgctctcataaccttgtggttttatagtccttaaattattgtagcgcacgttacttaaatccagaagcagatgtgtaccccagcaagagataaaatgacgctcagagtcagtagatccagaccgtgcctgagatcctgaatcctgtttcctacccactattcagccattgggtcacaagcgatgaaaagagcaccttgaaggtagtatagagcactgttttctccagcccttgctactaatccatattactctccgctaatatctttccaaaattaggaactatggcgtttcataattcttaggttgggtccctacctacaaccagccctgcacccgatagccttttaaaacatttttgtgtgaaaatcgtttgcaatgtgcaatatctgaaactactgccttggagtcattagaccctctgctcagtgacaataaacataaaatttccaattgtaataaacagtggaacttttaattttttgaggatttggagtcattttaagcaaaaagaacagtgataagtggacagtaaagagatgagaggggagtgggtcatgggtagtgaaatgagtgagaagcactggaagtgaaacgatttctaaacccagacattttcaaactgtagtcctgggtcttttcaaaaggtcttcccctctttttctcaacccctcaaccccaccccaagcagaggagagtgaagtggttgcctccctgcatatgtggacggtgttagtccattttcatactgctataaagaaatacccaaaactgggtaatttataaagaaaaagaggtttaatggtctcacagttccaaatggctacggaggcctcacaatcatggcagaaggtgaaggaggagcaaaggcatgtcttacatggtggcaggcaagagagcgtgtgcaggggaactgccctttataaaaccatcagatctcatgagacttactatcattagaacagcatgggaaaaatcccctccccatgattcagttacttcccactgggtccctctcaccacatgtggggattatgggagctataattcaagatgagatttggatgaggacacagccaaactgttctgcccctggcccctcccaaatatcatatcctcacatttcaaaaccaatcatgccttcccaacagtcccccaaagtcttaactcatttcagcattaactcgaaagtccacagtccagagtttcatctgagacaaggcaagtcccttccgcctatgagcctgtaaaatcaaaagcaagctagtggctgggcgcagtggctcacacctgtaatcccagcactttgggaggccgaggcgggcggatcatgaggtcaagagatggagaccatcctggtcaacacggtgaaaccctatctctactaaaaatacaaaaaattaggcgggcatggtggcaggcgcctgtaatcccagctactcaggaggctgaggcaggagaatggtgtgaacccgggaggcagagcttgcagtgagctgagattgggccactgcactccagcctgggggacagatcgagactccgtctcaaaaaaaataataaaattaaatttaaaaataaataaataaaagcaagatagttacttcctagatacaatgggtgcacgggagtgaggtaaatatacccgttccaaatgggagaaattggtcaagacaaaggggctaaagcccccatgcaagttcaaaatctggcagggcagtcaaatattaaagctccaaaatgatctttggatcattttgacttcgtatctcacagccagatcatgctgatgcaagaggtgggctcccacagccttgggcagctctgcccttgtggttttacaggctacaaccccctctcccagctgctttcacaggctaatattgagtgtgtgcagcttttctaggcacatggtgcaagtggtcagtagatctaccattctggggtctggaggacggtggccctcttctcacagttccaccagcagtgccccaggagggactctgtatgggggctcccaccccacatttcccttccacactgccctagcagaggttctctatgagggctctacccctgcaacaagcttctgcctggacatccaggcatttccatacatcctctgaaatctaggcagaggttcccaaacctcaatttttgacttctgtgcacctgcaggctcaacaccatgtggaagctgccaaggcttcaggcttgcactgtctgaagccaggcctgagctgtacattggccctttttagccatggctggcatggctgggatgcaggacaccaagtccctaggctgcaaacagcagggggaccctggacctgacccatgaaaccatttttcctcctaggtttctgggcctgtgatgggagggcctgttgtgaaggtctctgacatgccctggagacattttccccattgtcttggtgattaatagttagcttcttattacctatgcaaatttctgctgccagcttgaatttctccctagaaaatgggtttttattttctactgcatcgtcagtctgcagatttttcaaatttgtatgctctgcttcctctggaacactttgccatttagaaatttcttctgccagataccctaaatcatctctctcaagttcaaagttccacagatctctaggacaggggcaaaatgccactagtctctttgcatagcaagagtgacctttactccaactctgaataagttcctcatctccatcagaaaccacttcagcctgaattttattgtccatatcactatcagcattttggtcaaagccattcaataagtctctaggaggttccaaactttcccacattttcctgtcttctgagccctccaagtctctaggaagttccagactttcccacattttcctatcttcttctgagccctccaaactgttccaacttctgccagttacccagttccaaagttatttccacagtttcggctgtctttacagtagtgccccactctctgcattaccaattttctgtgttagtcccttttcatactgctatgaagaaatactcaaaactgggtaatttataaagaaaaagaggtttaatagattcacagttccacatggctggagagacgtcacaatcatggtggaagatgaaggaggagcaaaggcacgtcttacatggcgacaggcaagagagtgtgtgcagggaaactcccatttataaaaccatcacagcttgagacttatttgctatcacaagaacagcatgggaaaaaccctccccaatgattcagttacctcccaccaggtaccgctcatgatatgtagggattatgggagctataattcaagatgagatttgagtggggacataaccaaaccatatcagggacccatctcagagggtgacttctttcaagtctcagagtgtatctaaaaagaaaatgcagattttgtattatactctagaatgtatccatattttaattttaaaatgacatttattgagatataataaagatacaattcaatgtccagattttaaatgttagatgagttttgacagttatatatatatatatctatgaaatcaccacccaaaataaaaatgacattttaaactgcttacctgtcaagtaaaattgacattccagaaagatgtgaaacgggctgggcacaatggctcatgcctgtaatcccagcactttgggaggccgaggtgggcagatcatctgaggtcaggagttcgaggccagcctggccaatgtggtgaaaccccatctctgctaaaatacaaaaattatccaggtgtggtggcacatgcctgtaatcccagctattcgggagactgaggtgggagaatcgtgtgagccagggaggtagatgttgcagtaaaccaagattgcaccactgtactctagcctgggtgacagagcgagaccctgtctcaaaaaaaaaaaaaaaaaaaaaaaagatgtgaaatcatctttgcactttgagtagtccttgacacaatgcctcctgtccttgttgaagaagtacagacttccccttccatcatgtattatttatatcagtaccttttgtgacagtctctgcccctgttgcattagagtcacttggaaagctttttccaaatagttacttgggccctaccccagatctcctgaatcagcatcttaggacaagtcaggcacctgtattttttaaaagctgctacctgattttgctttgcagcccagagttgagaaccctagctctgttttcatgccagaagcatgagttactaattaaacatatgattgcctgtcaccaaagtaatactgttgattaatttggattgacaggttcaagactgatttgacattgacagaacaagctgtatcgatggtagtcagttcactgggcctacttctgtgtcaaaagaaacagtgacagaaccactcagtatgaagtgcaatgaaaactgaactctgaattggaacaaataactggaattcagttaactggttttgcaaaaggataaatactcaactggttgttttctgccatttaacaaagagaaaaatcattgggattgtttaaacttgctttcacctttgcacctttcagttcaggatgcagtgttcaattgttaacttgggcttgatgattcagcagaaagaaatgatttgagttctggctcactggattaacagggccaaggagcaagtcctttgcaatccaattgtaattacagccagcttgtccaacccttggcccaggatggctttgaatgcggcccaacacaaattcataaactttcttaaaacattatgagatttatgcaccgacccttttttttgttgttgtttttggtttttttttttttttttagctcatcagctatcatttgtgttagtgtattttatgtatggcccaagacaattcttctttttccagtgtggcccagggaagccaaaagattggatacccctgacaggattccaggattcttttgtaatttctcagaggccctctgtgcatactccgtaaggactatccacattctttattactttcattggcaataggtataaaattttatttgttggatattttactgaaatgttacttgtttttgcttatttactgattggtgggaggaagtcaaaggatgaataaatctaacctttttaaaagaaaaggctaaaatactcataacatgctctccaaagagcagagctagtcatcaaagaatctgcataccaattactctatttgtaggttctggatttgagattatgaaaaagagcaaattggtggttttcttctctctgggccagggagatatccaggcaaccaggtaatttagtaagaattgcaaatatagtgcctggagacaatttattctctaaagactgcagcttctacaggcagtaactcttaaagcccccaaattgggatagtgcattttaatttccgtatactaacaaggacactaaaaatccttgtgattattttaaagcataacactagctgaacttgtgattaagtattctcacaaatgtattatcaaaatgtgaaatgtttacttatcaaatgaggaaatgaatcaaggtcatttgtgatacattatagaagctaaaaatgaaattgcctgacataagataaaactgatactgaatatcttaaaaataaaaaggcggaaacaacaaaaaaaggagtctatgtagaacactattttttatagcaatgcaaaaactgtacagccggaaatgtgttgtaggaaatatgtcaacataggaagtaaaataatgtaatgaaaaggttctttgaataaagtgggttaaattgattttctttgcttctcattaaatctgtggacttcagagtaccaaagctcagcaacaggcttgaaacaaacccagtgaaaagcaactttattattgagctgaggattgatatcagtaataactcattaataaaaaagcttgataataaaaactcccagtgcctgatgccagctgacagacactgggagttttcccaggtaccctgtgacctagagaaagcttggattcctgcctttggcttgggctggcaagccctgtgcctttactctacattttaatgccagggagacctggaactggagaagggagtgctgtgggaagaaaacagaaggaatgttgttcccttgttttagctttgtgttcatccattatgggttttgggtttttttgttttttgtgtttttttaagaacatttgagatagtttgacagcagcagtcattacatcactgacgaggacgtttacttgtgtaaaatgcaccaggaaatagtgacaactgtatgttgtgctatgaggatgtaagagatttatctcaaatggcttagaaatcaaaatataggtcagtgcggtggctcacacctgtaatcccaacactttgggaggccaaggcaggcggatcacgaggtcagtagattgacaccatcctggccaacatggtgaaaccccgtctctactaaaaatacaaaaattagctgggcatggtgatgtgcgcctgtaatcccagctaccggggaggctgaggcaggagaaccacttgaacccaggagttggaggttgcagtgagccgagattgcgcccctgcactccagcctggcgacagagcgagactccgtctcaaaaaaaaaaaaaaaaagaaatcatagtatttctccgtatgatggaattccatactcgggggagtgtcccacagggtaggcaagcagctatcacccatgtaatatggtactagtgttgaaatattttctgttttcacttgcttcttctgccattagcattcattacagccctttcctttaactttttaatttgtactttattgctttgttttgataataatctattctccatgtcagcaaaacaaagatttatctctagggaagaatctctgagtgattcccagggtttgggggttgaactggggacatcttcatgatgaacttaagcccttaaacttctttttacatcataacgtttgagttcttctttggagcttagctgtgatttattcttttcacttcaaaaaaaatacatttaacatttatgacatctttcagacacatgaataggatcagagattaatatacacccatgtacccagcccctggcttaagaaatacatcacaaatataatgaaacccccgtgtgtcctttccccattacacctcctttcctgtcctacagaggtaaccactatcttgaatttggtgtttgtagttcccacattatccattctttagatgatcgatatttggtcatttttagtttttttggaaacagtgtgctctgaaattcttgcatgtttccttcttgtgcacatgtgtgagagtttctacatatatatcaaggtggaggtcatcatcatttgatctccaaagtattgtaccaatttatactcccaacatttgtgtatgagagctaccctttctccatagtctcaactgtggagctttaaaaatttttaaatgtgaaatggcttctcagttccatttctctgactacaaatgaggttaagttatatttgtatatatatattggccatgcgtgtttctttttctgtgaattacgtgtttacatctgttgcacatttccttattggattatcttttgctttttgatttgtagatgtcctttatgtattctgaatgctaattatttgtcttttaactttgttaatagtgattttagaggtataaagggtttttttatagtcacatttgacaactggtcttccttattttttttttaatttttttatttttttggtaacttgctaaagaaaactttttgtaacctgaggttatgaagatttttttctatatcaaaaagtgtaaagttttatttttcatatttaagtcactacctggaattgatttttgtttgttgagaagtaagaatccatataatatgtcaattagatttgctgtgtaattaaccaccccaaaacttagtggcttaaaagaaccaccatttatttaacatatattcctatgaggctggtctcaactgggctcacccatgtatctgttagtcagttgccagtgaactgagtcactcagcccctggaggttagctggttgtccactgggatagcgggcatattgccagtgagccacatagctctaccactcagcaggctagctggacttcttcattggatggcagcaggttgcaaaagggaatgagcctcattgtgcaagcctctatgtgcggtgtttgctaacatctcattagccaaagcaagttatgtggctgggctcagactctaagttaaaggcattcgagttacatgataatggaacatggatacagagaggggagaaattgctggccttttttatagtcaatttaccataacatccagttgtccaagcaccattcataatatagttcattctcatcccagtgatacataatttcccctctgtggaatgtcaagctcgcatatttatgggagtatttctgtactctctgttcttttcctatcctaacaccaatcccacactatcttaatttctgtgtttttaaaataagtcttgatgttggtaggacaagtagtccctggacttcattcttttgaagccatcttgtttattatattaattttaagcaactagaggggatggaagaggaacctttagattaaaagagatttaaaagatagggtattttttaatggacaagactaaactacagtgtctagggatgcacattgggtgataaagctattttaaaaaacaaagaagtgatgagtataaaagtcagggtcatggttacttgatccctcatgggtaatgttgtcagatttagaaaaaaaaaaaaaaacaggactccaaaactcccagttgaatttgaactttagatgaacaatgcataattttttttagcgtaagtatgttccaacatatttatctgaaagttaaatttaactgggccacctgtattttacctggaaaaatcctgattttattcaaggtgataatgcagtttacattgcccagccttccttgtagctaggagtggtcacgcgtccacacatgggccaaagcaatttaaataggagtcactgggcagggcttttaggaaagctgatgaaactggcaagtaccctctgtactcttcctctgtacaacatgataattggagttgtagaagtcattttggaaccacaagatgactctgaaaatggaagctacatgccaagaagttaggcccagaaagagagggatcctgggtcctacatgactcttgcctttgtcaggttttattatcagatttttatcacttcataagaaaaaaatgccttcttttactatattctcacacacattgagtagcattaggattattttttcctttatagttagaaagaattcttctagaaactatttgggcctgttttgagggtggagaatgggagggaatgattgtttgataactatttcttctatgattgttggcatggtttagttttttcttttatccgaagttttggtaaaaatatatttttcagtcccagctactctggaggctgaggcacaaggattgcttgaatccaggaggcagaggttgcaatgagctgagattgcaccactgcactccaacctgggtgatggcgtgagacagtctcaaaaaaaaaaaagaaaaaacaaataatgtattttttttctaggaaactactcgtctaaattttctagcttatcaatataggattgaatgaggtgattattcttttttaaaaaaaattcttctgcatttatagatttctctttgttttgtatatttgtttctcttttttttcttaattaggctagccgatcatttgtctttacctttttttttctctaaacaacaactccttggacatacttattcattctgtcatttttctgttttctaatttaatttccactcttatttttatttccttccttttgctttcttgagcatgccattactcttttcctcactgttaccaccttttgttagttttacaatttctacattgccagagttaataacatttgcactgtgttctataaatataatcctcatgtttattttacattcaaggctcttgccagtttttccattcacctcttaattggccgaagattaccctctatgcattttttcaaagaaggctgatgagactgatgagaataatagtccctgagttcttatattttcatacctattatctggtttttttctttacttcaaccataggttggcataatatataatttctggcttatattttattttctggaaggattctataggcttttactggcattgatgttattgtagtaaagtctgaggacagcctgattattttgcccctaataaatacccttgatctttttatttagcttcccaaatgattcttactttatctttgaagatcaagaattttgctaggctatctgccgatgttgatgttctgttcctttctttcttgagttttgctatctcttttcaagctataaattgaaatatgcttttatttctggtgagttttcttcaattacatctttaattttttttttttttgcttcattatatgttgtctattgttgtataaaaatttaccctacgacctattcagcagcttaaaacaagacccatttattatctcaaagtctctatgtgtcaggagtctgagcatagttttactggatcctctggtcagcatctcacaaggctacagtgaagttgtcagctgacctcatggtctcatctgaggctgagttttcttccaaattcaactgatcgttgaaagaatgaatttccttgcagttgtagtattcatggtggcttgcttcttcaaggtcagccggggagagagtgtgtctgaaatcttggagcaccccagttctttttttaaagacctgattaattcagacccaccagggtaatctcttttgattaactagattaactggcttgggattttaactacatatgtgaaagcccttcacctttgtcatattctattggctagtaacagagtacaatttccacctgcactcaagaaaagaggattatacaaggagtcaccttagggtgtgtccaccacacattatttttttcttttatgcattttccaattatgcatatgatggatctcgttcactgttctccctgtctatcattttctgtggactccttttcaattctgtatttccattcatgttgcttatttatttacagcatcatctgatttcttttgctgcttctatctttgccataatttcttgatgttttaattttttcttctgcttctttcctgagccctgccagataatatttcatctgtctcccagctttctattccccactcccttctcccttctctcttcttccctcttccccctccttaccttctcctcttctcctcctttcctccccttctcccctttttccctttcatcttttaattctcttggtctattttgtgcttttatttaatataagcagttttttttcactcgtggcagaatgttttgtcacagtttttatttgtgttgtggcaattttctggggtataacctttgttttcgtatagtatctttcaaaagatcttgagctttttatttactcatttttgagtgagtttttcctctactgtaggaggtttatgtgtgaacaaggccattctggttcacagttattttttcttagcacatttaagattttgttttcttacttctattgttactcttgaaaagtctgctgttttcaaatcaccatatctttgaaggcaatctctcttccctctggttgcgtctaagatttttttcttcttcaaatatttcgtgttctggtttctttatgttgtgtatagatttctttttggttgtcttgaatctatggatttctgtattttattattaaaattctcacctattataccttcaaacatgtgtaatgtgtcatgtgtcattttatgtattttctccctctttctttctttcttttttttttttttttaagtcaaggtcttgctctgtcgcccaagctggagtacagtggcacagccgtagcccactgcagccttaaactcctgggctcaagcaatcctaccacctcagcctcttgagatgctgggaccgcaggtgtacaccaccatgcccagctaatacttttttactttttgtagagattatattgcccaggctggtcttgaattcctggcctcaagtgatcctctcatcttgacctccaaagtgttgggattacaggcatgagccattgcacccagcctctattttctccttctgaaattccaattagaaatatcatggaacatcatatatgtcttccatgtctcatcttctttttttcccttttgtcatctctgtggtacattctaaacaaattttttaatgattctaacggccatgccacaaaatgtctccatttggttttatttgacaatatctttttctttttttttttttttttgacacagagtctctctctattacccaggctagagtgtagtggtgtgatcttagctcactgccacctccgcctctgagctcaagcaatcgccctaccttagccacccaagtagctgggactacaggcatgcaccaccacacacagctaatttttgtattttttgtagagatggggttttgccatgttgcccatgctggcctccaactcctgggctcaagttatcttcctgccttggccttccaaagtgctgggattacaggcatgagccaccactcccagccaacaatatcttattcttttacctgttttagagtcctctgagtacttctttaatcaacttcagtgtacttatttgaaaattttcactagtaatccttccatctgaagttgttgggggcctgattttgctgtattctttaactttcttgcataatatttgcttccttgtgtgttttgtaattttgaattttgagctcttgtttaccttgttcttcaacccaggacactcagtcttcaagaagagagtatgtggataggcttttccaggcatcttaggactgataacatctcaaaatcactttgtgctcatttcttggcatagagttacctgggtcatgtatgttgtgagtttttgaatcatgaacccacataaggaaaacctttgattatgttggttatgactttcaaggagtactattttcccctgctcagagcccaagatgagatgtacaagtttctacgtcagatagttactttggcaggcaggcagatatttgtttttgtccatcctttcaataaaggaatcattccttaaggttcctagctatatgcacagatctcactccaacctccacatcttgtctttctgtccttcatggtctttaaaatctaaaccccttggatatcaagattgggacatgttccagtatcacctcaccactccagttttcagttacttgattttagtttttattttttaaatgctttttttaaaagagaagttttatgctcacaataaaattgagcagaaagtacagaaagtttacatatactccctgtcctgatacatgcatagccttccctgttatcaatatcccagactagaatggtatgtttgttataatcagtgaacctgcattgacacattattataacatgaagtccatagtttacattaggattcacttctttctcccttaacacttggcaaccactgatcattttaccatctctgcaattttgctttttccaccactggaaatgttacatattggaatcatacagtatgtagcctttacagattggtttctttcctttagtaatatacatctaaggttcctccatatcttttcatggcttgatagctcatttctttttagcactgaataatattccattgtctgaatgtatcacactttattaatccattcacctactgaagaatatcttgattgcttccaagttttggtaactatgaaaaaaactgctataaacactcctgtgcagtttttttggagacataagttttctactcctttgggtaaatacaaagaatacgattgctgaatcatatgataagagtatgcttcattttgtaagaaaatgccaagctgtcttccaaagtggttggatcattttgtgttcccatcagcaatgaatcagacttcctgttgctctatattctcaacagcatttggtctttttaaaaattgttttgggccgggcgcggtggctcacacctgtaatcccggcaattttgggaggccgaggtgggtggatcacctgaggtcaggagtttgagacaagcctgaccaaaatagagaaaccctgtctctactaaaaatacaaaaattagccggtcgtggtggcaggcgcctgtaatcccagctactcgggtggctgaggcaggagaatttcttgaacctgggaggtggaggttgcagtgagccaagatcgcaccattgtactccagcataggggacaagagcgagacttcatcttcaaaaaaaaaaagttttgtttttttcctttcaccaaactaagcatttagtcttgtcagtgttttggattttgactattctaataggtgcatagtggtatctaatttttaatttgcaattcccttgtgacatatgatgctgaacatcttttcataagtttattgctatttgtgtatcttccttggtgagatgtctgttcagatcttttgcttattttattttatttatgtatttttttttcgagtctcactctgtcacccaggctggagtgcagtggtgcaatctcggctcactgcaacctccgcctcctgggttaaagcaattctcctgcctcagcctcccgagtagctgggactacaggcacgagccaccacacccagctaattttttgtatttttagtagagacgggggtttcactatgttggctaggatggtcttaacctcttgacctcgtgatctgcctgccttggcctcccaaagtgctgggattataggcatgagccaccatgcccggccttttgcctattttttaatcaagttgtttactttcttattgttgagttttaacagttctttgatattttggataacattcctttatctgataaatcttttgcaaatattttctctcagtctgtagcttatcttcttctgttcttgatagtttcatttgcagatcaaaagttttacatttagtgaagtgcagtgtatcaattctttcttttttgtccaacacaagatcatctagctattctcctatgttatcttttaagagttttatagttttgtactttatatttagatctatgatctgttttgagttacttcttgtgaagggtataagatctttatctagatttgttttttacatgtgggtgtccatttgttccagcaccatttgttgaaaagactgtctttgctccatcacattgcctttgctcctttgtcaaagatgagttaactatagcctggtgtgcagtggtacacacttgtagtcccagctgctcagtagagttcaatagttttctttaggaggctgaggtagaagaattgcttgagcctaggaatttgagtccagcctaggcaacatagcgagacctcatttgtaaaataaataaataaataagaccagttgactgtatttatgtgggtctatttctggattctctattctgttccatctatttgtctgttctttggccaattgataaaatatcatgttgtcttgattactacagttttataatgtcttgaagttggtagtgtgagttttctgacttcattcttcttcaatattgtattggccattcttggtcttttacctctccatgtacaatttatttttatgtatttatctagagacaggtctcgctctgtcatccaggctggaatgcagtggcgtgatcatagctcactataaccttgaactcctgggatcaagtgatcttcccacttccatctgctgaatagccaggactataggcacacaccgccttgcccagctaacttaattttatttttaattttgtagagaatggggtctctctattttgcccaggctggtggtctcaaactcctggcctcaaatgatcctcctgccttggcctcttaaagtgctgagcttacaggcataagccactgctccatatgcagtttagaatcagtttgttgatacctacaaaataacttgttgggatttcagttgggattgtgttgaatctatagatcaagttgttcgcaagaactgacatcttaacgatattgagtctctgcatttatttagtgctgctttgatttctttcaacagagttttgtagttttttcatgcagaccttaaacatttttaaaagatttatacctaaatatttcatatgtagggtacgaatataaatagtattatggtttttaaaatttttttcttttttatttttttgagtctcactctgtcacccaggctagagtgcagtggtgcgatctcggctcactgcaagctccacctcccgggttcacgccattctcctgcctcagcctcccgagtagctgggactacagacgcctgccaccacacctggctaatgttttgtatttttcatagagatggggtttcaccatgttagccaggatggtctcaatctcctgacctcgtgatccacctgcctcagcctcccaaagtgctgggattacaggcgtgagccactgtgcccagccaatagtattatgttttaaatttaaaagtccactgttttttgctgatatatgagaaataaattgatgtttgcatatgaaccttgtatcctacaacattggtataataacttattagttccagatattttttattaattcattccaattttctacatcgatgacaatttcatctgtgaacaaaggcggttttatttcttctttcccagtttgtgtatcttttctttgctttttgcattagctaggacttacggtatgatgttgaaaagcagtggtgagaagggacatcattaccttgctcccgatctttgtataaagtctctagtttctcaccactaactgtgatgttagctgtaggtggttttttaaatcaagttgagcaagttcccctctattcgtagtttactgagagttattatcattccaaatgggtattgtacttcgtcaaatacatctatttgacatctatttttctgtgtctattgatataatcatgtgatttttcttttctttttttgagacagggtatcactctgtcacaccagctggagtgcagtggtacaaacacagctcactgcagcctccacctcctaggccatgtgatctttcttatttagcctgttaatgtgatagattacataaattgattttcaaatattgaaccaacctttcatacctgagataaatctcacttagtcatggtgtataatttcttctatggattgttagattcaatttgctaatatttgttggtgtaaaagtcattgtggtttttgccattgaaagtaatggcaaatgacttttgcaccaacctaaggattttgctaaggattattgcatctatatttatgagagatattgctctgtagttgtattagtctgaattctctagggagatactgggagaacccacccccaatatttcaacgtaagttctattttccataagtgtcagctggctgagaaataaagagagacagtacaaagagaggaattttacagctgggccgccaggggtgacatcacatatcagcaggaccatgatgcctgcctgagtctcagaccagcaagtttttattaagggtttcaaaaggggagggagtgtaagaacagagagtagatacaaagatcacatgcttcaaagggcaaaaagcagaaccactgataagggtctaacaaagatcacatgcttctgagggaacagggcaaagggcaaaagcagaaccactgataagggtccaacaaagatcacagggcaaagggcaaaagcagaaccactgataatggtctatgttcagcggtgcacatattgtcttgataaacatcttaaacaacagaaaacagggttcaagagcagagaaccagtctgaccacggatttaccagggctgagttttcccaaccctagcaagcctgagggttctgcaggagactaggacttatctcaatccttacctcaactgcacaagacagacattcccagaacggccgtttatagacctccccccaggagcgcattcctttcccagggtattaatattaatattccttgctaggaaaagaatttagcgatatgtttcctacttgcacatccatttataggctctctgcaagaagaaaaatgtggctcttttagcccaaccccacaggcagtcagaccttatggttgtcttcccttgttccataaaaatcgctattattctgttctttttcaaggtgcactgatttcatatttttcaactacacatgttttacaatcaatttgtacagttagcacaattatcacagtggtcctgaggtgacatacatcttcagcctacgaagataacaggattaagagattaaagacaggcataagaaattataaaagtgttatttgagaactgataaatgtccatattaagatgaaatcttcacaatttatgttcctctgccgcagctccagctggtccctccattcagggtccctgacttcccataacagggagacagtgccaatgggatatatatagagagatatacgaaagagatttattagaggaattggctcacacaattatggaggctgaaaagtccaataacaggccatctgcaagctggagaccctggaatgtcaatggcataactcagtccaaggccgaaggcctgagaacccagggggctgctggtgcaagtcctggagtccacaggccagggagttctaacacgcaagggcaggagaggaagggtatatcccagctcctgcagataaatcaacacacttgctttttctgttttcgttctctcttgtctcttggcttattagatggtgcctgcccacattgtgagggtggctcatctttacctagtgcacttagactcacacactcatctcctcatgctgatcacaagcacatccaaaagtaacattttaccaggtttctacagtgttccttaatccattcaagttgacacctaaaattaatcctcacagtagttttcttttcttgtaatgtctttgtctgtttcagtattggggtaatgctgccctcatggaatgagttaagaagtattccctctgtttctgtcttctggaagacatagtagagaattggtataatttatttctgaatgtttggtagaattcaccaatgaacccacctggactgggtgatctctgttttaaaatattttgaattattgattcaatttctctaatacatataggcctcttcagattgtctgtttttcttgtgtgagttttagtaaattctgtcttttaagaaattggttatcattttcttttttttttcctttgagatggagtttcgctcttgttgcccaggctggagtgcaatggtgcgatcttggctcactgcaacctctgcctccctggttcaagcaattctcctgcctcagcctcctgagtagctggaattacaggtgcccaccaccacgcctggctaatttttgtatttttagtagagatggggtttcaccatgttggccaggctggtctcaaactcctgacctcaggtgatccacctgtctcagcctcccaaagtgctgggattacaggcgtgagtcactgtgcccggacatcagtttcttaaattgacatctaggttatcaaattttggggcataaagttgtttataatattcctttattattctttcggtgtccatgggatctgtagttatgtgccctctttcattgctcatgtcagtaatatgtgtcttctctatttttttttcttagcctggctagaggcttattgatttttcttgatcttttcaaagaaccagaatttagtttcatttttctctattgatctcctgctttacatttcattgatttctattctagtgtttattatttctgtcattcttcttactttggaattaagttgctcttctttttctagtttcttgaagtaaaactttagactactgatcttatatcttaattcttttgtacatttctcttgagatttcttttctgacccatttgttatttaaaactgtgcagttttatttccaagtattttgggtatttcttgctaaatttatgttattgatttttagtttaattctactgtggtctgagagcagatattgtattatttctactcttttaaatctgttaagttgtgttttatggctcacagtgtgttttgtcatggtaaatgttccatgtgagcttgagaagagtctgtactttgctgttattagatgaagtagtctatagatgtcccttgtatacagttgattgatggtgctactgaattcaactatgtccttactgattttctgcattctggattttatccattactgatagaggggtgttgaagtttacagttataatagtggatacatctgtttctctttgcagttctgtccatttttgcctcatgtattttgatgttccattgttggcacaatgcacattaaggatttttatttcttgttgaattaacccctttatcattttgtgacccactttttaatcctgataactttccttggtctaaagtcagctctgtctgaaatttatgtagctattcttgctttctcttaatgactatgttagtctgttttcatgctgttaataaagacatacctgagactgggtaatttataaaggaaagaggtttaatggactcacagttccacatggctggggaggcttcacaatcatggcagaaggcaaatgaggagcaaaggcatgtcttacatggtagcagacaagagtttgtgcagaggagcttccatttataaaaccatcagatttcatgagacttattcactaccatgagaacagtatgtgggaaaccactcccatgattcaattatctccacctggctccacctttgatacatggggattactacaattcaaggtgaaatttgggtggagacacagccaaaccatatcagttactattaggatggtatgtccatccatttactacacaatctacatgtgtctttataaagtgggtttcttgtagacaacatatagttgagtcatgttttttatctactgtaatgatctcttgtttcgaattgatatatttataccattgacttttaaagtgattattgatatagttggattattatctatcatatttgttacttttttctacttgctgcctttgttcgtagttcctgtttttgtcttccagtctttttctgagttttggtgttttaattgaacattttatgtgattttgtcacatgattttgtctgaaagtatcttatttctctgcttttgaaggttaattttgtaggatgtttatatggtttggctctgtgttcccacccaaatctcatgttgagttgtgtggcctggtgggaggtgattggatcatgtggatggtttctaacagtttagcaccatccctctagtgttgtgtcatgatagagttctcatgagatctggttgtttaaaagcgtgtagcacttcccacttagctctctccatcttctgccaccatgtgaagatgtgcttgcttcccctttgcccttctgccgtgattctaagtttcctgaggcttcccagccatgcttcttgtacagcctgtggaactgtgagtcagttaaaccccttttcttcataaattacccagcttcaggtagttctttatagcagtgtgagaatggactaatacagacgcacaatgctaggctggtacttttttcctctcaacactttaaatatttcacatcactgtcttattgtttacatgatttctgagaagtcagatatctttcttatctttgctcctctatagataagatgttttttccctctggcttctttcaggattttttctttatctttgcttttctgtaatttgaatatgatttgcctacatgtagatttttttattttttattttcgtttttggcagttaacctgattggtgttctctgagcttcctgggtctgtggtttagtgtctgatattaatctggggaaattctcagtcattattgcctcagatattgcttctattctttctccttctggtattcccattgtacatatttataacttttgtagtccactgtttgttgatttttttctttttttcagtcttttttctctttgcttttcagttttgggcatttctattgtcatattctcaagctcagggattccttcctcagccatgtccaatctactaatgaatccattaaagtgattcttcatttctgttagtgttttttaatctcaggcatttctttttttattctttcttagaatttccatctccctgcttagattacccatctgttcttgcatgttggctgttgttttttttttcagtagagcctgtggcatattcatcatatttattttaaattgctagtctgataattacaacatccctgccatatctgactctggttcttctgggaggttttttgagacaaagtctccctctgtcacctccctctgtcactgctggagtgcagtggtgtgataacagctcactgcaacctccgcctcctgggttccagcatttctcgtgcctcagcctcccaagtagctgggactataggcgtgtgccaccaagcctggccaatttttgtatttttagtaaagacagggttttgccatgttggccaggctggtcttgaactcctggccttaagctccttagcctccctaagtgctgggattacagccatgagccaccgcacctggcctaactctggttctgatgcctgctctgttttcaaactcaattttttaccttttagtataccttgtaattttttgttggaagttggactcgatgtactaagtaaaggaacagcagtaaaaaggcatttaattgaaatgtggtgggagggaatgtgttctattgtctttagggatctttagggagcctgtgtttatggactgtgaactttacaagtgcttctcagcccccaaccccactcaggcgggacagaatggggctagagttgggtatttcccttcccccaggtcagttaagctttgataaaaccccaataggtaaaaatagtttctctggaggagaggcctgctaaagaccagaatgctttgtttcctttccctcttcctctggcagaagcatgggaggatttttttctccagtcttcattgtgagaacctggtagaactcctagaggtaaaacctacaaaagtgcgggtgcctccatctaagactgggtccctctggagttgttttttgtttgtttgtttgttttgttttgttttttctgtttgttttgagacggagtctcactctcatgccaggctggagtgcagtggtgcgatctcggctcactgcaatctccacctcccgggttcaagcaattctcctgtctcggcctcccaagtagctgggactacaggcacccgccccctcgcccagctaattttttgtatttttagtagagatggggtttcaccgtgttagccaggatggtctcgatctcttgacctcgtgatctgcctgcctcggcctcccaaagtgctgggattacaggcgtgagccaccacgcctggcccagttttaattttttattttgcatataagttcaaagccttccaaagtgtttgtttatgatttattttcttgttaaaatctgttcttgttcattgcctgtttataagtgttgtcttgatgtttattttttgcatgtacattttaatttgtcaatctgtttcttcttttatttcaactgttccaaattttagaaagttgtttcaagtatctgatacctaattctaatttatgctagcttttctaacatttgatattcaacttctgattttgagtttatttttgtgtatggcctaagatgctattattcctgttgttattcatccatcccagtatcatattcaatcaacctcccccaccaccaccactattttgagtgtggttgcattaaaaagcatgtgggcttttggtcagaatagatttgggtgaaatcctggctatgggtagcagtctccttctactttaagagtaacttcttcacaaaaggagctagatgatcctctgctttgcctctaatgctgaggaatgttgcacctacaactatcatggaagacgctgaaacctccattacccaatcctgtactcccagcaccctcagggagccccacctctggaggactcagacactcatgccaggtaaagctgtaggacagaggccaggcatggtggctcacagctgtaatcccagcactttaggtgagaggattgcttcaggcctggagtcgagactagcctgagtcacatagcaagaccccatctctacaaaaaattaaaaaattagtcacacatggtagcatgcacctgtagtcccagctacttgagaggctgttggggagggatcacttgagcctaggagtttgaggctgctgtgagctatgtatgatcatgccactgtactccagcctgggcaacagagcaagaccctgtctcaaaaaaaaaaaaaaagaaaagaaaagaaaaagaagctataggacataggggagctagtcatatgtctgtcctactgagactctagatggcacaaggcaatggcacttgtgttagaaccagaatgcagctatggctgacttggaaccgtctgtcagaggaaaaaaggcatgcaaatagttactcatttgaccaaagcagaagaaaaccaaaatgtccaatgcctccaggaagaaaggcaaagatagagatactaatcatttctctacacatctgccatgccatgggtgaagaagacagccaagttggtgaacagatctggaaaggttaccatcattcttgattgagctctgccctccaaccgaacacccctgagcagccacggcatgccggctcaccgtgcttcccaccacgcatggatcaagagcacctccacaggttctcagaagctacggcaccaggacccatttgcctgctttttgctgttcctcttaagacagggtcctgcaatcacagctcaccgcaacccctgcctcccaggctcaagtgatgctcccatctcatccttccgagtagctaggactacaagtgcatgccaccatgcccagctaattaaaaaaatttttttttggtagagacagtgtttctccatgttgcccaggctagtttcaacctcctgggctcaagcaatcctcctgcctcaccctcccaaagtgttgggattacaggcattagttactgtgcctggcctctcttggtaattttgactatgccactcctaaatatatgcctcttggcctctgcatgagagaaggtggcctttgatgtgttatttccagcactgtggtttactttagctttttaaattgtttctttcataatttctactatcatccagcgtcagtgtttctagcctatcctattaagggttattcttttgttttgttttgttttgttttttgagatggagtttcgctcttattgcccaggctggagtgcaatggcacgatctcggctcactgcaatctctgcctccgaggttcaagctattctcttgcttcagcctcccaagtagctgggattacagtgcctgccaccacgcctggctaattttttgtgcttttagtagagttggggtttcaccatgttggctaggctggtcttgaactcctgacctcaggtgatctacccaccttggcctcccaaagtgctgggattacaggcatgagccaccatgcccagccccaagggttattcttttgatttggggaacagggttccttggccctattacccaccacattgttctccactctttgcatcctgagcatctccatctgcatttttcactcctgagtactggcagagatgagcacaagggtaatgggacttgatgtagtgacattgtatccaccacatgcttagagaggttacatccaccacaagcttagagattctgtatccaccacaggcttagagaggttgtatccatcatacagttatgttgcatccaccatacatctagagatgttgtgtgcactatacaatcagcaatattgtgtccatcatacatttaataatcacaaagccattacatggcccacatttctgagcacatcttccctgaaaattttgacacgtagttctaggacatcacattttccatgcactggttctttttcttctggatgtcaagccctcaggtccacattatctagaaggtgttctttaaggtagtccaagaaggaaatgggtaagaaatttcccaaaggcttttaaaagcaataccttgctgacactcattgaaactcatttcagagaatttgacgatggtttttggaagccataagcattccagaagaacagagtagctagaagtgcccccaccattcatgtgtcccaggactgactgacagtggaaaagctttatgtgtgtgtattttccttgctgcctggtcaaggtctccaatcaatagtttaagactttttcacagttcattttcgaccaccgaagatttcctttaactttcctgcaaactcaaatatgcatttaaaaataatctgtttcatttttgcaggatatggttgaaacatttttcagattatctagtctaccatattgccccccacctttttttaaatcaggaattttatttaagtaaaaaccaataacaacctggttcttcaatggtattcctgccatagctaagacaagcactgagtcctttaactgacctgcatcaaattgtttaggggagatttttccttctagtttgagtgtttaatgctttctttgctgcttattttcattaaatatggtagaaatactttgaaatctgcccagattccatcagccctattggagaggcacctgagaaatgaagatgatgtttctgactcataactttctttgacataagggaacaataggagtcagaatataggatatacattcctctatcttctactcaattggttctccaagtgtgactcagaccaggagcatcagcatcaccttggaatttgccataaaatgcagattctcagaccctattccatacctactcaatcaaaacttccaggcatgggctccagagatctgtgtgttcaagccttcaggtgactctgatggcgtgcttacatttgagaccctctgctctggtctgatcacccagaatctcccttgggagagctaccttgaaatttctgcttatttcccctgcagcgtattgaagactccacggtggttgttttgttttgttttgagatggaatctcactctgtcacccaggctggagtgcaatggtgcgatttgggctcactgcaacctccgccgcccgagttcaagcgattctcctgcctcagcctcccggagtagctgggattacagacacgtgccaccatgcccggcaaactttttgtatttttagtacagacagggtttcacctccgcagtggtcattaaagcttgaccactaaattgccctggttcttcaacatgcactaggcaggctggaccagaagccaggagacctggctcccagtctcattatcattactaaccagtcctggagttttccctcaccatgaagatggaatttttaccatctgctttctctgctttgtgtggcaggaagataaaaaaataataataatggatattcaaacggtttatattgcatgtaaaatgcaatgtggcattgattgtagatcccttaattcagacagatttccccacgcagacgctgtgtgtcacagggggaatgggcagcgtcactttttacatccagtcatattgtatgaaattgcaacaaattcaaaaagatgccatcgtgggagtgtggtgagtaaaaaacagctttcatgaaactcaaatcttgaaagtcagatgctttctgggtcttgtttaactgtaaaagagatagatgaagtattagaaatggagaaggaaaggggggaaaagccatccatttactgcttaagaatggctctgctattgcgatacctaaggtcacatgcgtagccacttgggttaatgatactcagtttgtccacggagtggcagtagcaactgtctgagaatcagtctcagccggggttccttctgtctatagaaagtgaaagacagactgttattcaaattccatgtgcaaaaaagccttcttacattaaatacctgggcatttcaggaagaagttttatttgacttaaactgtgaaggcagtttctcatttgaggaaaagaaagatataacgtgtttcagttgaaatgtcaagatcctttgattgcacatttggtttcctaggataaattattctagccaatggagcagaaactggctaatcaaaggcacagtgcacagttacacttctgtatatcattctctttttttaaaataatagctggaattttttttgaaagtgaaattacaatttaccacctcaactcagaggacatattagcttgataacttattcacagttgctggtgagttcaggcttaaatcatcagctgtcactcacaagtgtttacccttgaactttccgaatgagacatcaaacgtcttggtagtgggtgggtttaaacaaagctgcccacgcgagaaccattgtggagcttcttgttccaggggccggtcacggacaagctcatgaccagcacactcagatgtgacaatcagataacaagaggcaagagaagactttctgggaaataaaagatcatttttgtgatttctttaaattcagatcatataaattaggtgaagatagacattatttctcctgtttatgtaaaagaatttagacaatgaagtcacgaaattcatgagaataatttaaagactgttggaacttcccaatgtttttcttggcattcagtcactacacatagaaatgtatactatgccggttcctaatgacttagcagttccctcaggctttgttccacaggatgtgacatctcctctgccaacttttcctgcctcctttcctaatcataggattgctattctccctgacaagtaaagaatgacaagatattttattaaaaagatgttttatttatcttttaaagattttttaatgtatgtatctgcctctgaaattattaagaatgccttaataataatccctctcattttatttcagaagacactattgtaatagcatggctaggaaggaaacacagctaattattaagatgaatcatttagcaaggtggggaaaaatcccttgtgtgtaaaaatatctagtgattgacatattaccaaatttacatgaaatagatttccatgtaattgagactgatttttcctattagatggaaagaaccttcctgatcaggactggtgttgggggaatgttttccttatgaaatcagaagcagagcttctgtagggccgtccaagatcaggatgcttacttcaagatgccactctgcatctctccccacctgccaagtgtttcctgtctcccagatgctttctattggcttattgtaaggactttgacttctgcgctacgtgaactggggagtcactggaagagtttcagaggtgcaccttggtagactcaggctttctctggatctcactggctgctcttatgagtccagaatggaagaggatgaggacaaatgcagggggatgttaggagaccactaagcaggtccctgtcatttctctctctgtgattccttttgctgccactttctccttgtccccttggctccagccccctgctgtccttgctgtttcttgcacccgcccgtgaggcatgctcctgcctcaggctctctgcctgccgtgctctcacctcgcagacccacgtgatttcctcccgaacccccttcaggcctcggtccaaacatcaccctctcatcgaggtcttccttgaccacactgcttaaaattgtccccctcgcctcaccttaccaccttcactgcctcatttctcctttgtgcttaatcaccatctcacacagttatccagagcacgagccccacgaggaagggtctgtcttgtccactgttggacccctgacacctaacccctggggctggcccacagttgggaattgcatggctgtctgaagccagcaccttcctggttctgctgttccctggaagtggggttcagtacaccccacgagccaaggccctcatctcagagggcgtgcacatggttgcctcaattgtgctttcacactggacccttcctgcagtttactctcctatgtcagatgcccttcaatgaaagcaagtacattgccaccttgtcacacctctagttaccattttctttatggtccaggtcctgaccagctctaaagatgggtcagctgctgtatttccaagaaccccatgacttccagggccccttgttcccaggaaggccccgcaccccagtcgtcccgtgcataacctcacgggccagcacctggtagctgctggaaggcttctgggggatgcctgggcccctccagccctacctctagtcctgccactttacaactgagcacctcccgctgctgcctgctgaacccttcagagtccttgccacaggccctatttactttttcctgagaaggtatgtgtgatgccaaagagagaaaagcagcatttgctaatttgggtaaaatgtttctttgggaagggcaaattgatgtacagttgtccctcagtatctgttgggactggttccaggaccccgtggataccgaaaccctcagatgctcaagtcccttatatcaaatggtgtagaatttacatgtaacctaaacacttcctcctgtacactttaaatcatctctagatcccttacactacctaatacaaactaaatgctatataaataattgttatactgtattttttaaattgctattattttttattgttgtgctattatttttattgggctccctcctccccctcccaccccagtaatttcaatccaaggttggtggaatccatggatgcagaaacaatggatactgagggccggctgactagacctatttttattgtaattactcattctcttctacctcattaagcttggttctttcaagcatgaatacctggttgaatctgcataacctcttattatcgacctacctttgttcacacacaaatgattgccacttagagctctcctaccgggctccttttgtaaaataaattttatcttctccagatagaaagaaatgtgataccttgcggattttgcggtttccttgttttgctggattgcaagtcctttagacataaacaaatgttctgtaccccgacatcggtggtacccagctctcagttgagaaagagatgtaatgtgaatgccactcttggccccaggcactcctcacttgcccccactggggactggttcataccctcctctcctggcctcagtttccatacctcttagtgaggcctttgcgttatacttcagaaatattgtcagtatgactttgaagatgaaagtttgcccccaaaatcactctctgttatcattgtgaaaccagagatggaatggaaaaatgggtttctgagacattttaaattattccttgcttgtctttagaggcaaaattcagataagaaagcttatcaattatacttttgtttctactcaaaaactcatgactgctcactcaaagactccttgttcttatcttaaaacattgtttacagtgtcccagatgaatggcaacaaatcctggggtttggtgtttggatggtacatttccctggggaaagaaataacagtttgagatggaaccgggttggggtgggagaatacttctcattctgaggaatatttaattttgccaagatgagcatttctagttcttagtctgttgacgaaaagagctatggtttgtttctggaacttttgataaaaaataaagaaatttgtagcctggggagtttggttttaaaatgcaaacacaggagttatgagttgagacttggacagggtgtcattttctttttaaagggcagcaatatgattctttgatttgtctttgttatcttgacttttaatccggattcctgggcagttgttcagccccaggacatctccatgggcaggtggcctggccttggcacactacccagtaaatctctgcctgagaggacgctttagctgggaggccaggctgatttttaaaggcagaattggactatttactctaaaacagtaatgcacactgtttagaaagaaacattcctattctgggaggaaggaggagacacacagaagtatcatttatttctagtcttttctggtagaagctatgaagctgagtttactctctggaaatttgtagtttattttctagaaaattgcattttatcactgcaaaaaggattttatttccaaatgagtaggcttttgagcaagagttttggagtcacagagatggggttaagaaagtgataatgtgcaatggcgattctcaagttcaaggagaaaaaataacatgcttttattgggatactttgcttgtctataaaagaaagtagctattggcatttatgtagaagtcagcagtttcttggcaccaaataaataattttgtgctgaataaagggagagttatccatagtatttattactaaccaaagaaatgcagggagaattgtaattcattaggttttgatggccaggaaagccaagctgtgttattagggtcatgacaatcacagacattacggatggctgacctgtagtatggatagagggcagagggtagagtgtgaaatatatcacagaattatgtcaaataatctggatagttactactgcttaaaatctaagtgcacagctagaaaagtgggtagtgacgcactacagtcttgctgaacactgggtaagaaaatcatagcaaacgttgagtctgttttggaaatgttctaaaaccagactattaacacagtgagccattttaaatgtggcttgctacgtgtttggagagaaacacatactcttttattaggaacatgaaacaaactctttgagccgcagtatcactgcgagtgagtttaattgctgggattaataaatcacagctgcaaacgttaaattcttggcaggattctttattcagctgttttccccttgccccattacattccagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggcaagaatgctcctcggaacctgagtttctctcatacagagcagattgctctttaccccttgatcagtggttgggtaatcccaggcttcctaccaccctctgaaaaagcatccaggtagttaacctgagttgagttagtcagttgaattaggagccttacccctcagagagtggtccgtggaccggcatcccctgggagcttgttagaaatacaaaatcttgggcggcaccccagacctactgaatcagaatgtgcattgcagcaggatccccaggtgatgctttcacatggcaagtatgagaagcccaggactagatccccagttctcaagtgtggttgtacataagaatcacgaggtaagtggtaaacactatggctgcccgggtcctggagagtccgttgtaattggtgtggaaggggtgtggactggcactgggattgttttaaggctccccagtgcagtctaatgtgcagaaaaatttgaagatgactgggcgtgatgacctctctgagtcattcgaagcttcactgaagtagtaagcatctgcaagaatgccgtttgctcccttcagactgtttgaggctcgtttccggtctctatgtcggactacgatcagtctgagaccttcgcccagatagaactgaccccaaactgacaaagggaaggtcagtgccagcctttgtgaaggcttcctggttggcctgaatttcctgctcccttcaggaagggtggggacaaaggagaggcccccctgggggcaaagagggaaatatcagaggttgcctaagaaaatgccctgctggaaaacacaaacccgaagggaagtttgggctgtaactctggtggcagggtgaccaagcgcagctgcttgaggaagccctgctgtgcctcaacaggatgtaaactcattgtgagcaacactttcctgctctctgtgaacttaaagggcagaaccagcaggtcctgccccaaacagtccctgccttagagcagggtggtcgggatggcctggacagccacagcaattaaaaaattgcaacattttaaaattttagtctataatatatatacaaaggctatgtgtatggggtgggggggtgtttgggggcagggggtgtgtatgtgtgtataacatgatgttgaaagggaacttgaagacttggtccagcttcttttttttcaaccaagacaacttttgcaagggtgacacttttctttagtcccaacctgacatacggtttctccttgaacaccttcagtggctcagactcacaggtccgtttgttccaatggtgggaacttctgaacaggtcttcctttcaatgagcagcagtcagcctccccgtaactgccaccacgattctatcgtcagagctaaagggagcaggaccgtgtcccttatcacggcatgccatcttctccacctttgaggacagctgtcatgatccccctggcatctgtcccccaggctgtatcctcagtcccttccacagttccttaggagactcagtttccaaaccttctactgaagacttccatgttttctctgtgctcagaactgtatgcagctatcccgattctgtctaataagggcagggtagagaactctcacctgtcgcattctagatgttgtccccagaaaactgctggcagccacatgtctcattatgggtgtataaggcacttgctgtcaactaaaacaccttttcacatgagcagacacacatgctgccattgccatcctgtacttataaattataaaggtgattgatttaagctgagggcaagacttcacatttatgctgttaaatttcatcattccagcctgttgggctatttagggatctttactgacatcccaagtatcagttacctttacgtcattcacacatatgatacacacctcatttatgtctatgctgaagtcagtgtaaaaaaaccccaggctgtgccctcagacctcctgatgacactgatctcctagagggcaggcattctcttgatagagatgtttgcctgcatggcactgagtccagcacctgaaatgtcatctgcctcttgcttccctcccctatccaccggaccattctgagacatttggcaaatgacacactgaaacccagactgtggctgtagaattctcctgcattcacctttcaataatctgcccccagaggaaacacttaacacggttttgttgaaaccacgccagctgcacagcatcactccgtctctatttgttttccaggggccaggattaagctgttgatatgatcacttttagaatttacagatatctcagctcccatacgtggttatatgttttttgtttgtttgttttccagcagcacttttatttttccttacacgatgacatgttgctggggcctattgttctcacataacagtagaaaaccaaaatttgttgtcatctcttcaaagaatcgagaattgcatacagaaaaaccttacataaattaaaaggatgaatacatttacaggtgtaaatgcaaaccactttcaactcagacaagtaacagcccatggtgttctggcagaaaacatcagctaagaaaggaaactgggtcctaagtcttggactttccaacccttacagaccggcagaacagaaacaactggttcaggagcccttgccagcctccagagaaatcccagaacacgcagccctgacgtattaataccctgcacagatcagagactgctggccacgcagactcaccaagccacagacttgtcttccacaagcactttcttatcttagccacaaagtgaccaagccacatgtactaagggttgaaatcaaagatatgtacagggtattaagcaaatctggttatatgttttaaaacaacttctaagacaaattgatggcaagtttgtgtgaaagttttatatcaaagttgttataagaggttcctgagcaaaccaattgaaatacagtcatgcattgcttaatgacagggatatgttctgaaaggatgcatcattaggccattgtgtcattgtgcatgcatcatagcatgtacttacacaaacctacatggtacggcctactatgcgcctaggctatatggtatggcccattgttcctaggctataaacctttacagcatattactgtactgaacactgtaggcagttgtaacaagtggtaagcatttgtatatgtaaacatagaaaaggtacaataaaaattcagtattataatcttatgggaccaccatcacatatgtggtctgtcattgaccaaaatgtcatcatgcagtgcatgactatatttctgtctcagtaggggcattcataggggaaaaacggagtctagtttcaagatgattaggctgggcagtcacttgggattgtaaccttcattcctcagaaggaaggggttcttgatctcattgagatctaccagaaaattgctgaagccatttatcaagaatgcaacttacttcctagataggattactcatcacatcagacccaaaattttgcccagctcaggtttggttcctctcctcattcctggttgataataatctagtatgtatacataatttaaatgttattctccatgaaaaaccaaagttttgtttttaataaagaaaaatgtctatccaaatataattttcaaaaatctgaaaagatgactcatacaaatatagaatgaataaagcttttatttaattcattaattaaggaaccagtaagatggtaaagctggttcaaaggaaaattcaaggaatggaaatgtgtatatcagtcagtccagtgattgttgaaatgaatttcctaatagatgcaaaactgggtaatgtcctatagggcaaaacattgtaatctttgaggtgatcttttaaatagcaaagtcaaacggtggtacattctccagctaattaaagaataattgagtgagcctattaaacagtaccctagtataatttggaaaggctgcatctccatcttgccttatttttaggtttgagataatttttctttacatggtcattgctaagtgtgcaatgagatgatactgtactggaaggaacatacattggtatagtatttctggaaagcagtttggcagtgtgtgttaagaacttaaaagtttaatttttaggccaggtgctgtggctcatgcctgtaatcccagcattttgggggtccaaagcgggcggatcacttgaggtcaggagtttgagaccagcctgatggtgaaaccccatctccactaaaaatacaaaatttagccaggtgtggtggcgcatgtctgtaatcccagctactcaggaggctgaggcacgagaattacttgaacccaggaggcggagattgcagtgagccgagatcacaacactgcactccagcctgggcgacagaccaagactctctctcaaaaaacaaaacaaaacttaaaactctaatttttataccctttgatccagtaatttcacttgtaagactttattccaaagaaataatcaaaagatgcaatcaaagatttgtgtgaagtgtataattatgcaataagtgttttgagcacactatgcagatggtcaccacagttttctttttattacaaaaagttgggaacacttcaaattccaataatagaggataaattatggcgtcctcttaaatatgatgtggccccattacaaatggatttttgaaagttttttttttttccttttttttttgtggtggagtttcactttgtcacccaggctggagtgcaatggtgcgatctcagctcaccgcaacctctgcctcccgggttccagtgattctccagcctcagcctcctgagtagctgggattgcaggtgcccgctaccatgcctggctaatttttgtatttttagtagagacggggtttcatcatgttgggcaggctggtcttgaactcctgagctcaggtgatctgcccacctgggcctcctgaagtgctgggattacaggcgtgaactgccatgcttggccgtattttttaaagttcttaatgagggaagtcaagatgtaaaaccatatatttattattatctccattatatacacacatacatgtatacagagagaaaaagtaatgaaaataaccaaaatattaacaataagtatctgtgttatagaattatgattgttttttcccgttttccaaattttctacagtaaaacttttgaagcttttataaccaggaaaaaaatttaaaagtttgcaatgcattccagaaataagtgtctcaaactttgctaatttgaattgttcatgccttctctgcctgccttctccaccttcctccctggggctggtgttcccggcttgacattttaaaccctgtaagtggagagcagtggaagaatgatgccccagccctgagagctgagggcggccctgtttgtattttcttaggttgctgtagatgtcacagggagttccgggccatcacagccagggaacacaggatgttgccaggtgtgggaaaaggcctttagggtggtcagagtcccgaagggagcctcctaattcccagttggggaatggagatttcaagcgagttcttgtttccaggctgagatgagcacacttgcctcttacccactggcccagtggatcctaaccttggctacaaatgagaatcacccgggggacctttaaacaaacactgttgccactatcccacccacagtcaatcaaatcagactttgtaggggtggtcccggcatcagtggtttttcagaagttcctcaactgatttaaatgcacaatggaagttgacaaccaccagactgaagataccacgtgtgttaatgggcccaatgtattcaaggcccagtagttggccccatctcccctggtatcctaagaactctaaatcctttctagctattcgcttgtcaaactcctgagcttactttcaatggagcttacacattccctccttccctcacatgaccccaggcacagttaatggttgttcctagaggactttgtctttgttccttggggatcaggtggagtgagacagtatccccaagactaagatctctgaggagagtaaagacaccatctctgtgcctctggttcctgctacagagtaacttcctgatggttgccaaaagaatgaacagaagaatgaatgaatgcagcggttcttcctgccatctgataacagactattctttgatgttttcattttcaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgattcctgcctttttcctcagtaggctgagggtacacagaggtgatctaagtcagggaccagaagctgtgacatgttaactaagattgataggagaccttaacatccccaaaatccaacccaaactcccaaagatccatgtgccacatgttcattccattaaagaatgtctgacgttacaaggcagttattcatctatggatctttccatttattaattacacaataaatacaggaatgtatacttaaaccaaaccaaaagtaaaaaaagaaaagttcatcttcaccacagcctgcacctcatcccatgcccttgcttagagaaactgccatcaacaatttgatgtgcattcagttgtattcttttctatgcatttcatagttattgacatcctcttttttttttttttttttgagatggagtcttactctgccacccaggctggagcgcagtggcgcgatctcagctcactgcaagctctgccttccgggttcatgccattctcctgcctcagcctcccgagtagctgggactacaggcacccaccaccacgcccggctaattttttttgtgtgtgtatttttagtagagatggggtttcaccatgttagccaggatggtctcgatctcctgaccttgtgatctgtctacctcggcctgccaaagtgctgggattacaggcatgagccactgtgcctggccttgacatcctctttttaagcatactatatgcttattcattttaaatttttgctattatatttttgtaaacatgttcaagtttttctgtaaaataaaatttttagaaatgaaatccctcaggccaggtgtggtggctcacacctgtaatcccagctacttgggaggctgaggcaggagaatcacttgaacctgggaggcaggagttgcggtgagaaagatcgcgccactgcattccagcctggacaacaggagcaaaactctgcctcaaaaaaaaaaaaaaaaataaaataaaataaagaaatggaatccctcaaaggatatgtacattttaaattatattaaagagtaccaaatttcccgcttaaaaaactttgatttcactttacagccccagtcatacagtatgagtgcctctttttccatcctttggtcaatgcaagatagaataatcttttgagcctgggcacagtgcttcacatctgtaatcccagcattctgggaggccaaggctggtggatagcttgagctcatgagttcaagaccagcctggccaacatggtgaaacctcgtctctacaataaatacaaaaattagctgggtgtggtggtgcatgcctgtagtcccagccactcagaaggctgagataggaggatggcttgagcctgggaggcggaagttgcagtgagccaagattgtgccactgcactccagcctgggcgacagagccagaccctgcctcaaaaaaaaaagaaaaagaagaatcttttgaatttttgccagtcttatgaaggtgagaaatgatagctatttcattgttgtaatttgcacttctctctcactaatgagattgagcatcttttgagatgtttgtgggtcacttttctttgtccttctgtgaatcacctgtttatatcctttgcacattttcagtagtggttgcttttttcttattgatttatgatagctgtttattatggataaatataagtacttttatatttaaaaattgtgagagccaagtacaatggtgcacacctgtagtcccagcttcttaggaggctgagacgagaggattgcttgaggccaggagtttgagtccagcctgggcaatgtaacaagaccctgtctctgaaaaaaaaaaaaaagaaaagaaagaaaaaaaaaagaagaggaagcaaaaggaaggattttaaaaactcatttatttaatttatttatttatttatttatttatttatttatttatttatttattttgagacggagtcttgctctgtcgcccaggctggagtgcagtggcgcgatctcggctcactgcaagctccgcctactgggttcacgccattctcctgcctcagcctcccgagtagctgggactacaggcatccaccaccacgcccggctaattttttgtatttttagttgagatggggtttcaccgtgttagccagggtggtctcaatctcctgacctcatgatccacccgcctcagcctcccacagtgctgggattacaggcaaaaacctcatttatttacacctttttttcctctaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccacaaa

SEQ ID NO: 677 - DNA, 209992 bp, Homo sapiens
agagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggtgagcaagggcctgggagcagccccagacagacgtgggcctggagcagtttcctaggtccccgtcccagcctcgcacccccgaggcagtgcgcccaggcgcgtggtggaggtaaggggaccgctgtcctggcacagagctgtccccgggctcggtcacctgtgccgcacgtttgggcttggctggttagctcaagtttgggcatcaagctggggaaactgggtgaatctccaggaacttggtgctccggggtgggcaggattcgcctgacgctctccccttgtccctgcggctcccagctaggcggcggactcttgccctctgacagttcctcctgtctctgggtatccaagtccacgtcactgcgccccgagcagtttttctttcgcttagttctcggatgaaataactgccggcactttttcgtgataaatcccctagtaacttccccttggtgagccgaggaagggatgggaggggtagagaaggagaggactttaatcacctccccccgccccccttgcgaaacctgctaaagcttaaaatcgtggtttcaacgttaccccctgcggtccccgtccattgtctgggcgggtggtgagtgaaagggtgaccgcaggcagataacacagccagaacaggaattagtaggtaggcctgggagacacctcagtgagaggtttgtgaatttccaggacctgctcatagagcctcagttctcagttctgtactgagtcttggaagagagagagagagagagagagagagagagagagagagagaaaaggcaaaattcccaacaactaaaatatctctcgggaaatccctttccacaccctcggggacgtcccctggccctggtatcctcaggcccgcctggcggctgacacaagttgttctaacagggtattccgtgcgctcacagttgcctgacagagcagcaggttcctttgctcccctaaactgaaaatttaggggatttttttttctttgaagttttttttttctatccctgcgtagacagttgccagttaaactcctacttcctggtattttggcctgtttgttcttagctttttctttagcttttatcaaagaaaaatctcacttccttttatccgtgcacatcccttcagctgtcggcaagctcaggtcacagaagaggtttgaaagcctctgaatctctcccaggaactggcggggagaggggtttgggggccagagcctgaggaagagattacaagtgtttgcgagctgctgctgctgctgccgttgctgtgtgtgtgggcgggaggagtgccctctccagatctctttattaaagttacatttctgggtgaggtaatgagctcacctgatgtttctgaggctgagggaaaaaaaaggcgtctgcgttctctgacaaatctcgggctctggggcggggactgtgaaaccatagttcaaccggatttaaagcaggtgtcctagtgtaacaacgctggggaggtaggtggaaaggcgagacccccttgggcctggcacagtgtggatttcactttttcgagattccactgtccgatggaggaaaggacactttggagccagggaatgagccaagaagggaggacaagggtgatgtcggtttgtaacatgcaaacgtccacacgcccacagttggttttccgattaaccccctcgagacttggagaatgtaatctcaccctcgtccacacccctgacacaggcacataaccagtttccttttcggtgccgtcacaggcgggccacgtcgcaggataggtttttctacacatttaactgctaaaagggggaaagttccgctttcagacctccttcacggtggttcttttggcgccacaggctcgtgtgtccagggggcaccgagctgcgcgctttcggcgagcggctagccccggctcaccgcaaccagccaccgtgaatctgaggatccgatatcggccctggaccctcagatccgtggtttcggtgaattaccgagctggcattgccgaaattctcattgcagtatcagtgtgttttgaaaggaaaggttacagcactaaaggcgccgtgtctacactgaggaagcaagtcttggacagtaagtgcgccttcttcggagccctctgcatagcagagcccggtgggggcgcggtgccaaaggccggcttcatttgagcggggtaactgccttccctgccggccactcttcatttccggagcagttttaatagtgtatgtccagttgtagaggtcaaaaactcgagtttgtgaaactgcttccccgggtctttcggcttgtagtcgctacaaagtcattgatatattttaggcgtgccacgttacctgttttgaaaggaggagaaaaatatatgaaccacgaaaactgaattcagagatgaaggcaatgaagtgtgtgttcaacatccgagatagcaatattctcgttattcttgtagaaagagcgtcagcctgtggtgacattttgtattgcttaaaaaaagaatgcttttctggattatttacaaggagatggggcgctgcagttaactctttcttcacttgggtcatctgtatgaacccctctatgggatttttcataactactcactgatctcactgatataagattcattctaagacataagcacacataaagctttcttcagtgggatattatgtttgaaacatatcaattgatctcaacaggacttgggaaagcatcaactcaaataatgtcctttcaaagactattgatgtaggactattgaaattgattaatttaaaaactaaaaactgtttaacagccaatatatatatattttttccttaaggatttatttaatccaatagcaatttacaatttaatggagcattatttgcagtaaattgcttttctaggctttcttcaggacatctaccttcaggcacttgagcaagtcatttaacctttttgagcttcagttttctcatacaaaataaaaagacagactagaggcctactctctgaaatgtctcccagctcaaaaactctttgtttctgaagtcttaaggtaaaaaaccaatttaggcaggcagagtcatttttcaacactatttttctaaggatctcagtctagacaaaattcatataaattgtattattagaaaagtatcagtagaccccaatttctaatttcctttttttttctacctttaaaaattcatgataacatctatgcttactctttccagccttagtagggaaaaaaaaaagcgtgaaggagagaaattagccttccactctcctgggaaaagaggacccaaaagtaagaaaggatagtaggcctcagaaagccctgctagtgtaactcatctctcctgcaaacctgttcctatataaactgcatacatagtacctagaatgagatgtaaattatggtttatgcttaaatattcatatgacaaagcctcatattgtacatcctaaagttgctcaaaaagttgatttgcaacatggttgtaaatgcaagacagaaggaaatagaaaatactaatatttttctattgttttaaaacttgtagaaatccaaaatatcttgtcttaccagattccaaaccttttctgactttgtaaaaaattcaaactagcttatcttttttaatagacattcagatgaaaatgcatgtctaccattgacttatcaaaaagaagaaaattaattaaatagtcttgtgttattagaaaaattgtatattgtagtcagtattcatgtgttcagtttctaactatgtcatgtaagaatgttgtgaccttgggaaaattatttttctgctcttttttatttcccatctgtgaatttctttctgtgcaatgtgtggttctgattgtgttgagattagtaattcccttgctcagcatttcaaattttttaagtaaaacgtgctatattaattaaggcttttattatattgttaatagaataacattctttaatttattccacttaattatcacttttatcattttattaaaataatggaaagatgtttctttttttttttctcttttttctttttctccgtcaaattttcatgccactaaccgtgggcctttgtaaaacttagtaccacctaagttgtcaatattacttggtgtaagatggcagcagtttgtcagatagtattttaaatgctttataatcaccatgttttacaattccaaacacacttctttctgttctggccatttatttagcataaaacaccatcaaagagttctagctccctgaaggtattcactcaagtagacacatgcaatttatagcccagatatgcagaagatccacttaggtatagctatgatagaagaatatgtctctgtctcaatgtatacatagaaacttaaatgcaatttctcacaatgtgttaattttattcttcattgttaagtattcacagaggctaatctcatttcttacacattatgtgtgtgacacatgtatgtgacatatgaagaatgaactaacttactggaatactaaagaatggtttcttgggtgtggtgggtgataacatttatttggttattacttttggatttcaactcagtttattttcaataagaaatggaaaaaaatccatttatacttttgattactttttttattagggtagaattttcctttccttgtggagagtaaattcaagactaaaatagatattctatattcaggaagagaatattgcaggctgtttggtaaggttaaatctaaatcctacaattattatagtgtccctatagtacgtaagtcattaccatatttttggagttactgatattttcatgcagctaatttctctgcttaaataataaattttacattctcttttctcccttattattgaatagaataccttatatatttcagataggcctagttccaaatgtggtatggtattcagtaattgttttatgctaacctattatcatagcccattactgtagtctatgttccaagaatgaaattagcttttaatgcttcctctcttatttatccagtcagttctcaattatccattccattgaaggggaaatcagagttgcgcacaatccaaaacatcttctaaccaaaggattacttaatttgactttgagttgaggtacttcaatgaacatgtctatacttgtctggtctaagaattcatagtacttcaacacaatgaaactaaactgctggggaataggttaatcagaaattagacagctgtccagcttctctgatttgcttctctattactgttattattgttttagctcttttctgtatcacttaaggaactgatgcaaaatcttggcccaagtaagactaaaaacatctatgagatgaaactaaacctttgcaatcttctcaaatcctataaatattatagacccttgatgttcattcacaggaaaacatactatgaccatggcaattgctgtagtcttctggcctttgctcaatgacacttccactatgaataatttgtttagctctgcaaaatcacatttcaagttttagaaaaattttaccctcacctggccctttttcttaagcaagttttttattacatcatatgagtttccatgaataaatgaataataaagcaatacccttttcatgttatgagttgggttagcagccaggtaggttgactctccagtaggattttcacacacctgcttttagaaaaaaaaattactacttataatggattatggggttacagtaaacagtgaaaaccagtaatatcaaatccataaatgttaggaagattggaacttgtaattaaaaaagactttatttttgattattttaacttattatgatgatttcactagagaagttaactgaatttgtagattaagatatcaaccagcactccaacacaatgttttcttgagggagataaatctcaaagatactttcaccttagaaattgatataagtagatttttatcctctccatctgtatagttttagagagagtctagattaccttatttgaactgtgaatgaagaaaaaaaaactttcctgtacttacttgcctttggtgcaaaatcaacattggaatgttgataatgactaaagtgagtcttaacttttcccttttccttttccctgtacttgtctttgctgtagtttttaccacattgtattatgatattggtgacttttttcagttgaacataaattttttgaataccaaatatcatctttgtctatgtatcctcaagtctagttaagagcttgacacctagaagctgcttcacattttttctttgcattaaatacagtagaagcaatgcatatgtggagaattaaactccatatggcagcacctgacattcatgcattactaagaaattttctcaaggagtttgggagttgaggatataatattcctcactgagaattgaactggaaaataaaaccatcatgaaagaacagagtgggacaggctatcaagacctgatggcactttagtagtattaatgaaaaacaaaaagaaaagaacatgtatattcgtaaaggacctgtgattaaggatgaaaaagactttggtcattggagaaacacagaaaaagtagaggagttgggccaaatgtggttattgaagctattatacttaatgaatccaaacactttcttttatggtgaaagtaagtggcccctctaactggcagacatgacttgcccagtctccttagcaggtatagctttttgttgagatagataaaactcattataagaacctaattctggggccaggctcagtggctcatacctataatcctagcactttgggaggccgaggcgggcggatcacctgaggccaagagttcgagaccagcctggccaatattgtgtaactctgtctctattttctttttttcttaaaaaagaacgtaatgctctgaatattcaagtcatatagtaaactttcccatggtggaatttcatggtcactaagaaatcttctaattataatgtgatgcttgttttttgtttttgtttttgtttttgagacggtgtctcgctcttgttacccaggctggagtgcaatggtgcgatctctgctcactgcaacctctgcctcccgagttcaagcgattctcctgcctcagccttccaagtagctggaattacaggtgcccaccagctcgcccagctaattttgtgtatttttagtagagactgggtttcaccatgttggccaggctggtctggaactcctggcctcaggtgatctacatgccgcggcctcccaaagtgctgggattacaggcatgagccactgcaccgagcccaatgtgacttcttatatagccagtttacagtcagaggatgcactagctggaagagaagcattgtattcccttggcaataattgctcttatgtataccaataagctggtttatgagtttggttagtgagaattcatctttaaaagatgggaaaatgtttggtaagcagccaaaagaagcttctaagttttcagggttgaaacctacacattgaacccttccaaattcagcttgtttgtggtacaatcagctaaccattccccaggtgacacctatggtgtcatttgttgtcaacttgtgtgttacctattatagacatttattttctttcttgtatatcttttggtgctatcttgcttaatatgcatattattagtaggttgaccattcattcatcttggtatacctaagactgtcctggtttatgcctcatgagctggtacaattattaatggcatcctttttcattttcagaagtgcattttgcataacatatcatacaggctccacaataatttgtaacttgtctttatgtcttggagtacttcactgtgataaatgcactcttcatcctaaccaagtgcatatttttaacccatttaaatttaattatcagctacagtgaaatatcattaatgggttatatgcccctttcatgtcaggtataagaaagaaagatgtgaggttgtagcctctagaattccagaatgttgtggatatgaaacattgaggatcctatggtttggaatggaaactaaattgacctcagatgccaagggaataattttgtttgaaattcacctgggagctacacttagctacggggttatttagggaagaactatttcagtatgagcatgaattccttttgcagcaaattgtacaactcccattctgttcttctatgagatttctcagtaatcacactaccaatttttttcttaaaaaaaccagggatgttgaaggaagccccagcattcttctgtacatgcaaactaagttgtatcagtcagaaaaggcgacctgatgtggccaccaacagtatggctaggatacggttgtagtcaagggtgtgacaacagcaaagacgcttatcgcggaaactttgaccctgtattaacaattttcaccttctagatccttgggcaaaacatacggccttttgagaggctcaagcagtgttgaataagaatactttcacttagagcgaaaaccttaactctctccagagttaaattatggaaagttcagtgtgtgtgagtttgtgtgtgttgggggctggagaggagagagaaagacagagacagagagagagagagaatgaattctgaaggattagaggcatggaatttattgtcacaagttaaaatatggtaaaagaagggttgttggaaaaatgagaatgttcttttgatgttctttttgtttagccccccatttgagagctgaaataaatgaaaccacaggtttaagagattacctaaaatccagtagcaaattaaccacaattcctagtgacatgttttcagtttcatttgcgcctaaactcatagattaaaggttttgacctgtaaagaacctaaaaattaattaactacttgactaaggtcacattgttggccaatccagaactaaaactcatgtcaattgatcattcagcatatataacagctttcaacaaatattaatggagtgctcagtatgtactacacattgtgcttgaggatatggaaataaactaattactatacattcaagatcctatcactcaaagatgttatgttctctcagggaaacagatatcaattaattaactatataactatttgctagaaattttggtaaatgtcacaagaacaatgaacagcattttacaacaaaggggccagatctagtctgggatttaagagaaactcagaaaacgtctagcaggaagtgatatctgagctacgtgctgaggaataatctagcaaaggatgtaggctgaggaaataacatgactgaggatgctaaggtggtaagaaacatggtttctaactcctggaggtgaaaatgtgcctatcccttttcatgaaaactaaagaagttttgaaggttgaggcaaaaaccaaggattccttgaagttgttcaaatactttcctgcaatctccctaattgacttgccagttgtgggatctacaaaaggatgtctttgtcttattgaaatattcacatattagtaaatatttgtatgtatacctccctacttaaaaaataaagtggaaacataccatatacatcattttgtacctttcctttttcatttaacagtacattttggagattaaaaaattgtctcatagcagcacctatagctctacctcatttttaaaaagtgtgcattggattttactgtactatcatcattaatgtaaccatttcacaagttcctggaagtttaggttgtttccaatctttcgttattacaaactagagcagtgaacatcctaatcatgttattgtccatataagcaattggtggcagttgttggtaaaatgtcttggaagtgaagttactgagtcaacgatgtgtttttcatttagaaagaaattgtaaaattactgctcaaagagtacacatctttaaaaaaatcccaacaaaagtaagataatgcctttcttaaactctcttcataaatctgtactattacattcctctttttaaccagtatcataagttggttttcatttatttaaagcttattggaaaagttagaattataggagtagtaggcatatacactcacatacaaggcaaaacctatattggtgcctaactttattatacatgagattgggccagaaatgggaaaagacaggtatttaccatgaatttttattattgttctttctacataagattgctaacttttagaacataaactgtataattataagccataacctcttccattttgtaaaattaatactctgtacaatcaggattaagagacagccacatttgagccataagtgaatttaatactgcttttcaacacaaagaaatggtttccaaatatttgtattagttcgttgtaggtacagtatacattttatgggtggtctgactaatgccactttgtaaaccctgtataatagtcattactaaacaaacttcagttatttttaagtaaatcatatttcgaacaattattccaacaagtttaagccttaagtaaatcatcttttgaacaattcttccaacaaagcttgtcagaattttgtataaactgataaaaagtacaatattttacaaatttttttaaaaatcagtgccactaaatatttttcacctgtaattttttaacccattaaggaaagtaggaataaaatctattttagtcacttttacatagaaaatagcaggatatatatatatagttttgaaaaattatatgccgaaagtaatatttttaaacaaatgataaatattcataatggaggtaatgtttgtatgcacatactgtaatttaatgagtaaagcagtttctgcctggtatttagtttagatgttcaaatctggggcacttatactttattctgcaagcattttccctacctggtgataggtacaacactttctaagaagaatgtttatggtgattttaaggtataggttttatatttttgcagagatggtcatggatctaagtatgaataacagttttgatatcagatctaagagtaaaatgtaatttatatttggatttactccattacataaatcccctgttccacccagcctcaatggatactggctagttctcaaatagttttttttttttttttgagaaatgcttgtttagtataagattaaatagcttctctgatcatactagaatggcaaatacgtatctgtttattaaaacaaaacctttatccactcagctgttttcctctttgctgttagaaaatgccacctttctaaaagagattataaaatagtaaaaaaggagtagggtttcagggtatggtttggaggttatcattttctagaatccatccaaagtgtttggttagaaatgatttgaactgcttgagtagtgatttgatggtaggcagtatggccgtatctccacggtataagaagactattctccaggcttgatcttcatgaactgtctatgctcagagactccagactgaaatctgcatagcatagatttctttatataacagctcaagagcttgggctatggatcagagcatgagtttgctttctagcttttgtctgttttttcatttgttaattgaggatagcagccaagttcatttggtaggaatattcaagaaggtaatgaatttatattatgtttgtcagtgcctagcacattgtagacactcaaccaaataataatcattatgaatcacatttttcagtaacctaataatatcagttattcacatcagaaaaacttgtgaaatacttcattttactgattgagaaatatttcagttccatctgaatacattttgggcttccataactaaactgaaaagtatattttattagaatgtttcataatctcaatgaatgtcaagtaacctttcagttttatcatctcaggaaaaacaaaagaacataattgaaaattatagctttaaaatgtaattttccacaaaaaaaagagaaaaaaacacgtgttaaaattataaagacatatgtaatgcactatattattctcagaaattgacattattatatgtgtttctgtaatttgaaaatattagaacttagaaagaaaaatttccgattgttacaatgctgtcattttgataataaaattatgattttaaatacattatttctcaagtgtaattcaatagagggagctccactgcttcccttttatgagcactgtaggatgcttccatttattatgattttccaatgacctctaatttaatagtgaacattattaaaaacctataattttaatattaaggatattttggaaagtgaatagtatcctctttctattcatataattcaaaaaatgcttccacaaataatatgtgttttaaagccccagttcttagttctttgtaccttttgcataataactcactagacatgattaaagtaggtatactcttgagaaacatactttaatacaccaaggcatcaaaagagaaaaaagttcatttctagtgataaaataatgcatgttttcatattaattttgtggtagctattaagttaaaactgttatatatttgaatagtagacaaaatcttttaaaattactctgcctagatttttaaccaaatggttacagatttccacatggaaatggtcttcttccttttttattttctcatatattcccttgatttaggtaatcccaaattgtattttcaagctaaattgatattcatcatcttatctattattactttaccttttaattttgttatgatgaaagaagttgttgggttgattttgttcaaaaatttataattttgtcaaaaatccactaacatggttaaaaaatttaaatggtttcaattttataagacatctcctaagatgtttctacataagggagttatccactctgtgtgtgaccctgacaattcatttaccttttatgaggttcatttttctcatggaagtattgtaccatgtgatttcttcacagctcaaaaattctaagattcaaaactatattttgatttagaagaagaatatgcacgcgcacttgtatgtttgagtcagtgttgagcaataattttacctgaagtctaattaaggaaaaaaaattcaatgatgggcctcatttttaaatttgaaatggaaatgattttattacattctatagaaaattgtataatatcacacattagacctcctaatttattactaaaattatatcagtaaatgaaatcgtccaattctctggtatatttaagaattgtcaacacagaaacagatttaaaaatctcatattgaaattagattatctgtcacgacggccatactgggaaaggagctttgtgataaaggcctgtgggttcttcatcacagttttaacaaatcacaatttaaaataccttttaaagtaagtgcccattttattgtgcttactttccattatagatcagagtttgagaatatggtgtctgtagccaaattgtttagttttgaaacctgtgtctcctttctccagtttcccagttgggtggcattggggaagttgcttaaaccctcttctgtcctaatctatgcaatgggaataatagcacctatcttgtaggatagctgtgaaagttaaatgaattaatacacataaagttcattaaacagtgtggttgtcagtagtaagctcttaagaggtgttagtattattcaagtatttaaataaattaaatctcagttaatctttcccacttccccaaaatacgattatacacccaactgattcacatagatattatacataaagaagagaggccacaggttcagaattataaaattgccagctgtagctcctctccactctacctttctttccactcaaaaaagagaatctgaatgagagtgatgtcatgtttttatggggcgtaaccttgaatctactcactctgtaaaacaaataaaccattcacaaactccaagactttatccattaattgttagtatcatattcattatgtcatagttcccatctgttaatgaaacatcattgcattgcaatcttgaggttgaaatataaatttaaaagtgaatttgaagctaaaaatgagatgctttgcagcctatagtttacagtgtctaaaagcaattgttttaggtcattagtgtaagtaggccataggtaacttaggagtatacaagtgactgtgctcgaaagacatttatgtagactctgtagattcagagtctacacaataataaaatagggcccagtgatcatattttaagaaaccaaaagaagtaaacattttctaacatatttctcaaactttagtcccttctaatcttttctcccctctgccatcagagtgatgtaagatctgaatcaactcttttttttattgtcatattttattttactttatttttttatttattttttcttttttattattattattatactttaagttttagggtacatgtgcacaatgtgcaggttagttacatatgcatacatgtgccatgctggtgtgctgcacccattaactcgtcatttagcattaggtatgtctcctaatgctatccctcccccctcccccaaccccacaacagtccccagagtgtgatcttccccttcctgtgtccatgtgttctcattgttcaattcccatctatgagtgagaacatgcagtgtttggttttttgtccttgccatagtttactgagaatgatgatttccaatttcatccatgtccctacaaaggacatgaattcatcattttttatggctgcatagtattccatggtgtatatgtgccacattttcttaatccagtctatcattgttggacatttgggttctttccaagtctttgctcttgtgaatagtgccacaataaacatacatgtgcatgtgtctttatagcagcatgatttatagtcctttgggtatatacccagtaatgggatggctgggtcaaatggtatttctagttctagatacctgaggactccccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctcttgcctgcataaatgtcttcttttgagaactgtctgttcatatcctttgcccactttttgatggggttgtttgtttttttcttgtaaatttgttggaattcattgtagattctggatattagccctttgtcagatgaatcaactcttataactgctctgcttcaaatacttcggacacttcccaatatagtcagggtaaaatagtaacttcttaatatagcatttaaagtttttcttacatttctcagaacaatttttcttggaattccatgtgctagccatatttctaaatgtgccatgcccttcctgcttcctgagtgggttgttattcacgtctctgtcttattcaagaacaccctttgcttcacaccctctcaatcaccctttctttgcctgaataacgtgtatccctatccttcagaacacagtttatatgccatcacctccagaaattcttccctgatctctctaaggtgcctgtcctctgtagttccagagttcatttcatgtattgcctattcattcttctctctctcccttagtgaatttttatattcctggaggcaggagctgtgtctacttaatcttttttctacccagcgtctactgatacatggtacattttcggtacacacccatgatgattgaataaatgcattagtcaaaattagatttcttagtctactgatacatagaactttctcagtacatacatgacaattgaataaaggcattagtcaaaattacatttcataattatcaatgaagcctattttaaacaacaacatataatgttgtatgaataagaaatatctacattgagaaaattgttcaatttcttttaaaaattgagggaatgacaactctcctaaaatatggtcctaaaaagaatttgccttattctacccatgctatgcaaattgagtgctaaaacaaatggaataaagttagatttcttctgagtgccaatccaagttaacataagtactcttcttgagtttccatattgaacatagtctgttcattaaatgtgagatcatcctgagaattatagaaatttatttaaactaatttattttaaaaactgtaggtttgtgaagatactaaaactactttttctcccacaggataattgtagacatacattcaaaatagaagtaaattaatggtaatattagttcttctatttttaattaatagattaaacctttggatcacggcatttctcataatctagcagaaataatatagaaaagacttcataagcagattgatcagtcacgcaggcagtatttaacatatttgtaccactgaaaatacatctgtactgtggaccatgtcttggatgcttttgagagtaaaatattagagaaaatttggagaaaatctggttttatttttacaaaactattgactattgaaagagaactttaaaattcagtcactaacttaacaaaattatataaatttgaatgatgtttcatttttactgaaaaataaaccttgtgctcttgaaaccaacatatcattttgagaaataagtctttactgataaaaacagtgcagaattggatttatcacagatctcattattcaatggtacttaatagctgagaacttaatagttttaagtctggtgtcacttctctggacaaaataatcttaaattcttataatctttcaacttaagtcctttttttataagctttgttttatttccttactttacttttgatccttcccagtccttcagaattttaacttctatatcatggttttactctgccaattcccatattaccttcccaatttaccttgttagtaaatttttacttctttggtctctgaggcaagctgtcttctgaattcttgcccagaaattctaagacttttctaatatattattaaaaatacttgtccagataaaccaatataaatacaacacattaccactgataactctcgtttattaaatacctgctgtactccatgtaaaatagtactttacgaaagaatggctaatatatttgtataaccaattttaagtttaaaaactgtgactcttttttaattttttaaattataaattgtaatctcactttcagccttttaaatataggactttgaatgcagtatagtttatgtatcaagaagtagccagagcaaagacattatcaaataaagccaagtaaacaagactttctctttgttgaaatatataaacctaattgggccatatcagtgatcagttaagattctggattaatcaaagaggctacatgacaattttttaaaaaatcttttctattacttgaaaaaatgtcacccatttctaagacaaatactgtctagttcctggattcttggcatgtaatctaggcttcacgttcttgatgttgtcacccaacaaaataatctttccacaaacatataaaaatatatggagttctcaattttccatggaaatagaatctagggttaatgtggtgaaataattttcattattaacaagccttattttagtatatgtaaataggattagattgaaaagccaagttttatagtaaaagatgtgatttctgtaaaagagagtattctgtaaaagctggaggacaagtgaagcttaaaggagcagcttgtactgatgagaaaggggagaggaatgagtggacctctcttcagagaggaaagaaagataagatgaaaagccagcatgaaaaggaacttgctatttaaaattacaacaaactgtttatgtggaccagtagcatcatgatgtaaaataaattttctttactgctttgccatgacgcttaattgataatacattctagtaagcccaaatttgaatctcttctcgataactaacattcagttaatttcttatttcgaagtgggaagagcaatggctggaaagaaacttcctacagagaaattctgatgcaaatatgtcttgaaatccagagcattttggtccaaatttaacaatgtgtgtcaaattttacaacagcagatgtgaatttatggttctttattaagttttaggaattctgaattgtatttgtctgcttaattctatagtgaaactaaagctcagttaaatagtctaaagaatgttacttaatagtaaaattacataaatatgccatgcacatgttggctttcaacagagtgcatttgaatatattcagatctgtggtgggtgctgaagacttgtctatataggttcagttccataactgaaccagtgagaatctagaaaaccagtgttttcaaaactactccctcatgggtgaatggagcacatactattgaatgatctgctctaaacttaggcattggtgggcctgaaataagacttgggcagtgagcatctgcttctcttcacccaaagagttgaccttccaagactatagaggaagttaaaattaagaaatgagtataagagagacacaagtaggtgacttctcaaattctgaaaagggaagtttgggtaaacaaatctgaaggaagaagaaattaatattagaaaagcagagttaggaagacagaagtgaatcagtaaaatgtcttttgttagaacaggtgcttctacatctgttttgaatcaactgcacaatggtttatgcatgggccaactgaatagaaatactcaaggctggcataaatggatttggttccagttacagatttctttgttttgttttgttttcaaaaatagagcccaattaaatccatcctcattggttgtagacattaccctaaatgtctagtgtgtgcaaatgtttctctataccctaccttcctatccctattccccatgggtccctagcattagaccctgcttcctgacagtctagacttgggcttgtcattataccaccataaattagaccctgcttcctgacagtctagacttgggcttgtcattataccaccataaatatatatatatatatctgtaattgtttccttagtgaattgaaggttttttcatttaaaattaaatttgtgtggaaagtatattctttcccatcaagttaggaatatttaaaagaagtatacatgttagatgcaaagcgctaattcaggaatgaccagataactagtatcattatattctttttccaagtatattccccaatgtttggaatgctgttcttttgatcttaactctttcatctgaaagcacccatcaaaggttacatgagcaaattacccaataaatgttatttttccaatagtttcagcctcaccctacttaaaattatattgaatgttcgtgacagttcaaattgacaaattttcagtttgcctcttctttttaccccacgttattctccaaatagaaatcttgagattttttccacaagataaatctttagaataactgaggactaattatatgttccacagcagtctgtagtagtctcacaggctgagcgtccaaatgaggttgctgctatagggaagggcaggcggaaatagaaataaaataaataatccttcccaccctcacacacacacacacacactcacacacacaatcaagaaaccatcaaacaaagctcagaaacatttcaaacataagatcatcttttactttacttttttgttgcatgtttactttgccttctggaaatattgcacaatctattagctttttctctttagatgtttgaaggatacagaaggtactactaacttaaaaaaaaaaacattgattctcacagcagaacctgtgtgtacttgttcactacatacctacattgttaaatatagttgcttcacaaacaatacaataagaaagaatttaagaaaacagattctatgtaaatagtctgcgtcactaactctattatttagtgattaaacggaaaaatatttagtattgagtgttggttcatcattgttgaatcagtaacggttaccaggatcattgtcaagttaataattgagaccaggaacttccttcttgctgagggcttttagtagtgatcagtggcagagggatatgaaaggctggagaagaaaacaggagacccagtcctgcctttaccagcagccctgagattttggttaatcacttcatatttctgttctgcttctttgcttatacaatgacattaggctacagctgagtgggctcccttccgtgtggttgtgagactttattctactgccaaataaaaataatatttgcattatctctttttttaatatttgcacttttttgttctcatcagtatccataatgaagcactaagcatgtaacattttgcagattgagatttcccagtcaccatgcaccataaataaaataattgagacataggaataaaaatgcattacagtataaacaagcagtaacagagtgtggaaaataaaaagacaaggaagtacaacctctcctctgtttaacactgaacaaaatttttgggagagtataatgttatatttataaatagagcaattagatttggttcagagaaaagaaaatgattaaacctatagaatacagttgttgtaaagaagggaaaagacctggagaaggaagaagtaaaaggtgaattaatagctgtgatgagaacactgatccatgattcttcatctccacagacgactgtcccacaacaaaaacaaaacagcatgcaattgctgaaggaaaaagctagttcctcaaatttgaaatgctacttttgaggaagactcagggacttctacctcttagagtattacaaaatgttatacatataccatactccaagcagagatgttctgctgtctctttaaacttagtttagtataaaaggatggtaaatttggtgataaatttagtaataaatgcaacatttttcttatctgtaacttaataggaataaactaatttaagattccttctgtttcaaattctttatgattttttattttggggatgttggacttgaagcttcactaaatattcggttatagaaatacttttctaggaaaacttattagggttaagaaaccagatatttttcttttaaaaaatatgtaattcatatattttgaacttaataattagattccaaatggtcctaatcacaccctgtggatctttagctcttgaggattcaaaactatgagattttacaatcacgttttagatagtaaagattgaatgagtatgttaaggctttcatgaaagaaaaatggaagaaagaataattgaaacaagtaacttaagtggtgggcaagtaaaatctgtaagccaatttctttgtctgtaaaatgaggagaataatagtatttatatgaattctttgttgaatgaacaaagtgagataatttttggaaaatgatgagcaaagtgaatggcaagtagaacagacttcagaaatgttagctatttattatttacacaagaaaagtggaaggtatggtgtactaaatatgacaaatatgacacattcaaacagaaaagaggaaaaaatttctgttatgtagaaaattatcccactacaattttctttatccttatttattaaaaatacgggatgaaagtaagaaagaaagatacgcaaaacagtgtgtggtatgtttgcttaaaacggaatgtgttttgaaacacacaaaaccatatacctacttgtatgctcatatatacatagtttttttttttttttttttttttttttctaaaaaacacacaggaaccttaataatgggcttctctgaaagggaggcctgcgaatatgagataggagggaagccttcttattttttaagtatatgctttatctgatttgaatatttataatgtgtacattattttaaaataaactactagtgcaaaattagtattattttttattttttacatttaattttattttaagttccaggatacatgtgcaggatgtgcagatttgttaaataggtaaatgtgtggcatggtgatttgctgcacctatcaacacatcatctaggtattaagtcttgcatgcattagctgtttatcctgattctgtccctcccccctaccccctcaacaggtcccattgtgtgttgtccccctccctgtgtccatgtgttcttattgttcagctcccacttttaagtaagaacatgtgatgtttggctttctgttcctgcattactttcctaaggataatggcttcccacttcatccatgtccctgcaaaagacattatctcattcctttttatggctgcatagtattccattgtatgtatgtaccacattttctttatccagcctatcattgataggcatttaggttgattccatgtctttgctactgtgaatagtgctgcaatgatcatacctgtgcatgtatctttataaacagaatgatgtctattcccgtgggtgtatacccagtaatgggatggctgggtcaaatggtatttatggttctaggtctgagaggaatcaccacactgtcttccacaatgattgaactaatttacattaccaccaacagtgtaaaagcattcctatttctccatagccttgccagcatctgcagcatctgttgtttcttgattttttaataatcgccattctgactgggatgaaatggtatctcattgtggttttgatttgcatttctctaatgattagtgactttgagctttgtttatatatgtttgttggctgcataaatgtcttcttttgagaactatctcttcatatcctttgcccactttttaatggggttgttgggtttttttcttgtaaatttctttaagttccttgcagaccctggatattagacatttgtcagatggatagattgcaaaaattttctcccattctgtaggttgcctgttcactctgataatagtttctttgctgtgcagaagctgttcagtttacttagatcccatttgtcaatttttgcctttgttgccactgcttttgatgttttgtcatgaaatctttgcccatgcctatgtcctgaatggtattgcctagattttcttctagggtttttgtagttttgtgttttacatttaatgctttatcatcttgagttaattttgtctgatgtataaggaaggggtccagttttaattttctgcgtatggctagccagttttcccagcaccatttattaaataaggaatcctttcctcattgtttgtttttgtcaggtttgtcgaagagcagatggttgtagatgtgtggtgttatttctgaggcttctgttctgttccattggtctatgtatctattttggtacctgtaccatgctgttttgcttactgtagccttgtagtgtagtttgaagtcaagcagcatgatgcctccagctttgttctttttgcttaggattatcttggctatatgggcacttttttggttccatatgaagtttaaagtagtttttttctaattctgtgaagaaagtcagtggtagcttgatggtaatagcattgaatctacaaattactttgggcggtatggccattttcactatactgattcttcctatccatgagcatggaatgtttttccatttgtttgcgtcctttcttatttccttgagaagtggtttgtagttgtccttgaagaggtccttcacatcccttgtgtgttgtattcctaggtattttactctctttgtagaaattgtgaatgggagttcattcatgatttggttctctgcttgtctattgttggtgtataggaatgctgcttatttttgtacattgattttgtatcctgagactttgctgaggttgcttatcagctttggggctaagatgatggagttttctagatataggatcatgtcatctgcaaagagagacagttttacttcctctcttcctatttgaatatcttttatttctttctcttgcctgatttccctggccagaacttccagtactatgttgaataggagtggtgagagagggcatccttatattgtgtcggttttcaaggggaatgcttccagcttttgcccattcagtgggatattggctatgggtttgtgataaatggctcttattattttgaagtatgttccttcaatacctgatttattgaagggatgctgaattttatcaaaggctttctctgcatctattgagataattattgtggtttttttcctttagttctgtttatgtgatgaattacattgattgttttatgtatgttgaaccagccttgcatctggggatgaagccaacttgattgtggtggataagctttttgatgtgctgctggatcagtatgccagtgttttattgatgatttttacatcagtgttcttcagggatattggcctgaagttttcctcttttgtatttctgccaggttttggtatcacgataatgctggtctcacaaaatgagttaggaagaagtccctgtctttcagtttttggaatagtttcagaagaaatggtatcagctcctctttgtaccttcagtagaattcagctgtaaatccttctggtcctggtctttttttttgtttggtaggctatttattgctgcctcaatttcagaacttactattggtctattcagggattccacttcttcctggtttagtcttggggtggtgtatgtatccaagaatttttccttttcttctagattttctagtttatttgcataacggtgtttattgtattctctgatcgttgtttgtatttctgtgggttcagtggtgatatctcctttatcattttttattatgtctgtttgattgttctctctttttttctttattagtctagctagcaggctattttattattataattattatttaaaaaaaatagctcgtagattcattgatttttttgaagggtttttttatgcctctatctcctttaattctgctctgatcttgtttatttcttgccttctgctagtttctgggtttgtttgctttgggttctccaattctttcagttgtgatgttaggtttatgatttgagatctttctaactttttgatttgggcatttagtgctataaatttacctcttaacactgctttagctgtgtcccagagattctggtacactgtctctttgttctcattggtttcaaagatcatcttgatttgtgccttaatttcattatttacccaggagtcattcaggagcaggttgttcaatttccatgtagttgtgtgattttgagtgagtttcttgatcttgagttctagtttgattgtagtgcaaaattattgtaacaacagtattactaccaaaattgtagacaagatacatcttctcacatagtaatttatttattatgaattgagaaattaggaattttggttatagttcctatgaaactttaggataacagttgtgctcatttttatgtgttgcttgtttcttttccccgttaggcttgcgaatttttttcttatttgttacaataaacctacaaacatattgaaattaaaatgatctttcatttttattgccattcttatattagtctatgtttaagttaaatcacatttaagatgaagttgcatagtttgcttcttgattgatgttttgaagtgatttgcaaatgtaacaatgtaagcctagaggatatctactaaaaaaaaaatcacccaaacatacagttaacagaagtgcaaatattcttcagtagaaataaatttatacatgttatggcgagcaagtatgagaagaaaacataccataagaggaatttaaattttgtatcaataattttttgacactcaagattgttgaaccacacttaatacaatggattattttaaaagctgtggcatagtatttctggagaagtatttcctaaattcttgtgatccagataattagaccacaaccaaattaattttataatggcatatacttatactcactcttagaattcacaatagaaatgagctttgctaactcctggtataaagaaattgtttacattgtttaaccttatgtctgacttgagacatttggaaaaccagcatttggaaagcagtgttttgaagtaaaatatactacatgaatgaaatacagtgtctagatttaggactatttgatgtctggtaccttctataaccataattcttcattataagtcaaaatacaacagaagaacaaaacaaataaatacaaaaagccctattatttatttccatgaagatacatgtaagttttccacatgatttggaatttatattatctaaatttttattttaagctcactcaaatatagataattgcaaatttggaaaagcagtcagtaatatcaaaatactgttattttgtgcctgtgtatttttacaaaatatttcgagtccattctttcaagaggttcacatcagtattcaagtactatggtactttcactagtagccaagtactatagtactttgactaagtatggtaacagcctgtaagcctcctaaagctgaaaagattaaaattttattcttagacaattgaatccactaatacaaaataatttaaagtaatcggttaattttgtttacttcgcattttactttgctatgtgtttccctgacatatgactcactacctatgtatgtctgtgtctgagaaggacatacatagctacgcggaagggacatgcgagggatgagggaagcataggcatgttgaggtacttatctcctgcagagcaaacacgtcatgatctggaaatgactgcatttcctcccacgtgcctaggcttttctgaatccctggttctcttttcaacaggcccatagaaatgtctctgcttctttgttgttatttacatttaccaaaactgcagggatttccttagatgccttccagctagtctggctttataaatcagacctatgtcccaaaggaattttaacaagttttcactatttttgggaaaacacaggacatgtaatatattccataaactactcctgaaaatatttttttaatttcagagttaaattgtgtttagtactacacaactccaattttctcctgcaatctatagatttattgacatctgcaaaattgtttaggcagaaaggtggtttctttttccattttaatattaactgcagccataaaacaagcatggcaaaccaatgactatattttgggaaattttttagataattcagtagcttacacaaattgcctttgttttttctgagcctattatagcagacctgtaaggtttggttgtatatattcattttttctactaatgtggaaagtagttgtagttttataattggtgaaataaaatgcaagcaaggtaataatgactgtatttcacggagtaatttctaactttataactgtaagcacagtaaataaagcatgtacctcatgccataaacttattctcaaagtttatcttaagttaatcaacatgtatgatttgacttttcatcaaatgaccgccctgccaacttattaacaaaggatttctggtattaaaattttttggcagttattttgggcctttcaagatctttccattaaaatatatatttagtgaccacaatggaatatgtttttactcttcaggttgtacaatcttcaatgcaactttttcaggaggatgtttcatacagtgtcactgtaatcctataaagtataatatgaagattcaagagttttttgtccttggagagtacacagaaatagagaaattcacagcaacaaatgagctcttatttcttatatccagagatgttttcttactaaattgttatgtatgtatactcatgtgacatattttttctatttgatgtcaagtgattcttttacatcagctctccattttagattattcccatgaaaatatgcttttcttttactattaagttaaaagcaattaattcaatatgacttatgacaccatgttatttaggatatcttattgcaatgacaggaatcaacaggatctagcttaagcaaatatgggggatatataacgagggaacaagaagtctctgtaacagagctatagtaagatatgcatctctataatgaagctaggacttagatctcaagaacgaatttaaattaagggcatgaaggctatcagttctgtctgtctcaattcctcagctcttctttcttttcatttgccttctctctttctgaagactatcccattttgattctaaggccatatggcagcccatgtctcctggattgagttctcctccatttaataaacatagtttgcctagttctgaattcacagggcaaggtttctgattggcttagcttgggtcaggtgtccatttaggaccagtcaactaacattggaggaggggaatttgataggtttctgtgcaatttcaagaagccttgggatgtgctaataaagtagactgggcaagcacaataataactgcctactatagcattttttgcttaattaaattaatatttattagacactcatcataagcaagttataaccgtggtgctgaataaatgagtaaaatactgtatctatattcaacaattcaaggatgtggctgctgtgcaaatcattggagtacagtgaagacagagaatggagcttagtgatgatcataaggagagaaataggaggtttaggagctaggaggtatgatcttcctgagaatctttgaaatagaagagacctgaatatctgtgggagccaaaaggaaagaaggatcagactcaaagggcaaaactgaacttggaaaagcacagggattgattgggcaatgtctcaaatctggagaaagagacaaaactgagaaacgggacaagattactagaaacttactggacttcttcctaaaaggtagaaacaaaggatgaacaaaagcattagtacaaattgagtttttaagtagaattaatttctagtagatttaatgaagttttggacattcttcagcaatatctactatctaacagtaaaaatattgtggaaccatagcttccctactgcccagtcctctgtctgtccttgatgttcatggtgtcagcgattattgggatggttaactctgcaagtagtatttaggaaaaagtgattgccctcttaaaggttaccatacctttccaaagaccatagcctctggattcatttcttagcagttttatagttcctttgttaaatgttagcatgtgagatagtaatttttcataaaaagcatatgtatacttttaggtggcatgaaagtgttaactatctgtggacttttatccaatttcagcttatggtgacaggtttcctattgtagatgaattgaattaatttttcaaaataacctttttttgcgaggctatatcaattggtgtgctacagttaaaatgtattactttgcctatttcccattttctactaaagtttataattcacacaaagaaatacaataaagtgtgtctcctgaaattgtgctttgtgaaatgatgaggccattactctgccttttgagattaataaatttttctcttggcatttgttcccttatctaactggcaatgtgagtttaagctttacagataaatattatactattgttttaagttttgatttttgtttattccttataaacattacttttgaaaaataaagtgtatcttctgcaagttgtacacatgtatatatgaagtaaacttagtcaaagtgcttgagttgctttgtaattcaaaattatgtaagtacattatgttatgttgaataacaaaaagtgataactctaagtttaaatgggtgactaaatttaaaaaataatttataccaagtatagagataatagatttaaacatatcaatttaaacttatagctatcacttcttgttatttaacataacataatatattcatgaataggtagtagattccatttttcatgatcaagctttcctcaaataaccctccctccaattttcaataacaacgaaacacaacaaattaaccactcatccagaaattctaaactatttacgtataatgattgtcacatacctttttaaagaacactttgttttccaaatataatttgactaaatgcaaataagaactgaaccaataaaatgaagcttttaaaaaaattgaacttctgtttgataaatggaattatttatttgacaacactaaaaatatgtaaaataatgctttagaatatcattttaaatccactttttaataaaagctttcttaactaattaattcaacaaatatttgttgagtgactaccatgggttagctactgtgttaagttggatgctagggatgcagtgataaagaaaacatggtcctatgaagcttttgttttggtggaatggtggttcttaaacttgcacgtgcctctcaatcacctggagagtttgttaaaacataggttgttgggcttgacatctacagtttcagattcagtatttctgaagtggggttccaaatttgcatttctaacaaggtcccatatgttgctgatgttgccagtcctgggaccacactttgagaacagctgtcctagaggaggcagtgctgtctatataccaaaacttcaattagcctatgctgtgctgacccatgcatgcccactgcagctccccctctttcattttttttcagaagaaaaaatgctttctgtaaatacaatctggtatgtggatagtgcacaaattatatagttgcttcttaaattactgagaaatttacgaggtcaagtaaatataattttcagagataatgctaccttatttagcctagtgaaaatgtatcatcagtattatggcctgattttcaatttaatcatcactttattttaacataaagcttttctttctgatcttttggtagccatccagttttccatagtcttttaaatgtgatggccagtggttcatttattgcaataattaagatggatagcagcatgccagctggaatgactacacttgtgtttattgtataaattatttccttagtataaaagcctcttttatggcttttgctttggtcatatcttttgtaccctaaaccattaaccatagcatgtttaggagagccatttataaagaagctggtaatatttaccaatttctaatcaccattaattcatgtctacatttttcttagcactggagattgcttgttgctttgttccttctgccaagagcaagaaaaaaaaagtgttctaacccttctaggactcataagcttttttttttccttttcttccttttctttgatttttttttactacattcacacttcttttattttgttctactctcatctcttttccttgtgaatcttaagttactttggttagtttactcaaaatacatagaaatgcagcccctaatgtgaatttcttataaggcatatttgaaattcctttaaaacacagactgcaactgatttttgtcatttttttaaaatgctacttgagtttggtggtcttttgcatttcaaaaataattgcatttcagttttaacagaaattattcagatatagttcagacactgatcatttctgtatgcatcatcgtacccagcaaatttcagtaaatatttgctgacctattttttttctttacactttagtttcaaggaaattgcatgcctgttacctttctaaaagctagtgcagtgattgttggtatatttacaatactcatctttccttttaaactttgtaagtttgaaagtataaatcaaaatgtcatattacatcagaatataaattttattattacccatatatcaaataactagttaaagcaattcagagtagttaagagggaatatttagtggcaataaatgtatattgttgcatataaatacacatattaggcctagatttattgtctacaattcttttaatttcttatcagatttcagtatgaaaaaaagtgaatgaaataagcaaaagactatatccagttactgtaactaatgctaatttcataatctcttaatggtttaatgttatatcctgatggttttatgttttttgaccaatctttcaggctatccttttctgaccactcaaaccatgaaaacctgccctccctggaaaatccaagagccagtcagttcccacaaagacaacaagagccactctgtttggaaaactttggctctttttcagcagtcaccattggccttagaatacagagcattcttacccactggctaagattaacttggttagcagacagcctacatcccttcgtataaaaactgttcttaaaaagtagcaaacattgtcctaaatttccttaccccatccctgactatcatcacctactttctgtcactgacttgttaatacctttattgttatatacagattttataagttgtccctacctgtttttaaataattgaggttataagcataatagttggaagggttaactacgttgtcctgttaaggctgataaaagggcatagatgcttttaaacatacacaggaagaatgagaaaagcagatagcccttgtttgggtcattaagaagatgataaagtatttttcttatagcatgtttgtgggtaaagtatttgaaagcttctaatctgccattgataaaacagatactttactattaggttttgaaaaatgccttaaaaaaatctgctgcaaacatcatttaatatgtcatttaacttataaataataagcagaaacctaatatcttcatttttgcaggtatgaaatattgtaaaagaaatgtaaaataaattttaattttattcattgatactgtgaaggagaactttaatagactgagcataatgtatcatttgcatttatataatgattttaccactgtcattttagaatactataaatttagaagagtaatacagtaataataagaatttttaacattttttagtctcaggttcagagatgagtaaaagaccctcaggacatacgtaaagagaagaactctttctagacagaagtgaagaaatactaaacactcaagtgtaagattccctgaagatggaatgatggtagttgtgttggaagtggtggtgggatttgttggttgagggaagagaagagaaactaatctattgttcagagatggggttaagtagaccagggattagatttctactcagttaccagctagtcatttgccgttgagaaagttacatcagtctttggatactttaattcccatctgtaaaatggggaaggtaatacctgttttataaagttagtggcataattaaattttaaaaatgtgtattaaagcattttgtacacaaagtaggcactcaagaatcgaactattactaaagactcttactattaaagaaaagcaaaactgtattataaaggaaaagcaaacaaactctggacaatcagaattataccagaagtgtattttccatggaagttgaacctagattagtgcataacaaggaactgctacaggcattgatcgtttcttagaaattggctactgattccacaaggaacacccacaccttagtagctgatgatccccttttgtgtggaatagaaataaatgtaagtagacaataaataaaaactgaaattatgtactgtctctgtaatttacgtctagtatttgaaagatcaccactgaatcttacgaattttgctgactcctatacacaactacttgggaagtttccttaggggctgagacacaggagcagcacagtagaggagcagtacaaaatgttcaggagaagataatagtcagatagcattgtcacaagaaatacgctgtattttccactaagctcatggttgctctcagtgcggttgtttattcattcattcatccagtaaatttttatcaagtgtttatatgttatcagcatggaactaccaacacctgaaaatacaataatcactaagatagatagagtccttgcctttgtagaacttgtagtatgtctaaaatttgttttaaatcattctgactcttttagaaagacttcttcatattaagttgaagaagttgagtaaagttgccacccccatagtatagcccttttaatgaccccgtctttctcattattaaggaatgtccatgtgacttaggtgttctgaagcaaagtaaactcctctagactagtggttttcaaccctgactgcacttaggatcatcttggaagttttgaaaatatgaataattgagtctaaccacagacaatgaaataagaatttctagacttggggctcaggcattagtattgtttaaaagctttagaagtgattctaatgtgtagccatgattgcaaacgactgcttgaaaaaaacagagaagaaaaatagcaacttggggtagtgaatgatgacaaacaggaagcaaagtgagtgatagaaataacaatcatgaagctttaccaaacatccccatcatagatgtcaagataaggcttatacagaaagtaaataaaacagcttactcttagataatatagtgatttcatttatactcaatggaaatattccatcaagaaatgtgccaaatctagatactttgtcatattattagaaatgtcgatattgcaactagaagatgttggataggaggcaggactagcttgtggctcccactcagacagacagagcagtgtgtggagattcattgtgaaccattgctccaagaactacagcaggaacataccaggaaagcagagagaatccacagaccctttgaaggaactgtatcactgctgcaggctccatgagatgctgaaaaactgtgagtcagcttgctttctcaatggggagtctcgtggtttggggcaaattctcagccctggtcacctgctgcatagaaatagactcggtgctgttggtggggcatggtgggagtgagaccggcctttaggtgtgcaggctgcatgggagcggggtgtggcccgtgactgctggctttctcccacttccttggagacctgtatgactcagcagaggcagccataatcccccttggaatgtaactccattggagttataactgcacccccatcccccatggcagccacagcaagctctgcccaggagaggctgagttcagacacgtctatccctgcccctacctagtggtcatcctctgcctgcccaggtagccaaagacaaagatcataatctcctgggagccctatagccctgcccaccgtctgagaaacctgaatacttaaccaggtgtccctagggcaagtttgcatcttctctataggattgcagctgatgcgctttttttttttttttttttttttcttaaatggagttttgctcttgttgcccaggctggagtgcaattgtgcaatctcagctcattgcaacctcttcttcctgggttcaagtgatactcctgcctcagcctcccaagtagctgggattgcagatgcccgccaccacgcccagccaatttttgtattttcagtagagacggggtttccccatgttggccaggctggtctcgaattcctgaccttaggtgatccacccacctcagcctcccacagtgccgggattacaggtgtgaaccgccacacccagctctgatgtgctcttgaaagcatcaccttctggctggaggccaacaaacacaaaatcagtgcactaaataaaaacacaaccagggacccttatggtgtccacttcactcccctgataccttcaccggagcaggctgcgagacctgaaaacggatcacatcacaagactcattgcagacactccccagtaccagcctaagctggtagctccactgggttgccagacctagaagagcaaaaacaatcatgacggtttggctctcaggaagccccactcctaggagaagggggagaacaccacatcaagggagcaccctgtgggacaaaagaatctgaacaacagcccttgaatcccagatctgccatctgacatagtctacaccaacgaaaaggaatcagaaaaacaattctggtaatacgacaaaagaggtttcttcaacaccccaaaaagatcatatcagctcaccagcaatggatccaaaccaagacaaaattctctgaattgccagaaaaagaatttagaaggttgattattaagctaatccaggagccaccagagaaaagtgaagtccaacttaatgaaataaaaaacatgatacaggatatgaaaggaaaattcttcagtgaaatagatagcataaataaaaaacaatcacaacttctagaaatcaaggacacacttagagaaatgcaaaatgtactagaaagtatcagcaatagaattgaacaagcagaagacggaacttcagagctcaaagacaagtcttttgaattaacccaatctgtcaaaaacaaagaaaaagaatggaaaaaaaatgaacaaagcctcgaagaagtttgggactatgttcaacatccaaacctaagaataattggtgatcctgaggaagaagagaaatctaaaagtattgaaaacatatttgagggaataattaaggaaaacttccctggaattgctagagatctagacatccaaagatgagaagctcaaagaacacctgggaaattcgttgcaaaaagatcattgactaggcatgtagtcatcgttatctagtcaagacaaaagaaagaatcttaagagctgtgaggcaaaagcatcaggtaacctacaaaggaaaacctatcagattaacagcacatttctcagcagaaaccctacaaggtagaagggattggggtcctatttttagcctcctaaacaaaacaattatcagccaagaattttgtatccagtgaaactaagcttcataaatgaaggaaagatacagttgtttccagacaaacaaatgctaagagaatttgccactaccaagccagcactacaaaaactgctaaaaggagctctaaatcctgaaacaaatcctcaatatacacaaaatagaacctccctaaagcataaatctcacaggacctatataacaataacacaatgaaaaaaaaaacaaggtatttaggaaaaaaaatagcacgatgaatagaatggtacctcatatctcaatactaacattgaatgtaaatgacctaaatgctccacttaaaagatgcagaatgacagaatggataagaagtcaccaaccaagtttctgctatcttcaggagactcacctaacacataatgattcacataaacttatgataaaggtgtggaaaaagatattccgcaaatggacgctaaaagcaagcaggattagctgttcttatgtcagacgaaacaaactttaaagcaacagcagttaaaaaagacaaagagggggcccagtggggtggctcatacctgtaatcccaacactttgggagaccgaggcaggcagaccacttgaggtcgggaattcgagaccagcctgaccaacatggagaaaccttgtctctactaaaaatacaaaattagctgggcgtggtggcacatgcctgtaatcccagctacttggcaggctaaggcaggagaatcgcttgaacctgggaggtggaggttgcagtgaaccaagatcatactattgcactccagcctggacaacaagagcaaaacttcgtctcaaaaaaaaaaaaaaaaaaaaaaaaaaagacaaagagggacattatataatgataaaaggactagaccaacaggaaaataccccaattctaaatacatatgcacctaagagttctcaaatttataaaacaattactaccagacctaagaaatgagatcgatgacaacacaataatagtgacggactttaatactccactgacagcaccagacaggtcatcaagacagaacgtcaacaaagacacaatggacttaaactatactttataacaaatggacttaacagatatttacagaacattctacccaacaactgcagaatatacattctattcatcagcacatggaacattctccaagacagatgatataataggccacaaaacaagtctcagtaaatttaagaaaaccaaaattatatcatgtactctctcagaccacagtggagtaaaattggaaatcaattccaaagggaaccctcaaagccatgcaaatacatggaaattaaataacttgctcctccatgatcattgcatcaacaataaaatcaagatggaaatttaaaaattcatttaattgaatgataatagtgacactgttcccggaccaaactgagggttgggctgttatttctcacagccccataatgagatgcagataaactggggaggaagagagtttttatttctgtaaccggttacagggagaagacctggaaattatcactagaccaattcaaaattataaagttttccagagcttatatactttctaggctatatgtctatgtgtaagtgtgcattcgcctaaagacacagtgatcaacttcttttaatctgtaactaaggtctgagtcctgaagaccttgctctggagcctcagtaaatgtcttacttaatctacatgggtccagatactggggtaattacccttatcttgtctcctgctaaatcatggaggtttgaggagttcttcagacccccaataaacttgtttgtggaggtctgggaagtttctttagacccacaataaaactttagtcctaaatgggtcctattaagaattccttcgttattttgtcatgctttaaggcccaggaaaggcctaggcaaaactcctgatgggctttttgttacatcccagccattgtataagggcactggcttttaatatttaacttaaccactcagtcaatactgaaacagctgttagtgagagctgacctaccacaacacaacctatcaaaacctccgggaaacagcaaaagtggtgctaagaggaaagttcatagcattaaatgcctacattggaaagtttgaaaaagcacaaatagacaatctaaagtcacaccttatggaactggaggaacaaaaacaatccaaattcaaactcagccgaagaaaagaaataactaagatcagaacacaactaaatgaaatttaaacgacaacaacaacaaaaaacaataaaaagataaatgaaaaaaaaaaactggttctttgaaaaggtaaataaaactgatagatcattagcaagattaaccaagaaaaggagacagaaaatccaaataagctcaattacaaatgaaacgggagatattgcaactgacaccacagaaatacaaaaggtcattcaagacgactatgaacacctttacgcacataaactagaaaatgtagaggagacgaataaattcctggaaacatacaaccctcctatattaaaccaggaagatacagaatctctgaacagaccaataacaagcaacaagactgaaatggtaataaaaagaaaatgccaacaaaaaaaagtccaggaccagatggattcacagctgaattctattagacattcaaagaattggcaccaatcctaatgacactattccaaaagatagagaaagagggaatcctccctaaatccttctgtgaagtcactatcaccctaataccaaaaccagagaaggacataacaacaacagcaacaacaacaaaaaaaaaacaacagatcagtatccctaatgaacatagatgcaaaaatcctaaacaaaatgctagcaaaccaattccaacagcatatcaaaaagatagtccaccaagattaagtgggtttcataccagggatgcagggattgtttaacatacataagtcaatagatgcgatacaccacataaacagaattaacaacaaaaatcacatgatcatctcaatagatgcagaaaaggcatttgacaaaattcagtatccctttattattaaagccctcagcaaaattggcagagaagggatataccttaaggtaatgaaagccatctatgacaaacccacagccaacatcatactgaatgggaaaagttgaaagcattcccccagataactggaacaagataaggatgcccactttcaccacttcttttcaacacaatactggaagtcctattcagagcaatcagataagagaaagaaataaagggcatccgaagaggaagtcaaactgtcactgtgtgctgatgatatggttatatatctagaaaatcctaaagacttattaagatcctagaactggtaaatgaattcagcaaagtttcaggacacaaaattaatgtacacaaatcagtagctctgctatatactaacagtgactaggctgagaatcaaatcaagaactcaacctgatttacaatagctgcaaaaaataaaataaaatgcttaagaatatacctaactaaggacgtgaaagaccttacaaagaaaactacaaaacactgctgaaagaaataatacatgacacaaacaaatgaaaacacaccccatgctcatggttgggtagaaacaatatggtgaaaatgaccatactgccaaaagcaatttacaaattcaatgcaattcccatcaaaaataccaccattattcttcacagaactagaaaaaaaaaacttaaaagtcatatgaaacaaaaaaagagcccacatagccaaagcaaaaagaacaaatctggaggcatcacattaccctacttcaaactgtactataaggccatagtcaccaaaacagcatgatacgggtataaaaataggcacatagaacaatggaacagaatagaaaacccagaaataaacccaaatatttacatccaactgatctttgacagagcaaacaaaaacataaggtggggaaaggacaccctattcaacaaatggtgctgggataattggcaagccacatgtggaagaatgaaactggattctcctcttaccttatacaaaaatcaactcaagatggatcaaagacttaaatctaagacctgaatctatacagattctacaaggtaacataagaaaaacctctctagacattgagttaggcaaagacatcaagaccaagaatccaaaagcaaatgcaacaaaaacaaaggtaaatagttggtacttaattaaactaaaaagcttttgcacagcaaaaggaacagtcagcagagtaaacagacaacccactgagtaggagaaactcttcacaatctgtacatctgacaaaggactaatatccagaatctacaaagaattcaaataaatcagcaagaaaaaaaacaattccatcaaaaagcgggctaaggagatgaatagataattctcaaaagaagatgtacaattgaccaatgagcataaggaaaaaagctcaacatcactaattatcagggaaatgcaaatcaaaaccacagtgcagtaccacctcactcctgaagaatgaccataatcaaaaaattaaaaaataattgatgttggaatggatgcagtgaaaagggaacagttttatgctgttggagggaatgtaaactagtacaaccactatggaaaaacaatgtggagattccttaaaaactaaaagtagatctactatttgatccagcaatcccgccactaggtatctacccagaggaaaagaagtcatatgaaaaagatacttgcacatgcatgtttatagcagcacaatttacaattgcaaaaatatgggaccagttcaaatgtccatcagtcaatgagtggataaagaaaatgtgacatatatatatatacacacacaccatggaatgctactcagccataaaaaggaaggaaataatgatattcacagcaacctgtatagaattggagactatcattcgaagttaagtaactcaagaatggaaaaccaagcatcatatattttcactcatatgtgggagctaagctataagggtgcaaaggcataagaatgacgcattggactttggtgactcaggagaaaggctggggaatggcaagggataaaggatgacacattaggtacagtgtacactgctcaggtgatgggcacagcaaactctcagaaatcaccactgaacaacttactcatgtaaccaaacaccacctgttccccaaaacctatagaaattaaaaaaaaattaaaaagaaaagaaatttcctgtcctaacaatcaatgaattattttatcatatattgccaataggagctaaacaacgagtttgggccagattgatctgtattttctaatatactttattttttagagatgttttatattcacaccaaaattcaacaaaaggtacaaaaatttcctatatatccccttttgcaacatgtgcatagccttctccattatcaacatgctccatgagagaggtactttgttacaactgatgaccccagcgttgacacattattatcacccatgatccatagcttacattagggttcacgcttgctgttgtacattctgtgagtttgggaaaatgtgtcatgacatttattcctatctttaaaaataggagtaccaaccggaacttgaatttggcccttgtatctttacagtgctggttttattttactctcatagtcatcttttgatgctgtaacagaaccacctgactacccatactatttgtaggttgtctccaagattgccaatatgggtcacccagaattagcacaatgggaaaggcaggttggctaggccaccttaataaccacaaagacaaattgtcttaaattagaggaaaaaaggtagtgtctaccaagacatctaccgtaaaatctatctgaaaattagaattggtttaaggtgaagtaagtcagaagagttaatgtccatttcttgttcatgtacgtgtgtatgtttgagtctttatgtagtaccactctgagtgtttatgtagttatgtggtactacataaatactcaaacatatacacatacatgaaccaccatgtaataccaccgtattgtctgtatctccggggatataggctttgctaacttgttttatgatccactgttgatacatttgtaaatctaaatgctaactcatttattctgtttacctttccgaggcaggcaggttcaattgacttaacagcaggctagcaactcagagactgtgaaatctaatcacattttgacccattcttaaattgcttcatctgtgaaaaaatgtttgatgaatgcagtactctcttgtgagggtttgtatgaagaataaatattagaaatgattgtggggcactttgaaaataaaaattgttatgaaatgataattatattcaaaacaccctttgacatcaacttacagaggaaaaagtgtaatttttcccattgtagacctttttaaggaattccatatttggtttatccctagaattttctatacttgtgtataccatacttctcctaacccattaatggagttgttaaacatcatataatattgaaagatatttctattagatgagctttcaattattaatggtaatggaaaaacattaatgcagctcttacaacatgacagactgtcagaaagatctcaggaatagtgaagggccagagatcctagagtccctgatctgtataaatttgctgcagtatctttataaagtggataataattgtgttagagatcatttgatcagggagaacccagctcaactgtgcaattcagaagagctgggagttaggaggaggttatcctcaatatattaaggcattccagttcacttctggatgtcccacttggtaaaagaaagtacatttttcattgcatagtagcagcatccacagcagcagaagtagcagtagaaatagcagtagcagtgatagtagcagtggaagtggtagtagtagcagcagcagcagctgggataataggaatagtaacaatggcatcaggagcattagctaacattttattaactgttactatgtggcaggcactgttctaacctctttacacgtttccattcatttaattttcataacgctctttgtaacacgggtaattcccatcttagggaatactgtctatgagaatattattcatcaaaaatgagcaaagggacaaagggagaatagatatgcagtgctcaaagtttagagatgctgtgtagtcatttgaagagagctgaacaggacttcttccagcctaaaagacaacagaaatcctcaggtgactaggcacctgctgccatagatagcttctgatgttggagagaacacagagaaagctctacagtcctctgtgtttaggatcccataacctagaaaagaagtataacctaaaattaaggaggagaatatttttattctaaagatgaaaagtataagaaatgatttaatcacatataaaaaatttatgttgtaaacaggagcaaaggcgaaaaaaatctcatactgataagggcatttttatgaactgaaacaggttgctgaaggaggaaatagaatcttttcccctagaggcatttaatgtcaggactaatagcatcaggataaaatgctataagtaaaaccctgagaaagaagggataaacctctagagtcattttcaggtctatggttttataaagtaattcttaaatgtttaatatattagaatgggaggaatagatctatgtgtccaaataattaggacattggtttccttcaggattctgtcttaataaccttgaagactgtggtgaaacaaagaacatcaaggtcaaaaagaattagaaacaaatgtgctttattctcattgtgaactgatatgatagataatacttgagctatataattataattaatttgaaatgcagtacttgaaatttaagcagatgtattcctctcactgtaacactgttagaggtaaaataaaggagaataattttatactcaaatctagtaaaattagcgatccatatggacttcattttatgcaaattattaatcttgtatttgcacttttgcgtttgggaagtagaagaattgtaattcagaatcggaatgttgaaagtgtcatattgtttcttttacacgtgagatgatttacagttttaagtgttatgctcttcagaagaaaaacaacttacattgagccccagaagtcaacatgaggagaaagcaaatgacgttttgtttaacttaagaaaaagttttcctagccacctaattttggaaaatacttggaatatgtgtgaataaaaatacaaaatacataatgttcatccaaagggcttaacattttatattagatacaaaataagaactgatgggtgtgttaataggaatattaaatagaatttctctcaaggaaagattttaaaggaaatgatcataaacattgtgccgataaatcactcatcatataataaacaaaacatgattaaatatttatctaaatttaacagttttagatgcttaagttttgcttgggttctattaatttgtgcatgtagttaagaaatatatcttgccattcaggtagacccagttctaaacaaaagttctaccaccaactagcatagtgacacgtgaccttgtacaggttagtaacatctctaagttctccatttcttcgactgtaaaatgtgaataatgatattatttatctcagtgcccttgtgaggattaaattaattagtgaattaagtgcttcatacagtgactgatgtttgataggtgtcagtggagataacattttgtaattattatatatgatttaaaatgcatgtgataacaccatatagtttaggttatatgtgtatatttgtacagtatttcttctgatgttaaatttctgtatacattttcttgtaaataagaatagaaaatagtgtctccatcttctctctacacatttgcacatctttccaatcttacagacctgggtgattgtgctgtaggctagaatatgcgcagactctagtcaaacatacttgatatctacttcctcctctggtgcatagtagatggatgtgggataagtcacctagcccatttctgaacttcagttgtaatctgtaaaatgagatcattgatagctaactaataggttgcttggaagtacagatgtaacaatgtcaagaatctccatagttgacatagaacagacttaatactgaataagtaaagtgtccacagctgctgttattgcaatgtgtgtttgtccattagaggcctccttttaattacactttctttcaattaaataatgcaaaataaggtaattagaaaatagtatgtttaatgtttttgactaaagttttgcactcactaaatggaagaataaataattagttaggcctaatatggtcatgtgccatgatgttatttatcaaacattatttagttccatttagcaaatttaatgcctactatatgcaaaacatcatgttcaatgctggcaaagggggatgatgaatgttaataaattagatatagttctgctacttagtgacttaaaatccagtgattgacagaaacacagaggttaatttacggttgtcagtaaaagtatatgaagaaatgcataaatggtcgagtgcagtggctcatacctgtattcccagcactttgggaggctgaggctggcggatatcctgagcccaggagtttgccaccagtctgggcaaaaccgatggaatgatgaaattccatcttacaaaaaaaaaaaaaaatgcagaaattagccaggtgtggtgctgcgcacctatggtcctaggaactcaggaggctgaggtgggaggattgtatgagcccagaagatggaggttcagtgagccaagatcatgccactgcacttcagcctgggtaacagagcaagaccctgcctcaaaaacaaacaaacaaaaataaagtactgtgagatagaataggaaactgtgagatagaataggaatacaggattgtctgaatggagtgaattggaacgcctccttatgcaagtgacctagaaaggaagaggaggctgctatgaagtttaaacgctctctagaaaacagcatgaacaaagaaagacttggatttgagaaagctcagagcatgttcagggtactgaaatgtagggtgctggtgtgcttatatgtatgtgcagttatgtttatttgtgaaaaatgagctaagggtcagaatatagggggacataaattttaaaagcataacttataattatattgaagaaggacttgaattctaggccaaggtgtgtgatcttattttgtatatattgggaatacatcaaaggcttttgaccaaggaaatgaaaaaacccaatttttatttgagaaagataaccctgatgccattgtttaagatatgtctgcagagagtgagtttaaagctgggagagcatttaggaagctaatgtgaagataaggggaaaaagcagatatcgtctgacctagagcctcagctgtgaaaatagagctgactcaagagatctatgtcagcctggatagtttggcctcctctgttaaacagtgtttcgaatgacttgtaagtctagcagcctgaacatgcagcgtagtcctttttagagcacatgttggaagagttgatagatgtccattttcccgtgcttatttactgaaagactccaggaaaggtacctcaatttgctttctctgtaaacataattacttgctttcatccctttggtctcagagagttttaaggattaattagttgagacgaagtgcctcaaaaagaacaagtatggaacatatggttttcctgatacaaataaatcttatagatgcgtccatgctgtctttggaagcccagcaaataaaagacatgcaaaaattgtgtaaagtagaagataagctgagatcaacaaataataaatccccagcattagcttttgcataggaaataaacatttctgtccactgacaacagctttcttttaaaggaaaacaacctgatgatcagccccaaggccacattaatatcagccaaagaaacatttattggttctcttctggaaaccataacaatgagcatgttgcatcaaattggtcacacataaattagtttttttgaatcgataaccttttatttatttctgttaaagtgatatatttttcctaaaatatttgttttctttctgtgccctctttcttttcaagttacctccacagatttatgtcaaaatattatgttcattatacttttgctagtggcttgctttgatgcaaccataaatgaatatcattacactttacaaagataatttattttctaggctttgctgtcatgctatatgtagcttgtatagttaaaacatatagaaactaaaatattttggggcctaaagaaagtttattattttgtttttggcttttcaaattgacattctccattgtatctctataatttaaggcaaccaggtatgacatgcgcaatttatttgctaagacaaaccagatatgctggataaagctctttggggcagtcttgcaactctctccttgtccccaaattcagcccatttttattagcttctatctggctcctgattctttgctgcatctgtcattctcaacttgactttgttctttctcttaaggataaggataagtcttaaggataagactctccttatcactgtttacattgaaggatacttagtcattaggatgtctctgtaagactttatacccttaagggaagactttaatgtgcctgaagctgtgtttttccaaatgtaacatttaatatctccttaacactcttttaatacaccctatatagttggcattgctacattccagctatgtgatattggtcaatttactaaacttttcagttcttaatttttctacttataaaattgtgataataagaataattgcttcagagcattgttgtgagaaaattatatataaaatcacaccataaataatacatataatatacttagctcagtttatggatcacagtaatagttcagcaattgcatattattattattgataatagtaaccgttattatgcaattgctccgtattgctcctcatcctgtgttcccattcttgataaatgttaccaccattcgaccaatttttagaccaatgtcctgaattatcattgacacatcttcactcatcttatttctatgcattgccgtattcttaagttcaagccaccatcatttcttccttgaattactgataacttcttccttgaattactgataaatgttaataaattagatataattcattttcataattccttgaattactgcaatagctaactcatctccctacatttcccttgcatactgtgcaattcatactcataatagagctggagagaattttggaatatttaagtctgatcatgttacctcttacttaaaatgtctcagtagcctctcataacttctaatatgaagtctaaaatccttgatatgagctataataaaagcccagcatgacatgtcctttgcctaattcccctgtgccattcatctcctctttatcacctttgtactcaagctttggcttttctgaactttccttattttcaaaaatgtctcccagccccacttccacccgagacattcacacaccccatttcctcttccaggaaggctcttatgtcgcctgggtaaacttactcttcaagtctagtgacttttttccagaagctttcctgatatctttccatttcaccccactgctgacttattaaaatttctagaattttatacttttacactacattctctgtgttgtattctcttattcagggtctgctatttaatttttaagttccttgaaaatagagacaatttcattgttttcatcagtttggtccaagtatatataacatagatgaaaaatagatattttgtattatatatattatataaataattgttgaatgagatgaataaactatagtgagaagatgctaggctttgttaaccattcaaacctaagctcaaatcccagcgcggccacttgctacctctggtactttgaacaaattctttagccttgtttctttgattttgttttgtttcagtcaggaaattgtaagataattatagtctcctcattattcttgtaagagtaaaataaggaaacatgggtaaagcacttaacatagaatatattttctataaattttacttcctcttttttttcatttataaagttgttcttccaaagtagtagtattaacattgaatagtgtaaagcattcatgccattttattgtatcttctcttaggacatacagaagataatttggtccctcttgtcaatattcttggagtgattgatgacaaaccattttagtgtccctagaaatggaggacttactgcccctttttttcaaaaatgaatattctttttttttggctataatctgaggaggagatgcagtgatctaaaggtaaaagtatcagaaaaaagaattgtccttttgctgattgatttgagggatgtgattatgtagtacattgatgctgactcaccctgagtaaaaaattcgttacattctcatttcctcctactaatatatggctgtggtctttcttacaaaggcctttaaattcaccaagtataagctctaatgaaaatcttgtgtatttttaaaatgtctcttacttgatatgtaaaggaaaacagaacaaaggcattgaagaggtaactcttttggttttaggaatattaaaatgcaatcttcaccagctgtccatttttaaattagatttcagtttttcacatggggtactgtgtgtgttggttagcattggagtaagaatttaaattcttaaaagctttgaagttaattctgtattaagaaacaactgagaggttgagtatggcactatttcttcctgaatctgagatcaagcagatgtgcctctttcaatcagtttttactaccatgagatttaaagcaaagaaaaaaaaaacagttaatgacagttcaaattcacttagtagagtaacgtgttctaaaatggaggattgtaatggttgaagaattgggttatgtttttctcttggtgtgtgtcattttgtattgttttgtcttgccactaagttaatttgatgcatttccctcagaaattggggtagtggggtgtttacatcagaagactatgaccaaagtaaaatgaggggtgaaatatgcttttaaaaatatagagcaaaagcagtgattgatactatagatcttcaattttatcttcaggttctagagttttccagatattcactgtagaaaaaaaaagacttctggtcacaaattctgttactttcacaccaaaccccaaaacatttcaccgaatttcttatcttcctactctttcatttctaccattttctttctttcttacaaataaaccttccttatcaaatcccattttctgtgctttatttgagcaattgatacatcctactttctttagatatcattttcctttgcctccagatacaactgcatctatggggtctctgatttttatagcttgttagaagaagatgctgtattatataggataaaaattattatataatacctatgtatacaaaataataaattcccccataatttaaaaataatgtagtattatagtttaaagttaggttctcttcatctacttcctgaaactctacagtgaggccaaaggaattgaatttaaagaataattctggaatgtctataagttaaatagacgacttgatttctgagtcacgttcagattgacgccacttcttttcattgctgcatttgagaaaatagtgtagaaacaggtacattctgactatataagacataactaataaaagtgaaaacaaagaacaaaagtcagggaaacactaatggttctagagcactaatgggaaaatgaggaagtacatcaagaaagggctaaactgcattcaccttgacagctggtagaggtgatacgccaaactgcattgcagagaacatagcaactgcacgatgtttcaacagtcattttgacagggaaagtccagggacaaagaaggaaaatgaatataaagagcaaaattttgttaagccttgaaacagaaaaatttcccatagggaattttttaaaaatatggcagactagaaagtattagttgtcccaaaggagtcttatttttccaattgaagtagctgctgcttatctgaaacttaacagtttgttgtggccaaaataagcaggtggttataagaaattaaatttccctggagaatgaataatagtgacatacaagtaattataatatcacatgattcacattctgaagaaggtcaaataataaacatataattcatttccatctgccaacatgaatatttgttgagtgcctactgtgtgcctggcacagctagcttcacggttctatctggatatatagatggaagacgggtgagtcagagaaagagataaagactttttatatatacaagcacaaataaaaaaaccgttttggaatttttgcagaattgcaaatgttacttcatattttaaagtcaaaaaaatagcaaatataaaacacttaaaatttttttctaaaaggtagtatttcaattttaccatagagagatggttgccttatctaacatctcgaaaagagccaccctttgatgttcctcttcctctctctcttcctttctctctttatccctgtcttctacacctttattaaaaaaatggtcttctcagtatttttaatatagaattctgcaaatgaaataaagaacattacttatgtaggcactgaacacatttcaatgtttttctttttaaagaaaatgacaggttctgcacactggtatctactaaaaatgaacccaactttgcctctgagaatgttactgtgaagaaatgctgcatctaaacttcagccaaaatatgctaattagaaaatgaagctgaatgaattgctttgctagatgagattatttggaattatattactgaattttggaaattatgtgtcctatcaaagaataacttttgtcataatatcttccttagctcacaggacatttattaatgccactcctggtccagtcagttcagccaccatttagagaaagtctaccatgttccaggcagctaccagcttctaaagatctagagacaaataagaaccaacttttctttgtttcacagagtagcacagatgacaggcatatttacacctaattataatgcacagagattgagggttataatggagatattgctatgggaacaaaaatgagtgaacaacatatcttggtggaggtgcagaaggtatatttactgaagagaggaaagtaaaaagagggagatttgtaatctctgaggaagagtattcaagggcttagacacagtttggttgtattttaagcaaggaaatcaatgatggattggtaaaaagttaactccggggcaactttttttaagcattggtaacctgtgagaaaatgatctatagtaaatatttctttttattcctcaggcagtacttaaagcactgtttttaggagttagatgttttccttatactacttttttaatagtagtaataaccctctcaggtaagagttgttaatttttttgtagagatgaacaaataggttcagagagaatgagcaagtggttccatttacacagttaataatcaccaccaattgtctgtctgattgaattaaatataagagggaaacatatagaaatgaggagataaattgcagccttgatagaaaaggagaattgtgtttgtgctatggttcttttgtggtccatagcaatttaattctttgtgatgaacgtaacactgataataccaaatttcaatgaccacatattcaattcataataaacatttattataaatgccaacaaaattggtaatttaaagaattctctatttttaaaaaaagaagacaaatagattacttttaattatatctagtcttttcctcagcctgttctattctgataaaggcttaagaaggaaatggttctgatagaaaagaactaccctgaaatgtggattaagacttgtcacccatagaaatcctaggttccacagctgtgaccaatccatggcattcaaagtggatctctcaagaagaagcactgtagttaagaaaatttctaaaagaattttgttcattcttgagtcaaaactttgatgagattaaaacattttgttccacttctggggtctcagtgttgaacaattttagcctctttaagatgaaaatacttttcttgaggtttttaattttttttttaacttcaatatcttttggggtacaagttttcttttttttacatgggtgagttacataggtgaattctgagattttagtgaaccagtcagccaagtagtgtttattgtacccaatatgtagttttttatcccacaacccactcccaattttcccacttggagtcttcagggtccattatatcactctgtatgcttttgcatactcacagcttagctcccacttataagtgagaacatacagtatttgagtttccattcctgagtgacttcatttagaataatggcctctggcttcttccaagttgctagtaaaaacatttttacgttgctttctgtgggtgagtaatattccatagtatatatataccacatttcctttatccattcatgggtcgataggcacttagggtggttccatatccttgtaattgtgaattgtgctgctataaacatacctgtgcacatgtctttttcatataatgactggataaaagtactttaaaacaactaatgattccaacattatttccagtggtactggtaatgcattcaggcagaaatttttttttactcctggatttttatctgaactaatgcactttttgtatgccaattgccaattaaagtttctgattttttgcattgcccctgagatattttatagccttgggcaaaaaagtgtactcttccagaccacaaagataaatggagaaaatagtgcctttccttaatttatggcgctgttgtaatcatttaatgtgtgcaacatgctaaatgttgtcattatggtacagtattggatttctttgttgtattacggagcagaacattcaataataataagatagaacagctttttctaacaacttgtgttcaagccactgataataatgaaattatgccagatgaacttattctccaacctcttcctgaagagtcagtgggatacaaaatgtttgagtgaggaaaagcattaatggacagaaggaaagtgtagtcattactctggggaatgacatagttgaacaactgaacatgcttttcagaaatgattacactcataactatcagttgtactagttcggccttgaaaatacagtagctatcccattttacaacataatgtatagttatgtcatataattttactggaatcttctaatgtaagttcccattgttagcagtgaaagaaacagctggtcacaagtacattgtttgaaagagcaagatgaaatagaaattttttataagagatgcattcctgtaatgtagatggtgaatcaaagtctttagagtaagagttttattgcaataatttattataaacattatattataatgtctttagttcactactataatatccttggttctttgagaaatcctctccctcccactattcaataaaaatatctgatgcactttttcagggcttatgaaaacaataaatattgtgacaaatgactgttatcatgtctatggcgtctcatttgagtacagattcttttggcgcagaacaaacagggccaatgacttaacattaggcttaatcagttatcctagaaatttaatattgaataattctttaactttgggtaatagttaatcatagctactaggcatttttttttaacatctgttctttcagggaaaaaaaaaaaaaagaaaacatcatataatcaggtcttcctgaaattctgttcaatgtgtttctgcctaattctcctccaggactctgtttgtttctttaatgaccaagatttcttttagatgagtattaaattctttgagtttgtaacgcaacacttgcaaatatttcgctagaaatttatacacacacatctgtcattttattctacaaattgatgttttctcattctataacataaggaactcagtatttaaagttcaaagcaatcaccactttaacaaactcttgagcttgtagttgaaagttcacacacattttacagaagagaaacacagctagagaaaagagcctaatcatatagtcagtaacttagattcatgatgactattctgtcttgaattaaataagctacccttatttgaatagtttgggggacatctaactagtatgtttttaatgtatattttcattaacatttcagattactcattcattcactaacatttttggtacatgtgccatgtacactattctagatatgtggggttttttagtggttaaaattgtcaggttagaagccagatattatttattaggaatttacttcagctctccattttgtaatttccttgtgtctgagaaattgtatctactttgtagggtttttgtgggtatcaaatacataaaaacatatgtaaagaataaaatgaagcctgagccatgttatggtatcaaatcctagatactattaattactgtattctcatttaatcctcacaataagcctgttgggtaattattattattctcattttgcaaggagccatgctatcctaaattatacgtctaagaaattccagaattcagatgaactcttagaatagtccgaatttcaaaatcatgttctttccattacattgatgacaggacatttcaggcaaaataaatattgtgagcataagcatattggtgttgaaatcagaatgtttcatggtggtctactgagaatttacccctcttgattttagagttgtgggtaggtaatgttgaatagttggatggccagtttaaagacaatctgaaaagacaggcattataataggaatttgctgaggttgacatttgaagacattgattatatttaggtatgtcttaagatggcaggaaaagataaatctgtttggaaggggacaagattagcaagacaagtgaggatgattttgtaggaatctaggtgtgaggtcacacagccagactaaaatggtgtcggttaataaaaccatgtccagaaaaccatagatatttataagaaacaaatgatacgttgatagactataataggtgaataaggggaaagagtaccttactttctgacttgagagattggcctccttcacctagtaaataaatcaaaatggaatacatgctatgtgtctgcccttgtgtttagcaccatgcagtaagtggtagaactagaacttgaactctggggtgttttgcatgaaggtccttactctcaatttcactatactgcctccaacctatgagtgccatttagctattttgattctcattctacagatgaggagaatagggctcaaagatgcctcaggttgtcttaacaacagagttatcagttgtaaaattcagaaccttcgaaatcttgttttgtacttcattattattgaattcttttatagttcttttagcataagtgtgagtctctatgaaaaattattttatttacttgaggttatgctgtgcctcatatgtttgatgacacattggttctatttgctctgtgtgtgcgcctgtgtgtatgttatatacctaggcttgagcagggcaggggaggcaaaatttcctcattgtccagagtggaacctctcagtctttcaaaggagactcctgcattgggcattggagatgtcttatgctttttgcctttgctacacacttctgatcccggagaaacgattttcattctccagcaatgatttaaaaaataatttatcacaaaaattaaatagattgcactgtaaaaatcatataattactcctgtaaaactacagatgaaagcatgcacagaaaattatagtggaaagtttttaattagcttctgattaactgtaagcttatgttttaaatgtaccatgcagaaccttataacaagtaggcataaattaaatagtcactaatatgtatgtagcaaaaatattaatacggctgctactagggattttcactggcatatttttaattttttttttttttactttaaagtggagtagattctgtagagttggggtatcaatcacatgatcattaaaagggcaaaatattttttcaaaacttgtgcaataatctttacctaactggctatgtggttggtgatttgttcctctcttaaagagcgaacaggcgctctttcaaatggagatgcttacatgatttcatgtatattcttagttttcatgggagacctatcccttcagtagaaggaaatgctagctttaggtcacagcaaaactaagctttatttttcccattttgtctagtctatgtttcacatgttaaagttgtgaattggacacttaatttgagtgagagtcagggtatttttcaaactatatttagtgactttaacttgctgagtgacctaggacaagtcatctaagctctctgggccttagtgttctaactggtaaaattagaaggttaaattaaatgatctttttacctagtgtcaaatcaaaagaatcacatttctatattaattgtatttttaaggttgttggtacctaggttcttttaataatatcttggaaataaaacattattatattctttaaaatgtacatataacaattgtacatatttatggtatgtaccatatttatggcaaaatgtgatgttttgataaatgtataaattttgtaatgatcaaatcagggtaattaacatagccatgactttaacatttatagtttctttatgatgagaatattaaaaaagtctcttctagctattttaaaatatggaatacattattgtattatatatcatagtagtcatcctgctgtgcaatagactaccagaccttatccctcctatcttactgtagatttgtactcgttgacaaatatctctacaagtgtttttcacaaagaagcccctcagtattctgacatgaggaaaagcaacgaacttgctttccatttatgcaaattagattgttaacttcctatgcaactaggaatacttaacagtacttaacaatatttatattgttcctttggacataagtatggctatgattgcccccacctcccaaaaaaacaacaaaaaggaatcataggaaacaatttttaaacttattttcaattttttttattattgattaaataaaagcacaacttaacaaaatataggcagtcttgtactttatatacaatgatccttctggggagacatggaaattcatctgtcttcctcaagccaagtgggactgttctgtcctaggagaagggatttttaaggagtggggaaggaaggggaaaaaaaggaaatcttttccttattgtcaccactgcttacccttttcaaagaagtatcttcggttcttagaaatcccatgcccagggtgaaaatggagagaaagaaaacacaggaagaagagagtatatatagagagggaggccagggaactaggagaacagaatgagaggcaaggtaatctctctcacccttttaggaaaggactctcattgcctgtgctccttctttacctgacaagctgcagttgcccctacctctactgttgcttttgttcctctgtaataaagaggtagagaagaagggaagaagaacagctgaaaagcagagaaaggaaagaagagttggcagtgaaaggcaaactcatagattgccttaaaacttccatggctgccacttctggccccctgtccccactgcttcatcaccatgggctgaagctagcatttaaagggggaggaaaagagagaggaatctgaagacaggaagctctagtctctttcagtatccactgtgttcttcatctacccaccccctcccctcatctgacaccttgcctaggacaagggctcttaacccctgagcttccaatagtccctaaataagctgtacaatgttttttactctgtgaaattgtaggtagagtttgggtgtctttggggcggggagggttcatagagtttctccgatttttagatacacccagcataacctaactcacctgtgctttttaatattcttctttggcttccataggctcttctgaaaacctaaccactatatgcacaaagttcttaccattggaaaacacctttaaatgatacacagagaaagtttccagaaaaatcatttcaaggttggagaaaacctattatacttttttaaataaaataggaaataataagctggattgaggtaatatatatttggctcctactcacacaaaaattttgaaaaagaaaaaaaatgtttaatttattttttaattattcatttgtaatcacgaaatatctgaactaaatatttgaatctctgcaaaggctgggagttgctatgtgttgttgggaccacactactctcatatcctgtgtaaataccccatgactgagtaaatattatcatgcaattttagaattagaagtttagatgttttgacctaaatgttttccagggttaaaatatccttcttacagaacagtgatcctcataagtttaaacagactggaaacaataaagcctaaaaagaaaatcatgcacatcaacaattttctttctatctttcaactttaattttcacccttatagccctaaaccactaatttgaaaagatttttctaaaagttcatctttctaatatatcataatatttctttttttctggccctggaagagattgagtactccgtattttttaaatatataatggatatattataaatactagaaatgagtacaatactattatttaattttgtgccaatttcatgaatgaggaaactagatattgagcaaagtgcaaagatagacattacagtcctgacctctggtaagtatttcagaattgtcactttcaaaaggtaattcaagaacactgtatttatgtatctctcaataagttcactatttgcctctcctatagaaacatggtagttgttgtgtgaaccattatccaaagcaaagttagatcaatactactgaagtaaataaattgaaaactatattaaaactgaaaaatgtggttgtgaggacatgcaagaaaaacaatgtggtgctactagcctggaattggtatgaataagccctttaaaaaagaaaaaatgaatccttaatctttatgccttagtatcttacaattctccattaacctttgataaaaccatcatattgggcacaaaagaaacacagtcaatgaatttttcttgatattcttttttacaggaaaaaaatcaaacaatgtgattcattataaaacctatggtcagaatcaataatctatgccttcatatcatgcctgtttagataataattattaagccaccatttaaaattttttaaactcaaattccatctgcaaaaaatctattttgcttttaaaacttaatattaggtttcaactttactttctgtcatccttcttttggttgccacatcagtagactcagaataaaagcatctgcccaaagcaaatacactggagttcactgtcaaacagagattcccaagaaaccaaacagaaaaggaataaaaatgagaagcatgttttattaaatgtcttctacacctgcttcctttatcttttagacctgcttaccaaagcccattggatattttgattttttaagtcacaggcatatgaactagcttgaacatttatagtatcaaattattaaaggtaatgacctggtatttaaaaaatgatgttccacatctaggggatctccatgaaagcttttcagctgaataaaggttataattgttaaacaaattggttatttattaagctagcactataaacaaaaagagtatttaaacagctggtatccctgtgaccctacctttaatcttctccagagaaaatgtgacaagaagtgatatttaacaataattttagaaaatgtaatgaacaccaattgattatgtaacttgcattttattttcaaaattacattaaaatagtatgcaactattcatttaaatgcattttagaattaaaatgaattattttcacctacaaaacttatgtttaaaaatgagatagtactgttttattattgatctacattaaattagcaatatgttaaaattcatttctatattgtaatgcttggaaaattataaatttttgaactttttaaagctatgcttgaaagttcaagagagccttactcagtaatgaaagttaaacaaacaaattaataatacataaacaaaaaggttgtttataaccagtcctgcacaattttaaatctatgcagtagagcaatgtatgataattttaataaacacacaatatatcaacacattttcatggacactatatttttaaatagaaatttaattttggaatatttttaaatgtatagaaaagttgtaaaactagtacagagtttccttatactttatacccactttcttctatattaatatcatatttatagtacatttatcacaattgagataatattgatatattattatcaactaaaattcatattttattcagttttcttttttagtttttacctaatgtcctttttctgtgacatttacataccactttatgtttagtcatcgtgtctctaagttcttggctgtcacagttgttgaaactttacatttttaaaaataattttgacagttttgaggggtattggtcaggtatttactagaatgtctttttatttgaaattgtctgacatttttcttatgataatattgggataacagtcattgggttttgggaggaaaacaacagaggcaaaatggcattctcatcacattaaatcaagggtacttactgttaacatgatttactactgtccttgatcccctggctaagttggtgttgccgtatttctccactatgaagttacgcttcttcccttttttcattttgtggtctttagaaggaagtcactatgcaaagctcacacctcatgttccagaagctgcttttccaaggagtgaatatttatcctccacccttttgagtgtggagcatttacttaaattgtttggatttatgctctgcatgagagacttatctattatcttccattttaaaatgtatttaatcatcctatcagtatggactcatgaatatggatattattttatactatgaattatagtccattactactctattttgttgctcaaatagtttcagacattatcttttgaactacttatggttggaagttcctagcacaatgccagaaacatagtagacgttaatggtaatttagtgtgaacctaaacttaaaaatatgctcatgggccattttttaatttaaaaatagaaagtatattctattaagaggtactcgatccctaattgcaaatccccacttatatccttcgaaacaaaaaaaaaaaaaagaggagacatggtatataatttagatattgccacagtaatgtggcattgtatacaaccatgaaactcagcagcagacaacaatgaaaatgtatttagctcatgaatctatcagggtaagctgatctgggttaagtttggctgacttgggcagggctcactcatatgtgtatatggcagaggtggagtggtcacagggggagtcatctggagctagtaatgcctcagatgacataagtggagcaactcagctctggtccatggttgcctctcatcatgaagcaggacagcctgagcttgttgtcatagcgatgagcaaaggcaagtaagcaaaatgtgtaagtgctttctgcttgtatcccatttgctatccttacagtggccaaaggacagcataaggtgagcccaagttcaagaagtggggaaatagactgtaactccgtggtgccagaaactgcaaagtcacatggcaaatatagtgtctacaggaaagggtaaagaatagagaccattaaaccaatcaatctaccatgcattaactatacaaaggaacgagtctaagctctcatgggtgtgtgtttattatttttgaaatcagttttcaccctgtttttgttatgaattatgacagtgagtggaagtgcagcattatcattaactatgtcatatttcagaagccgttcttcccaaactgaggaccaaatcatttaaaagtatgatagtaatttacttttcaattctgcactcattttagattataatgaaatcttactgaacaaatgctttttaacagagtatgtttccaatatgaatgaagatttcatgcagcaaaacttgagctgtaataatgaacaggtctgaaaaaacgaaagaataagctaagcctataaatctcttccatatacatttatgacagaattagacatatgaatactctattcttagagaatattcagtaaagcataaactcttacttataatgaggtctccatggaaatgctctttcaaatagagttattgacaattgcaaaatatacaacttgcaaatttttcgttttagggtttgtttaaattaagctttaagaattcatgcatatcaaatcctatttttttctgtagaaaaattcaaataaaatcatctgaaataagtcccctttttcttaaaacatttgaaaataatgtatgaaatgtaattaaacataaacttcaatgttcatatctcaagttctaaatacaatcctggaagaagcagtttctattacacttcccatagaaaactgcttatgtttgaggtagcattttgttttgaaaaagatgtgagcttcagatcctccaggaagctctaggtagatattccgattttctcttttgtaaaattggtttaaaaggtttttgtttttttaatctctctgatcctcggtttcctcatctgtaaaaaggaagtaatctgcctgcctcatatgggttttaatgagaattaagtgttacataaaatgtcaaacttagcacagcgcttcacacataacaaactccttactaactccttactcctgccttccaagatgtacacttttacatttacttacttagtactccactccaatagttttcttttgcataatagaatgcaaaatgcatactagaaaggaaattgtcctgcagagtttcagcaaaacaaatgactggcacaaaccagtatgttattacaaggatttatatacactcttgttctaatcatattctgtgaaacgtaacaggagcatatattaaccagcttcatataaccaattttccaaactaatatcaacactaaaaagattttcaggtatattaagctggagaactttgttcagaagactttaagaagtggccatataggaaagcaatcaggattgcaaacattaaactttagcataaataccacttgttcctcctttcagagacaatgaaaactcttgcttatggctataataatcaggctacaaggatttctaagaactgttcttagtttaatttttctgctattgccagatgcttttcaccattctaggtgcccaaatcctgaagccaaatttaataaaggagaaacaggcctaattgataaatggatgttcagtatgcgttttccagtcagaacttgccttggcttagtggaacattctggtagttcaggcaaaaagtgtttcactacaagatcctgaacactatattgcatagaatatttgaaaaccagtgatgtccaagtcactaaattcttcctttacttctttcggatgggactaaagagaaggagtagcttgaccttgcttctatcaccttaagaaatatatgcacactctcaaacaagctgatacactgaacactggattatagacagtgcatttaaattttgtaatggatatctgatgaactagtcagagggattgaatctaccaattaaagtctgtcccactgcaaaaatagtcctcctgggtctgttgccaggaagaagactgagtaattaagatcaatgcagtttttttttgtattctgatgtccatcccccaaaacatcacttatttcattgtcccaccaagggggatataggaaagggctttctatcaccttaagaaatatatgcacactctcagacaagctgatatactgaacactggattatagacagtgcatttaaattttgtaatggatatctgatgaactagtcagagggattgaatctaccaattaaagtctatcccactgcaaaaacagtcctcctgggtctgttgccaggaagaaaactgagtaattaagatcaatgcagttgtttttttgtattctgatgtccatcccccaaaacatcacttatttcattgtcccactaagggggatataggaaagggcttaattataagactggtcagaaaatataagacaaaggtatccttgacattaagaatttcatgattcataacaactttaaaatattgtctattctccatatgaagtgactttcccttttaaattatttggtatttatggaactaataatgtgttgtgctaacacagagcttttcatccaagaacttcaaagcactctttatttgtcacattctgtgatcatttagtttgactataaaatattttatgattaatattggagcgagaaaacatgcaggaaaacaaagtataatattgggggaaatttcaaatacataagatttcatcctgactaattatctcagttttctgtagcccatggtaaattaggatgaaatatgcttgcacttaaaacttagctttgctaacatctgtttcttttaaattagattttaatttaaaatggcttgtccttacttcaaaaatatgagattatttttcctccgattttgagtttttcactaaaaatcttatatattaatatatataaatgtattctacattggcctttttatcctcttgggcaattactaaagtaattcatagacctgttcttactggtaagtagggataaattaaattgtcaggacactaaagtaacattagataaattatgtttcactgacttaaagacagttaattctctagaaatgaagcagtttatttcttaactcatgggtaagtttatattggaattttgaaggtgctcgtgaaatcattgtttaaatgaggtcttatttagttgagcacctaatgaaatttcttgccatttctcccagtgattatacatgtatatgtaaactgtcaaccagtttcttcatgtgaaacgcatcctaaacttaatattttaaaatccttatatatgtgatttaagagcaagcctctggagagaaactgttgtatgaaaataagtaaaatcattgtttggcttgctatattatagtctttgcctatgctactaatcaatgatatggcatcaggcaattccttaactttcttcaactgtaaaacaagggcatacaggttaatgactcctcaggtcattttaggcttctatatgatttaatacatgatcactttctaaaatatgtatttttttatctgtttctaaaccatgcttatggttgtttactactgacaaaaatataagattaattataactgatgtcatacctatagtcagcagtgctgaagcaaccagtgacaagtcatacaacaaaaaacgtgtctcctagagctgttaacagtaaaataaaatccactcttactgcttctgaatttaaatccgagtactttcctgagtaaataaaaggaggacacaaaccctgctggacgtttctgagagcacattatgactgtcactattttctttccattgctatcatatgactcaatgtcagcacagtgctattcatttttactctttatagggccataagtaattgataaaatggtattggaagattcatttgttataattcttttagtagcaagtaataagatgctatctcaaactagattacataaaaatgaaatttattgggtcacataaaacttagaaataatggggtaggactggctgcaggcctagaatccagagcctatatgatgccaaaatgcacatcttaccattgcttcacttgtgtattagtccatttttatgctgttgataaagacatacccaaacctgggaagaaaaagaggtttttttttgtttgtttgtttgtttttttttgagacggagtctcgctctgtcgcccaggctggagtgcagtggcgcgatctcggctcactgcaagctccgcctcccgggttcacgccattctcctgcctcagcctcccgaaaaagaggtttaatggacttaacagttctacatagctgggcaagtctcacaatcatggtggaaggcaagaaggagcaagtcacatcttacatggatggcggcaggcaaagagagagcttgtgctgagaaactcccgtttttaaaaccatcagatctcatgagacccattcactgtcacaagaaccagcacaggaaagacctgcccccatgattcaatcatctcccaccaggtccttcccacaacacatgggaattatggaagctacaagatgagatttggatggggacacagagccaaaccatattagtttggttttcccttgtcttgacttcatttggacaacttgttgccagtgtattttaggatggcagggattaaaatccatccattcaacaacttcagtgtaaacagtttattttattttatttatttatttatttttgagacggagtctcactgtgtcgcccaggctggagtgcagtggtgcgatcttggctcaccacaagctctgccattctcctgcctcagcctcccgagtagctgggactataggtgcctgccaccacacccggctaattttttgtatttttagtagagatggggtttcaccgtattagccaggatggtcttgatctcctgacctcgtgatctacccgcctcagcctcccaaagtgctgggattacaggcatgagcctgtatttaatttttttaaattaatagttctagcaaaagttcttcaactgagtcttcttagtttagtgtagctcacatgtccatctaaatcaatcttatgattcaataagatggactctttcttctggccaaattaagcatgtgcacatctcttgagctggtcagggttggagtggggaatgaagtcaactttcctgaactgcataaactgagtactggggaggagtgatgatgcaatgacagtcagggtgctattcccagaagggtgaatgactgctaggttatcacaagcaatagatatccactacaaacaaaagtcaaagaggaagaaaaagagagtcagaaagggaaggaccattctttcaacaactgtatttgaagtgttaccatgtgtcctgtacactgagaatacagatgtgaacaaaacagacaaaaaattcttgtgtccttatgtaactcttaatctggtgggagagacagtgtatatgttgacctctggcaaaaatattggtgtaaaacacttcatcatgtgggaattatttggattcaaatattaggtctaagactggatttgcttggttaatttctcactttcatcctctgtaattttgaggagctcaaagttgctaaagtttttttattttacttacaactgattgttgcctataacagaaatatctaaaaatgtaattatatatttttaaaccgatatcatctattataagtaattatttgctttgattatttttcctataccttttggagaaatctttagctgtttttttataagcctttcccaatttctgaaatactatatgtttctatgacaataataggacttcatggcaaaaatgagactaaaacattaggacatttcatccacaataattaataaggaagacaagctgaatgcataaagatattctgattaattcaactatattacatgaaccctttggtacatagatggtagggaaatccaattagctataatatttaagagactgctgtcctaatacatatatcatctttctaggataatagcttcttcctctgattgtacattttttttcctccaaaggaagaaaaagaaaataatctaacgtggaaaatttttcttttgaaatctaccccaaaatttattacaatagtgtaaaactccttttaaaattttaaatgtattcaaaataccatacttaaactattctatacaaattagaagcaatttattttatagctataaataagaagagattcctaaactctcatattttatagtaggaaaatgtatatttttatcaatcttaaatttaggccacatttatattttaaaggaaatggtgtagcctaaactcaaagtttatttgtaaataaataagtctctaaacaatcactcctatgatgtaaaataaacttgaaagcaagaattttccctctgctgcccactaatagcctttgctttctaaacctttagtcatatctgtcatgtcctttaaaaagaatgtgatcttccttaaagtatgagcttgatagtccaattattgatcttctgctactgggtatgatggagaatccttaatttttcacagactatatactgatctagtatatagtctacactatatgtttgtactatattatacaactttatactatacttaacatgtttgctttttacataattcccccatattgctgacataatctattattcataattcggactccttggcattttacttacttatctttatacataagggacacacataattttatttttaaaatgttagttaagcttttaaaaagtctcagaaaaacatgaaaaatctctataattcaataatgtatttattcagtatctactagggaggatttaatcgataaatgttaaaagaaaatgtttcaccatagaatagataccaaaattatatgataatgaattatctaattattatgcaaacattttattaggtatataggttttattattttcttgtaattctcaatacttgaattttacaagtgtcactggcaaatgttgactaatgacaaaaatgtcaaatacttgtctctgtgatgaagcaatcatgttgctacagatattgtatagagacacagcccagatgtggtggctcacacctgtaatccctgcactttgggaagctgaggatctcttgagcccaggagtttgagactgcagtgagttaggattgtgcactgcactctaccctgggccacagagtgagatcttgtttaaaataaataaatgaaggaaggaaggaaggaggaagcaaggagggagagagggaaggaagaaagaagggaggaaggaagaagcagaaataatgttataatactacagacgaaggtatatgaaatcaggatggtaatgacagttgcaaaataggtgaaagcatttgctcttcctgccagagcaagatggctggggggccttagacagtgagtaatcaaaattggaagcagaaactatggcttcctagttgctagtagctagggtaatgagttagagagttaggattaatgatacaggatttgtatttctcactagtcaggatccaaagaactttagaatcattaattgagagtgggaagtgtaaccaggtctcagaagaaattctatttaattgtttaagttatagacctatactgagtgcaaagttccatagtggtgatgacacagagtggactagaatcccagagcagtcattatttgaatggtttgtgcaattgacatatgcctcagtttttgtttttgttttttaaccaataagcatggaaaaaaaaaacctcctatgttagtttcttatttttcatatatagaaagtcatatggaatactcctgctatatggtaagtactccacaaattacagttactaggctacagataaagaaatggtctaattttgaaataagcttatgatcttttggaaagtaagtaccttatattatgggaattgggtatgtgaataatcggggctcaatatgaaattttgaagttctaccattctgaattggaaaattgaagcaagtgttgatctgaaatctaaaatgtcatgtgcactgagatcaggatacacgtattcagagagcagaatgaattcaatctcaaggcagagggagttaacttctgtggcctatttatatttctgaaggagtcttccaggctgaaggtcagggcaaaaagtatagtcatttcttggagtgcaaaatccctgtgatgcagacactgttctatttgttgttgtcattgttgttactgttgttgatatttggctataacataagaggaaaagtgtgcttatagagatattttcttttctattctgtgaatatcataaaaagtaaggttagtaaatgttataaatgaattctgtcagaaaacactttataaaaggaaaaatctcacacgccatccattcaacaatatttaaagcccacttagtatttacaaggaactctactaatcaatgaaaattaacgtgatcaggctaaagcttttgaggggaccaggaaaaaaccaagtcataactagagaaagcaccttggggaagtttggctatagaaatacaaaggcatagcatctaagtcaaatgaggcgaaaggaagtcaagagaacatgaaccaggaagggaactctcctcctaggaggtggcacttgagaagagataacaaagaaagcattggttgcacaattctaatgtcaataagcaaaatattcattgattatctactgcccgtcttagaatagcacaaagggccttttcaggcttgtcttattttgcttaaattttgaggttgtgatgaagttgaagaagggaggatggacttggagaaaaacctccaagttataacttctcaaaggcagtaattagagagtatctcctctttgtctctgattcaggactcagctaaggcccagcaaatgggaaacttcctttttaaaaaaagccagtgtagtgctggcagtcattaaagatttgctgaattactgacctcttatcgcccacatgccctggggaatctgttagcagtccaccacctcttgtcactaatcaagatgcctttatgttaacacctcccttttaaaagcaaatcagtcaggaaacttaagtagattaacacttaatcattaattacctcatgggataaccaaacaaatttcttttctgtttaggctatctctgatcttctgccccaggatatatttttcaggcattgaaggactgatgtgagttactctggtagtcctggcacttagggtcttggtgaatctgcttggggaaaggaatgaaggcatggaaacaggacagaaaggtgaagctagagcagagaaaaagcactgaaaagaaacttcaactgatttttagtttcacctagggtatttctaggagttagaacctccatccaagaatgcctgagctaatgtaaattaagatctgactttatgtcttggttctacccatcaatcataatcactcggttattaacagagtatttgccaaaggccaatggcacttcgtgaccaaacaagaagaaaaggaaatatgaaagttcttaatatataacttttcttgtgggtttacattttctttttttttttagttctgaatcaggtaattgattcagtttttcatgtttgcacagtttatttaactatgttaactaaatggtctgaacagaatagttgctaccatggcttaagttactggttcagtgtctatggcaatgcattaaatcaagtttctgctcccagttttataaaaaggaaaattgactagatgagaacattgccaccttattcattatgtatagctcattagttcccttgtcaactttcctttgcttttaatcaattgaaagaaaaagtcttcatggatttttagtaggaaacatatggagctgtaaatcatcagtaatgtgtgaacttatatttacaggtgcaactgaccttgactgtgcatccttcccaacttacttcttataaatcctgtaatcaataagtgaaatagtattccatacccttcataattcaccttccaatgtctgtttttccacacatcatctaagcttctataaaacattcttttcctctgtaatggactccaatcctgtttataagttttataaataagagcttaacatttcttctcaatacttagaaatgacgataaaagaattagttgacaagattggtatcttaagaatttcaactccacttaaatatctaagtggatgctgcattttttcaaagagttaccctgagtggcaatatattcattccaagagtgttgcctttgcacatagatcattgcagctatccctttcaaatagcatttagaatctattttcagatttaaaaaatagtctaacattagttttaaaaaataaccaaaggtatttaatgcacaccactacatattatttctttctatatacatttgtgaatttattgggaagagtaaacagttggagatgtgtcaatgctgggtttgaggttggatgagattttatattattaagtggagattattacattagaatgagactagaaccaatctatcttgggcctttatacttcttttttctccctcaggtttgaggtatcaggacacatttagggccctgttaccttttaaacataatatgggctcaagtaaaatgaactattattttcaaaatatattaacgcattacaggatgttagccaagtaaatttttatacatatttattttactttaagtgaatatttaaaatacattttcagtttgtttcttaggataagtgagaaaaatatcaaatatttgagagaaaaaaagatttttaaaaagagcgagagttactcataaaaaatgagtaaattcggccaggcgcggtggctcacgcctgtaatcccagcactgtgggaggctgaggcgggtggatcacgaggtcaggagatcgataccatcctggctaacatggtgaaaccccatctctactaaaaacacaaaaaattaggcgggcgtggtggcgggcacctgtagtcccagctactcgggaggctgaggcaggagaatgatgtgaacccgggaggcggagcttgcagtgagccgagatcgcaccactgcactccagtttgggtgacagagcgagattccgtctcaaaaaaaaaaagaaagaaagaaattacatttaataaaactgattccttcaactttaaatacatatactttttaagataaggtctccttctgttgcgcatggtgaagtatagtgagtatagctcactgcagccttgaactcctgggctaaagggatcctcccacttgagccccctgagtagcttggactacaggtcaccatgcctggctaatttaattttttgtgtatagagatggggatcttgctatattgtccaggctagtctcaaactgctaccctcaaatgatccacctatcttggcctcccaaagcctggggattacagccataagctacctcgcccagccaagattttgtttctattttgggtgcaccctttataagagatcaagtacaccattaacatgttatgtgtattacttggaaaatgaaatggaaacattatccattcaatcactaattctctcaagaagacatgcctatattcccaggggctaaattatatattttttctaactgcattcctaactccccagctttctccagatcctgatatgtctcctccctgttctattcatttccattgtgttgaaaaccatactctgcaaggcgcagtgtgtctgactgaagtatattatgcacgcgagctttccaaaagctgaaaaaaatattgagaaccaatgaataaaaccataggtatctaaaagacattgaataataataagagatatacaatagaatttaagaattcattaataaaaagtataactggagtttttctaaaataatggactcttaaaccagtaaaatatatatctaatttaaaatggtttcttttaaattataataaaacatatacatgtaggcacatcttattaaacaatggacaaatgtagaactaaatttcatttccacttaaaaaggcacaggcaggtttcaaatggttctgcatataaacttgctgacatgaataattttaaatcaggccagttatagctttcattctttgaactgaattcaaaactctcttacttttacattattagagagatgaatcaaatgtttctataatgcctactttcattcaatccacacccaattttagaggactgctgtcacaatgccaaaaaaacatagactgaagttttaataatgtttcttatatgataaagaaattctagggtaattttatagcacagtataagtgctgaacttgtgttatacctttcaaataacagtaaccacctctaatttcttaaagggctctttaaaaaaatgcatggtatgtccatcatagagcaagaaatgcctctttttataatatattcaaaatggaggtggttatgtttccttttacactggtattgcaattcattttctgttagtaagcaagaatattgaccaactgtattacactctgttctcacactgctataaagaaatacccaagactgggtaatttatcaagggaagagatttaatggactcacagttccacatggctggggaggcctcaggaaacttacaaccatggtggaaagggaagacgcacatcttacatggtggcaggagagagataacaagcaagagcaaggaaaactgccttataaaaccaccagatgtcatgacaactctctcattatcacaagaacagcatgggagaaaccacccccatgatacaatcactgcccacttggtccctccctctacacatggggattatggggattacaatttgcagtgagatttggttggggacacagagccaaaccatatcaccaacataatataaaatcactttgaaaggacctcaaaatacatcctaaaatttgtttcaaagatgaaaaatataacttaaaataccatgacttctgaatcagggtagtttgcaaggtgattatcttcacaattagaaccaaaatgcttaataatactattttagtttgtgtaaaactttaaagagtattcatgctcttcatctccctatttctatcttttttaaagaaaagcagtcaattagttaaataatcactaatgcagttttatatgataataaataatgacaccaacttggattgtcttaacaaatctgaacagtgacttttcttttgagaattgaaagcatccctagaaacaaatttgcctgtatgtttaatgactcatacattccaaatacatccaggagacaatcaacagtttatctgatgtatgatatataaaacaaattatttaagtgaacttcatttatcttagtctatacgatataatcataatgctatttataatgagctcaaatagcaacaagaaaatattggagaagttaatattgaagaaataaaattaatcaagctgtcctactattcaatttctgaatattcagatacagtaaatgttagttaatacatgaacaagtaattatcaagaaaataatccgatttacaataactaacaaaaaaatcttatggatgagtttaaccaaggaggtgaaagattactacactgagagatcaatacactaaaacactgaaaaacattgataaaaaaactgaagaagacacaaataaatggaaagatattttgtgctcatgaattagaacccttaatattgttaaaatgtccatactattcaaaacaatctacagattccattcaatccctatcaaaatatcaatgaaattcttcacagaaatagaaaaaaatactctaaaattcatatggaaccacaaaacaccccaaatagcaaagcaatcttgagcaaaaagaacagatctggaggcatcacaccacctgatttcaaaatacactacaaagctaatagtaactaaaacagcatggtactggcattaaaacagacacacaggccaacagaacagaatagagaagatataaataaattcatgcacttatagccaacttattttcaacaaaggtgccaagtatacacgtgaagaaaggacagtctttcaataattggtgctgggaaaactagatagtcacctgcagaagaatgaagctagacctctatctctcaccatgtacaaaatcaattcaaaattgattaaaggctgaaatgtaagatctgaaatgataaaactactggaaggaaacctaggagaaatgcttcatgacattggtctgggcaaggatttttttggataagaccacaaaagcacaagcaagaagagcaaaaatagcaaaatggaattacatctaatgtaaatgctcctgtacaccaaaggaaacactctaaagagtgaaaatagaacttacagaatgggagaaaatatttgaaaactatgcatctgacaagaggtaatatacagaatatatcaggaactcaactcaatagcaaaaacccaattaatccaatttaaaaatatgcaaaacacctgagtagatatttctcaaaagaagataaacaaatggcaatgggtatatgaaaaaatgctcattatcactaataatcagggaaaagcaaatcaaaaccacaatgagatatcacctcactctgattagaatgactgttatcacaaagacaaaaaataacaaatgctggcagatgtggggaaagggaattcttatacactggtggaaatgtaattagtattagctattatggaaaacagtatgtaggttcctcaaaaaattaaaaatggaacaaccataaaatccagcagttgcactatggagtataaatccaaagaaaattaggttggtatgttgaagagatagctgcactctcatgtttattgaagctctattcataatagccatgatatggattcaacctaagtatctaccaatggatgaatggataaaggaaatttggtgtacacacacacacacacacacacacacacacacacacacacataatggagtactactgagccctaaaaaagcatgaaatcatgtcatttgtggcaacatggatgacacttgaggacattatgataggtgaaataagcaagacaaagaaagacaaaggccttccttattatctcacttacctgtagaatctacaggagttgatctcatagaactaaagagcagaatagtggctcccagatctggaacgtgtacaagaggaaggatggggagaaactgagtcagcaggtacaaagtcacagttagataggaagaataggttctggtgttctattgcacagtagaatgacaatggttaacagtattgtatattttaaatagctggaaaagaggattttgaatgttctcgccacaaaaaaaaatgataaatgtgcgaagttatggatatgctaaatgccctgatctgattttcgcacaatgtatacatgtatcacaacatcacactatataccccataaatatatttattattatgtgtctcttaaaaacaaaatttcaaaaatggtaatcttgttatactaaggtttctgaaaatgcaaagagaaatgtgatatatatatgttactcctttaaacttaaagagtaaaaaattaaaatcaatgtatcctaaatactaaaaaaaaattagaatgttgagctaagacgacaagatgaaaaagagtagtacttttagtgcaggagtaaatttcagaattttagagattgtatttttaaaggtaaatcactacctgtcctgttaagaggaagctaagacagatactgtggttctcacctgtaatctcagcactttgagaggccaaggcaagtggatggcttgagcccaggagcttgagaccagcctaggcaacatagggacatgccatctctaccaagaaatacaaattaaaaatttagccaggcctggtggcatgcatctggggtgctaccacccagctactccggagactgaggcaggaggattgcttaagccagggagatcgagctgcagtgagccataatcatgccactgcgctccagcctgggtgacagagcaagaaactgtctcaaattaaaaaggtgcgggaagataagtttgtgtttatacctttgtaaatataattctgaaactgtagcgtatttttgacaagtgctttgcttttgttatcaaataatgctggcagtggaatgaggctcacgacattattatcaataaacacataaagaaaataaaaggctatacctatttttctttctaatgttctcaagagtaggccaaaaatataacaagcaagatactagaggtttagttaatctgattgtattgttttcatatagatctctagatttctgcaattggatgtgtttaacatgaaaccttgatatatgatttcactaccaacaacaacaaaaaatcagttgggattatgatttctaatggtgtggaaaccctgttttataaaaataagacacattagctacttaaagttcatctgaacctgaactgtaattatttcagagaagtcctgaaatcattttggtcctgatttagaggtcttctttgtcttttcaatttaaagcaattttcatgtatagatttttaccacatttccaccttttataaaaccctaaagaatatcagtcactaaacctactgtagtaactgatctgatattcatttaagctaaaactttaagctaaaagaaaataattaaatttgtttgacctaaaaagaatgtccttgcattttgtagtctccattaaaaaaaaaaacactccagtaatctttcgaatcttttttcagccaacagctctgtaacatcttgcctctatacatgatactgcctttttagccaattccaacctagagcaatgagtaaccatggctccatccaattttccacatgacatctgtggcagtagaagtattaacaggacttctctcctggagagctttgccttaggaagagcttaaatttctgtaagaaagtcactgacacaggaattcagtcaggactctgcactaggactagaagctgccagggttcagatgctgacaaggcaatgtttcttatctctgagatttcgtgcccttcccccatgaagctatgctcctccagtctggcagggaactcgcctatggacaagagggtgacagacatcttttgatgatgagcatccacaggcacagggaacagaatcttgctattcattgagctgcacagctgtggcaactggattctgcccgggtgtcaacaatgggggcagggcttcagtttaggcaaaagggaaacagcttgagtataaatgaactgcttttaggctctttgaatttatcttccccagatgccctgagatttcagatccactctttattttactaaaacttcatagctgtgaagtgaccatcttctctgaaggctcacatggaaaaaaaacaaacatgtttctacatggtaaaaggcatgtttgcatatttacatatgaatatattgatggatccttggcattaatgattctacaactgtatgttcttattaaactctgggttcagcataaaatagtatcttactgatttatcttcagtgctattgtatggtctgcttggctgcaggttgtataagatgacaaagcattgatttagtgaattttttcacagttttgtgaacaaaaagcttgcatatttaataagtaagttattcaaatcttgaagaaatacaggcacgttctccaggcatttttagaaagaagagaaagagaatctatagcaggtggatatttccaactaggcaaaacgaaaagcacacaaagagttaactcaactgtataaatgaatatgctaatgaatgcataatttatctctgaagaaacatatttattgtttcactatttgattagatggcttcaatgttcaattaatcagttacctttcaatatcattcctgagagctgcttaattaatctgttgcactaccaccctattcatcctattagcaatccctcgtcccatttcaaatgacaaaatccaggaactgtgccacgtaaagactttatgtcaatgtcaagtgaaggttgataagtggctggctttttttctttattaggttaatcaaaccaatcagctttataggatttacatttgtcagaaaatgttaatgagttgaaactaatgagaaatagagggggaaaaccaccaagagaatggtggcacagtttatacacttcaacagcaatatactactttcattaaatagattgttttatcctcgttttctaaatgatggatttaaaatgtcctgctaattaaactcaaactcgtctattgtgttctatattgcatctcttactaacaaaggaagcacaatagatacacattcatatgtgtctttgaatcaaaaagtgtgctgtatgtttactactttctgggcactgtttcttccataatgttattaataatagttctaataatagttccatgaaaacttaccagtttgaaggtgctatgtacatagtatagagtagatttcaagaaatggttgagataccccaagacttaaatcatgggttgagttctttcctcatctgtttcatttaagcttgaaatatctctcttctacttctcttttcttccttttctcttactattgtctgatactccggataattcctcagcattactccctttgctctccagagcagggacgttttgatagaagttgcagcacaaatctcataccacctcctttaccttctcaatgtcctaggccaactttcattttcacccactacctcacatacacacactccttagcattctcagagggatttaatacactttgaatcaatcatctgttaccttaaataacttccaaagcaaaatacatatcaaaccataaggtgttgtttctttaattgtatgggtgccataagtctctttgagaaaactaatgataataatagtaatatttgtcatatacttgagtacttttaatttgccatgcacaactttaaattctttttttctatatgtctcagacagaatagatggagtgtgcaaggatagatggtgaatatgtattttggtaaatttgtagagaaaacgaagaaaacatataattcactaaataatgataatatccaatgtctgttgggggcaaagagcctagaatggacaaaagtagtatgtaaatttagaagggtgggagatcagatttaaggcatcctgaggtcaaggtatatttggagaaaaaaaatactatttaaacttcgttcagaagaatgacgtagagttttaattaatcaattccaaacatgtagagggagaattaggatggggaagagaaaaagtacacccaaaggaggtaggaagggtgagtgtaaaacaggaaaggcagaatgaatagaaaggataaatagaaataagagagtggaaataaatccaaagaagtaagtaaacaaaataaaggaaaaaaaaatctgagcatggtggtgcaaccctgtaatttcagctacttggaaggctaaggtgggaggattgctgtagctaaggagttcaagaccagcctggacaatatatcaagaccccatcttgaaagaaaaataaagcaaggaagcaagaagaaaggaaggaaaggaaggaaagaaggaaaggaaggaaatgaaggaagggagagagggaggaaaggagggagggataaagatgaagagataagaaaaaaagaaaagaaagcaagaaagagaaagaaggaaaatggaataagctgtcctgttaaagcacaaagaccctcagaccgcatagaaacaaactccagctatgtcatttctacaagagactaattaaataaaacacaagaacatgaaaagtttgaatgtcaagcctagaaagaatatgtcaggaaaatattaacaaaaagaaagcaggtctacaaaacaaaacagactttgagggaaaataaaagcattaaaaaagataaagagagtcaataaataatgctaagaggttcaatttgttaggaacataacaattgaaaactttatttactgaatagtacagcttcaaaatatataaacaaaactggtttgatctatgaagaggcattaataaatccttcactattttaatacagctttcttggttattggcagatcaagtataaaaccatattggcaaggataattgagatttgaacagcataatttaaaagcttttaggacactgcgttggtttgccaccttccccaagtcccaaattcaccccatatacactcccatcactcttgtcctgactttttcattggcttatctcagggtagtccttgatttgggtctgcactgcaagttgtattatctgcctctggtttgtggctttactcatattctcaattttaccttcacagtttcttaagcaagatttctcccttccagtatcttagtgaaataattttttttcattttttggtttttttttcttccaaaaaaaaggatacatgtgcagaatgtgcaggtttgttacataggtatacatgtgccatggtggtttgctgcacttattgacccatcctctaagttcctcccctcactcccacctcccaacaggccctagtatgtgtttttcccctctctgtgtccatgtgttctcattgttcaactcccacttatgagtgagagtcgaacatgcagtatttggttttctgttcctgtgttactttcctgaggatgatggcttccagcttcatccatgtccctgcaaaggacataatctcattcctttttatggctggatagtcttccatgatgtatatgtgccatattttcattatccagtctatctattgatgggcatttgtgttggttttgtgtctttatgattgtaaatagcgctgcagtaaacatacttgtgcatgtgtctttataagagaatgatttatattcctttgggtatatacccagtaatgggattgctgggtcaaatgaaatttctggttctagatccttgaggaattgccatactgtcttccacaatggctgaactagtttacattcccaccaacagtataaaagcattcctgtttctccacagcctcaccaatatccactgtttcctgactttaataattgccattctgactggtgtaagatggtatctcactgtggttttgatttgcatttctctaatgacaagtgatgatgagctttttttcatatgtttgttggctgcataaatgtcttcttttgagaagtgtctgttcataccctttgcccgctttttgatggggttgtttgttttttcttgtaaatttgtttaagttccttgcagattctggatattagacctttgtcaggtgggtagatttcaaaaatgttctcccattctgtaggttgcctgttcactctgatgatagtttcttttgctgtgcagaagctctttagtttaattagatcccatttgtcaattttggcttttgttgcaattacttttagcatttttgtcatgaagtctttgcctatgcctacatcctgaatggtattgcctaggttttcttccagggttattataattttgggttttacatttaagtctttaatccatcttgagttgatttctgtataaggtataaggaagggttccagtttcagttttctgcatatggctagccggttttcccagcaccgtttatccaataggagatcctttccccattgcttgtttttgtcaggcttgttgaagattagatggttgtagatgtgtggtgttatttctaaggtctccattctgctgcattggtcccaatgtctgtggtgttaccagtaccatcctgttttggttactggagccttgtagtatagtttgaagtcaggtagagtgatgcctccagctttgttctttttgtttaggattgtcttggctatatggggtcttttttgattccatatgaaatttaaaatagttttttctaattctgtgaagaatgtcaatggtagtttgatgggaatagcactgaatctataaattactttgggcagtggccattttcatgatactgattcttcctatccatgaggatggaatgattttctgtttgtttgcatcctctcttatttccttgagcagtggtttgtagttctccttgaagagatccttcacatcccatgttagctgtattcctaggtattttgttctctttgtagagattgtgaatgggagttcattcatgatttggctctccgctcgtctcttgttggtgtaaatgaatccttatgatttttgcacagtgattttgtatcttgagagatacacaaactaaaattgtgtcctcaggatacagcttcaaattctatatgtttattattttattcaattttgtgttcaaatcatcctatgtgctatcatttttccaattacacagatgagaaaattgaggccctgggagattaaattacttgctcaagagagcacacctattctattaaaagggagataaaataatatttataatttttaaaaatataattctgaaaactctagcagctttttgacaagtgttttgcttttgttgtcaattaatactgttaccaaatgatactcttcttaatttattcatatccacagtgacgaattgcacaaaattatccaaaagattattaggtaggtctcatttagtggcaaccaagagtaaacaaactattttaagcaaaaagataatttcttggcatgaagtactaggaagtacaagtgtacagatggccttagacatggctggatctgggtactgaatatgtaatcagaatattatctctccccatctccccgcatgctttcctctatattaacttcatttttagacaggggagactgagtagatcacagttttaggaagttgaccctgagtcggtctgcctgtgtgttccagtcctatctaattagaaacagaggttacaaataagttcttcaacattgtttatttctcaatagcacctagaacagtattggcacatagtagatgctcattaattttttttttttttttttttttttttttttttttgagatggagtctcgctctgtccccaggctggagtgcagtggcgcgatctccgatcactgcaacctctaccttccggtttcaagtgattgtcgtgcctcagcctcccaagtagctgggactacaagcaccacaccacagcgcccagctgatttgtgtgtgtgtgtgtatttttagtagagacggagtttcaccaggttgaccaggctggtctcaaactcttgacctcaagtgatatgctggcctcggcctcccaaagtgctgggattacaggcgtgagccactgcacccggcctaaatgctcactaaaatttattaactgaatggcttatgtgaagaaactcttgttgaattactggaagaggttaaggcaaacacctgtctttgataatacttattctaaaatgttatttataagcttggttatatgtatagtgagattttaccaagttatgatttgtataagaaaacatttggccgggcacggtggctcaagtctgtaatcccagctctttgggaggccgaggcgggcggatcacgaggtcaagagatccagaccatcctggctaacacggtgaaaccccgtctctactaaaaatacaaaaaaattagccgggcgtggtggcgggcgcctgtggtcccagctactcaggaggctgaggcaggagaatggtgtgaacccgggaggcggagcttgcagtgagccgagaatgcgccactgcactccagcctgggcgacagagtgcgacaccgtctcaaaaaaaaaaaaaaaaagagaaaagaaaacttttattagagataataagttcaaaatataaacaggtaaggtagaaatggtacacacgaataacaaacataaaagtacagatggaactgtgttaggaggcaggactcaactctggaggtggagctcagataccagacaaaattgaggactaagacaaggactgggcggaagtagctttcctgaagacatgctcactagtgtgccatgtcagtttaccattgcaatggcagcacctgcgagcgaccaccgcctttccaggcaataacccgatgacccagaagttactacccttttccgggaaatttctacctaaatcaccccttgatctgtattaaagtaagtaggccaggcttcacacctgtaatcctagcactttggaaggccaaggcaggcagatcacttgaggccaggagttggagaacaggctggcaaacatggggaaacccatctctactaaaaacacaaaattagccagcccaggcctgtaatcccagctactcgggaggctgaagcatgagaatcgctcgagcctgggaggcgaaggttgcagtgagccgagatcgcgccaatggactctagcctgggcgacagagagaactccatctgaaacaaaacaaaacaaaacaaaacaaacaaacaaaaaagtaggtgtaaatgtgattgcagacctgccctgaactgctactctcagcacactgcctatggggtagccctgctctctgcaggagcagtcacaagagttgtaacactgccagagctgttaacactgctgcctcgatacaactgttttcttctaccctaccaccagcttgtccttgaattctctgctggacaaagccaagaacagttgcggactaagctccactgtcctgcatcagaatggcttcaaaagttacaaattgtcaatgacaaaatgtaaattgacactaataagttaatcacaaaattgagcccttaaaaatgatttcaatgttatattaggaacaaagcttcctttcctgctgtttttctatgtattcccagaaaaaaattcatagtttgtgtgataattctttattcaagcttgactaaaacttataagcaactacatagagttaccttggactcctctttatcgtttaacatgtggatgtaacattcaacccaaactcattcaagtacagaagggtgatgttttcttaatattagtacagtagagttcatagatagatgtttttggctatgttataagcccaaaatggcatgattaaagccattttacatttctctgcatgctggagtattttgtaaaatggctgtttctaagacaaatgcataagagcttctgcgtataatgaagccatagtcttcaggtaaaaaagaaaaaaaaaccctctagttaggcaagttttctctttatctgaaggtttgtaagttcaaaattaaccatttaaaaatgatcagaagattttaaattaatgtacgtttttatgtagcacatgcaaagtttaaactgtttcttagtgacttaggagtgatcatcatgactattaattacacacagatgctgtcctaggctcttttcaggcatttatgttgtaattcatggtactactactgtgagtcctccaccctccattagagttatttatttatgctctgccttatgctaaaggacttaatattccttaaaatacatcttaaaagatttttttctgtgtcagtttgccaagaataatggcctccagctccattcctgtccctgcaaaggatatgatcttgttcttttctgtggctgcatggtattccatggtgtatatgtactacattttctttatccagtctgtcattgatgagcatttaaccaaatactgcatgttctcacttataagtgggagctaaatgatgagaacacatggacttatagaggggaacactctgggcctattagaaggaggagggtgggaggagggagagcagggaaaataactaatgggtactaggcttaatccctgggggatgaaataatctgtataacacacctccaggacacaagtttacctgtgtaacaaacctgcacttgtacccctgaacctaaaagttaaaaaaaaaaatttttttttaaatgttaagaaaacgaagaaatcaggacactgatgaattaagtagaatgaataagacgaagctggggacgatattagtacacaaagtacatgttgtgaactgctgcccatatgctggaagaaggcacacatgactagcaagcccccaaaacagggagatgtcaaatgggctgcagttgtttgtgttcaaaggtgcagaagaatcagaaccatttctgacactgagcaaaacttcccagggtctccacagcttcccacatgttctctgttttacctggaatgtccttccaccactctccacctggctaactctttttgaaaacactgttcaaaaatccctcatccgtatcctgaatgtttagttacctttctcctccatagtgttgaaagctcctcaatggagctttccaatggagctcctcctaataaacatgctcattataaatctaaaaaactagtttcttagagctatttttatagcttttcctactgtacacacacttcaggggaaaaaaaaaaaaccagctttatagttgaactaacacagtgcaacttaacacctgcaactaggggcctcacttcattcagagatatattttagcaggttagatatattgcaaatcattatacaactgtaggaaattattatttcaaccaaatatttgatatgtgttaagcaatgatgaatttgaagttactttaatgtatcttgagaacagtgattctatgttgcttctttaaatatggagcaatttactttcctgtcaatggaactgggtatgacattgacttttgtaaggtacgcaggcatgcacctgtacctgggccaaaggagatcctactccagcatgcagagaaatgtaaaatggctttaatcatgccagaaataaaggctgctctaattggatgttttgtctttgatattgtctctttccttgattaagctattagctatcacttcttacaactctccaaatacttacatactcaaaaatttccatgtgtagtgtaagttagattagtaaactagatatttaagcttattttaaaattatctaagtaaaaatatgatgtacctcatgtagacctaactgaatacattctgatgagtatgagatggttaaggtggatattaaacctgcttttctgccttgagagctcttctaccactccacatccagttactcaacaagctacagcatttcgcttctgaaatagctctgctcctgttttttagctgtctctttatttgggggcttatgtcatcttacatggcatattgcagaaataccctatttggtctctctgtcattacccttctaatccaacctttacactcatcttttggatacctttcataaatgcaaatctttctataaatacctaacaaccttggaataaaagccaaattcttttctcactcagttattcacacaaatttttgttatgtgtcatgcattgtgttggatgcttaacaacacatgcgaaatctttccaagattgtctcccttgcttcaactcccagctttcccccactcatagtctatgagtacatttattatccagaagtatgaactcctccagaatgcagaatattctctcatatttccaattgtttgcatattctggtgcttccgcatgaaatattcttccctcttgtccttttaagactcatctcctctgtaaagacttcttgtcacttcttcccatccttaggcagagatagagactttgttttggtgctcaaatagccatgttttcaatacttgcatgataagtttaatcatggtgtttgtaactttttgtgtccttgcattattttttctaatagattgggaagacaggggtattatcttgttcatcttgtgtccatgacaaatagtacatgttcagttaatgtctactgaagaaattactgagttatcacctgcctgctttcggtgggcaataaattgatggcactaccatggtccaagccctattgtatgtcatgtttatttgcaaaattgccttctaccttcccttctgattagattgtaagcccttgaagatcagggagttattactcatgtgatacctagaaaaatgcttagcatgtagtaagtactcaatccataattactgaattgaattgaaagtactccaacaaatttccttgtagtttgtttgaacttctaaaatgatgacatcattgctgtgtgattaataaagacatttaaagaaggaattacaaaacttcctagggaaatcatttctcctcttagttcccgctctcttctggtttcttacccactctaatagactaattagacttgcatagagatgggacagcaggctgtggaagggaaagctgtataatgcagtagaagtaccatagaaataaaaaaataaattggattttttgatgacaaaaaagtatagaaaaaattgctggaaacattaattcaagaagcatctaggtgagaggaagcagaatcagaactgtgtttggggaaggaagcagtcaaagtgaggcagttttgacagtatgtggtggatagtctctctggtatgactaattgagaattgattgtgcatgcagaaaggttatgttttattaagggaaaccttttttcccttttgtcgttatgaaatccactcttctgcagatgttattcccttcccatactaaaccctcattaatttataattcaccgcattgctttaaaagtgctgcacagatttcctgtttctctcacatgcagtgcttctaatagagaaagtcaactcaggatataggttgaaatgctgcttgtcttgagggctgcatgccagacttgatggtgccaaaacatttcaccaattgtctcttagatcattgtaaaggtttcaaagtgctatttcataggctttaagaaagtgaatttacactctaaaacaactctttcactattgactgtaaattgactctggtgtttggaatctggagtcaaagtcaaatggtttcctggtgggattctcttaatttcaaggacaagaactcacagagagaagggtacactttcttcaagtgaagattctgagggcagaggcaaaagaaacacagagaaggaaatgaataccccttctcccatcataactcttctctctgccagtaaatttgacagaacttgggaaatatttgggtacagagatgtagaaaaataagtgaaaatggcttttcaatttttaattacccaacatgccattggtgaagataagaattaaaggaggattagttttcacatttcttttcattgattactactttactgatatataggaaataaaatgataaattgacaatttagatatatgttttcaatttaaacatcttgaatatgaaatgcctaagagatatatagatagaagcttcaggactttttagagatttcaagtaaatatggtgtgtgtgtgtgtgtgtatgtgtgtctgcatgtgtgtggtgtgcgttggggtgaatgtattactatgaagtataatacaggggttaaaatctcacatatctcacatgttccagacagagaacatacatacataaagcaaaaccaggatgggggctgataggaatatgtggctggacaaaagggtcagtagctattaagctctggttgattactgccaaagaagaatgcaggccagtgtgaccaaatttggtgtttttccaagagaaactggaaaactatatttttgttcgttcaatgtcacatgaatatctgcaactaactaaaaattgaaattttatgatgtccaaataaaacacatatataaggcaaattcagccccacaggatactagtttgagacctctgaattaaagtcttattgggagtaaaagacacgtaacatgttaagaaattgaagagtggtctaagccattacataactggaagtcaaattaaataaaattaagtgtcaatggataaacttgtaagtattctggaaagggagagatcaatgttggttgaggtttaaccaaaattatgtgaagaagtggggctttgcctgaaacttgaggaatgattggctatcattggcaataaacaagggagaaatagagatgatgcttagggaagacagtgagtagcttattcttagtggaaacaaagaaagaactagaaccatttctcctaactcctggtttattgttttatcttccatgttctaccacctcctatttgatcttggataaaacagggatacatagaaatattaattaattaagcaaatatttattgagcacctactgtgtgccaaacacttgtctagggtataaggtacagtatatgttaatgctgtatacatgctttcccacatagagaaacaggtcagctccagcttttttacataaacattcacactagatacactttaattattctagaaggcagggaaattatttgagaattttcataatcctggggaaatatagtaaaaaataaaattttgaatatggacatactatatcaagagcaaatagttgtgccaatatttctagaagcaaatgagtattaaacaatatcttgtttatctaaagctaataaaaatttagaaatgggtagccaaactaaaatagcaatttgatcagctaatgaacacatttcattcaacagccattgaatgagtacttatcatagggacaagtattaaaatcaatgtaagtaatattattatactttgttccttggctcttatgccctttgataaggtggcatgtggatttggagagaatagaaaagagaaaaagaacaaatattttgaggagggtgaaactgatgtgtgccaccccaaatctttgattatatattttatgtagcatttcattgtataaagaaataatatacatgtataaataattttttaaaaattggatttctagtttcagcaaatgcctttatgctctttttaaaatatgacagtctggtttacaattgaagtacattatgtatcaaaggacccatatttgacagtgtacaaagttatgcgtttaaaaataattacactgttaaccaatgaatatgagttaatactgggaagaaaaactttattcaagtgttcattgcccatagcaaagtaaattatagaacagaaagttaataaaacatctaagttgatgtttcaaactcaatattacttttaaaacatcatcaagcagttgaaagccatgccaaagagattagttaaaggctaggtgactgaatacgatatatgtacttacaaagctttcattgcatagtgacattctgttcaaaacatactatgttgctggcctaacctttccatctgtttctcacagtcttcttatccaggtagttttccaagacatacggaatattagctatgcactctctaaatttaccttgagagagatcagatccatatcataagaaaaataaagtgtcagcatgaccatcttaaatctgtatcttggatattatttttaaaagctagtctttcatagctgacgtactacataacaaatacaatacattttaaccttattttcctgtgcaccttccacaaatccatactgcaatcacgaaaagggatacaaatcaatattcacttaataattttgattagaaaaggtataacccaaaggaccattccagtattgaaatttcagtaatatttcacctccctcagtcctatttctactgcatcagcacaacattatctcagctagcagccattaagatggttttctctttcatgttgatgctcttgcatacattttacagcctgctctgatggaatttttatcttcgcaaatgtatttcctaatttgtctatttctgtgtccagtaaactttagtctatagactaagaagtcaaaagttatagctacctttaagttacataactttagagacagaattttctacagtgagaaatttaacatactttcttaaggcattttggtgaacaataaaactttcttgttaaatttttgctttgcaatttacaagaattgggaatttggggtgatttgagaaaaagaggattattcaatggataccacctgcatcataaggctagactaattcttttgaaaggttaaaattggcagttactttaaatgatcttttgtcgacttttggaggtaacacagatgtctactacatttttcccagtgaatgtgttataaaatttaactgtagggtagtgaggctgtggattcagagacataataaagctatttggaaatctgggagattttgttttgttacagtagtattttccctgaagtcccttagtcaatagaaggaatgcaatttcctaggaactgcagattactttatatgggtgattgacaatttataaaacttgcatctttcctaaagaaggtttttatattgcacagatattttgttcaccacaagcaagattaaaataagctaatgaaatatgcaacttgttatttcacatttagtgactatgaaataactgctgctctcaaagaaccaatctgtcaacctccagaggactaaatagtgcatgggacaggggacaatcataacttagctagtcaaatgcattttttgtcttgtccgactatattattagatagtattggtaaaattaagatttttttaattaaaacttttactaaaagcttctatttcaaggaatttttgactatgaaatggaatataatggatcaaatttttaaaatattaataggttaatatttttatattgtgcataatcctggttcccaaacagataaaatttctatatacaaagagtttagttatggggggtaaaatgaaaactttaaaagaaatattttctatttaacaaagacgtacaggtgactcttagttactcaaggtaggacaatctcagtccacaaagagattgtaagtgtgtttgagtcaggagcctagtttttcctttatattttctccttcataattataagcatattaggacaaataacaactttttattgcattgggggctcttgaaataatgtagtatgttttctaccatatagaaaactatattttatcataaaaacagaaaagttttagcaaggagtaatccttcccagaagactggatctgttgattaacagcattttaatgtgaggactctgtctttgcaaaattaactgcagataatattatggtggaattagttgacaagagatgaatgtataagacaacagtttggcagaggaaatattagtatgcatgccatccttgaagaatattttaaaaatataatttacataaagatcttagtggtaggatttaacagattttgacagatgcattcaacggtgtaaccaacaagctagtcaacagatagaacatcttcgtcacccaatctctttccagtcaatctcccctgtacccagcgcatagaaaaccagtgcttccatttttatcatcataaattggctttgtctgaatttcatataaatgaaataatatggtatatacttagatattgtgataatgaaataaatgagaaaaaatagtatcacttagaagttagaagaggcaaggaaagtgttgtcaaaatagaaaaggcttgtgtatattgttcatgagctcaaggaaaaagatctgtggcaagaaagagctaaaagattcaaaagcaggagtagcaacgatgtgattttgaaagagtaaaaacatcttttctgaattgaaggtaacacgatgtgcaaacataaattcgtagtggtgtcagtcaacactgttacatgacctttttcagaaaattctgagctgttaaggagtaggttcagaagaatcagaagacatgatttagtcaatgttagtcatgggcaagatgggttcagcagaagatcagctgtggaatgataattagagccctagtaaaaatatgtagagaaaaagagataatagtaaggattgaaggaatggcatttactatgcataagacatttctgctcactgattatatgttgattggactagtttgttaccagttttagcagaaaatctgaaagtagccctctctagctcatacttcagttctctttccagctttaaataattaacttgtttacttgaatctatcaaggttgataatcctcagcaagtttaggaaatgttttacttctcctcctactggtttttttaagtttctacacctactggtattgtagataaacattagtatgtatttgttaataaaatcttctttcaaaaaatttgaaatttttacagtttttcatccttcacaaaagtatctatatttcagattaaatctgaccagaagtctagaccgctgtgcattgccagaggtaaatagattctgactttaaacacaaggaatgatacagcaagaaaaagacagttgttgccctagaagcagctctacaatgacatcactaacagtgatgctggtttctaaattgtcatctactccataaaacattaattttgcattcatcttttattgaaagcagtccttatacacagtttctattttaaaaatatctattttttaaaatttattgtaccatttatttcttggcccttaagtgctagctcaaagatcatgatgacttattatccctgctccatgattatgtcttcttaactgctcaacaatttggaggagctcctgtccttgtgggtctagattcccccaattttcagtgcttgctccacctagtaagtgtctttctgtgcatcttgaatgttctccaagagagcgtggatgaataagccagtgtcactacatgcttaagtgcaaatagcagccatttcagcaatcagggacaagagatcaggcaaaagcattctttaacattgtgcgatcttcacatttttatttaacgattactgatttattaaagctgcatatgttcagaagattctgttccttgtacaagaagtgtttaagtgcttttcttatatcaatttgttctttctggaatttttttttaaatcttctcttccaagcttcattagttatcaaaatcattctttttcatgtgccaggatgtggcccaaaggttaacttgtccatctaacttaatcaagaggtgactgtactctggtatccctgagacatgcagaattaaaaggttataaaccctgaatgtttagaacattgtttcagcacatattaattagtgacaaatgacctgaattgattctatctatatccagttcaaatgagcaagcagatattcgacttttagcttctaatgctagaagcctggatgttggatttttttttcacaaggagactcagtgtctagtttcaacagcttgaacaagttaggcttttgattttatcagtctcacacagggtgagcagactctgcagaaatgacttacattaagtaaggctgtcagaaactgatttatagagcaaaatggcattttatcaatttgcaggtagaagagaaagagaagggactttgcaactgtgtagaatggagtttaattctcaactttaccatttaatagctgtgtaactttggagatgtaatttaatctctttaaatttatttttcccatttctaaaatgagtataatacatattcaggactctggtgagaattacataggctagtatgaaaagtgcctagaaacctctctggaatatactatgtgctaagtaaatattagtttctttttcatcatttctattgagaacagaaatgtttatctagtaagagtttggtgcacttgtgggtggattccttcagaatgtcagcctacaaattaaatagttatttcgtgaacatggaattacacaaaggatgatatttttatctagtacaggattaatggattgatcttctttaacctagaaatgtctctgcgtggattgctggtattgaacattattagccttaaagagcctcactcatggagaatgtgagaggcacacagggaaatgttgactatacggcgctcctttttaaatactcctaatgagatgttaacttctcatattataatcttacttagaagatgacattcttagtttatttgactcctaaacttttgggacgagtacttaattagaaaaatattataggatcttcaatgaggtttggagataccttaaaattatcagaagtgattagggtgtggtttctacattttcatgttggttcttactgactttaatttctgatgattttcaaaccctgaaacttattttgtatcttcagtgtacatagttaaaattacacttaaaaacaattaaaatgaggtatctcattttgcaaaatagcactgtggctcatgtaatactgtacatttttaccactactgccttcaagcacttataaaacttctttcctcatttttcatttctcatgttcagtatttcagttttgttgacaactgaaaatgggaatcagatttgaggaatcccttcaatgtggttgatttttgccccatgaaaaagaagtggtaatttatatcaactctcaagaagtttaggcaaggtgtgggatgaaggcaataaaatcataattataatatcatgtgctaatgtggaagaacaaattttgagtgtagcaataggggagcgtctgattcagactaaacatgtacctgcaaattagtcaagaaataatgagacaatctgttaccaaactcttggctttgccgttctctttctctggcactactacgaaccaagataaataattatacaatatgtaataaagccaccttgttaattgccacttaataaaaataaattagtaaaaagtttggttaatcaatcattggttcattggttgcttcaatagtaaggctgagatctgatggcatggctttgatggtccacattcttcccaagtgataaatagtaaactcttcttttaatcatcagactgtatttatagtcttgactagcatccattcaataatattaatttgtcataaaagaatatagaatatgcatcattttgttagcctgtcagcactgcaggaaaatcagctcacacatatgtcatgaagaagatggtggtttcatgtccctggttggcagtacatgtaaggttgctggtataatgtactttgccatttctgttccctttctgaaaaagaattccttactaccaaggctgcgcaggtccatatgcaatgaccaagagtacataaagataatgtccagttcagttcagttttgtggtgtgtttgtatttaaaatgtgaagtagcgtgtctatatgcattcatgtttatttgaacaaatgctgtaagtcccctgcaaccttttagttaagtattgtatttttctgcactagaactttatttgatttttatttttctgatttcatgtgctatttatttattaatcttgagcatgaatgcttatgtttgagcatagttagatgctttaaaatccatgcataataattcaagcatttgggtttcaaaagaaccagttcttttgaactggtcattttggtcattacctgtttacagtttcttttgattggtcattatatgtgagcattgtcctgcttcttcatatgtgtatcaattctgtatcatacactggatattgtgaattattgtagagactttggattctgttatattcccccaacaagtattgcggggttttttgttgttgatacttgtctgtttaataaggcaatcaattcaatactttgtgaccactgcggtaggcagcagttgaaatttctattcagatgttttagccttagtattttaagagtctgtactgcacagttcagagttctgctagatattaggtagagtttacacacagcacttgtccttcttctccctccaattctctctttttcagtatttcttctcctcgctttccaggtgctatggtggttccaaactctatttcttttaaaccagtgacaccatgaacattatttatataaattgaaggcaatggagacagaccaaaagtaaacagaaagtagaaaaaaattaaaagtcaaaacctagaaaatgaatggccctaggtgagtttgggtgagtttcttgtttttacaggattttgtctgaggaccaaataaataactaaatgtttgtacaaaatgtactatatatacatatttattccacaatttgtagcttagaatttgtatctgtagggaagttggtctatttggaactctgaaagcagaactccactccaaactttttaactgctgttatcaccttctggaatatgtccttttaatatccctcaaatttatttcatattatcccagtttatcaaacatttaggacccaattgtagtcgtaaaggaatctttttcttactgttctagctgacagtgcaatcatcatctcatattggaacttaaattccctggcttacttcacctctcagagccccagttttcaaatctataaacacagaaataatcattcttacctcataggggcattatcaatattaataatacaatattatgcatgtatgtatggtatattttatattaatataatatataatagtaacataccataccatacacacacatttatatacacacatatacatatatgtgtgtgtatgatatgttatatacatacacacacacacacacacacacacacacacatattagcatggttgatacctggtaactattcagcaaattatgggtgtaattatgggtttaacgtctgtctacaatttttacttaaattgaaaggcatgcatttttcaattgctacctaaagtctcagaaggctgcaatcaagtatgaaggccaagatgagaaagagtttatgcatttacttgataactcaaaaaaaaacacatatggtaaattattcttttgtgccacagtaaatactgaatatattggtgtcaagcaatggcttaattaataggataagaaaccatgttcatagaagttaggaaacaagtgtttaggggttaaattataattaaaataattgacctcttaataactgaaaatggtctgtacctaaaaagttggtataaagttattataagtaggattaactatcattcatcagcattttgtaacactcagatttgaaagaaagagaaaaagagagcgataaacaggatttattcacaagagaaccttctgtggcattttctgaagattagaaataatcagttctaactcctaagacaacctataagtgtaaaataataattgatatttataatgatgattctgagttgcacaatttaactcatcaaatatgttcattcccttccatagattatacttaataagccaagaaggggattctcaatcattttcaaaagatttttaataaggaatgaaattttaaaaatgttttcctccctggtttactttaaattcatgaggaaatttaatgagtcagatcatcccatttccaaagcattgcactatttgttagggtatacttttttaaacctccaagctgctctgtgaaaggttacatttatttttatgctaatttcctgtccttacactcaacttcaactgccaaaaaggaatgagactgaggaaaggagaaagaaaacaataggaaagccatttattcttatacatgtaggtcaacttattggtttatcgtcatttaatttgaatgtcacttggaagattttatagtgtggaacagatcgaagttgaaagtgtggggaataaaattttttattgttcagtaactaaatagttcttttttggaagccggaatttaaatccagtctggtcaaactgttaaaagaaaaagaaaaagtaaacataggaaaaggaaatttatgggatggaaaaatgtcattttctaagaacttcttggttgtaaaaatcctgattattatcccacaaaaaagtgcacaaatggaaaatgggtccaggtaaaaggggtcaagtttagcaagacaaatttgatggtgtggagagcttccacgtaaatacgacttcattttagattagttatgttctggggtgacgtctgttatggtgagatagctcacaaaattggtgctggagctgatcagctgcgaagtaataagaaaataattcattttgtgttttttaatgatattattggattaatcatgaaaaacgactttttggtttttttcaaatttatttattttaaattgacataaaatcatatgtatttatcatgtacatgatgttttgaagtatatatgcattgtgaaatggttaaatctagctaattaacaaatgtgttacctcacatagttatcatttttatggcccaaacccttatacatccactctcttagcatttttcaagaatacagtatgtcattattaacgctagtccccatgctgtacaacagatctcttgaagtcattcctcctaactataagtatgtattctttgaccagcatcttcccaaccttctctcccaatgactaccccagcctctggtaaccaccattctaccgtctatttctgtaagatcaacttttctagattctacatatcagtgacattgtgcagtatttgtttttctgtgcctggcttatttcactgaacgcagtgtcttccaggttcatccatgtggctgcaaatgacaggatttccttctttcttgtggctgaatagattatcaccctcatgtaggcctagtttttttgtttgtttctttgtttgtttgtttttttaggcagtgctactgatgctcattcctttatgaattaatttctttatttgaacttttctggttgggaaaggcaatatacatagaaatcactaatacctgagaagaattcatttccctaattgcttccttttatggaagaagacagactgggaaagctttaaattctaaagtttaagtcttttagggcttgacatgacatcacatacccctttggaattaataggaagacaagttgccttgataatcctaaggttatcatttctgctgtgaagcaggacaccagcagctagcaccctcttaattgttgtatcaacttaagtgtatgtaactcatttcctcttattctgtctagaacaaagaaaaacaatgtgacaatatacctgttttatgggtctagaaactgaggagcaaataggattgtaaacatgaaaagatcattttcaggcactttcttgttccaggcaaggaacattcttgtacggattgagatgtctgaaaatcaaaacactgagtaatttaccaaaggttatatttcaagtagtgagagctagaacacacattctcaagtacagtggtattttattgccaccaactactgtctgatcttctcaagattcctcaactttcttatctgcaaaataaggacaaagataaaaatatttaactcaaaatataattagcatgattcaacggaataatgtataaaaatgattagtggtgctgtgtgtatataagataataatgctaataaggtgggcccatagtaattttttaataactattctcttttaatacaaaaatatatactgcaagactcacatgttggttggaaatttccctcaaatcacctactgattacccttgatttcccattgtttttagtttctcaaaactaatgaaatgaaatatagcagaatgctaacccatataaaaataaagtgtacccaaatattgtaatgtaaaaaatatatatatattcatatagtagagccagaagtggagttcaagcatgtttaaccaaataagagttttaatttgcagttcaatcatgggttcaaacagcccatttttggaccacaacaacatatatgtctagcttactttaattaccttacttcaaaaagtcttgatgttacaagaaaatacctgctttttaacatccaactcccttctaccagcatgatcttacttcctccttctccagcctgtatcccatggtcttttattatagttagatccttacaaactataactctcttgtcctttttatcttccacttttcttacttagcaaacccaaacctctataaatccagctatctgcataccctaggcttaaatacaaactggtaaacatagctggataagaattactcaagtattatgacaggtttcatacaatgtgcatgaccataaacctcagattaacacacaccacagctcagaaaccctgcagtctggctctagtgaattcctttgttatatgcttagagtttctctcaaagcacattatgactaaggagtgtgtgtatagggctcccatccacaggatttcatggcacattccatcttctacaccactctaacccactgaagtcctagaaaggtatttaggtcaattaagccactagacaatgtgagctgctgataataaggcagagccagacagttttgttttgtttttttttttaaagttaaggtggctgccttcttgtgtctgtcacatctaattattcaaaagattactgccaaggttgagccatgcttttaagggtcaaccactacataattaccaactccatcattatgaatatgtacctgtggttccatcagtgcctgtgggtctatcactaccacaggtagtagctaaattttgtagcatttggtttcattctcagtaattgggaaagtatcctttgaggttttagcaattacccaaagcatatgctgtttttccaacaacatcaaatagattatgtagactttgttacaagaattttgatgctgttctgttacttgccctcccataattttgaattaaagatgtaatcaggcactgaatagaactgttgatatgcactgtgcatgtcaatcctctctgtgttatgcatgaagcaactttgtgtgtttgtgtatatggtctgacttcttccataaagtaattcttagactagattgaggttttatatgaaaaattttatgagaatatattttttctggttgcatgagaggatgttcagtctgattaaattgtcccagaacatgaggttactacttaagagatttaccgtaaccttatgtaacttcattcattattggtctaatttgctaaaaaagctctgcctttactgacaaatggaaatattcaggcttaagccttttcttgcgaaaaaaaaagagagagagagagagcgagaaagaaaagaagctttattatcattttacattcaagggcaatctcttttttttacgtatgaaagtaagtgagatccatctactactttgaaaatgaagaaagttgagatcattgacaatgaacatactataattttaaatttaaatgtttaatagtttacttattataatttatttataagaattactgtctttaaactactattggcttactagttgttgtttttttgtcacatataaaatgctttactggttccagttagtatatttattcaactgccaattaaagattatccctgtgtaaaaaaaaaatgaataaaacaaacaacaaaaaaaatcatcctgtagcagctcaatttgagcaaaaaaaaatttaattatctaacaactatgtggttgagatgtggctggtgggttcatctcatcatacagttcgaatatatagccagcatcacccatttagtccctgcagtggctgaaaacctggcaaggctttttctaacctgcttttctccttgaagatatttgcttacattgtcaataggctaagggggttgttttgaagcctggattttgaatttcaactgtcaagcatagtctattaatgtagaaggttttaagtttatagtttcctcaatgaatgcattttaaaatggtacagataactctatataatatcctccatatgaatttagtttatatgctagcaaaatttaaatgagatttaaaaaatattctggttgctctgaggagaaatcactcaggtaaatctagaaaaataaaacagtaaattgcaatatgcattctgttcatctgcttcagttgtgtacttgcttgaaactaatttgctggctatgttatcacttccctttaaaatggtctttactgagtagagaaaatatatctgtaactttttgttaattggcgcataagttttaaacacagaagacttcatcacgaacacataatttggtagtaaaatttttttagcatcaaatgtaactactttataaatttcatgctcagcaaaacatttgattatttgaataagtttaaggaaaaacacttttttaatgttgtttctgactattggactagtttttaaaactggtagctcatatctgtcatagcttctcccagtttctcaggaactttacacgcttgtgtacaccctttccctctgaactggatcctggcccccatcatgctcttaaatgtcccatttaagataaaaaatagatttccataactttaccttccccaactcttctatcaccttcttcttccttcctcttttacacccaaactttttgtaaatagctatctataactgctgttatgtccccacatcctcattttctatgcatacctttctcctgagggtctaattctatttcaagtttcagccctccacgaaaatgattcctcctaagaccaacaatggcctgtatttctaatccaatgggatttctgagttttcattttcatgccttctctggtgcattccaagctattgatgatttcttctttgaaacaccttgttcctgtaatccaacacagggcacaatactggtttctttcctaatcctgggtttcctttgctgctcactcatctacctacacttccaatgctggaattccttgagcctccggcatatgtttctgtaccagctctcttcttcctctaaatgtttccattcacaaccatgactaccattgttatgtctgtgttaataatgctcaaatatatacctctaaatcaaaacacttcactcatgtccaaacctaaatttctcctcagaatgtctcatagtttttgcctaaatttattatatcccaataagtaccccatcttctttcacagacttctgtcttttccatcttcgccatctctttactggttccagttagtatactttactggttccagttagtatatttattcaactgccagttaaggattatccctgtacgaaaataaatacaatgaataaaacaaacaacaaaaaaaaatcctgtagcagctcaatttgagcaaaaatatgccatctcagtaagtggcatatccacctttggttgctcaagccagaaacctagaaaacatttgttcacctttgttctttcgtttagtctccaaagacatatacaatttcttcccattttaagtaccatgtctaaaatgtttcaaatgttgatatggtttggctgtgtccccacccaaatctcaactccagttgtatctcccagaatttccatgtgttgtgggagggagtcagggggaggtaattgaatcatgggggctagtctttaccatgctatcctcgtgatagttaataagtctcacaagatctgatgggtttatcaggggtttctgcttttgcttcttcctcatttttcctcttgccaccaccgtgtaagaagtgccttttgcctcccaccatgattctgaggcctccccagccatgtggaactgttaagtccaattaaacctctttttctttccagtttcaggtatgtctttatcagcagcatgaaaatgaactaatacaaatgtatatgtattttagaaaaattgaaaaggaaaattcccttttatatttacccacatatttaccttttctaatgctcttcatttttttcagaagttttgagctcatttggtattaattcccttcagtttgaagaactaactttagcatttctagtaatataggtctatctgtacatatctttattttgctttcattctgtaaaatattttttgttgaatacataattctagctggattgatatttttctttcagtgctttaaagatgttgatttattgtcttcttgcctcaattgtttctgattattctcttctatgtaataggtcaattttctcttgcccattttaatattttctgtctttgttttttagaagtttgactatgctgtgcctaagtttggctttgttctacttaaactgcttgggatttactgaacttcttaaacctgtaaatttgtgtctttcaccacattgggggaaatgttggccattatttcttctgcctcattctctctctactctcattcttgcattgaagacatttatattacaacttttggtatcaatgctcagcttcctgaagcactgatttttttaatgttttttccactttttatatgtaatatgttttatctctcttgaagtttactgattcttcagtcattttattctgctattaagttcaaatatacagtattagatattttaaattttactcatagacttccatttgtttcctttattataatttccatttctcagtaatatatcttctgtattaattcattataagccattttttcccttgatatcatgagactagcatggtaaatattttaaaatagtgtgagctaattctaacatctgtgtcatctttggatcattctcccttgattttttcccctgaaaattgctcatatttctctgtttcttctactatctagtaattttttatcgtatccttgacattttcaatgttatgttaccacttcttgggattctgttaaattcatctcaagagtgttgaattttgtgtatttgttgtaacagccaattaagttagattcaaggctgctgttcttgtgcagcagcttaaatttttgttatgttcttttaatcttctacaggcttcttggagtctgttcatgcatatatgatttgaggttcagacagaaatttggggagagtttatttacagaattttatgcattgcctctatagttctctcctctccaggattcccccttacaaaatttctagtagctgaggcagcccctctcaagtcagaaagtcaagattttttaacagtgattttagttatctccatgactcccagtgcagtccatacacatacgcaaacacacacagaaactcaccagtgccattctcttctcccaagaattgacaaccctataatagaatcttccactggttatatttcagtgcttttgagcagttgtttcttaaattttttcatgtgttatagttatctgtgagaggatcagtacaataagagcttttctagtcattactaaaggtaaaaactaaactctgcaaatatattttagccactttgtatacatttataatacttaaagagataataaaaagaaaaggttttggagaagaaatctcaagattgtgatttttttggaaataaatattttacgggaggcatgaatgatgatttagagttctctgagcttataataaataacctcagattggtttggtttttaagttctagaattaacatgtataactttcctagtgccacttatcaccctcctattttattggtgtatcatcaagccagtcactgaacatttacaggtttttaaaaagaatgtattgtgtctagtctataacagatttaggaaacgagataatagagcttgatagaagtgtatctaaaataataagtattttcacagtaagatcacaggaaacttttctttaaataaaattcatattctatctgacttcaaaattttcattatgtttggtaaaaacaaaattagaaaacatttcttgtagtttgtgtgtatgcaatatttatgacttatggtaattttctcttctagtcattcatgttattaatagaaaaaccttaccaaaatgaggcaaatatatactacaggataaggtcagaaagtataactatctaaaactggtactaacaaaagtcagcatggtgaatggagatagtttactttttagttgatgagtttaagaaaccttcctaaatatcatcaaaataactactaaaatatcatacataaaatacaatatttaaattgctaatattttaatgacatgaaaatgcttggagcacagcagaaagcaaatggaacatatgaatttctggcttttcacattattttctagaaagagagacaacgagcttcagacatgcttttagaccacttgacaaaaattatatgtatacaaacattgcatatgaagtctgctttagcttgttaacattctttataatgaccatcatatactatttattctgcctgcatgccttcatgcaacttgccagttcattcgcatctgcttgtcagtttcatgattttttggaaaattagctgttgagattttgaattaaatagccattccctatgaacttacatggtgtttatcagtcccttaaaatccaattacacatactgtttatgtctgcaaagctttgaaccatacgttatactatgggaattcaatttatttgtgaccagtctaccactccctacacacaaagcacaaatcaaaataggttagcctttatttatagcatctttacattccttaatttccatccaaacaatctgaatatacacattttggcataatctgttaacaaacaaattaatgatgccccccaaaaaacacacagttgaaataagaataatttaaaagtttattcattcattgtcctcaaatttatttggattacctgaggtctggagtttgagaccaacctggccaacatggtgaaacccagtctgtactaaaaatacaaaaattagccatgcgtggtggcacgtgcctataatcccagctactcgggaggctaaggcaggagaattgcttgaccccaggaggcagagggtgcagtaagccgagatcacgccattgcactccagagcctgggcagcagagcaagatgttgtctcaataaataaataaataaataaataaataaataaataaattgctgctctagctggtgttttttaaagctcttgttgctggagtgtttgtgtgtcaggtgtgtatgtttctgagtgtggtgtgttaatattgtgaagtctgaaatattttctaagaggtggtttgagaatgaaacagaattctgcacctttgactcaacagaaaatcatagtgctcagatgcaagtccctccaaagcatggcttcaccatggcagtcatctggaattgttgtagggacatgctaggctaacatgtagcaaaacagatcttggggtgagaacttatgtcttccccatccatagcagaaagctagactttagtttttttaagctgttatttgctattactttgaactccctgtaaaatttatgtaaaatttcacataaaaagtattttctgagaacaatttatccatgttgggaaatgcttactagagatataagtactattgtttgttttcctgatcttataaagtaattcagcagaattgctttctaggggattctttcctttgtttccactctagtggaaagaaggcaccagagagtgaaatcctgttgtctgattgatgagattctgttccggctgtgacagtgcataactcctctcattgccctatctgttgacccccagagaggctaaaagtagcacaaccttgggatataagaaggtttttgtttggttttgtttttttactagcactgtttacaaaaataggaaccatcagcagccttagggtgaaaagtgaaatgtatcttttacccagaaagttaaggaaaaaattggtggggtcagattgcttaatggggctaataaagcaaatgccactagatttggctcctatataagacacatacaaatattttgttttcccaaaccaaaaactgagtccgtaactatagactataatcaacttttaaatcttactcactgattgcaagcagaaccaggggagactttgattactcacagcttaatgttatttgtcttcctatactggaaaacaactgcaatttcatttttcactgatggaattgatggcttattttttaaacttctgttttgaagcatagaacatatgtagtgctgattatgggtcaccaagttaaaaatgtaacattaggtattgaaggacttaaaaataagtaaaatgaagattaaagatggtatgtcattttaaatcagtaagtttttcttatcttttataagaagactaattctacaacaagtccataaatacagttttaaatgatatccttacaaaaaggaaccaaaccgaggagattttgttggttgaatttctccacatattacattatgtgaattaagacagagttaggaatcagaggttttcttttttggaggaaaagaaataagtctaattttttttaaagttatgttttttctttatctgttacttaggtatttcctaattttttccttataaaatcataaaggtgttatttgagctatttggccaattcattaaagataaatagtttatatgtttaatttcaaaatgagaattacatttattcgctttttcactatttactgaattatatcaggtaatttgagagtcaacaaaagtattatttaacagatttcgtagccgtagactaattaaccctaaaaagaaagtttaatggaaaacaaatgaacaaaagagccaagaaatattatttgaaaactgatcattttccactaatattaattcgtattttattttattttatgttttttgagacagtctcactctgtcgcccacgctagaatgcagtggcacgatctttggtcactgcaacctctgtctcctgggttcaagctatcctcctacctcagtctctcaagtagctgggactacaggtgtgtgccatcacgctggctaattttgatattttttgtagatatagtgtttcaccatgttgcccaggctggtctcacattcttggcctcatgtgatctgcataacttggactccaactgctgagataacaggtgtgaaccaccattcctggcccttaattcatattttaaaagaaaaatttcaaaaatctcaagtaagagctttttttgtttccagagaatatattaggaaaatttgaattattatttttactctcattattttagtatagtttgtccatttcagaacaaataaattatataaaaaccaccagacaattctgttcattttgaatgataccacatgtctgagaccaggccagaactggaacacaccacacaagaagggtaagattgaagcttatcctatagcttttgataaagtgtatttattcagcctatactttatattaaaacacaacatccattagaattatgttgttctataaatgttatattaaaaagcaatgtaatttgctagttaattgtttcaggatttgtgattgaaatcacaaatttcagaatttgtggagtcgtctttctctgtgagtcactaattttacaagacagcaatctgaggtgctttagaaaaaaatcatacccaagaacatgtaagtagtcatggctacctgaggagaagggaagccagactggttttcatagaaacaactaaatttccctttgtccccagccaatttcccccctgattctcaatctaaggggattagtagaaaaccaactagattataaatgagtaaatgaatttagattttgcctaggctttcatttttcagaaagatttctttgacttccaacttggggaaatttacctctcatatatgcctactgctggaagatagcaggcatcatgtattatttctttgtctctcttcatttattacaataaagtaaatgaggggagaagctatatcttagtcatcgtttactcatttctgtcctatttattcatcaataaatatttgcagagtgcctactatgtgttaggcattaaagtgagctgtggtaaagagaggaaagggtgggaggacagataccagatatcagtaaaagaaagatattaggagaactttgtgattgattagatgtgggtggctgagagtagtagcgaaacccagggtgactcccaagtgcccaattttgttgcttgtatagatggtcaaattagtgacctaaagaaaatgtacggagaagcttatggaagatagggtaagaaaaataagaaaacaattagttctgtttgtgcctgtaaaatgtctgtgaaacatccaggtgaaaaagatttgtgagcaattgcaaatgtggggctagatcataggagtgttgccaaagctggatatgcagtccttaaaagatccctctaaaaaaggatgtggttggtataatctaaacaactgcagtcagagaaagagaaggatcatgcaggagatcaagataccatggagatcaaacaaggaatgtgtgttatagaacacatgtaaacagaagttgcattggggtgaaaagggatgagatgaactacacctaataatgaacaatttttatcagatttatagtttgctacgtatagaataccagagcttaacgtgcctgggattatacaaaacccaattaagtgacaagtactttttaacaacttacctgttcttagacaagtcttttattgtctccttctcatgttttttctttatttgtaaaaatgaagatatttgataaaatgatcagaaagctgtcgcctaacattaatatattacatacagtattagaggtataaaggaaagcgttcttggtcagaagcaatttcctaacaaaagtagacaaatatagccattgtatgtcaaatacatattatatataagaaaatcagccatgtaaggaaatactgaaatagtacaactaggaaagttacaaagtaactactaccatttttgctctactggatgaattacttttgttacatatactttttatatataattttagttatatatatatatttatttatataaactgggaaatcaaatcaagaatatctatgatccggatatctgtgatattccctttcaccagctacatctaaatggcatgctgccatacccaggattttaaagaaaaaaatgtttaaatctcaataatttaatttcagatgactgaaaggtcagtgaatcaaattattactagtcaatattaatacatatggtcatgggaggaaatagtctattgattgatttctacacacctaattgaaaaatatttaccaaaactcaagctttctgagccaaagtcaatgtggatgacttttggaatgtccttggtaccatgaagatctaaggatattaatacatagtaatacgagggtcaggccaatcaaaggagacgacagaagaggaatcattaacatccaaaggcatttttacactgtgataattatccccatttgctcaggttaatatgctttcaatggaaacatgtggaataaacagctgtcatggacatgtgccaccagaagaaaagctcttctcagccagaaaaacaactgggaagttagtgaaccagtacatgctcataccttaggaaagcaaatacttttcactgagcccatagacaaaattaaagtctggaagaattctttttttttggtgggggataggaaataatacaaatcttgaaaacattctaaaatattcagataggttccataaatatttgttcaaaaattaaaatagaataaccttttattcattgttcaatttttatctatcaaatctcgaattatgaaaacaaactacactatgctttacataagggaatagaaataaaagtaggcatagtctggtaataccaaatcttgcatccttaatgcatcatgaaaagatgcttgtggatgttttgtccaaatggctggcatcaacacccacatacaaactgctcctgctcaaaaaaatgcccttgtttttctctgagtacagcattgatatacatttggaagaaatcttattatagtcctgaaagaaagctagtagataatctagtttatttttgagattccagacagaactacattgtgtgtgtgtgtgtgtgtgtgcgcgcacatccacatgtgtgtgacagagagaaagagtccactgcataaccaaaaaatatgaatttggttcctagaatgcaaaaaaatatatctaaccagtacattttaacccagaaatgttcaatttaagcattaggtctataataataagtggaaacgtttgatcaactatcatttattcatttatttaataaatatacacatagtaaatatttattactattatcatctgtgttattgtatgaaaatcattatgttaatgaaattatatatttacatacttcggttttagattaagcaatatgatattgcctgtaagtgatcatttttacctcaaaaatgactgtttcatatttttctgcctagtatttgatttaatcactgaataatgatatatgttaattcaacagcttgtaaggtcaatttagtaaaagcacaaatttatatgaatgaaaataatggcctgcaaagttaagatttgactctgctgtagaaatggacacaaattacatcaatttaccaaaaagaatagttcttacaatcagagttaagcaagtacttgctcctcttggtggtttaccaactgccaaaataacagcaagatcagatttcttcatagaaagttattggtatgaaactttttggattaaacagttgtttctgtaactattaactaaatcattaaaagggttagcctatttatagtaaccttgaacctttttaaatttaatgttttcagatgaaagcattgatccttccatgcttcataaaatggcatcccactgggcagtgtcattagtgatagtcctactgggagagacacccgtccaaattattgaatgaagagcctaatatagtgaaagatacttctaaagtgcagcttgatgttttaaaaatgctttcatacataatggatgcctactgtactcagctatttgaggtgttgtagcacttactgaattttcacataaattgctgctctctgaataagactattgtaccagtttataaggcttgatatattttctaccttccaaatgggcattcaacgaacttaaattttatctttatattgtacttaactgtaactcagtaatttttcttaaaggaggagaacaaattgtacaatacagtccatattagaaggaattagcttttgtttttaaaaagaagagaatgtgttttatatcatttgacattttcaacttataaattttagcaagcatgcatccattataattacactggttttttactatgtaatttaccacagaacagaatacatatacagacagttaaattaattcattagataggggacatataggaaagtcagcttcttatagttaaccaatccaaatatattcataaaaatatagatggaaaacttgattcaagaaatagtttccatttatctttcaacagtagttttcaaattggttagcataaggtccaactttaaatggatgaattatgttttgaaaataaatacttgcatttaaatgattattttcagcagtgaattattcttcggctatctctctgcacagagcataagacatttatttatttatttatttatttagacgctttgctaggctaagattcaaaatgggttactagtgaaggaagaggagttttgcctagtttggcaagagatttatctacaagctctataaaaagacaagtttttatttggtgaaaccagttaagatgcaagagttggaaatttttgagttggagtaactattttttaaaaaaactaaccatgaaaaaaattctggggtctgttgtcattttggataacaaggatccgtcccattctattctcccatctacatccatctcccagatccttatagagagttatgcccaagggagattccaggtaaattaataattttattaccaattatagtctactcttaaatctttctgtgattcctgcccttggctagctgcacagaacttccatctaatagatggagtgtacatctaacataaggccaagactaaaatcaaatttgtggagccaactccatgtttccttctccctagcttatgtcacaggtttataagaagaaaatgaagtgtttctgcccccaggttctatcagctacactggaggaatagagaaaaaaaatgaaaatggacaagtaatctaagagttgtaggagatgtcaaaataggaggactagaaacagaagagttatcaagttctttttctttcaccagaaattatattctcctagcaattatgactttgtcatggctaacattagtacctcttaagagtaagtatagggtcagagagggtagaaggtaaaactgagttttttgttctaaccccagaagtgagactacaaagactttcagcgagaaaacaaaaccagctcaggagagctaattatttactagagaaaggctaggttgctggtttaagaagagttcccagattgagccaacaatgaccaaggggcttgcatgagagttcctagattgagctactgttacagtttggatttttcagtcctccaaatctcattttgaaatatgatctccaatgtcggaagtgggaccccatgggaggtgtttgggtcatgggggtagatttttcatcaatagattaataccctctctggggattgggggctgtgagtgactttttacttttgttaggtcctgggagaactgcttgtttaaaagagcctggcacttttcccaacccttgttttcctgtctcaccatgtgatctctgcacacactggctccccttccctttctgctgtgaatggaagcagcttgaggccctcaccagatgcagatgctgggtccatgtttcttatacagcctgcagaactgtgagccaaataaacctcttttctttataaattacccagcctaacaaacagactaagacagccatcagtggtcaaagagcttgaacaggatgccaccagcctgaatataaaggccaatccaggcagaaatggagaccaggagagctccattaaaaactaataaagctttaatttagatacaggtacagtagcaaaggtggaactgtgaggtacaaataaatgggaacattactacaaatttggataaagacattttagaggaatctaaagaagaataaatctattaaacagcttttacactaatgtgtgggaaaagagtgaattcatgaatttcaacagaaaacaaagtaaaagagagacaggaaggaaggtaggaaggaaggaagaaaggatggaaggaaggggaagggaaggggaagggaaggggaaggaaaggaaagaagggaaggaaagaagggaagggagggagaaggagggaggggaggaaggagggaaggaaggagggaatgaatgaatatgtagacctgtgattaagatagagtacaggatgttaatgcttgattgatgtggtaaacgggtcgattcaccttgttggactcccgtattctcttctgcaaaatgcaagattagattgaacctggatgatttataatgttccttaaggatttaggaacttatgattcatgatactaaaccaagttgaataatggatccatttatctgttacaaacttgtttaaagcatgagagtttatcacaaagataaaattttggttaagagtatgttatacaacaaaggcatccatgaaggtggactgaagagtattaaagggaaaagttgagatccaagaacataaaaccctgatttcacagatggtagtaatggaagttcatccctgaagagttttctgttggagagtgttctgctcaaaatcaatgcatctcaaatttaatgtggatacaaatcatgtgcaaatattatcaaaattcggattcagtaggtcttagagggtgcggtgccgagatttttatttctaacaagctccaattttatatcaataagtaccactttgctttcatatccaagtatatattatattccaatggcttacagtgaaaaaagcaaatttatgtataccataattgttcagtcaaaagtcagacttttggccatgttgacaatgatagttatccagaactagttttgtatgagctgattcattctcttaaatacaggacaatagttatgatcacatatcatcaaaaataggatagattatattcaacatattatcaagtttgatggataaatcagtggagcattcaatgccttttagaaaaattgtcatctaaaatgtcaaagcatgttttgttaatataattatataattaaatgggtatattttaggtattttgaaatctttttcatccaggacattatatcatccagggaaaaatacatagcagaggtaccagtgtaaatacacatttttatgctgcctttaggcataattcaatatattttattgtactaaatggaagctacattctctgaacactatcctgacatagagaaaaaaatatattcctgttaaaaatataaaattgatctggatattctttgttacatattacttgaacctgttcatctctatcaccatttactgattttcacctgtgttatttttcacattccagtcatgccactaacactttagaaagtagaattagtgctgctgctgttagttcctaccattcagatctgattccaatgtacattttaagatattttgtttacctagcaaagtaactaagaagtttggagaagtgaggctaaaaaaatgtattatgtcttaggctgcaagtggcctctcttgcagaagtttttctttgttgagagtttctaggttgcaagtgtcttccttattgaggcattgcagacaagtttttattatctcacattttctaaataccaactgtttgaagtgtcttccattcctaccctttcacaagcattcagttgatgccttgtactagaagagtgacgtcaagtgactgtgctgaataaaatagctttaaccgttaaggaaagaaactggtgtataaataaagatatctgttcagatttcctttgtaccgccgaatcctcttagcctgtagtacttttgaaaatagaagtaaaagtattgttctttctttcttaagtacacacttgtgttctatgagtctttattttttgtatattttctgttcacatttgaagcactgtgtatgtatgtgtgtgtgtctgtgcatgtgtgttgtttgtgtgctgtttgggaggcatagttgggaagaaagcatgttatagattaggatttaggatatggtttctgaacattctcttgccccatgcaagtacaaactccagcaaggtagtcaaatcttaaagctccaaaattatctcctttgactccatgtctcacatctaggtcatgctgatccaaaaggtaggttcccataaccttgggcaacccttcccctgtggctttgcagggtatggccccctcctaactgctttcatgggctggcattgagcagcttttctcggcacacagtgcaagctgtggatggatctacaattctgagggctgcaagatggtggccctcttctcacagtgccccaatgggaactctgtgtggagttccaactccacatttcccttctgcactgccctcgcagaggttctccatgaaggccccacccttgcagtgaacttctgcctggacatccaggcatttccatatatcctctgaaatctaggcagaggttcccaaacctcacgtcttgacttctgtgcacctgcaggctgaacaccacatgtaagcttccaaggcttgcaccttgcaccctctaaagccacagcctgagctgtaccttggctcccttcagccatggctggagtggatgagattcaggacaccaagtccaaaggctgcacaaaacagcaagaccctgggaccaacccatgaaaccattttttcctcctaggtctctgggcctatgatgagattggctgacgcgaaggtctctgacatgccatggagacatttttcccattgtcctggcaattaacatttggctcttcattacttaggcaaatttctacagctggcatgaatttctcctcagaaaatgggttttccttttctatcgcatcatcaggctgcaaatttttcaaacttttatgctttgcttctgttttaaacataagttccatttccaaatcatatctttgtgaatacataaaacaatgcttttcacaacacccaagtcacctcttgaacactttgctggttagaaatttctcctgccagataacctaaatcatctctctcaagttcaaatttccacagatctctagggcaggggcaaaatgccaccagtctctttgctaaagcataacaagagtcaccttagctccagttcccaacaagttcctcatctctatttgagaccactaggcctggacttcattgtccatatcactatcatcattttggtcaaagctattcaacaagtctctagtaagttccaaactttcccacatcttcctgtcttcttctgaaccccccaaatggttccagcttctgcctgttatccagttccaaagtcactttcacatgtttcggcatctttacagcagcgccccactacccggtaccaattttctgtattagtccattttcactcttctatgaagacatacccaagactggataatttataaaggaaagaggtttaatggactcacagttcagtatggctggggaggcctcagggaacttacaatcatggcagaaggggaagcaaacatgtccttcttcacatggtggcagcgagaagaataagagctgagaaaagggggaagctccttataaaagcatcggacctcatgagaactcactcactatcacaagaacagcagtatggaggtaaccgcccccatgattcaattacttcccaccgggtccctcccataacacatggagattatggtaactacaattcaagatgagaactggttggggatacagtgaaaccatatcacatctaaaccagaaatatcacctatgtaaatttcaaatagctaaattaatttctgaacagatttttggtcagatactaccaattcctttgttaatgaagaaacctcttcccatggggtgccaaagtaaaaagacagaatgcataattgccaaaaaatgtaatgattaggagtgatttctctgactatttaaattttatttgcaagatatcattagtctgtgcttatttccatctagcagggtatatggatagactataacccaacatatgtcaaataattttggtgggtagctcatttgaactaatatggaaactcctcgaagacaaaaatgtaataatacattagcaatgtaatgctatcataaattagaaatgaaaaatgttgttctatttttggggtattaatttttcctactgaacatgtacattcattcagaactgtagaaacaaaaaaggggaaagaaaagaaaaagaaacatagaaatatgacatttgtcctctaaatttcactttttcaaaacttaattccaacttgactttaatatagtttagccattataagcattctacctaatgaatttttaagagcatttatatgtaaagtagaaaaattattgttttgatttttttcattttctcagttctgcaaattaagtactttagatattttttaggtttgatacaaattaaatttcaacttatatgtaaatattaggtgtacattttatagttctgttctcagcactgtagtatgaggaaagcactgtgttgtatcagaagctatgaattatacaaaatcagaattaactgcttggatagccttttgcaaatcatttcacataatttggtctctcagttctcatcaaagaaattttcagaggctcggtccctaaataataactaagttataagaatctataggggtatgaccatgcttatgtcaataaaatagtaatgatggtgataataataataatcacatttattaagcacattctgatgtgccaggctctggtaagcagaataatgatctccccaaagatgtccagattctgttccccagaacctgaaatatgttaatttacatggcaaaatgactttatgatgtgattaaggttaagggcattgagatgaggagattatcatggattatccagtcgggctcaacctaattacatgaggccttaaaacagagccacttcctggccgcagtgaggaagacgtagatacagtgtggctggttttgaaaaaaaaaggcagaaagcaggacaaggaacacatgcagcttctggaaaatggaaaaggtaagaaattggattctcccatagagtctccagaaagtaacaatctgctgacaccttgattttagcccagtgagccctatgtcagacttctgatctccaggaactatatgacaataaatttgtattgtgtaaaccactgtgtttgtggtaatttgttacaacagcaatgaaaatttctgatgtaccaggctctctgctaagtactttatattagcttatttttggcctcacaacaactctaagaaataagggccattattatccccattattattaaggtttaggatattttaagtagcttttcaagctcatcacttgtaaatagtaaagccagcatacgaccccaggactgctttggttggataaagatgatgtccttaaaattattagaaaacgtatatctcaaaacaatttaagagttcttgttttcatttcctctaccgtagaatgaaactaatttttctttactaactgcatgctgaaaagaagggtcaatgaggaaatctctgtgagacatatgggcccaatgggggggaaaaagctattatatactttgtgtaaaattagtcctccttttctttctaaagtcatcaattttctatttttctttaatccaatatgttcagtataaagtcatcagttttcaaccttcttttaatcagaggtatttcctggtattttataagggaaaaataaaatgtgacatcactaacctgttatattgtagaatataacaatgaatcttttgttttataaagggcctgccttccttctttccttccttccttccttccttccttcttcttttccctttcttcctttcttctcttttttcggcctaagcaggaactcattcacctaagaaggaaaacaaagttgctccctcttaagaaagacatcctgctgattttgtcagacaacaattctttcttgctttctttccttctttctctctcattttgtttctctctttccctccttccctccctcccttctttccttccttccttccttcttttttttctagggaatgggtcttgttctgttgcccaggctggaatgtaacgtcacgatcatagcctacgacagctttgaactcctgggctcaagtgatccccccacctcagcgtcctgactaactgggaacacaggcacccaccaccacacctggctaatcttttcgtttttttgtagagatggaatcttgccatgttgcctaggctggtcttgaattcctggcctcaagtgatctttctgcctcagctttccaaagtgctgggattataggcatgaaccactgcacctggaccactgttttctctttactcttatgatgcccccatttatcttaatcttattcttatcgcaactcccagacacctcctgtcctcttggtgcactaaagcctaactttctctttgctcatacagactgagagagatctttttgcccggaagctttgaacattttataaactccttaccaaaataacaccacttaatctgtgtcatctgtggtgacgagcttgtgaaagctatgtggactctttggcactgcatatgataccacattccacatcagaaatctggagcatccagaaagtaatttagctccttgttttcctctttggtgctgaaagcccttgaaaccacttgggggctgctgatatctcagattctctataagtaggaaactttttgataaaaactgcagtaccagcaggaccttttagtgtgatgagcactagaagaatgaacagggtgaaatttgttttgttccacaaagggacaaaaaaaaaacaaaacaaaacatgaagatgggtatagacagaaagagaatctgtgaaagatagagccctggttcaaaaaaatgacatatttaaactcaggcaatgaaatagtgagacaacaagttttaaaatagataacagcaacataaataagaacttatttttatatgaagaacctgaggttgtacttaaagtatgcaaagcacggtggaataatacattttacacagcacgcactcagaatccgtttatgtctaaaattagcaaacaagatcaaagtgccatttactacctatggctgcaaattaatgattaaagaagaacaggttgatggttctacctaaaaagtaaaagaaaagttaagggaattaaaaatcacagtattgtagaataggtctcagttaaataatgcacatggatgttttccaaaagaaaactaaactagttctgctttccctctcttgttttttcttaactttcaacaattggctgttctcaaagcccaaatagttccattcactataagtttcaagtgcttagcaaaaatgctgatagcttcagtttagctgttttcggaagtatgtggatttttaaaatactcacttttttctgctatcagaaaacttaagggacgtatgagaaaataaatatgagccgaaaaggcctttttcatatgtgaaacattgcagagcataacaatacgcaagttccccaatacattgtagtttcctataattaaatacttatattcacatagaggaatatatcttacattttcaaattaggcgaataattttatagccaaatcttttagtttatatagaacccaaatgcttaatatatctttgttatataataatattttatattgtggtcttaaagccattcagaaaggactaacagtcatttccccagaaaagtcaactctgttacaagaagttacagagagctttgcttcttattttgtagtgtgcaaagaaaaagagaaaaatgggataaggatggagggaaagaggaaggaaagttaatactttgaatgctaacactaaacaggctgttacaaaagcgttctgtcctcctcagtcactgaagaggaaatgcctattttgtatctccctcattgtcttcgcttttgctggacttgtcgtaccagtcaccccagaagtcactcagcatgccccctctcattcactggttctctgcaaggtcttttgacattcttggtgttaggcacattaacagaacagagtgactgaggtagataagattatcttaaagtaaattgtgaggtgattttttattaatagaagagttccatcctgaagaaattacttctcattctgcttggtgcattggtgcagttagatattctgatagtccaattgaggtgtgtgtgtgtgtgtgtgtgtgtgtgtgcatgcgtgtgtgtgtgtgtggtggaacgtacagaaaagagacgaaaaagagcaatgaagaagtgtaataaaattagtcctcaaatatggaaagaattaaatggacgtttccatctcttctttcaccctattacctcattctaactattcttagcaggtaaagaaaaaacgtctttactctatttttgaatctaatcaatgcagaatagaaagtttatggtacccttaaggaaaagaattcatataaagtgtattctcacctaaacccccaaaaccgtaagaatgttttcttcttagtttctttaaaaagctatgaatcattttactaggaaaataggatttttaaaaggtcacagaatatactgaagacaagaaataatttttctttaaatactatataggatgaggaaatagagaagaaagagaagacttccccagccatttatgatgataaggaactttaagttcttttgccttcatatttgtataaatttcctaattggccaacactacaattcacaataacatgaattatataatgcatgtaatttcttcagagaaaatgccttactggatgtgtattgtgcactagttagccttgcttattattttttttaagtgaaacagcatgggttgttagcaaatcaaatttctttaaaaataaatgagcttggatagtctcctgatgtctacattcctcatggcataataaacgcccatcatggttttgtggtgacattcatagtttcaaatattttgtcctgctgtcatggtaagtgcattcatacgtggaagattatatcccaagtttgcatttagaagatatagtcactgaacccatatgttgcccatcaaaactttttggctcttactgtttgaaaggggaaattgggggcctgggtgaggtcgctcacgcctgtaatcctagcactttgggaggccgaggcgggcggatcacgaggtcgggagatcgagaccatcctggctaacacggtgaaaccatgtctctactaaaaatacaaaaaattagccgggcgtggtggcaggcacctgtagtcccagctactcgggaggctgaggcaggataatggtgtgaacctgggaggcggagcttgcagtgagccaagatcacaccactgcactcaagcctgggcgacagagcgagactctgcctcaaaaaaaaaaaaaaaggggggaaattggactatcctttgtgaagcacccaccatgttccaggttactgatatcgtacattcattatcgacttaatgctgaaagataagtgtgattgtccctgctttacagtttgtgaagtagggaggtgtagtggttaaatatattcaaagtcatatggctaggaagtctggtgtcagggttcaaaaccaggacgtttgagtttcaaattgctgggttttttcctccactctttatagtattctgcttctgtattctgtagtttctggtcacacaaaacacaatgtaaaatgtcagcataagtgggaagttttctaaaaagtaaatgtgtgaataatgtgctaagaaattcaggacccaggtctcaacactacatagagaagaataatgacatttgtcttgagtttggtatccttgacaccaccatgttttgtctgttagcctgccaaatgtgtgtgtgtgtgtgtgtgttttaatcatctttctctttattagtataatataattttacctgccttgatatcatgtaggcataaggtattagtcttgttccatttgtaaagattccaggagtgttctgctttttataacacttcaaagttttgtgcttggagctccactatccaagagaggcaaatggctgttaaggaatctagtaaaacattccaatataaaaaccttcaggggcacatggtgatccattaataaaacagaaattcaaatgaaaactttagtttaacaattaagatgatcctgactccttgctaaattcccattgtcttatgggatacaagaatgcaatatgagatattgtacaatgcctttagtattttttctaatagatttagttccatcacgaactgctaaaacagtgtgagaaaattcttgaagaagttatataaatattaatgtatttcagagttttgcttattgtattgatatatgttcaaaatgatgtattttttcagcaatacaaaggatataacttatctcacctttctttaggcaaatgaatgacaacaaattacaatagtacaatatcactagatatcttctaagttcagtgattaaaatgtacctactaaagagaaataatactttaatcactgtaaaaacccaagcaaagtagaatttttcaaagccctgtggagtggcaaccctatatctttaatatctaagaactagaaaataattttaaatatacatatgttttatattccttaagagcaagtgactttaggtgagaggagaccaaaacttaagtgaattaccatttaaagcaaaagatcaaactagaatgttaaattgtagcaaaaaaggaagaaattatgtgactctttcatactataatattaccagtttggaaaataggcctagtaataaagtttgttttactaattctttctaaattccaggccaaaaatatcatgtaactttaacatggctttcatttccagtcatgtacagaagagtcctttaatcttatcttgctaaagaaaagaaatattttttgccttaaaactgtattctataaatcagttcatgtctgtctttctacatacaaattaatttctgtttgttgattaaaatctgctggggcggagaggtagctgtttgatgtaattggtctatcaagtttaaatgcaaatgattaagtagggtaaacattagcagggatggcaaacagaaccaaaagcattttctcatggtactctgctggaaagctgatgtgatttctagacagaacagacagcttacccaaaactatctaagtacaaatatggctacctctttcttctacattctctctcacctgttccaattagctgtaggaatcctcagggagaactgcatttcacaattagattttagaattgccgtacccttaataaatacgggagcctttaatgtaatatctgctatcttttcttatttcaatttacctcacctaacaaccactttgttttcagagcctctttgtagaaggtcagtgtgcagtagattggctttgttcacagactacacaggatcctcactggaggttttgtttagagctcatatcagttaatgtctcccaaattatttcttaagtgttacacttgatttaccaccagtttccacattatttcacaatacaaaaactcacaaaaaattaccatactttcttcatattaatacgacaaagaatgatgaacttttcctgtaagcctgcctgccttcttcttccttcctcttttctcatctccttcctagcttctttcactcaccatctcttcttttttcccttttctttctttttttcttaggattctgtatttttacgatgcaagctctgtttgtggtgggtgtttagatgacattaaaagatctctcttttaaaatatttcctttccaacttcagcaactatggagaaaatgctgatacaatatttaaaatttaatatacgaaagttaattttctattacatactccattgcatgttatagtaatgcacttgaaatatattatctccatttcatatcaccatgccaaacttacaaaaattcagtatctttaaaataccaagactatttagaacaaatacatgatgtggtgttcataaaaacaatattggattaagagtcacaagagtcatttccttaacttggttctatcttcaacactttaaattctctggtccttagcttctttagttacaggatgagtgactgcaataaattatctctaaggtcacttatcatttcaaatgtacatcttggaatcactaaacatttccttataaaagggcaataacagaaatatttcctacagctggagtcttcttatctgccaacctcaaccattcagagcccagctctgcaggaaacacccaggttttgagcagtcaaaataaatgctgatgtccatgaaccaaactttattcacaaggaaactccttgggcccctctcacagagactgtttactctttacattgaatctcttttaaagtttgattatgttgttttcaaaggcctggcatgttagtggcaaactggaaagggactatgagacaatcacagaagggagcaataaatgggcgagtgcttcgaaggctctgaggtgctgcacaaatgcgggctgttatcattagcgagagtgactgacaactgacaggaatagtgagagaaaagataaatcattgtaaacaaagcacaggaatttcaaaatactgtttggggtggggctgtttagtatattggcaagtcggttgaaacagttcagtaattcctgaaagtctcactgaattatagcatagtatgtgcttatagaaataacagttatcaaggagatgtttatttacattctgaataatatttggtttaacagatagtgtaactggaaagtgaaatcttaagcactatataatggtattttgacatgtaattttatttgacatcagaagagtatgcaagatgctccagatgttccaaatattctccatctaaaataatttaaaaataaaaatctataaggtataagaatctagatttcaaatacctagaaaataatatctgagtgatcttgaatacataaaatattactttaattttgaaatgtagtttatttttcttatccataatggtagtaattaagatgaataatattaattcattttgttccctatttaaatgaaacagtactatgcctgaatcagaatttcctgcatgcagcatggcttctaagctcacaagcttattatgagagtagtattggaaagatataaagcatagtgcctgccaatacttaaaacatattacatgctgaggcaatgcaataaaaatgtttaataattcttaagtgatagtggcaaccaatctaaagcaaactcaagttacagttgaaaacacttatcaattgatatagagttagaaaccaaaatcaaagtttgttcaatgtcaagttactaaaatattcattgaaaactccaacagcaaattaaattataagatgaaaataagaaatctgacatactatctttttgccagtccaggcataaaagtaatagggctagaaattccaactgaaaattaactgtatgctttttctcatattggagaatctgaatcctagaatatttaagccttgtcttatatcatattatgcataaataaactgaagcccaagaaagcaaggtcacaatgaggttaagatgaaacaagaaacttgttttctctagtctctttacactagtgttctttcaagtatgagttataaaacagatattttatgtagaattttttttaaaaaattcttatcatctactacctaacattagtggcagacagcattgtaagaatgaagacctgggtggttatcagagtccatgttcttcagggcttgaggccatgcttttggaaatcatttcccagagccggggcatttgaggagagtacagaaaagcaaatgaatggtgaataggagaaaggccatcagccaggcagctgcaggttagacggatggattgacttcccagcagagcagggcacagtttgctcaattacccttttgtacagctgggaaagaaagacaggaacatcagagactgctatctctcagttaccaataacttttgaaagaggtatttgaaagacatataaatgatattttccactgcctccctgtgcagggaaagcattgtatgtcaagtcaaaactgaaattcactagtaaccaaaattaacagccatagtctttggcaactatctttggtcacactatcacctagaattggctttgtactttgtatcagagctttacatgaggtccttgatctactcatcagtgttttcagaaagacttctggattcccaaataaattcagaaacttctcttaaaaagaaaaattagtactgattaaaaagcacagtattacagaacttgttattaacattttatttttgcatttactttttccaatctcaaattggtaagcacaaagcttaagaaaacaaacaacagtatttctttaggagagtttaagttccagctttgggtttttctctttctgtagtttatagtgtgtggcaaaaagggctcgcgtgtgttaaagccaaaatgcattttgcattaacaatttgcgtttagaaatccaagcacctaacaccaccagagttaatatttgctttggactcttctacttatttagtctcaagcttttccaaagagctaacacaaaaagacagctttcctatttgcctagtgagtgtgtgatttcacacatagtgtatgatatgcttctacagagacttggtattagctgtttttcatgtgagctgtgtacttagttatgttgggaaatgtgaactttgtagttgaaaaatgcagcaaactgactgaggctcatatcgattctactttagaaatgtctcctgtctccttttcactgtgcctctttttcattcccactgccctatttcactatgagtacataacctaaacactttaacacgattaccttccccgagtcccttctccagctagtttgccttcatactgctgccataattttcaatagcaaaaatctgaccacttcactgccatccttaaaatgaaccaaaaatccttttgttgactccacattctttacagaataaagtccaaattgtttaagctattatttaaggctttcaaagtatcaccccattgcttctttcccaggtgcctttccttccatcacctcctacagcccctaaacctcagccacactggctgaacatgattatacccttgctccagcctttctcttgcaaggagtttccttcatccttctttccacttgaagaaattcttatctgtgatgattcagtataaatgtccattccaggcaaagccttctccagcctattcatcaatccctcctctgctcctgcaacatttggcatataatctccattattccaataaataaaagccaaagagacataataactttcagcactcgttgtatgaaaagcacttttttaaagcaacttatacttattaatttagtatattcatgataacactatgagcatgatactattaaaagggggaaagttcccttgtccccctcacagggcatgcgacaggggtagtggctcgcttcttcagtgccccactgctcaaacctctagggagcacacagacgggcaggttatggggcaggttatggagctccgaccctatcgcagtgtcttgtgctcttttagtttcgccgtctataggcggcttgtgttaaccagcttaattagaccttctacgttgtcacaaggacagagggctttctgtatctcgggttcttgccttggtgtaccggaagaatcagatcacgtatgggcttggagaatgagtgcaagcttttatttagtggaggtagctctcagcagatgggggaagccagaaggaggatgaagtgggaaggttttctcctggagtctggccactcagcggcctagcctctccttcagctgcccccgccaactccgcgtctgtttctgcaagcccacggcctgccggcctgctggtgcctgtcaatacatacctcttgacgtccagctgctcgtttgttccccccaccttccccccgccgatgtgctgctcctccagacgaccacctgtgtgtctctgcctgctagggtctcagggtttttgtaggcccaggatgggggcatggcaggccagggtggtcttgggaaatgcaacatttgggcaggaaaacaaaaatgcctgtcttcacctaggtgtggggacacaggcctgggggtggagccctagccagggaccacgtccccctctacccagctcttcccttcccccttctgtatcatttaaagggaccacgctcttccctacccagcacttcccttccatatcactatcattgtcctcaattttacagctgggaaacattagtgcatattggctaagtaactcactagaagtcacctagcttattagtagcagagctggattcatccttaccaggtctgaggccagaaacaatgccttaattgctacactctgctgctaattatgtttcatttctgtcttctagatttttatctccttggaagaggtagcttatttatatgtatatgttgtattagaccgtcctctcattgctataaagaactacccgagactgagtaatttataaagaaaagaggtttaattgactcagttccaccagctgtacagggaacacagctgaggaggcctcaggaaacttgcaatcgtggcggaaggtgaagaggaaccagggacatcttacatggccagagaaggaggaagagagtgatgaggaagctgccacaggcttttaaaccaccagctcttatgagaaggcactatcttgagaacaacaagggggaaatccacgcccataatccagtcacctcctaccaggcccctcttccagcattggggattataattagacatgagatttgtgcaggaacacaaatccaaatcatatcatatgcccagcaggagtatagtatctggacattttagccaatcaatagctttatgtccaatttatctgaattaatacgaatcagagccttttagattaaggaaattttatttttaaaaataaaaatattttcacagaaaaacattcttagaaaaaatattgaagactgtttggcacagatcagtaataaataacttattaaattctaatcagatgtttagcatatatcttttacagtctttggattatatcaacaatattagataaagatataacctacactattcttcagatatatttaatttttttcattttcaaaagattttattggctttcccacagaaatcattataaatattctcatagctacaaaggctttagaacaaatagaaaatttccataactttatctttctgaagtataattgtgttgaagtatgatcagcgatttttattgatcttatgtgtttaccttggtgactgttaaataagattttgtattggaaattttctttgttgaacagctccctgtttttaaaattagaaacacaaatttatggatttctacataacaaactctctaaaatgatactctttacctaagaagtatgtaatatatgcctgttaattaaacatgtactaatagttatatttgcatgttgaggcttcctgcaattcacaaaacataaagaaaatgttttaaattgattctaggggtggtgttcttattagctgttgtaaatacacagagaggtagaattgtagctgaagaacacacacttatagcatatttttgtaggactcaggtgggaatgaacttgaaaattaccattggattttcagacagtaatacaaagtatttcagtcttttccatgtggtttgtttgtttggtttccaattaattacttcctgggggaagcattgggagttgtttcagttatagattcataacaaaatgagattcataaactaaatacatgatataatctgaagccctgctaggactcttacagctcgtctttataacctagtattcctttaatgagtaggaacagtgaacttttttttaaacccaaatgacactattgtctttaaaagctgttaaaaatagcagagccaaagacgtaatattataatattcagttaggggaattttgagtgtcattatctccctaagcagtaaccatgaacaaattatcaaagccattgtctcttttaaaatggaaagatgaaccaaatgtattagcacctcagtgggattgggaatatgtgaaaaacataatcataaaacagcaattgctaagcctctactcaagacactcttgttcatcagaggttttggtgctgttggaaagtcagcacctgctgaaatctgcctggggattcagctgcctagactggaatcacctctgctaatggatgccaaagctttgcccttgaagatgtttgtgtccttccctctccctataccagtggaatttagatgagactgtctaaatgtagaatatattgcataggctgaagaaattgtgtgtatcacttgtttttaattaatagactatttttatctgttcttagtttatggaaaaatttgagtggaaagtaaagagctcctatataggcccgcaattccctgcctccccacccccttgcccctagtttcccctattattaacatctttgcattagtgtggtacatttgttgcaattggtgagccgatgttgatacattattattgactatagtccctagcttacattagattttcctgttgtgttgtacattttatgggtttcgacaaacacttaataatgtttattcattatcatatcagaataatttcactgccctaaaaatgtcctgttctccgtctattcattctttcctccctcccttgagaccctggcaaccactggtctctttactatctccatagttttgccttttccagaatggcatatagttggaatcatacagtatttagccttttcagactggcttcttttacttcgcagtatgcatttcaggtcccttcgtgtttttttcatggcttgctggctcatttctttttattgctaaataatatttcattgtctggattaccacaattttttcattcatctgttgaaggacatcttgtccaagttttagaagttataagtaaagcttgtataaacattcttgttcaggtttttgtgtggacataaacttgcaactcatttgaaaagtcgttaattgtgaaaagtgtttttgacagagaggaaagacacaggtctttaagttagaaagactttaatctcaaccttgccattttagtcattcagtacgtttttattggaggtctactgtgctacccctgccgtttttggtgttagaaatgcatatagggctcctctgcctgtaacctgagtgccccacctacattaaaaagcctcattagacttctggttcctgatctgaaagatgcctatcttcttgaatattcatgattttctattttattttgaaaattagaacagctgccacggacaggacttgtatttcctgggagcaagtgccaaattgctacatagcatcccattgagaaagaagtgataaaatgtgttagttcattttctttctagtccttctaacctatatgttttttaaaatatttgtctaaatatgaaaagcattttaatactttccaaaacaatattcttgaattatccacaatataaaatgaaataaggacatggaatcattttttgtatatctaatagtgatgagaattggacttgagctgagaattcattttgagctctatctccatcacatactggcttcgtgatattggcttattctcttgactttgcagggagaacagtttcctattggtaaaatgaaggataataatatttgttcatcatacaggtttctttgcttatcatacaggacttttgtgaagcccaaatgcaaaaatgtacaatgtatataaaagaatgttgcaaactataaaacaccataaaaacattcagtattattaccaattgctttaatgtatttctaggtctatttaatcttttattgtatatatttaatctatacaacatgaggttttgatatacatatgccttgtgaaatgatgactacagttaagcaaatcaacatatcactctcctcacatagttatcattttttgtgtgtgatgagagtacctgaaatccactctcttagaaaatttctactatacagtacactattattaaccacagtcatcatgctgtactttacatttctagttgtgtcctatacagttgtaactttgtagcctttgaccaacatctccccacttctgacatcttcccacccctggtaatcaccatccactctctgtttctgtgtatttgccttttctagattccacatataagtatgattatgtagcatttgtctttctttggcttatttcaattagcataatgttctccaggttcctctgtgttgtcacaaatggcagggtctcctttgttgaggctgagtaatattttattgtgtttgtatctatatagacaatttatttatcctttcatccataaatagacactttggttgtgtccatatcttggctattgtgaataatgctgcagtgaacaggggagtacaggcatctcagtattgattcctttcttttaggcatatacccagaagtgggattgctggattatctggtagttctattttaactttttgaggaaccttcacaccgtttttcataattgctgtaccaatttacattgccaccaagagcgtacaaggatttccttttctctacatcctcatcaatacttggtatctcttgttttttcaataagaaccatcttaacaggcatgagatgatatgtcattgtgattttgatttaatttccctaatgatgagtgatgttgagtaccttttcatatatctattggctaattatatgtcttctttggaaaaatgcctattcaggtcatgtgcctgttttttttatctgcttctctgtgggttttgttttgtttactactaagttttatgaattccttacatattttggatatcaaccctttatcaggtatatggtttgcaaatattttctccctattcataggctgactttttattttgctggttgtttcctctgctgtgtagaagctttttagtttaatatagtcttacctgcgtattttaattttgttgcctgtgcttttggtgtcttatccaaaaaaattattgccaagtccaatgtcaaagagcttttcccctatgcattcttctaaaagctttaaggtttgtcttacatttaagtctttaatcaatgttaaactcattttttgtatattttttatttttaatttaactaaccccttactaaattggggtgggattttttcatcacatcagtactgaaatctttattttctggaatttcatagtctactaatgtcagtgggtcaatacggttatgatctgcctaatttcctccagatgttaggatcctctgaaaagcagatgtcaaaatggatttaacatacaaagaatgtattaggaaaaacacctatgcaagaaaaaatgaggaagaagatgggggtggtcggtgtggagaataagcataccgcagagtaaagatggtcccaagtgaaagggagaggatatgaaggttgggtggaagcgttctagactgtcatgcagtctaaggaaggttcatcagggaatcggggtatccgtgagctataatcagccctcataggagtctcttgtaaccaagaaacttgcctgtcttagtatacttgttgcattcaattattagctgggaacagctggtaaaagtgtaaccttagcacaaatctggtaatagacagaatgtggcagttgggtaagttatgttcccagcagttggagatctatgaggaacattttcatgtccactagacttcacagagacttttttccctaaataataaacaaaagtgatgaaccacttatttaataatgttttactaaggatgtgaagaggagaagcagagacaagtgagacagaatgcaaatattaccaagtgtgggaaaccatctgagagcaggcacattcccagaagaggggttcatgtcagggtttagtaacactgtcctcatgttcgagttcctgtgtaatcagtctacaggtgccattgacctgctgtaagaacttgttttccttatccagtgtttttgtttatgttttaccaccttgtttgtgatagctagtcttccaaaaattcttctgggcggtgcatttaaccatttcctaaattgcagaataaatataagacattaaaaaactacatttggcctctgggatataaaatgaagttttcaaagagttaaaatctttgggagtactggaaaatttcaaaacgggaggcaccttcagatgcagatttcatacccttagaaatgataaaactacctttcaatacagcttcctatatttctcatctctactcattgccttcctaaattatcttgttctttttcccatctttcctcccactcttcaattaagaagaatgactgtcaggaaaaatggaacacatgaaaagttattgttaaaatattaatagatgtcagtatgactctctaagttcatgcattccagagttaccccactgggctaccattgtgggcaagctacaatgagcatgactctccattctcactcagtccttgaggtgacacaccatctcttaaggcagaaagatgattttatcttcagatagcagattatactgatttcccaagtgtatgtgactatttgttttatttttaatttcctctttcctgtgcttttagtctccttcaaaaatttatcttggacaaacattccatctctcctttctcctcaaagctagaaaactagatcttatagtaagctgacttcagttcttaaagaaaggacaaaatgccatagaaagccgtaatattcttcctatgaccttaacttatattgcaacccctccagggagctgtcaattaaaagcatggaatttacacaaatctaagtctcggaaatcagccagcaagctgcaccaaatatgtggaaaaatctattaaatagctttttaacctttactacttaccatgtttgattgtacaaatctatatcctcaggagacataggcaatgctaattgtgattcatgtgaagaaaagagcaaaaaggtatttcaactgatataaacatttttcagtatgaggttagatacttaatgtggaatataccagaagctagcataccggactagatcactcaaccaattcagaagcagaaatctactactctgctcatttagtagccctaataatccacttttttatccctggtaattcactacctcaattataacacagcattttctaagtctgtaattctaatactattgaatattactttaaaagctaaagcaatacagttcatgtaagctattattaacagatgctttctgtgaaaacaatgatgatcttattggctaaaagtctttgtgatatattttttctaaagcattttgagggatattaaagcattagaaacttttggttttggagtttggtagtgttatcaaagatagctttgattttctcaaatcaagagatctttttgttgtcatgacattaaactatttgcagaaaacaaatttaataatgtcacaataactgtgagttctttctgaagacagacttcattctaaactccaaattttccattacttcagatgattcaattaagatcctttgggaagcattatgcctgcctttctgttgaaatgtttttacgaatgcagtacactcttcttcttgctaaaataggtgaattgtattcataatttcaatacaacttatgtggtaaaatgcacaggaaagtgtaatttttctccatttaagtagaactgatactctgaaatagttaaacttagattttcatgctcagaaaatgtacagagcaatagaatctaaatatattcatctgtcctttgcattacttagcctgaattaatataactaatatttcaaatataagtttctacatctccagttaagctagttcccaaatgaagtcaacaggatcagaatctagactaaattgaagaaaatttagttctttagcaagaattaaattgagaaaatgaatcaggggagaggggagcagaaggaaaatcatactttgctagttatttttattgtattgactaattatctgagtgaaggactctacttatatgagcaccttaaggactcagcctcaaatcctaattagaagtataatagtaggaaatagtcaactttcggaacttcagttaacacaaattattaattacatacatgtttttgagcaaaatatatagtataaagaaaaacatacttaaacatttctcctgtttagtcctccttactatgaaaatctactttaaaacaaaatagaggcgattgttctttttacacacaaaatctagatttttttggttcattgtattctttctgcctatcccccccaaagcacccccttcccacgcatacagagcatgaagtatttttaaatgttttttatttaagtttatcaccacttaagggcctgtgccttacttagcatgttggcatagaccccatagcctggccaaaaatactcatcatttaggaatgatgacttggtaacacaggggtttcattgtggacaagtatgtggaatctcagtctcctgctcagaaaaaagaatgtgaggatcattgccaaggaaaccctaaagcccagtgcttttagtgacatttcaaatgtaagtctagatctgtgtacttttttccatctatattatattccattaaaatgtttttaaagcaaaaatagcttttggggggacaattttaagaggggacaattttgggggaacactaatctcaaatcaccacagtgctcccctctcactaccctgtagctgtattccctaaaatttcaaagaatagtatagtagatgccttaaagttcattcctggatctcaagttaagaaatgctaatgagtgcagtagaatctgcatatattctgatttaaaattcatgaggcaactcaaaaaataaaaataaggtttcacaacttcagtcaattctgttgctttttgatcatttctaaataagatttttgcttataatttaaaaatggccccaaaaggaatccaaatgctagtgttgatgctgaaagtaaagagaaaatagagatctaacattttattgcattttattagagaaattttatgtgcgcttatgaatttgggaaaactgccagtcttaggacatgttccttatgaagatcaaagatctactctgtagaaattgttataataaaaattgagtttgcccaaagagagaaaaccaagcgtcactcagtgcttctcatgcactgtgctattgaggtagttcctatcttcccatctatagaaacctcaattcagtgatgaggtcaaatgaaatttcctccaagaagcttttaccaatatcctcaatctcattgctgggattcctttctatacagtcccacagcatttggtttaccaacccaaaacctcacactgatttcatcttgtttcttaaggaaaaggcctctgtattttacttatacattttcttcacaaagcacacctaaaacttgccctgtagcaggtgtccaataaatatttgatgcatgattgaatgattcgatgatttttgagataggccttaaaggaaacataggaatctgaacagagtagatggggccaaggaaccataaaattaggtagagatggggtaaagcctaaactaattgggagaaactgtgacgtatccagccccatagatcatttcatgcttgtagaataacaaactatcaggctaaggtaaattaagaaggtaattttctgcacagcaatgtaaatatcgatagtgtatttttaaaactttattgtttgtgtaattcttttctatgacataatatggattattatattggcttattgtttaataaaaagataaatatttagagcattaaattatatcaaacttggaagtaaaataaagagtacctatcttaaaacataatcctgggtactactagtagtttataatttagtaacatgggcattttccctctgaagattattccacagtggcaagtggtggggggaggaggaaggaataattactatttatcttatttgtaggcctcactcaattatatctacattataatgtataacacttgagaaaggcaatgcagaaaatgaattttgaataaacatatccctacttcagatgcagcagacccaaattggcctctaactacccccatttgttgaaggaaaattaacaaagaaaaagaaacgagaaaaagcccttctttctatttcacaaaatgacattagatttcatcaggtaacttctctaactcagcatcccttccaaattacttggcagttatagccctttgtatctcacacacacacacatgcacaaatgcacacacagagaacttactttatatacctcatgaccttgatgagaatcttaaactcttgtttatacaataaagtatgggagaagctgagagataagataactccatgtgattgaatcataaaatctcaggtttgaaaaaaatacctttttcactctatcagtagaactatgatattttatcagtctttgtcatttttgtaaaaagattgggaatccacttcctgaagtcaggaattaatccctcattgtgatttaatatgtttctgtgtggcaaacaaatttgataataaccagatactatcatgtatcattctgcttctatcccttagcttgtgttcagtgattatttagtcctatgctaagattctatttttccaaaaattcctttattggaaacccagtttaatcacatgtgagaaaccaatggctgaaggtttaaacaagtgattctgatttgcataaggtttggtgggcaattttgcctcccaatgggtatttgtcatgcctggagactttttggctgtcataactgggggaagagtggtgctgtcatctaatgggtagaggcaaggctactgctaaacatcctgtaatatacacagcaaagcactctcacgataaagacttatttggtccaatagtgaccaggttgagaaacaccgctataaactagtgttacaaaatatttgcattttctttagagttgtacatatcctaattcattagtgaaacaaataggagcattagcatgtctgtcaaaattagtaaaaaaatatgaaagtaatttctaaggataaacttctcatttctatctgcctcctcagggacagttcatttgttcaaataagtctctgtaaaatttttgtgaaaccggcatttagttcttataagttctgagtccattgtagttgcagttaacccttttatgacacttagcagagctagagctcaaaacttcttttacggatgatgatgctattaatgtattggttcaataaataataattaaccaggctaaattacagcatgtgaaaatagactgtctaattctcattctattttctgtattatttgatgttcttctgcttgaaatgtggtagcagattctgaattttaatctacctcaattcaaatgtctatatgtcaggaatgcaaagagaatgattcctctgaatttggcagttagttttatggaaaaaagcatttgtcaccaaaatggccaaaattacatttttattatttcaattagaaataaaatgtttacctaacttcaaaacattaccagagtctgttttcagtgcctcttttaaatcattttctatacaaaacatattactgtaactagcttatattttatcgtcacttgcctgagattctatatatcagaattacttctttaagagatttttcttttcctgtgctcaccgcattgaatttccattaatacttctatgtaacctttgtaattctattgttctttacctttggttaataaccttttatttaaaaatgcctaaataattacacactgcttctcaagtatgacacattttatatcgtattgtatgttaagacattttaatagcaacagtaataataagtcataaaatgtcttaaatttataaacacatttaatacagaaggttctagtccaatttaaagtttcttttgacctgtgcttatacacacagccataacacatacagaacacacttatacattcccacattggtttacacttgacatttagcctctttcaggaaggatgtcacaggcattctctatgtccagtagtgcccgataatctctaggctacaaaaccatgaataatttaactaacaaatattacagggagaaaattgcaagggaattctagtaagctaaactcaatttttagacttggcaattcaaagataaaaagctgtttcttctatgaaaaatgtaaacagaatcattcgagttgacaggtactttgggtctcactggcacttcatctcaaagattaagatatcactagaaattaggacgtaatttatcaccaaatcaccatggtctttgtagcgactttatccctagggggcgcgagatgttagctctcccacagatgcaagccttcagtccttctgtcagatgaacttgggagtcagtatactctcacaagaagagagaagttgattattatagcaaacttgaaaattgattctaaaataagcacgattatggcttctaacatgccatccaacttactgccactcattctgccctaggccttatgtctgtaattgttggctttttacctactgccctctgtctagtgtggtatcttatttctttgtgttcgtcctgctcttcaaagttctttcctggctgaggatttggatttggatttggagctgtcattaaaagacaccattcatgaatttccaatacttgaataaacaacttttactttacggtcatcacaagtgaagaaagggacatttcatgatatcatttgcaaattagggagcacaagtaatcaatctttaatttctctttaaagggaagggaaaatgttctctcttgtcattccatctgtgaattcctataaaatgtgtttgctgtttgtttctcctcaagacagagcttgccacccaaaatcaaaatccaagttctctacacatccaagataagatatgaatggctttagagtatgtggcagaaatgagaattctcaaaattccagtgttgtcaactgctctctgattttccaaaatgttagtttgataaccaaaatggaaagaactccagagtcattttagtaggtgcccattagatgctaggcgttgtttctggagatacaaagcttaaaaatacatgatctcttccctgttctgattgtgctttcatcatgccaatacactatgtatttgaaattcatagagctttaagactcattataaaatattatgtatatgtagcacattaaagttctatagagaagagaaaagaaaaatggtctgtgagaaagggcaaagcattaaattcttggaaaaggaattttcttatttccctttacctggcaaaggattcacttcattggtacctaagctctgtaaactgttttcactccttggccaatcatgaaaacactgttagttgccaaaggaaggtatgatttcaaataataggagacaattacaggtgcatgccctgacataaattaaggtatagagatggatcctctcaaaattattacatattcaagtgccttgttataagctgatgaaaaaacaaaatatgaaattacaaaatggtttccttggctttgcagacctctacctgtgaagtgtatgaacaagacttaatacacacagcagaaattccacatttaggagccaaatatcacagagaacaagtaatgtcatgtgcaataaagcaatttcctaaatgttattagtctgcatgtctgcagccacctgtctaaagctcctttatttttattttaacaaagttgaataaaaaaatttcttcatttacagtcttatgcttggtttgatgttaaaagggattataattgcagtatagagaacacaaaacaattttaaaattatagagataaatttttattatgagactgaacatatgataagcaatttgaagtaaacctcatgtctcaagtagtaaatgaaaatgcattctcactttgcatatttggtattctgtcttaacaatgttaaaaatgctgaaaactagttgttatgttgcatatttacatgaagtgtgtgttctttgttatgtttctgttcactggggcaaaattcttaaccttaaatgaaattttggtatacatggtgattgatagataacagtcgaaagatggtatcctcccagtcctgtttcttcagaaagtcagaagatggttttatttatgtgttgcagattgccgtcgctttgcattttagcaccacctggtggacaaaatatcatttgtttttttctctactgtttaaagtagccccttcacactctatacccgattatgatacaccttaatagacattcagctgtgtaagttctaaattttaaagattgttgtaaataaactaaggttaaaaaattgaaatgtttcccaagtactataaccaatttaaatgcctgggtttttttaaccttcataaatatatccagatttgaataatgcttttcattcatatgcaaaaattgcttctttccacattttaattttttattgtttatattttttcttaatatagaattaaataagatgaggcagttttctgtatgtacaaaattgtggtttaaattatattgtcttccaaaaattcacataatcactttgtaaatagcactttatgaagcatgttcatactataaattcttactatgctaatattttatacaaaattaaattagtattttaatttatactactacaaaataagccactttccccttataaataaaattcagttgtggtcttatgtgtattaattctcagtttttaatagttttttgaattttacagaagaaaaatttgataatattttcaaatgaaaaacacaaatatagttaaagctagttttgagaattttaatcatgttagtctttgtgtagtcccacatttctataaaatatggtggaaattatttctatgaaatacagtaaagaagataattcatctgcagattccacgatgttcctttggaatacaccacttacctgttctctagtaaaattggagatctgcaaattttgattgtgtgatagtcaaggattcaaacattcagtagctaaatagaaaggtggtaatttttaaatggaaaatatattctagtctcataccttttgtataccatttaaaataaaactatagcagatgacaaccttcatcgacatgcatcttgaagttatttgtcatttcaagaaagcatttaaaattttgttctctctctctttctctcttcttcctttttttttttcccccaaaggccttggatggtatactgtaaattcagcatatggagataccattatcataccttgccgacttgacgtacctcagaatctcatgtttggcaaatggaaatatgtaagtgtgacctacctgggacttggttaattgcccttgttcttttaaataaaattctttctgtgagtaactgtgaatttcaaattaacctaaatgcaatattaaactgtgagtacaaatgtaggaaggtaaaattgtgtggaatatggcaaaaaaataattcctatcttacataacaaatgatattttaaaataaagccaataaacacatagttcttagaatgtattagtctgaaagattccaccttaagtgttagaggcaaagaaaaaagcagagttccagaataaatcagtggattataggacagacctcagtggaggatggcaacctttcttcatttgttcatgttctacttgatgtggttattgcaaagacaagatatatcagtagatagagccttagacagtctttcggaattaatcatcagtattacaagcttgattctggcatttagccttaaaaatgtgttgatgctataggtcttttttatatttaacggtgttgattttttcccatatttcttgcagatagtaaaatcaaatcttctcaggtatgaaggtacaagtgggtctgaaaatggagggtagagatcctggtagggagatgtggaatggctatgtaactttgagtaataaaatgtctcaatttaattaatcaatattaatgcaaagtgtttgtgtggtacaatttcccaatgctggaccacaggagactcatgacagtctgcaagcttcaagtagatatgtttccctggacacaatatcaaaatttccctagctccttgaaatgttaaaaggtatttgcaaaggaaaagaatttgatggtcaaatactttacaaaaagtttattgcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaagtttattgcatcacttctcggagtctttcatatgtaaaatgcattaagaattgtctgagggtcatagtttgattcattgcttagatttatttgaccacacaacttttttcctcagatatctccaagaacaaacattctgcagaacacactgtaagaaatgtgcttaagcttgcactcaaggggtggtttaacacagtcttttaaaatataggttctgaaatcaacaggttccacaatgtgctcactgtgagattctgggcagaggaattaatccctattttttcatccataaaatgagataaaaatatcttcctcatagtgttgttgtcagagtacccgaagaaattgatatcaaaatacttacctagtacttgtcgtgtagtaatcattcaacaaagtgaactcgtgtctgtgatgctgcagaatcctaaccatactatgctcgtgtgagtgggaaatgaaaggaaaggaaaggaaggtggtaaggcagcacagcatttctctgtagcctccttctatttagtatccagttcactcgaggtaactttgaactatttctggtttcctataaatgtggaaatgtgaagttaaggcctctgaggacagagtctattagtgccaacaaaattccaagtgcctgggagactaccacacaatgcacttgttcaatcaaatttgctgccaaaacaaatggagtcaggtgatggcaaactttgatgatcatagaaaattctaactataacccagggagtagcattcacccagggagcagcacagttagtgaaatgtgggagttagtaaacccagggagtaacacagttcagtaaactgaactggcacagtggcactggaaatcaaacaataatggcaattttcaaatttttagttcagcaaaagtcttcagcaataaactgaaatatatttgaggcactatatgctctaaagtcaatcttgatttgcagaaatcaaacaataatggcaattttcaaatttttagttaagcaaaaggcttcagcaataaactgagatacatttgaggcactatatgctctaaagtcaatcttgattgcagaaatgctaaaatagagcatttgcaatgctctaatttaatgtaaccacctaaaagacaaaggaaagttttggaaaaatgagccgaagtaaacatagagaagaaatggcctgatttctcctggatcatattgtaaactccctgtgaatggagattacagctccctattcactcctcccaaccctactcctgacacctcctcaccattatctgccatagtgcctggtgcagaagagggattgaaggctatcaagagtggtacagtgtaaccataatgaggccaagctctaagctcaaatttttgctctgctaagatttcccagccaagaccttggaaagttacttaaccaaactcaacctccatggtctagtctgtagatgaggctaatatttaagtttaacttataaggctgttatgaatattaaaaccaattactgcatagaaagcccaaagaaggccgggcacggtggctcacgcctgtaatcccagcactttgggaggccgaggcgggcggatcacgaggtcaggagatcgagactatcctggctaacagggtgaaaccccgtctctactaaaaatacaaaaaaattagccaggcgtggtggcgcgtgcctgtagtcccagctactctggagcctgaggcgggagaatggcgtgaacccgggaggcggagcttgcagtgagccgaagttgtgccactgcactccagcctgggcgacagagcgagactccgtctcaaaaaaaaaaaaaaaaaaaaaaaaaaagaaagcccaaagaaaacacctgccataaagttaagtgctcaaaaattagtaactattatttattgaataaggggatgatgaataaggtagtggtctaacatactttgcataatgaaggaatgacttaagaagaggatttgcgttgtaaacctgtgattaaaacagttaagaagaatattgttgatgtattcagatatttaagcaaataaaacttttggactccaatatcaacttagtaattgatattattaattcttaaaactgaatcctccatagaatcctaaaatttgtcatggactataacatatatcacatttaattttctcaaaggtcttgtagggtacataaaggagggactgcccctgattttacattaaattgcttattaggtgagagaatttttgtgggaccagaggaagaaatgcgttatatgtctcagtgctcttggcataattgtgtatgcagagtacatcttattttggtgatgtttttgtatgaaagacttttgagctcattgttatgactcagcaaaactatgggttgtattagttaatctgactcattccttaatggacataattattttacaagggtaaatactgtttctccatcaagactggttaaactattccatgtataaaggtcagctacatcagttttggttagaggtgtggacatttaaaataggtggattaaaataaagaatattccaaagataattgcccaaaatatccaaaccagtatttgcagctcaagtgtatacctgccgtgatggttatctgaacatcattttgtacctttgtttgcatttatttatgttttattttatattaaacatatgcagcccatgtaagtttcaaaacagttaataattctatcttctcaatgaaaaaaaaatctgattcctagagctctaccctttcatttttactcattatggcttctctcttatgaaggattttctgtaatcaaatatttacgtgagacttgtataaaaattattcttcgtagacaaaaaatatagatattggtagaatatggccaaggaaatgttattttgaatgtaatcctgaaacatctgaatatgcttgtgtttaaatgtattattattttaatttttaggaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcagtaagtagtctgcagcagtgtcactgctaagtgggattgatggccagtaccagaccatgttctttagaaagaagactgaactctctgtagtgtctctatagcaggtatctatataaggggacttaaagagatcttcattctgctcatatatactatcagcaaagaaaacaaagagtatgaaattcaaataggagatttgcagtgaggaactaaaataatattctctgttactttgtcatgtaaaaatgtcgtgagctatgaagtactactactgataactagcaggtgatcttaatttttactgacatgtacaaataagtgttgtgtgatacatacatagatatatgatatatatgtaatcatgtatatcacgcatacatatacatgtatttggctgaaccaaatgaaattgccattttgctgcataataaaaaaatataagcaaattcaaactatattttaacagaggtataaattttccatttatatatatccacatatataaatatcccatatatatccacatacaaatattttatatattatatatattagagatatagatacatttccatcctgacctttattgactggttattgatttagatttcaaaaagtattcacttgctttagaaaattgtcctaaaattaaaaaaactcactataccctgaatgcttatgtgggatacaccaaggggagaaagtagagtagtgatggaagaagagaaaattgtagaagaaacttggaataattatagtcactatgacaaaattactttgcctaatgatagcatatagttaatgttactgtgcaaataactgtgcaaatgaatgacttgagaagttataattaaagtatttcatcttttaaaactcaaataaaaagtcccgcctctattacttcacaatattttagacactacagggaacgaaacaggtctcaaaagtttcagaatgccagtctttcagtcttttttaattagggaagaaggtttcactttacaactttttcccctctgctttctgataacttgacagcgcttagaaattattaaaataaatagggaagaaggaaacccagagggccttccaactacagcaagtaactatggatttttcctgtttctcttgtaatagcctatgcaactaagtaggtctgtccctcaagtatttatacggacttcaaagctcctatgggctcatgatgcagattcaaagcatgcttatactatcaaaggaaacctttgttccctagaagaaccttgtaagagcatattacatgtttcagttgattacctttcagcttagaaggcactttccagaaaccatccacacttctcgatcgttgtatgaatcaaaccaagtgcaaaccaagtgtttgcagtcatgcctgtttccataaaacatcccaaatagtctgcatcctgcatttgccagtggcccatgtatttttttcttttcttctatttcactttcatgttattagaaagatgaatagtgcactgctcaggacacttttctaaagcgagtaatcaaaaagttttttggtgatagttataatgtcataatataaccagacatcaaaaatggaccacagtagctacagaggttaagtcacagcactctaatggttatatgtattaatttgtcattgtcaggtttcatttttaaggtgttaaaattttcctacactgagatggtaatatacaagggagttgagaaaattcagtttgtttcatttggaagaattatttgtgacagttttcaaaacattttgtaaaaaaaaaaaaaaaacattaagctattcctcatatgcaagaaatcatacctgtaaatcaggccaaatctgattttttcagaaatctgaaaaaaattcagctggcctaattcaataaaatttatcagctgatttggaatacagggaatttctattattgtgaaaacaaactcacaccccacctaccgccaacacccccctactcccttctctttttgatgttgttgaaaacaaagtgattctcagaaacagaatttgcattccaggctgtgggccagggagaatttacatagacaagttacacactcttgaaaatggtgttttatgctagaaatcgtgagaccctccaaatccagtaaaatgaacagcaaagcttatgataaagacaatgtttacaaaaaacatataggggctttggtttgtttttttgttttgttttgttttcaatgaatttactttgggtcactttctgtgaagcaaaaagcagctgtgacagggagactttcattctctgcatgtgtatattgcagtcacttaagagttactaagcccatcaatcagtcctctgtttccctctgttgaatcacttagcaacgtgcaccgtgtaccatagaatcaagtgtggttaatgggagccagtctcagatcaggctgctgctgattgccatcctcatgagctaagtcaaattgtttttattctaactacagcccctggcaaatgaccttgctatctttaatgcaggtttgcttgtttaattttaagctattcctcatatgcaagaaatcatacctatgaatcagcccaaatccaaataagtggcattcttagtcaccactaatcagcttttttcttttagttgaatggcatcaaaatcaaactgtgtttttatttagtgcacatttgaggttaataaaaccattcagaagcaagtgtcagcctttaaaggtgcccaaagattcgttctagtgattgtgaaaaaggtctagaagtcaaatgggtacccagagagccagaaggctgttggtgagatggagcagtcactgagcgggtcaccaggagaacttactttatgagatctgctgctaatttctgactttgggcaagtcacctcaccagtctggggctaagattcactcctcatcagtaaaatgaatactttggatgagacgggaggttttcccattctgatgctaggatcttgttcatgagttaatgaagacagttgaggaaggtaaggagctatttctacttgattagtgaggcttcagtctatttcaacatttcaaagtttttcatgataatttgttcatgaaaaaaaaaagaaaacagaggagttgctccagctctaaaaaaaatttgaaaaccacaccctgtgctaattgcaagtctagtctactctggtgctgctctgtggtattgcagacatagagtctgctctgtggtacatatggaccaggtcttatgatgatgataggccatgtttagtggcttcacacagaggtacttcagagcttttatttggattcctcccacttggatactgttctgactgctttatcaaaattaagtgtctttgctttcaccctcctcctaaaagtcattcaacctaaaagtaaaattttggggggcattgaggggggaggaagcagaaaatgttctgtttaacaatgagatctacaccagatatttcattttgattatttaaatataaaagataccttttgctcacagtagttggcttaaagtacttcatgatttatgaggggtgattgctgacaaagtactgggaggagccgttttgagtcaacacgaccatttgcatctgccttcacttgctctcctctcttattaaattgagctatcctatgtgtgggtttttatagtaatactagaacactgtgagtcatacagagcagttgtgccgtcttcactacattctcaccttgctgtgagctggctacatgccaaaaaatatacattttagtaggttgctgatttttagattctttgaaggctaatgttcatagctcttactagcaatagtctgggtattagaacaaaaggagctgtctatttcagtatatttctttctgaccactccccagccccttaccacaatttcttctccagctataaaatctcctgtataactgcagatgatataaaacaaaaagaaaagtagagggaaaagtaagggcactatttatgaaatgttttaattgacactaaatattacatgtagcttaacttttcactatatatgatcagcccttaatgggtattagtgaaagccctacaatttacttggttgaaagccactatccatagcaagctaacacaggaacagaaaccaaatactgcatgttctcacttataagtgggagctaaatgatgagaacacatgggcacatagaggagaacaacacacactggggcctttcagagggaggagggtaggaagagggagagaatcaggaaaaataactaataggtactaggcttaatgcctaggtgatgaaataatctgtacaaaaacccccatgacataactttacctatgtaacaaacctgcatttgtacccctgagcttaaaacaaaagtattacaaaccgaaaccatttgagtcttagcattatatatcattgttcaagatactggcacatactacatgttgccatgaatatcagctgcccctgtctccaacacacacatgcgtgcacacgcacacacacacacaccttgtaaaatactatcagatttagaataaacactgtaagatatttttaatctccctattctataattttaagctaccatagtgtggccctattataatatagcttctaactacttaagatagccaggtcagcaaaaaaagaaaataaacaaaggcatgatttttccatttgataaatattcagttgaatgatttagagaaacttagccaagaagactcagaagcaaaatttggcttaaatcattgcccttgactaaattactttaatgatgcaagtaaatttgtagcattgcttttcccttcaattctatacttggttatgaatctttgaatcatgttaagatataattcacatagactattttttaacactttggaatcaatatgcaattttgctaaaatagtgcatgtcctcttttatggtcctccaactaatactcatcaattgtcacaacctaatataaaagaaaattacattcaagatacatagttaatatagaggactcaaaacaaacctttaaggagaaaataactcaggaaaatgaaataagtattaccattacattcacaatactcactgtgaccctcttttccaaatagaaagacgaatcataatgtaaacaggattaagctttaaacatcctttcatcaggtttccttaggtttgctacagtttcatttcattgaaaaaataaggaattttataaagcatttatggcaacaaaacacacatgaccatgagtaaaggaccaaacactgaaatacaaagtgtttatgattatgggtgcattgataaaacattacagggtttacaaagcaaagtaaagttatacattttctattagagaaagagtatgtgcacaacagtctggatattttactttggtgaactggaaagtagtgaaacttggcaaagcgacccaccaaatctgtctatttagaacctaaatttatggggagaattgtcaaatatcatcacatattccaggcatagtactcttgaaggagaaactaagaatgttttgaccttttttttctgttcattttgactcttcattggccacgtaaattaactgcatgtattacatctattgagctctcagagagggtgtcactaaataactgatttcagtttccagaaaactttgacttacttacaccccaagaattttctttttgtttaaatatttcagatgcattcttctctcaaatgtattagatatttgcctttttaaaacgtggattccaaataagattcagtgtttcatcaataaatcagagttccaattatgaacattaataacattctattaaaatagtgataatgtcaaggtttactcttacgtgaaaggctttaacccccacacaatatgtttcccagaaactggtgtctattttgagaagcttttttttcttggtcaactttttatcattttatggtcactatcctaccaatcaggtagtcaagtgtcacttctagtttgtgttaatgttaattttctctgttgtgtcttcctatttttctatatttattttttctattgttctatcttgcttatgttttgttcccaatcagtgtctttggaaactagaaatcatcattgtgaaaattgtatttgtggaattatatttctagaattaatagttaagtaggccctcttataattaaagagcatgagttcaacacatgggaggatttattgtttttgttcattattctaatatctcatgtaaagcatatttatgaggggaaattaactctagatattaacctaaagaaggttacatttgtttctcatataatctaaagatatccattttgctaccgcagagacattttgtcattttccctgttttctataatgatctagggaggtaacatgtctaataactgaattccaaattgagtaataattatacaaaagccaatttagtttagtttggtaatcaaaattaaaagtattaggtggtaaacaataagactataaaagaaaaagtagctgattgtttaaatacatttgcttataagaaaatagaataattttggtccatgagactcacaaacatcagtgacaatgaggcaatatactttttgtgtaaactaattgttggagctatttaaaaagcgcaaaatccatcattgatagaaaatagcagctaagaataaaataacttaaaatcagtttaaataataaattgttgctgcaacttttaatcaattgctcctgaagtctttattaaaatttatgtttcttagaactacctatatttaaaatgtttttgtccatcatctcaggttccacatttgaaagattttctcacatttacactttcatattgtgacttggcttaagaggtaaagttagagatatttcagaaatttgggtttataaattccttaacttgctttctatttcccatgattttagaacagtgtttctcaaactttatggtgactgagaatcccctagaaacttgtttaaaatgtagagttatgggatttttttttttcaggaattctgattcagtaggccaaatagggctcagaaatctgaattttaaacaagtatctttgtgattctggttcatgtaaattaatgtcttcagttaatgagctggaagttactgataagtaagaagtgctcatggtaatcaattagagacaatatatcctatataggacattagcccctgtttcactatcaaatccatattcactatttataaagcattcagaaagcattatttatattttattcaaaggaattacaagcactgaaaataatatttaagataataaatatttgaaggggtagacctatagattccccaaatccagattgtataacgaaatctatttttattctgttgcttattcttctgtattgagtaaatgaattgtttttgctgtgaatcaaatcacagaagtcccgtttttcttacatatgtacttaaaatctttctctgcttaactttagagcaaccatctaaacctgaaattgtaagcaaagcactgtttctcgaaacagagcagctaaaaaaggtaagaattgtttttgattaatacctttatttagccagtgttgtaagtgccttcttctgaccttacattccaagacaagtaagaaaggctttgctcttgtggagatgacagtgttgcagctaccaatcagaaattatctacaaggcacagagggtacaacatgctcacagtctcaggtaaccatgaggacatcaaggaaggtggggtcatttctgaaaagaggagtctttctcatttgaattaatggattgtttaatagaaggatgaagccagttagcatgattcatgcctgtaagcccaacagtttgggaggttaaggtgggaggatcacttgagcccaggaatgtacagcatggcaagaccttgtttataaaaaatatttaaaagttagctgggcatagcggtacatgcctgtggtcccagctgcttggtaggctgatgcttggtaaggaggactgcttgagcctaggaggtcaaagctgcagtgagccatgtttgcaccattgcattccattgtggacgacagagccagaccctgtgtagaaaaaatatatagagagaatgatgaaagatgaatagattttcaccaagccaaaggtagaaatggctttccaacaatatgaaataataggatgtgaaagagaacggtgtgtttgggaaacagcaaattttggcattgatgaaactgggtgccaagacagaaaacaagaaaggatagaaagagatgaatctggagaggcaaagaaaagttggatcatgacaaatcttacatactaaatagggagtttggactttattctgttggcaaattatgctactgaaagattgaagtaaagaggtgagatcagattcgaacaacacattagcagatatgtgaagggaagctgtattaaagtgggggacaaagttggagttccatattgaataataatgtaactaaaataccaaagttttcctttgttgggagatggaaacccaagtcctacattctttgtgtcatattaaattttactgcataaaattatttgatgaataccaaatattaaagttaaaatacatttaaagaaagtgaggggaattatagagcatgataatgtatatcctcttgaaatatatgtagtatgaaactggagacacagccccattttaacaccaaattattcttccgtatgaagatctatgattcatggtaatagtcagtgttaatagagtaatgttatttggttaatgttaaaaatgaatagtgtcaaaatgaatttggcaatgctttcaaatgaatgtgattttataatagtgacaccatctattgcacatttaaaaatcgtcaaaagtatattttcaaataaattgttaaaaaggtcttaaaaagacattgtttttataccagagagcatgtattcagtctttggtcagtgttggaaaataaacgggtcaagaaacccttggaataactctgcattgcctgagtttctggagtttccaaattgacagcccctgattgaaccaaggtaataacattgcctttttattttgcagttgggtgactgcatttcagaagacagttatccagatggcaatatcacatggtacaggaatggaaaagtgctacatccccttgaaggaggtgggtgtgagggcaggaggacagggagtacattcagaggacctgttctgactttctttgttctaggtattctttaaaccagtggtctccaacctttttggcaccaggaactggtttcatggaagacaatttttctttggatcagggtggggggatggtttcagggtgattcacaggcattaggtttattgtgtactttatttctattattattacatagtgatatataacaaaataattatgcaactcaccataatgtagaatcagtgagagcccagagcttgtttttctggaactagacagtcccatctaggggtgatgggacacagtgacagatcatcaggcatcagattctcataacaagtatgcaacctagatccctcatatgtgcagttcacagcaggatttgcattcctgtaagaacgtaattccacaactgatctgacaggagaaggagctcagtcagtaatgtgagccatggggagtggctgtaaatacaaaagaagcttcttgtggttgcccaccgctcacctcctgctgtttgcacccataccagtcctggaggttggagacccccgctttaaactattcaggatctaaatatgttgccctcttttgagctatgactcttatgctctgttactttaagtatgtactaaattaatacatgattttttaaacatcattttcagcccttgtacagaagaatcaagagcagaggaaataatttctgtatatggcatgatctagaagttaattaagtgagtgggaaaagggattccaggattctatttctgtgtctctgattcacggttttgaaacgacatctaacctcactacatgtcaattttctctcctgctgaatacagttagaaggaaaaaaaacacttctcaaaggtgtggtgctgtttcgttaaggattgtgattgtcagatgaaagaccctatcatcagtgttctttattttcttcagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactgtaagtaattcaatatataattatgctatttaatgtattagaaataatattcaaatgctattaatctttgaggtcccaatccaattactctttgaattctgcttccagtctgcaccccaaattgatggcacccaaataatctcttcctctttaggagaccatagcatgaataaacatttatccatcctataatatctttcactctctacattttatctatgagtgtctcttctgaattccactacacactaagttctttaaagataagatctataacttattttctggatgaatgacagacaaatatagactttaactggctttctaaataagagattaccattttaatgaagaaatttattttaataataagatcaattgcataagtttgataggatgttgtattacaagacattttacttaactaaattgtgtatttgaaacagagtatttgtctacaaaggaatcttcatggtcatctgttctaacttcattattttagttagtaaagtgaggcacagagtcttgccctaaattagctgtagatattagaatagaatctttttctccattgctgtgctttccttgtaagacaggtgccaagataatctaatgattagaagcaaaaattctggaattctagtcccagcattatcaattaccatttcttgaaaagtagcttaattactctacatctcagttttcttactttaaaatgggaaaaatataatacctaactgatagtgttgttatagagagtaagtgaaatcacaaatcaaaaatagcatgctacatcacacattaaattgtcattattaagtactttattattattattatatggtcattatcacaatataaacatagagctgaagatatttggggggaaaatgcaataaaggattttcttcttattattaatttatctaaaatttttgtgatactggcatgtgttctacagtaacctagcacttctacatctattttagagaaaagccaggaatgcctgctgagcctttcgaaagaatcacctcacctacatttctttttttggttccctagggcacaatatcttatatgagaacaaaagtgaaattcttccaaagttgccctaatattaaaaggtagttttgccttaaacttgggaaataagtttcaacttgatttaaacccaagaaattaatatttcattatgtatagcttatctaaaatcaaacttttttaggtgaaggcagaattctttctttcttttttttttttttgtgtgagacatagtctcactctgttgcccaggccagagtgcagtggcgtaatctcagcttactgcaacctccacctcttgaattcaagtgcttctcctgcctcagcctcccaagtagctgggattagaagcgcatgccaccacaccctgctgatttttgtatttttagtagaggtggggttccaccatgttggtcaggttggtctcgaactcctgacctcaggtgatctgcccacctcagcctcccaaagtactgggattacaggtgtgagccaccaagcccggcccagaattctttctgttagaaatattcaattggaaataaaccatattagtgtaagtgtaggtgtacaacacaggagagaacatcaagataagtaataagaattgggaaattggcttcagaaagaatagaaatatctgtgagtatgaggcatgcagagttgggtagacggagaagttcttgaatggatacgaagaaaatgattttatcatgctggctgtgtaaggtgcacttgtcatggcttttaagaagccacagtgggcttcatggtgaaaacacgaagcacaaagaagcagtttaagacagtcctcacattcaaggagtgtactactccagtagagaaacaagacacctacatcagaaggaaattgccaatgcaaggttgtaagggtaaaagtcttaggaactcagtattaagagtcttgagggctcaggtgcccaaggacagtggttctcaaactgtagtgtaaatcagaagaacatgaaggacttgttagagcacagattactgcaccctggccttgagtttctgatttagtgggtataggacggtgattgacactctgcatttgtaacaaattccctgatggtgctaatgctgctgatctgaggactacgagtggagaaccactgctctaggaagacttcagagaacagaagaagagtgctaaatggaaaggagagacgagtccatttcaagaaaaaaaaattggccaattcatcttgagaaagcttgagaaaaatgcaccagtccactcctttcttaccctattcaatcagtaacgaggttttagagaatctagctctttaatctttgttttgatctgatttctgccttctgacactgcctacgtttatgccaccattcctcattgcctctattcctgcgatggatttcaaagtagtatttttccaatgaattgcaaaatagtatttctcttgtctgcccaccattctctgttcacccccaaataaactgccctccaaactgctgccagaaatatttttctaaaacacaaatgtgacaaaaacttctcagtgactccccagagctctcagattaatatccttccccctcccccaattgcagtatgccttgagttcgttttagccatggtcctacagtatgtctcaaccctcatcactgcctgtatccactgtggtctgttctactttccagattccttctgtagagtaatacttacatgcctatgcatatgctgtcattttcccacctttatcatttagcaaatacccatttatgtgtcaaaacccagctccagggtcagttcctccaggaagcttcctagtctcatgtaatgatggctaccaggatccctatgcttgtgtcatatgcaggttttatgtggtcatactcttaattattaagtttggtgtctttacaaatagaggaaaagttcattgaggcagggttttcaacttcctaattccagcacttaaggcttgcacaatatagatgccaaacaaatgaataaatgaagaaggactgtaggataaataaatacatgaaaagaaaatttcagcagacagttttggttattttgtaggggtttatgtagcagagtaagagagaagactctcacttgagctgggttcaagccaaattgtggataccaggctaaggaatttttatttttaatcttcatatgttgggaatgtgtaacagattttgagtatcattgtaatattcaaagcgctacttcagaaaacagattcagaggaaatatatatgaaaggatcaaaaggaaggagactcaaggtgaggaaccaagtgaaatttgatggcattgcttcaagtttaggttaattaggacatggactagggaagtgttagtgagaatagaaggggagaatcagacccaaaatatattgtaaagtattaatcatcaagacatggtgactgaatggataagagagggcaaaggagaaagccagggcaatgggcaaaatgatgatttactagtgggcagagtaaaattcaaagtcaggggcaaacgcagagcaagggatccttaactttgaggtaaacacgttagtggacatgcagagagttactgtcaaaacgcaaatgtgttacattaaccctttgatgactctctaatacaaagcggagcctattgaaaagggaacacagagaaggggagttttaaaatagagaaggaagtcagagattgccatccctggctgttctgttgtgtcaaccttgatcagagatgtgccacagtgacatgccacaggccaaacatgagcactagtcagagaagggccaagtaagaaaagcaagagaggcccggaaacggaaggtcagcagggcaccaaaaccagattttatttacttttcaacctcaccggaaactgctggttaggaaactacttcaggcaaatccagaaaaacaaataagaaatgtattaaatcaatcaccgtttaacctcagaatgtactggacaagtattcagagatgcccaagcatagagaaaaggcaaagaaacaatctataacaaacttctaagtttttttatctgcactttatctatagaaaggtaaataaatgaccgcaagagatagaacaaagcctccaaaagtataacttactcatttcacttgttagctaataaaaaaaataggttttcatagataatttttagtgccaccagtttggaaatatatacacatgcctcaataattattaagtcttgtggaaaacattctataaaacatacctttgcattatatgatttcaaaatttattattcattgtattatccagcaacataacaaatggataggttagtggatcatttctaactgccagcaccacttcattttatttcctgtttgctagatatggttcactgtatccagcatttaatttcattagcattctactattgagtgctgaagcataccctttagccctattttctccataaattgaccaaaatggaatgaaagttgcatcttggctccaatgaacaggacaaaattacaatacacttacagtcctgttgattgtgtcaaggttctccctcagttcataggattcatctttttttaagcagatcttctctcctgcatgccgaaatcctcgctggtgttgtttagctcatgtctcctctttttatttcatatgaagtattatcatgcaatatgagtacagtggcatctaatagctttagctatttgctagctgatttttgtccttccaaactataagattcatataatatataattaaatttccctatcataaagccatgcagtttgattgttcctatggtcttttatacataaaataattaccaccattcctacctcagttaaagacattttgctaagaagaaattgatttttatgtaacagggtttctttgtagttggccctaagattagtacttgtatagcaagtagctattagcttcaatccttctataaaaaggtatatttaagcaattaccattactagcttcttgagaaaattatgtataatttagtcatttacattgtatgcacagagtaattcggtacttgacaaaaatggttaacttgtgtctgtaactcttacagatcctacagagcaggtgacaatacaagtgctgccaccaaaaaatgccatcaaagaaggggataacatcactcttaaatgcttagggaatggcaaccctcccccagaggaatttttgttttacttaccagtaagtgcttaagtattacttcagttggatgactatcatttttcctgttgtttgacttctacatggatagattaagtgagaaaaaatgttattgctggagacaagagacgccacctataaaatgtcacgtggaagctttttctgcacctgccactgttcttgccttttttctcaatgctgagagatttcaaggacaaagagaaaaaaaaagccaaccacaggaaaccataattgcaaaaacttaaagtttaattatccaaataaactttaagaatctgctcctcagaagcagataactacaaaatgaaaactgatgacagtgaatgaactgatgtggattctaaatctgcccacaacattgccccgaacacacctctaaccctcagaagtagggatagttctgttgcacgttatatttaggataatgctatggctcttttttggtcattatgtataatcttgaaatgccatttcctcaacttttctccatatcatagctgaaggaaatgatatgcatagaggatactttggaaaattcctctcggatgtgctctgcatgtcataaggatctggaagcagacaaggagagagctcgctctgaggatgcctgtttgctctcgcatatctttgtgtttgacatcactttcacattgagggaagccataatgcaactcaatactgcatttactgcagggttgtgcttacaaatttcatctaccacagtactcaatagtatttaagaatgtcattcactacattattcagaagactagtataagtaatttctttatgctgacagaaaactttgtttctcccaatgaattaattgctgtttttgtttcctttgcgaaggaaaatttaaaactaattaggtttctgctttggctatcggggatgacagagccaaatttgtgtctcagttttagcaataatacctgctgaatatctttctttgttaacttatattattcctacatcatctatatttttcctagtcttaatttcttaatttctttttttcttttgtcattttctttttttcttctcctctctctcttcctttcccctttctttctttctcattcttctcatttcatcctttcttcctttttactttccttccttccttctttccttccttttatgttttttcttttaatctggatatatagtgtatttccttttaagctgcctcaaatatttttgtcaaattacataaggcataaatataaaaataaaacattggactttttaaaaatgcccttgaaacttgagcaaaagccatgctgtcaataaaataaaagtcatcaatagaaaataaatcagctctcaaattccttaggtccaaaatattaattatttgcccaggaatcagatattggtaacacaaactgtactctttttgtgtgatcaatgaaacacattcccttttttatcttacttgataaaatgctatcttcatcaagaaatacaactgttctcattgtagcgaccaagtataatcatctgacattttgcctctatcaaaagggacagcccgaaggaataagaagctcaaatacttacacactgacggatgtgaggcgcaatgcaacaggagactacaagtgttccctgatagacaaaaaaagcatgattgcttcaacagctatcacagttcactgtaagtcacctacttcttcatcagcagcttcacctcaaaggcttctaatagcttaatgtagctatcttttcaaataaactgcacgtatatctttcttaaataacttggttgcaatagatgcagtagagagagaaagcatcgggataagctcaactttgtccagatttgtactgcaatattgaaaccttgcatggctctgataaccgcaacttttggcagtggtacatctccatcttctttctaagtgtcttcaatttgtggtgtcaatgaacaatattcatatagaccttaaagaaacaactctgtatattttaagaaaacatttccatgttcttgaagtgcaccagctttgcagttgacccagcattatcatttgtgttacagaataaatttaacacccaaactcagacaatacaaagttactacagactcagttttgggaacaggaagtagagatcattagaagttatttattggctgaatgtactctatatagaggggtaggaaatttctggaaacagaacctcttgaaaatcactgtggacataactttttaacttttaatttgcttttgatctccaaatactccaaaaattatatttgcctcggtgtaacagaaaaagacacatgtaaataccagacatttaacttgagttcttcatgacagtccatattattgatgtacctgatgaatcatggaaacagtaaactaattcataccacaccctggtgacactagaattcagagtgctttaagcaaatgtcagtcttgcttagaggtatagtacaaacttcctaataagtcctttgcactcaacagtaccattaataaggtttcctctagacatcatccactacaatcccactgagtataaagagactttagaaattgtcttgagtacatagttctaactctttcatttgactcataatactttaaaaacatgtgggatatgagctaaatttttgagagagatacagggaggtacattggggaataaagcaaccagatggttgcttctgattgtctgatgttgggagtgctcccttgagagccctgtaaaaatagtggactgttatgttcacagctgggccatttctccatttactccttgcttatgttgcttgggtttgaatgtgtctcccatcaggggctagttacagagaaagcagtagcttccagtataacaatattatccagtcctgttccatgaaaataaaataatgaagaaagagaatatagccagcagatagaaccatatgtggaatagctagctctctattatcattgctcatgatgtctttgggccaataatcaataatctagtgccttagagatggtgtgatgtgcttatttttaagagatgcaaggtacacaggtctctaaaagaaaagggctcttatttactttacttgtagataaggcaggggaggatagatggcagactgacaaagcaaaagacttggttgcagccatatagtgcctacgtgtttggctgtgatgggggaaaattaaacaaaagtgtgtaaaagtttaactggattttagtgcatttaattagatttaaatgcatcttggttttgacaggtagactctaacactgggttttaactctgttgctgactctgttcctcctcaaaagctgaaaaaaagtatttcaagtaaatcaacatctgattctaaattatatggaaacataaaaatcctatttttacccacttatctttgattgcttgcttattttccaaaaacaagatttgtttccttttcaaacatgtctaaaggaagtgtgggtagagaagcgccaacccattcttgcacatgtttgcagaatagactgctcatcaagtctcacagcctacaaattcctagttgctgatgaaagtcactgtttccctgccaatatatgcacacatagagtcttcatcagagctttcaaagtccatcattgtcctgtaaaattgtttatctcctctctggaaaattagctatccagctaacaaaaacttctaactcatccagaataaaattttcatctaaatacaattcacccaaatgttccaaggaaactccacttttctacatgttggtacatggtttcatattaatgagaaattgagaaagcatgctccttcccttcattcattcaatagtaatgtttgagagtctaccatgtctcagccactgtggatatatcagtgacaaaccaagtcacaatcactaccctcatggtgctttcagtctgataggagagacaaactttaaaaatgatgttgcagtcaacaagttgcaattatgacattttaaaccaaggagaaacttggagtgtaatggcaagtcttcatactgtagaacaaagacacaactcctagtgtggcaagcatggtcctcttcagtctggtctcaatgaattgtatgagtttaacttccatgagttgtcaccacttatacccaattactcaccattacaaaatctgccaagctttctcatctcttcgcctttgcttatgtgaccaaagttttccttacatcttcccctatcaaagtccttctcaaccatcagaggccacgaacatatagtgttccctttacaaagcctttattactgctttgaaacccagtttggctctgttctctatacttccattaagtcttcatttgtacctctgtttctagcctgcctttcatctttcaacaaatatttagtgaactccaaatcagtgtcaggtttgctactaggtgctgattttatgggctgtgtgttatagtcagcatagtacctctacctcattgacttataaggtcattatttatctctgcatctctcatcagtgcttgggacttagtagctgtacaataaatacttgttcagttgagttggaattttctcatacagatcagactatgacagtaagatttttataaagattgttttccatcaactggatgagaaatggaatagcactttttaaaaatatctgctgctatagtaaattctctctgaagaaacacaactactatctcatggtttttcaatttatcacctgctgtctaaagatgcttgattttccaacatttatgccttactgtctctttatataatatttacctagtcatcatctttattttcttccagaagtgacttaagatttttttttcttaaggtgataggccctaggggaatatttatatcccctcaaaatatcaatcacgttaactgcaaataaatggataatcaattagattgaccactctcttgtctaaactagtctcaaggctggcttgaaaaactaggctaatcatgctatagtccaattattttagtcatataaatcagttctgaatgttcaaatgcagttagaagaaatttattttctttcatcttttcttctccaaaatattttgactatcttacatttcagagttagcactttgaacagattttctgcttcacagatttggatttgtccttaaacccaagtggagaagtgactagacagattggtgatgccctacccgtgtcatgcacaatatctgctagcaggaatgcaactgtggtatggatgaaagtaagtaatatttttggtactaccctgctgtttggtttgatttctttttaggtttcttatgcactttatattgtattcaagtaggtatattcatggatgtgtttatataccagctctctctctctctctgtttctgataagagaaataaaataacaataaaattttagaggtgctcaacacggtgacatccataattggtattctgaaacttagtttggggtgttatgtcaattatgtgtatatactaattatacacacaccacacgcatgtgtgcacatacaaacatagttatataccacagggcttaataatttacagtgtgtttttgcccacattatccttacgtgatatttacaacaaccctgtgaaatacaaagattattattttccccacattcttcatataaagaaattgaagggaaataaatcagaaagctcataactgacagagtagagactcaaggccagaccttactgagtatgaatactatgctttgataagacaccttttgtctctctgctgctgagaccactcttaagtttctgaaaacaggttccactggatcaagggctcctagaaagcaatcccttttatccctgagctatagtagaatacctggaacatagtaggagttaattcagtattccctgaacaagtgcttatactcttgtaattgtctgaaatgtaggccattggctatccttttagagtaaggaagtgtgactgataattggtgatttgagacaaggttatcaccaaaggaaaaggttgtgattgcgatccctccacttaaacccttggctagtatatccaaactcccagtgcatttgttaccagagcatgacatgtgacaagaacccttaacccatgatgggttcagaaaacaacacataccatttgaaataggagttgacaagaattacctttataagaaactgtggagaaatatttttctagagtttctttttgatggaaatatattgatgaaattattttgtattgctttactgcctgccttttgatcctttttaacactcgatcctctgctacttgttgtcttactctgtgagctcagtttcttattgtactctctttcagccacagcctcatcacaacttgttcactaaaataaagtgccacttcctatgctgcaatctagcatgatatgtttgtagtaatcagtgatcacaaggctagacaagttctaggcaactagactaattcataatcatttgaacactcattgcatgttttactataggactagagaaactaagtttactgtggtttaaactgtttgtacaatcaactgcaatcactgttatgaattaactgtcatgaacagctcatgtattcaaaatagtgatgatcagtattccctgattattggttagttaatggggagtgggaaaaaatatcctaatggacaaagaccacataatcttaggattgtgtctagttgcctgcttaggagcatttcaattcctgacataataggattattttctgtatatcaggctattttttaaaattaaatgatacatttcctttgttcatagaaattggaatagaacgctttccaaattataaattcagtaaatgaaagagcgtgaaataaaaatctgacatgtctgactctaaaacaacaaaagaaaaaggaaatctattttgaaagcatctgaagttaagaaaaagaagtttgcatttatattattcccagaagaattgttttaggcttaattattatctaataaatacactgagaattttaattctgccacatgaggtaatttactttttatttaatcaggataacatcaggcttcgatctagcccgtcattttctagtcttcattatcaggatgctggaaactatgtctgcgaaactgctctgcaggaggttgaaggactaaagaaaagagagtcattgactctcattgtagaaggtaataaaatacttgggcactaattcaaattgttctttgagaattttttacctggtttcttttatgatctcagttcaacatcttattttaattgtaatatttcaggcaaacctcaaataaaaatgacaaagaaaactgatcccagtggactatctaaaacaataatctgccatgtggaaggttttccaaagccagccattcaatggacaattactggcagtggaagcgtcataaaccaagcaagtatttgtcttcttgttatatgctgcacttcgtccaatgcgttttttttccttcacgaacctaccctataggttggtttgttaccacataaaatttgcagtgtgtaggttggtttgttaccacatagaatttgcagtacatgctcagaggaagcttttgctaacttcttaattttcctagaggaagaacatggctcaaagagaaattttatcccagggccatggagaagggaagaaccattgtgtcatggtcagtatctgtttttaaaagaatataaattaggtattacttcatgatcattcattcctaaaatgtgagtgattaaaacattaagatatacactttcctgcaaaataagctcatgcatctcagtataagtgaactctaatactgtgctcaacttatgcacattaaggggtgttacttcttaaaactatgtcctcgtgtaggaatggtggagaagaacacagttactgcttatgaatgtgtggtctgacatgcctatgcagtgctagggccagaataaggcaagctacatatatagtgcctaggatgtgcccttctgaacaaaagggtcataaaccagaccttaatatttgtacctttttattttagtaatagtaaagggttaaggatttgttaacactacctgttattttcttttactattaagtctttgaccctccccttaaaggaaaaatgagaatctggcctaccactagggattcagaactgtaatcccagtaatttgccaatctgcttgggttgctgacatacttgctaattccattgttctctacaacagtcttcgtgtctccctcttctcagtataatctgtaaaggcttctcaggagcacccagaggtaccactggattatttaaatcttctgtacttctcagattttgacccagttgaaatttgagaagacatatataaagcaaagagctgtaaattaattttaagttaaaatctccactcttcctctttctagggaagttgggccactgtcccagcttacgccatgcagttttgcagtgcaaagtggattttggctctttcaactataggtgatgcatatatagctgcataactctagatatggaaagccctcaaaagagtaggcacacgtgaagtgaatgactcctgatttggttaagtgtgatggggacacacagtaagaaagcatataagaggaggcaaagaagctctgggctcctcaaacctaggaaaatgcagttttcttgatttggaataaagacttgaaccatctaaattgctgacaatgtgcagatctatttttagcatcaaaaatggtggtttcttttctactctattgtttttgctctctagttcaattaagtgataactgcagcaaaaaagaacctttaggtactggtaatacagacatagaaaacagaaacataagcagacagtaagtttttgattaatgaaaagatatgaagatttaaaagaccatcctagaaatgagaaaatatattttgtagagtttaaagtaacaaaaacaaagattccgtgagaaagtcagatgaaaaatcctagtacgaagtgaaaaaatagcaggtaaatttactgtgaggataaaaataataatgccatctttcattgtcaaggagaaagattgattctggcccactgggtgatatgttatttttcttgttctgggatttgtgctgatgcatccataatcacaattttatttgttcccttctcagatacatggtgaatctgttattttacaactagaagatgtctctgcccctcctccaccccagcaactagaagataaccaaaacaggagaatagctcttgtcctcaaggcacttaccatgtagttgaggagaaagcaaacaatatagaaagagaaaaatgtagggaatgagttcataagatgaccgagaaaagagtgcaagtacattatttgcctcaaccttgttgggtttaggagtcaaatcctagggatgagattaaagtaaattgtattttatatttgaaggaattaaatgcagtgattaccctcattaacacctcacaaacatcagagggacagcaatcactgaaaaatcatccatcctctgtatttacaacagaaaactttagaaaaaaatggtttcatgtacccatgagcaaattatacatacatacatactttgatataatggtttaagataaaggaattaattcccacagtgaagaacagtgactaaatttataaataattaaattcatatatttattggtggaaagttggtgtttaaatagtcaccaattaattattttgaaacaagtatcatcaggccaaaatgttgactaaacctgagattctatttaaaaagaagagtttaattaacttaattattagaattcacaaaagaaacataaacagaaatttcattatggatttactaatctttgtagatattggcatacatgggtcttgatctatgatcttacatagcttttgaacaccagaatgctctatagagcaccacgcctatcctattacagtcatcattactctttcctatgctttttaatccattttgatttctaaacccaccttttttcttctttttccagacagaggaatctccttatattaatggcaggtattatagtaaaattatcatttcccctgaagagaatgttacattaacttgcacagcagaaaaccaactggagagaacagtaaactccttgaatgtctctgctagtgagtattttatttctggcattacaaaagtaagaaaatttgaagttattcttcattagtttaaaatcttcaattccatcttcctgtactgcattatggtaagttttatttatttattttgcatttggtatcatcatcataaggttattttttcttttttcctgtccattcttgtactatccttgtcttgacagttaaatcatttcatgttttatgggtcagaggccttatcctgtacaggaatagttcccaaaagcaacagagaataaaaaataagtttctcttatttaattcatgttttatgttcagagtggagataattcaaagatcatcttaaaacatttttgtaacagttttaaatttggtaaatttgtaattccctttgatctattattttgccttctaattctttgtggtatttatcctacccttatgttgtactagaatgccacaagcttaaagtcatttagtaaactagcaagagtgattttagaattcatgaatctagtttacaaaactgttccttttgtcatatcatatttaaactatagccgaaaatcagataagtgaaactatctcagagaatgtggaaaaatctgtcgatgttgaaatcagggtaatacatacataccaacaacagcttcttcagaaaacaattgtcatttaatgtgaaattgtccataatcttcaattctatagttgttcctattgttttgtcaaccttaaatcaggactggcctagaatgaggctcagttctggacaggatgctaactgacctgccaaacttttattcttcattcagttggaaacctgtatatgacattagcaggctaggactacactagctgggaattagcaagagctaggagaaaataatcatcaaaaaataatggtccctcacagattatgactggaatataaaggcctaatggattgacaggataaaagaaccaaacaaatttaactctaagatagaagcattgacttctcagaatgcaattcagtgagtattgatttgtcccacctaggaagagaacctaccctttcttcctgaacacaagtttctctttttatgttaacccattgaatggtatgcttcagttttctaggccttgcagtgactttatcaacatttaatatagtcgttttcaaattcagtgagcacctcctgagatgccaatttagcatgtatgaggagaggtccgggaatctgcattttatcaaatgtcactggcagttccgatgcatgcccatgcactttgaagtttatttatagagtttaatattagataataattcaacacagtggtaattcttaaaatggacaaagagcatggcattatcagagtcatttggagagctttgcaaacatcatgtatgttgcttcttaatctcggaggtatccccagttttaacctctactcctactactttgagaacatctctagtggtaagtccttgacactggaggatgacaatgaattctcctatatcgggcaggaaagttgagaaaagttgataaacatcacactgtagacttcctaggtgccgacttgcttccctaaaaaaagaatgactattaaaaggtggtggatagtgggaaaatcaatatggatttcagattaattctataggtcatcagttatgaaattttctatggtagattaatatctttgcagttgtagctcctctccttaaaacaagattaatttctttgtaggcaaggtcatactttattaagtgtgatttttttttttttactgttagctatagaatagacattttatctttgagtattattacatcatactataatggtaaaggtgactttcatatatcaacaaattttgtttttaatttcatattaacatttttcatttcagtaagtattccagaacacgatgaggcagacgagataagtggtaggtactatgctgccgactcttcttccttgactatcagctcaagatttatgaagtgtcatggtataagtaattttcttagctgtccacaattttgacttgaattaaaataccaaagacaagatagtaagaatgctaaaattttaccctttaaaaatcacaagtttgcatgttaattactgtagtgagctttagtcatttttaatacaaagtaatagctagattgactttctgaaaatccttggcattgtctgtaattgcatggacttttcttctttgttgcagatgaaaacagagaaaaggtgaatgaccaggcaaaactaattgtgggaatcgttgttggtctcctccttgctgcccttgttgctggtgtcgtctactggctgtacatgaagaagtcaaagtgagttgtggaaaaaagatcttcatcgttcattgactttcactgggagaaaatacaatgtgctaattttgctcactccagtcgtgcatataatttatacaataaggaagatgtatccccaaatcaggttgattatatattttgtttcaactaattttgactacactgcctttgtcagggacatggcttgggatactgtttcacatgtgtccgtttatttgtctcaatcaatagcctgaattcaattatttgattttttcagtgcttgagtgaattttttaaagcgtatacttcctaaaggtcaacaaccatagactttttggttgaagttggagaagattcattaaaagtacctagtacatcttgtagggactgccaggtgtctttgcagtgacacatctggccagcaatgaaactgctgctgaggtaggaatatcttattgttattactcccatattctagttagttgactttgatccatataagagtctatatcagagaaaatcatgtcattatgtcaacttgagtttttaaaaatggattaaagtaccaacactacattaaaaatgctttagagatgttaaacattattagttatatgatattacagatagtatgaaccttacaaattatctaacagtggtttataaggaaaatccgatgaaccagcgaagattcttaacatacacacatgtcttatacttctcatcatctcactcctaaccctagattcagataccattgataggggtggggttccagcatctgcacttttaaaaagtttcactggtgattctgcggcatgctgctagtttcaaacatgggttttaaaccaccttatcttataaatgtgtaaattaagttttgcaatgggatgtctatagctagtggaactttggacttaattttatattatgtctgatatgtcccctttaaaaaatgtaagaaagttgacttaaaagagaatcaaaagaaaaatcagatttaaatcaggacccatgatctcaccttgtaaagatgccagttccaatgaagcaatattcaaatggagctgccatccaagggaggcagaagctctgaaattttgaagtcacatagcagcatgagcatgtattgagctcatgttctcacaacacatctataaagtacacaccattattattcatattttacattttaaaaatctgaggcagagaatggttaaatgacttgcctaaggttacatagtttgtagggcacagaattgttatttgatttaaggcagtgatgttttagaatctttgtgttgaaggagtagaccatactttctctcacttgctttattttgtgccacattaggcagaaacatttctcctgttgtgtgttgtcactgatgcacacgatgtccactctcacatgatggcacaactgctcctcatcttggcctttctctccttagtcttaagcagcccacaccaatacttggtatacgagtcaggattctccagagaatcaaaccagtagagggtgtgtgtgtgtgtgtacaaagaaagttttattataagaaattgactgacatgattacggaggctgagaagtaccaaaatctgcaggcaggaagctggagacacagtagagttaatgtgtagttccaggctatgtccaaaagcctgagaaccaggaaggtgtaagttccagtctgaaacccacatgggctaaaacccaggaagaactaatgtttcagtcccagactggaagcaagaaaaaatgtcccagttcaagtggtcaagtaagaagttccctcttactaagccttttttgttccattcatatcttcactgattaaatgaggcccacccacatagaggagggcaatctgctttacttagcctactgattcggttcaaatattaatctcacccagagataccctcacagacacagccagaataatgtttgaccaaatgtctgtgtaccacatgacccagtcaagttgacacataaaattaaccaccacaacttggtaaccaatatgttctttttctcaatgaacattttacctataaacacttcacatgggtttgtgtccatggcatctatagaaaattcggaagacctgtgctatgtaagtgaaaggaaaagcaaacagttgcccagaggcaacatccattttatagaagttctccttctgtgtgtacaggtttcctgatatcaaatcttatcctccctttataatccatgataatttactcacaaatccaacagcttgcgttctagggtattttcattttattatgacttctgaatactccacagtaattttacttcttaaaacaatgaaaataaaatttccctgtaccttgaaaattagctggaaaaaaaaactataattctttacattagggtcaaataaatgttaaattcttggagcacccccaacatccagtatctcatcagacaccatttgtccctctatgaataaaataaatttgtgtgtgtgtatgtgttctttcctttgtttcttcatgtggtaaccccaaattaaaatgatggataaatatatgctggacactgacttcatggtgtctttaggtgagagcctcaagcatttcctttaaaatatttcattaaattaagctcaacttctaccacctgatctgaacattcatctaaataactgttacctaatcgaaaagttcaccaactctgacagagttgatattattggtaatcaaagtaataaattgcaattctcatctgaagcatcaaggctttttattaagaatttgtggaatacttcagatttgctgagtgctttgcattcctggttagttattccttgcttgtgccttctgaaataagcaggcatttttggaatatgaattagtcttcttaacccttcaagctgctcatgcagagtaagttcagattcataataagatctttcaagttaagaatgtctaacgccatttttgtgatacagctagcaaagcagtgaaattttagcaacatttagctaagttctttgcattgataattttaaaagtcattggagaaagataagagaaacaatcttttatttctagtaaaatttaagagtacatttgctaatatacctagtggctatttagccagcattcactccttattccactaatagaagctaaatatttttattataattttcaaaaatggaaaactggagcaagaaagacttggcaattgtgttcttttcccattgtgaaatgacatattcatttaggagtaaggactcatgacttttttgctgctttaatccatataacttcccaatggaagttttttgttaaaaaaaactgaaggtgctttgatgacgagaatagatgactctgatttttttccatgtatgtagggtattaactatcagagtcaggaaaaggcattaattagtccaccctatatctagttgtttaacaggtagaaaagcattgaagaactagagatatttcagtggttaccttctactatgttttccatttctctcatccctgtcctccaaacatggtttttagttctacaggaagttaaatgttactatttaagattcattcctatcttgcatatctcatagtacaagaactaatgaaaaattaaaagagctgaagttaaaggaaaaatgtaaaggcagagtgatgtagccacaaacttcttcacaagtatattaggaccataatttcaaggttggttgtatttaagagactctgacctccataattcctataactaaactggaagcaagtgttaaccaaacatctgtaatctcaaaatagtcattgtgtaaatcttggaaacttactgagagatttaccttttgcagctatggaactcaagactattttcatgaaaattagtgtgtaatatagaaataatccgaaaatctaaaagtcagaaataccctttgttagttctgccttatacgatgctttattattccagtactttcttggaagaaaacagagacaatcctaaattggctgaagggctaaagaggacttgcctacaacactgaaacctcaataaacaatgttatgttaacattgttaaaattaacaatgttaattaagcctttctagaatccttcctgttggtgtctcttaatatatggaacacgatcttgcaaaaaagttgattttaactgaattctatttcccagtcaatactcagctaaaagcaaatatatgttctcagaagagggactcctcactgaataaattgaaaagatagtgctggaggaccacttaaagcacattttaagtgacttttctcatttatcactgcatgagaacctaccgtttttctctttttttggttattttttactgaaatcctcaacaatttaatgaggtacatacaattaaccccattttgtagtatctaagtctcagtgggagtaacctgctcaagatatcataagtagtatcttgttccaaattccatatagtattttcaaatctattttgctgccttaccaggccttttttggaattaaaattttagctctgactttgattggctactggcatttaattggtactatggaggaaagggtatgatcttaagggcaggctgacacagcctctctctccacttgtatgagaagtcagactaattcaaacgttgacttctctcttttctctacccatgacctagcaggctgccagaaggaagaaaagaaaatacctcactatcttatcaaaccataaataatagaggggacttgatgggaaataaaacaatgtggaaatgccagagtctccatctagtcaatcacagggtcaccggccactcagagggcagcaccatccatggccctctcctcttctgctgcatgtgacctgaaagtttccacaaggaagaaagggcttgcatcaaaatataatgtgttcatatttcaaaatcccctctctatatattcgtttcatttttttaaaaaagatcacacttgttttaaatatattttccaaaggctaaggaacaaaaaagtcccattctctggcatgagccaggctgtatgtgtcccatcatctaccctaaagaaacattttgagctgtgatgctgagtgcatgcaggtggcttcctgttttcatgcacattcagtacagttgtgttttttctgatccctcagccttttacctaatggttgtcgtattcactattgacctagatggaaaagccattttctgttttcactgaggacacacgcattccctatttctttgtagagtcttagaaattctaaagacataaaattttcatgaggaatttctttgtagagtcttagaaattctaaggttataaaattgtaagttgtagtaataagaccaactatttattcttctctatttccttcttcaatcaagaaattgctcataactctcagtggggattagtgtcctgctgtcctcctctagtttttcattaaacttggcccaaggggagactccttctactgagctgtgaccaaagaaggggaaaaaataaccatactcctgggcatgaccctaactacctgcacaggtatcaatggccggtttgctggaagtggtaactctacactgccaagatgccagtcctaaataccaacagctgtggtaccttctgtggtgtgaggcagggatgctcacggaaaacactcctctaactagcaagaaataaggatgcctcacacccgctctaagagaattttcaatttgttatacaaactgaaagcctgcttggaaaacctaaaatctcatgtactcctttatgtgtgaaatattttaagtgagtattgctttggttttctaaatataaaattctattatagtattttattggacttttccaaatgataccagccagattgtgatttactggctgcacctaccactgtcatccccttcacttgtcctgcctcctctatcctctcactatgctattgttcagttaaaggcatacttacgggatacccccaaagcagtcccctaccccttttgagatttcaaaacaagtgtagaatattgggaaaatctcaccaaaaaaggtcttaaatcttctgaaaagttatttgaaagtaactttagccctttaaacgcactgcgcttaagggaaattacacagaatgaggagttgagacttagatttaaactctcttctgctgctcttggccatcaagctccctgactcaccttcaatttggtgagtccctgcatgtaacctgccagctgctttcacatacactatcacatttatcctcacaccagctctacgaggaaatcctgttgtttcccctatttatagatgaacaagcatgcttaagaggaggggttgtctaagatcttggagctcagaattaatacatgaggataaaaacccaggcttgcagaccccaaggccaagacccctctctgccttgcagcttagactagagggtcacctttagcacttcttcccacggtaacttactatgatcctgtaatttaaattttctctcatttaaggttattaaaaagaggcaccgatgaggaaaatttaaaataaataaccatcataatttatattttataaattgtaaaataaatgtatatatattatatatacatgtatacttatataatatatacatatattacatatatacatgtatacatgtgtacgtataacatatatatacatatttatatatacatatacacatatataatatatacatatattatatatatacacatatatgtaatatatatgctattataacaaaataccataaacggggtggctttaaaaaaaaacaaaacaaatttattttccacagttctggagactgggaatttcaagatcaaggcaccagcagatctagtgtctggtaaggacccactttctagttcatagaggtgccttcttgctgtaacttcacatgatggcaggaggcaagagagctctccaaagtcccttttaggagggcactaatctcattcgtaagggctccacctttacaatttaatcatgtgatggtcatatcatctatttcagggggacacaaacattcagtatatagcagtgactactactcccttcaagataaagagcattacatcacccccagaaagttcccttagacttcttttttgtccagccccatcatccctgtctccttaggaaaccactggctaattgttatgaccagagattgtttgcctaatcttgaacttcatacaaatagaattatagaaaaggtactcttttataatgggcttcttccccttaacatgtttttgagatttattcatgttgttacacctatgagtggcttctttttttatattgctgatagtgtttaatcattagaatatgccatatctttaaaatccattctcttcttggacatttggatactttccagtttgggctactgcaaatagtatggctaaaataaacatttttatacaagtggtttttgcagacatatgtttctattctcttgggtaaaaacctaggagtggaattgcttgatcttccagcagacatttgtttatgggaaataaacaaatagtcatcctgcttacaactcccaccagtcgcatatgagagttttagttccttcccatccttgcctaaatctggtgttattctgttgaattttagccattctaggaggtgtgaattaataactagttttggttttaacttatatttccttgagatctaataattttaagctccataaatgtataggctatcttatatcttcctttgtgaagcgactattcaaatcttgtgcctatgatttttattggtatttgtctttctgtaattgatttgtaagagttcttaacatattttgcattaaaatcctttgacatatatagatatatttgaacattttttcccagtctgtagcctggttttcctgttcttaatgctgtcttttgataagcagaaattattccttttgatgaagaacagctatcaatttttcctattatgttcgtgctttttgtgtctactatatgaaatctttgcttatcccaaaatggcaaaggtattttcctatgttatctcctagaaacttctaaactttgacattgaagggtatgatctatctaaaattttgtgtctagtgtgagataaaggtgggattttgtttggtttttgggtttgctgtatctatttatcaagccattccagcacttgttaaaaggacttcctttcagccgtaacacatttgtcaaaacttaatttaccataatagtatgagactttcaactgtgataatcttctggttgtttcagaggtcttatttctttgcatgttcatataaattttagcaacttgctaatttctgtgccacaaaaagttttgtggaattagcgttgcttttaatgtacaaatgaatttgggtagatttgacaacttactaatatttggtcttcaaatccatgatcatatatctcctcatttacttggctcttttcaatttttttctgagtaatatttcaaattttaaatgtagacatttgatatgtccttaaaagtttattcctgtatgtttatacattttgcagctattataaatacaattaattttgtaatgtttccaattgttcctagtagtatgtgaaagtgtgattaatttttcatgttgaaatgtatactgacatcttactaaattaccttgttagtagttatattcgttgttttgtggattcctatgtaaacaatgattgcatctgcaaatggagataattttactccttcccttctactctatatgccatatatttcttttgcttgcttttttggcactcataggcacctccaatacacggctgaatagaaatgttcagaatggacacctttgcgtgtttccagtcttagaggggaaattgctcaatagttaccattatgtacgatgttagctgtatgtccctacccagagttagtcaaactgcagagttaagggtataatcctccagattacctagtctgcccaagaattctgactccacctgcaaggagttagggtccgaccacaaagtaagagggaagagtacactcaagatcacccttacttctgacaccaaatgcaagttttggtgtttcccaaaagaatcctcaggtttgataattcactggaaagattcacagaacttactaaaatttttatattcctgattatatttattacaagaaaatgttacattaaaaatcagccaagggaaaaacaaatagggcagagtctaagaggattccaaatgcgaagtttccattgtcctcaggaatacattattctaccagcatcgatgtgtaacaaaagcatggagtatggccaacctgaaaggctcacccaaactttagtgtctacagttttcactaggcattatgacataggcatgattaattggttgaacttaacctccagcctgtctcctcctcaggtcaggctgatatcacatagctcaaagttccctccctaaactatgattggtctttctagtgtcattataccccaccctaagactgactagtgtagaaggccctgccctgagacatctcattagcataagctatcaggtgtaatttaagggagcagcatagataagaaaacctgtgtaactcataaaattccaactgtttagatgttgcctcccagaaactgaaaacaaaggtcagatatctctttggatgaagcaaattctttactacaaagtatcctttatcaggttgaataacttttttactattcctagattaccagtagtttttatcacaaattgttggattttctcaaatgttcttctatatctattaaaataatcatattgtttactctgttaatatagtaaattacattcattgattgttgaatggtaagccagtcttgcattcttgaaatacatcttagtctattatgatgtatcataatttttatatattgatggatactatttactgacattttattaacaattcttttgtctatgttcatgaggaatattggtctgtaattttgttttcttataacattcccatcaagttttggtactagaataatgtggatcttataaaatggatcaataaaagggccccatcctcttctttttccaagtttgttaattcgttaaatatttgatagaattcaataatgaaactaactggaccttgagttttctttatgagaacttgcttcaaaacaaaatgtaaatttttaaattaattaattcattttttttctgtttaagacagagtttcactcttgttgcccaggctggagcgcaatgtcacgatctcagctcactgcaacctccgcctcccaggttcaaatgattttcctgcctcagcctcctgagtagctgggattacaggcatgcgccaccacgcctggctaatttttgtatttttagtagagacggggtttctccatgttggtcaggcttgtctcaaacttccaacctcaggtgatccgccctccttggcctcctaaagtgctgggattacaggcatgagtcacagcacccagccaaatttcaatttatagatacagggttgattctttttgaataaattttggcaggttgctcaataatttatccatttcatttaaattattgacatttttgcaaaaaaaaaaaaaagccggtagaattttttatcccttttatgcctatgggttctatagtgataacccttttttgttatctgatattgctaatttattttttcttttatctttcttagtctttatagggtgttatcaattttcaaaatgacctcaaataactttttgctttttttatctctattgcttattttttatgattttgctcttatcattactacttttttctttacatttccactttttctcctttctctgatttcttgaaataaaaattttgattcttagtattagactttcttcttttataagacaagcattgaaattataaattcctctcagcactgttacctgtgttccacaaatatcggtatgttgtgttttcttattcattcagtgaatgtttccctgtggtttcttccttgaagtcaagtgactagacctgtatgaaattccaagcatttctttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggactacaggcgtgagccaccgcgcccggcccatttcttatttaattcttttttgtcaacacaacctactacataatcttttagtctttgaagtacattgagatttattttttggcctagcatgcagtttttccttgtgaatactccacggacatttgaaaaaaaaaaacttgttgggggcttatgggtgtagtgttgtataattgtcatttaggattaggttaaggtgaatcatagtttgtttaaatattcttacccttacttacttcttttaaattatacaaaatcacttcacatgtaatgtaagaaggtaacaagcatacacttctatttccctttcaggtattttgtgccattgttgttatttatcttctaagtactaagcctcacaacacactgtcattattttatgctctgcagtctattatctgttttaaaaattaaaaattatgagaaaactttcttttgtatctacttatttactccttccagcactcttcttatttttagtggatctgaacctttgtctatcactttcattctgaaaaacctcctttgacattactgggagtgcatgtctaccgccagtaaattctgagttttcatttttatgataatgttcttatttcatttttaattttgtttgctaatttcatgggtacagatttctaggttgatacttcttagaatattgagtaccttaaagatgtgccattgctttctggcttgtattgtttttaatgaggagtagttggactttggccaggtgtggtaatgcaaacctgtagtcctagctacacaaggagatcagccaggtgggtggctcacacttgtaatcccaccacttcgggaggccgaggcaggcagattgcttgatgccaggagtttgaaatcagcctggccaacgtggcaaaaccctgtccctactaaaaatacaaaaattagccaggcatagtgccacacgcttgtgatcccagctatgcaggaggctgagaacctgggagacagaggttgcagtgagccaagattacaccactgcactccagcccgggcaacagagcaagactctgtctggaaagaaaaaaaaacagaggctaaggtgggatgatcgcttgagtccaggagtccaaggctgcaatgagctataattgtaccactgaactccagcctgggcaacagagcaagaccccatctctggagaaaaaagaagtaattggatattatttttcactgcttttgaaaatttggaaaaaatttcagcaatttttttacatatatgtttaccctcctttcttcataagactcctggtatacatatattagactgcttgaaattgtcccacagatcctgtctcaatttttattgcctttactgttttgaaaagattcatgttgcataatttctatgtctataacttaattgtcactgattttatttcagttgcaatatctgatcttccagtaaccccatacatgaaattatcatttctgatctgtgtttctcagtcctaaatattcaactttattttcagtcttctctttctattattattatactaatgttttcctctaaattcttataaacttctgtaattcctattttacaatccttgcctactaatttaattatttgtagggttttattaattcattttttctcccaattataggtcacattgctctatttctttgcatgtttagtaatttttgtttggatgttggaaatttggatgttatattgttttgaattttgtttgacaggtagccaagttacttatggatcagcttaactttttttggagcttggttttaaactagattatgatggatgtatccaaattagtacttgaagaaggaatcaaaggaatgcttatgtaaatttctcatgcgcttttctttgcataactctacctctttcctgcaattttcatcatctccttccagccaagtatgatttctgccttctcaactcagtgaaaactcttttctgcttgggtccttatttttggcaccaccagaaaatacttccaggcacaaagcctggattgtcatcaagtgcaactagtggcttttcccttagaaatcacacagatcagagtactttgctacctgttgtccaatgacagaaaatacttgttcttttattctttttcttaaaaatacatgtttatggcaagagagctagcccagtgaagcaactggaacatatgtggattttggtattcaagagaggtcctggaaccagtccactgctgataccaagggacaactgtactatttacttcatcaggatcatacatattaaatgttggtacaattgtcttaccaattattgagaaagtgatatcgaatcattcaataaagattgtacatttatttatttctcccttcagttctgtcagtttttactttatacttttattaggtgcatatacttacaattgttataacttccttatatatgaaacctttgtaattacaaaatatctctcattatctctgataattatcaattatatgtaagaccacctccctatctgttttctaggaatcttctgtccttccatcctgccttcttttgaattacttaattaagttttagtattacattttaatacctctactggccttttaactatacctctttgtgttcgtttactgtggttgctataaggattacaataagaactcaaaacaatctactcatgttaaaaatctaagatttttgaagcataatcccatttaacttcctctatctttgttgctattattgtcacatctgttttatctgcatatattataaagatcaactgtgttttacatatatatgcatataaagcatatatattaaactgttagttgtcttttaaaatattttacatatctacaatctgtatttttttattctttcttacgtatctgaattcccatctggtgttacttcccttcgaagaacttcctttaatgcttcctttaggaaaggtctgctggtgatacttttttctactttcttttcatttaatttaatatgtctttcttttgcctttaagtgaaggatcttttcactgatataaaattttgggtttaaaacttttcctttcagcattttaaagatgtttaattatctctggtgtgcactttttttctgatgagacatcacctgttatttatgttattgttctcctgaacaaattttctgtggcactttcaaacatttctttttatatttgcttttggttagtatgtctatgattaacttgagtgtgtttttccttttgcatttcctccttccggacttctgagcattttggatcttcaagttaatgggcttcatcaaacctgggaaattttctcattgtttctttaaatatagttttgcctcattctctttctcttctgtttgacttcaaatacatgtatgtcagcatatgttagcctgctcactatcatctcacaggccactgaagatctgctcactttttttttttccactgccctggactccaccatctcctcacttttttactgttttctttctctctgttttccagaatctgtgacttacaattttgttcctaggttcactaatgctttcttgtgccacctctaatctgatgttaagagcatttagtgaattgttcaatatcaatattctagttttcagtcatagaattatttttgttcacattttttgctgctgatatttccatctgctctctcattgttaccaaattttcctttaagccattaagtgagtattatataattgacttaaaattcttgcctgctgattccaaaatctgtaaatctgcatcacctaaggacattccctggactttgtgttacatttttctattcagtgtatgtattgtaacttttttactatataatggattttgtgggtgatatgttttagattataatttctgttatatttttctaaaggatatgagttgcttttcctagcagacaattagattactggctaattactctactgtcaccttgcgcttgtgatggttaattttacggtttgtattccatgtctgtcttaggatgaatgtctagttcttttattttattttttttattattttattttattttatttttttttttttttgagatggagtcttgctctgtcacctaggctggagtgcaatggtacaatatctcggctcactgcaacctctgcctcctgggttcaagcgattctcctgcttcagcctcccaagtagctgggattacaggcacacgctaccatgcccagctaatttttgtatttttagtagggacaaaaattttagacaaaaaacttttagtaggggttttaccatgttggccaggctggtctcgaactcctgacctcaagtgatccacccacctttgcctcccaaagtgttgggattacaggtgtgagccactgagcccagcctgtgtctagttctgacacatagtctttcttgttttttctggggtttcagtaccaagactgatgtgtttgctaagcacttctggcttggtgaagttcaactccaaactgtgtgggtagtacctaaaaatctatcaggcttctaagccttctggtattgctttccactaagctctttgaaatttctcccacatatgctattcagggggtcatccaaggagcttatcatagtgtatacgcaaatttggaattcttgccaccctgtggctgtctcctttctaagatttttcttccttgatttccagcttttggtctacttagaccatgcctcccaagctgagaagtgccctcagaggaaaagccatgtaaaattttctttcaatttctactttatttttgtcactctcaaatacattcacatacttcattctgtacttttctgagggtttataattgttataaatataagagttaacaaagtacacttggtgttttgtttttttttcagtgttactcaaaacagaactccttgtagtccatgctttattttaaggttgtgaaatcatttgcacactcaatgagaatatggctttattcttaccatacaggtcaaggcagattaaaaaacttaaaattgcaatttatattatagtagtcactgtcctgatgtattacattgttgttttttttttaattttattttttaggatttaccaactgaatgttgacttctttatgtatcactctctagttgctccaaacaagttatgattcttactttagatgaaaggagtggcagttaatgaagtgagtttaaaagaaaacagacaaaaagagaaagcaaaaggagaagtagaaagaaaaagaaaggaggaatggaatggagaaaaaaattagaggactgagagaagacaaggggaagaaaaaagagaggagagaagagattttggggattatgtggcttttttaaattgccacaatatcttactgatttatagaaattatagttattaggatatatagttagtagctattagaataatcaaagacctgtttatgaatataattttgtgcagaactatctggaaaggttggattaagaatcactcaagttctgtcatttcaatgtagtattttgtcaacttgcttataaaaaaaagcagctgggtatgtatggacttcatattggtgaacactaatatattaaggaacagtggaaggaaatagacataaaggatcatgtcagttcaacttagtagaataatgatcttttggatgcctaccatgttctagtcactgtattatgtgctatggataaaatataaataaaacatggctattattctcaaagagtttgtggtcaagtcaaggaaactaaagagatgtctcacatctcagtgtttccttggggcagatggatggagaaatgagctaagagcttgaagggaaaagctggatttctttgcattttttgagctaaagaaagggatactttctaggatgtcaattagaagcctgaaagaaccatgccttaggaataggagcaagccaaaggtagaccaaattttactaaaattgcagtggggctccaacaaaagtcaataacctgatagaattgtgtaatcagccccttagcctaacaaaggaaagggggagccatagctgatagaaaataacattctgtagggtctctacagttcttttgttcatagggtcagcaaaatttaaaaggacaagatattcaaagagtcaagaaaatacaatcaataatctagagaaaaagtaggtaagataagcaaacaataactgaattatttgaatattgtagttaatagataaggcaatgaaaataactataaatatataagaaaatgtgtaagaaaagatactcaaaagagataaaaggagtagagaattcaaatgcaataattgaaaagagaaaaagaattatatctttcagttccaaaatgtcaatttgattttaaaggatcaaattgacatttgggaactgaaagacataatattaaacactgtgttttcagtggatgaatttaacacagatgggccacagcagagcacaggaaaaggaaattggaatacacatcgatagaagacacacagactgaagcacagagaggaaaaagaacagccaagaccaacaagagcataagaaacatgtggacacacacatgtctaagctatgtatagaattgaaattccagaagaatgaaagagcaagaatagcaatcaccggtaaaataaataaatacattgtggtttattcaccctatgacatcctatagaccaatgagaatgaacaatctataatcatatgcaccattatacatgaatgtcacaaacttaaggttgagtttaaataaaaggcaaacacaaatgaataaatctgagatgattccatttatgtacaaattacaatagcaggtaaaactattatgtgagaattcaggttgtagtagcctttgggcaggaagtagactgcaaggtcatataatggtctgcaattgtctcttattctggatgctgggaggaaaggaaggaagggagggagggaaggtggaaggggtgcactcttggacatacagctaccatttgttctgctttctcctagttagccacaaacccttaattgtgtaattaagaaaatctgatttaatgtcttaaagaataagagcctaggcatgggtaatcaaagtagccgctaaggcattggttttcaaactgtggcaggcagtggaatcacctgaggagttgtttagcagagatcgcaggtcccatccccacagtttctgtttctgtttctgtagttctggtatagggcccgagaatttgcatttcttgcaagttcacaggggatgctgatactgctggtctggggaccataatttgagaaccagccacgttaaagttgctatagcttctgttgtcgatgttctatcataaacttggtctcaataatctggttgttgttgtattcagtaaaacagaatattcataaagatagacatagggtgttagctcaactgggatacatgatagggaacaccagaagggaacgcgccttcatgaaatgtccttaagaaaatttttttggagaaaattcgcttagaacaaaaatttacactatcaaatgagttacttcccagaaagtggagagaaaaataacctagctaaaaacatgatgcacaaagtgttgtatagtctgttttcaaaataattgatttttttttctcttagcatacatttactggaaccccatcaccaagctaatttcagtacaatgtgctccattatcagtcaaggctcacagatatggaaatttttgcctagcggtttgctgtaaaacatttgcttttcaaagacacattaattcaaatcttaaaattaaatataaaagttgaacatgtatgtgtcaatatgatgaagtttatttaattctcttacaggactgcatcaaaacatgtaaacaaggacctcggtaatatggaagaaaacaaaaagttagaagaaaacaatcacaaaactgaagcctaagagagaaactgtcctagttgtccaggtgagtagtctgtacgaggttcatagaaataattccctagcaagtaggaaacatccttaaagatgaagtcctttatgttaagatgctccataattacagctttcaaaacaggaagagaggggttttttttctttttattatgctttaagttctcagatacatgtgcagaacgtgaaggtatgttacgctggtataaacgtgccatggtagtttgcacgcatcaacccatcatctacattaggtatttctcctaatgcgtccctcccctagccccccaccccctgacaggccccattgtgtggtggtcccttccctatgtccatgtgttctcactgctcaactcccacttatgagtgaaaacatgcaatgttgagttttctgttcttgcgttagtttgctgagaatgatggtttccagcttcatccatgtccttacaaaggacatgaactcgtccttttttatggctgaatagtattccatggtgtatgtgtgccacattttcttaatccagtcgatcactgatgggcctttgggttggttccaagtctttgctattgtgaacagtgctgcaataaacatacatgtggatgtgtgtttatagtagaatgatttataattctttggctatatacgcagtaatgggattgctgggtcaaatggtatttccggttctatatccttcaggaatcaccacactgccttccacaatggttgaactaatttacactcccaccaacagtgtaaaagcgttcctatttttccacattctctcaaaacaggaagagagtttttcgaaaggaaactttcgtgactcagaaagtgttttcggaagaatggaaacttaccagtttcccccactccctcctcaaaataatcattatcttctgaataataaaaaccaactatgagatgttaacattcaactatcattttatattttaatgcaaaaactttaagtgcaaagaagctttattttttgaattggtgtttgggttcagtaagaacagattctaataccttagatttgttttaaataaatgattatgaaaataattttaaaatatgaaaattttaggccaggtataggcaatggctcacgcctgtaatcccagcactttgggaggctgaggcgggtggatcactggagactagaagctccagaccagcctggccaatgtggtgaaaccctgcgtctctactaaaaatacaaaaattagccagtcctggtggcaagcaccgataatcccagctactccagtggctgaggcaggggaatcacttgaacccaagaggtgggggttgcagtgagccaagatggtgccactgcactccaatctgggtgacagaatgagattctgtctcaaaatataaaaataaaaaaataaaaaactttaatctagatatttaataaaagcgtgagtgtatttatacagccaatatcccaaatcattttaatgaaaagcataacaaacttgtgcacgtgtgtatacatatacgcatatgcttttataggtagtatatgtatgtgtatgtgtatatatgtatccatgtatctatatgcacatatgtagaggcatatgactgttatatttaacatataaaatagctgtgtgtgatttttaagacaatctcaaaagaggtatgtttccatggcattgccacctgcaatttgaggtttttctttttatttgtgttcccttaaaccaagcaaatagaagagccatttggactattaatgtgtcctttagaataactgttactatagcttaccgatatgatatgacaagccccaaccgccacagtaaacctcgggttcattataaataaaccacaagtcacaatttgagtgggtcatccaagttaatcccatagtaaggatggagcgtgagaaaatactgaatttaaaaggatgcacacaggggagaacaatagaataattgaaacaagacttggtttttaaaatctgaaagccaggattttaaactgatggggtgaaaggaatcagaactggattgcttctctatctcacctttcattggaggtcaagtatgcagcattcccacatgactttttttgtttgttttttccacttctctagggttcttttccccagtcctttgtaaacatagattttaactactgttttcttcaaaatcgtataacttctcaatgaaaaactgtacttgaagacaaatcccacgaaatagtgtgatttgaagaaatgagtgtacttttaacctaaagagaaatgcaatgaaatattttcttgaaaaaaaacttgtaatattagtattaattttacaaaaaaagaaaactctgaataattccaaaaactatttgtagaatggatgaagcaatgcctgagattatagatgggcttggggacaatggagttttataaaaggccctcctgtaaagtaatttactaaattacttttagtacaaagtatctgttgatgttaaaaaattattgctttggaagcttatctaaattatttttttttcatttcagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttca

SEQ ID NO: 678 - DNA, 7945 bp, Homo sapiens
cgcgctgaagtggcatctctctcccgccccgcttccccctgggtccttatcctccgagacctttacctcatcctcgacctttaccctcatccatttccccctcctaatccttgctcctgtgtcccccgtaactgaatatctccactcctggcgccccccacgtttcttccctcccgccgcaaacctcgcgacctccagcagcccgcccccgcgggcccgatcctgcctggcggctcccgccgcagcctcctcagccttcccgctctgccggggttcgccccactacgcccccggtcgtcagccctcgggcttccctgctcccccctcccgtcccctcggagccccctcccccgcctcggccagccagcatgcaggtgtctatcgcgtgtaccgagcagaaccttcgcagccggagcagtgaggaccgtctgtgtggaccccggccgggccccgggggcggtaatggtgggccggccggcggggggcacgggaatcctccggggggtggagggtctggccccaaggcccgagctgcactggttccccgacccccagcgcccgctggggccctccgagagagcaccggccgaggcactggcatgaaatacaggtatgggggtggccgggcagcccaccccttccgctttcctttcgggacccctgagactgcttgagatggccgccaagaccccttcaaacttcactaagtaggtctcccttctttccatctcttctttctgtctctggcactccctcactttgtccctctcttggtttctgtcgatacccctgactacgagaatcaagtttaccaaggttgactgggtcctgtcagacccaggggatgcccctgagcttccctccttacccctgggaaggtcagggatgcatggatctccacgctacacggatctccaggctatgcctcctccagtggagtgtccttgggtccgtgtcctggggagtggagggagggaatcagcttctcactctggcctgctcggggtgcctgacccagatactgcccctgcctgccccaaaggctaggtcttctgcgacctttcttgggtgcaaggggagtggggccggtgggaaggatggaccacatttttcatctccatgctgagggacagggtctgggtagactgaaatgtaactgactttatctcagaggactgccagaccagaagctcagaacctgaagtagggggtagaggaggggctcctgcttgggagtgagctgaggtcactgatctgacctgctttgtcacctgaggaatctgatcccctctatatggtggccctgattggaaagctgagctgacacctgggttgggggctttgggaggatgagggggctcactggttcagagacagtcttcacaagtcaataggaacagagggagtggagagggagaactaggcttttctgtcttactctcccccctccccccaggtcctcaatctgcctttcctccaggcccatctgcctagcctagccagggacccctgtctgtctgaatgcctgaacttgacttggtttacctcttccaacctgccatctaccatttggcacagcactctgcctgagggcctggtctcacaaactcaccacaatcaaacaaaattcctcccagcccctcactgcacacaacccacagatgactcaaacacagacaagaccccagaagaaggacaaaccagactgcacgtcttcaatgtgataagagggaatggagactctggacagtggctccagaggaacagtcacatatggttcacttgtccttttgagaaaattcctaggacctctgctctggagatagcacttgcccaatcttataggcccactgggtctaatttctttggactgagacacctgagggcttctcagtctggaaggagaggagctgggggctgataatctaagtccataatggaggctccaccccttcccgctgcttctgtatcttgcaggaacctagggaagtctggtcttcgggtatcctgtcttggcctaggtgagtcagaatagggattaaggaaaggagggcattctttcatggtctgccccctgcagttctcatgtgcctggcttctctcttgcaggtacctgggtcacatttggttctcagatctcagatgaggtataagttatcggacctagaatcagggtggtgggggtgagggaacttgaaaaaagggaagtgaacctggataggggtttggacaacaagcacagggaatgagggatctgaggctggaggatggggagaggggagagactagagaacccagggctgagatgtgatgggttagagtacagtgagggaggtaactgaggagcagtagttgatctttacctctttcacctccctagacagcagaggatgtgctgactgtagcctatgagcatggtgtaaacctgtttgacaccgccgaagtgtacgcagcaggaaagtaaggactggggtgaaagagctaagctccatttggaaggctgagaggaccccagggattatcttctcgttttccctctaaagaaccctgggacttctgagaacgtgaagttccaaccttttggcggagggacccgaaagcactgtaggagctacagtcccaacattagtccctctctggcttagaagtcaatgggcgtactgtgcagctacattaaataaaggcaacaaatatatctgaggcattagttatgtgcaactacaaagatgaattttcaaacacatcatgccgtttcacactaggagcagggaaaacctaggatgacctaccctgcctcttccccatctagcaaacacttctgctcatcttcaagacttgacccgagtgtccgctccttcaagaactttgcccaactccccagagttggtcaccccctcccccaccatgagctcctaaagcactgtggactgccttctgacacgcaattcgtggtttatgcagctatattagctgctcaagtcagaggcctccttccatggaacttgtcttgctcttccccaagtacccacacagagcctggcacagagcaggtgctgcttctgggaagaatcaacatgtctgcgaaagtgcacacagtctaagtggttaaaggaaaaaaaaagggcaataggaaagattaaacaacggtaaaacatttcagtaacagtccaccatgacaacttaagacttgtcataagtgagctcataattttatgctaaattatgtagccaattctgtggaagctgaccagaaggctggaccatagattgtggcactcagagaacacattatggatgaggcagaatttgagctgagctttggaggacgggtgggattttgcagaggctcaaagaaggaggagggcaacccagatagttgaagccagacaaggcagtgtccttcctggctccaccatagttggcccctctcccctcatcctattctatctttttggcacccacagcagggcttggtacacagctaatgcacaacagatatttgttgaatatgtgatgaaaactatacaactacacccctagttccttccaacagacctcttattttgtccaggatggggctgtgagctgaaatggactcctggtttatatcctactttgcaagagaggaaaaggtggggaggagaggaaggaattgattggcctagaagggatcagtggctctgccttatgtttcttttagggctgaaagaaccctagggaacatcctcaagagcaaaggttggaggtgagactgttttggggggttgctggggatgtgatcacccaaaaatccttttcttactggttctcccatttctattcttccaggagatcaagctatgtcatcactaccaagattttttggggaggacagtaagtggctgccccactgcgattgtggagaaggcctacaaagaatgtgtgaaggtgtatggggtgggggtggggacagctatcctgcaccaggtccgcaccatgcctgtgaagactcgtgcaatcccatttccttatggctccaagccagccccggtcccctatctttgtcacatctcatctttgacttaccttttcctacagggcagaaaccgagcgaggtttaagccgaaagcacatcattgagggtgagagttaggggctggaaacccaaagtgaggggatatggaagccagaggagtagggaacattctctgaacttctggaggctttgaatagggatttaggtggccatggcaagggggcaaggtctgaattcttttttttttttttttttttttgagacggagtttcactcttgttgtccaggctggagtgtaatggcacgatctcggctcactgcaacctcctcctcccgggttcaagggattctcctacctcagcgtctcgagtaactgggattacaggcacacgccaccacgcctggctaattttttgtatttttagtagaaatggggtttcaccacgttagccaggctggtctcaaactcctgacctcaggtgatccgcccacctcggcctcccaaagtgctgggattacaggcatgagccaccacgcctggtggcctgcattcttagtacactgaagctgaggtgcttattttcttctccctaccccacctccaggcttgcgaggatccctggaacgcctccagctgggatacgtggacattgtctttgccaatcgctcagaccccaactgtcctatggagggtaaaagcagcacccccaaaccttacagtccttcaaaactgagcacttccttgctgggtgcggtggctcattcctgtaatcccaggacgttgggaggccaaggcaggaggatcacttggggcctggagttcgagaacagtctgggcaacatagcaagaccctgtctctacaaaaaatgttttaaaattagctggctgtggtggtgtgtgccttgtactcccagctgttcaggaggctgaggcaggaggatcattcaagcccaggagtttgaggccacagtgagctatgattgcaccactgaactacatcctgagtgacagagtgagaccctgtctcaaaaaatctaaaatacaaaaattgagcacttcctcaaaccctcagcaggaagccagcccctgctcagaaggcctccaaaactccacagtggaggctgagactccaggatgtggacaggaagagaggcaaagagtagatattaactttcatgactccatagagttgcctggggccttggtggggcaggtggaggtctgcaaatctggagtcttagattccagggctctgacagtaaggctttccctctcctgtgtacctagagattgtgcgagccatgacctatgtcatcaaccagggcctggccctatactgggggacatcccgatggggggctgcagaaatcatggtgagtgtgtgaccccaccttgcccctgtcccacaactggttcccacttttcacgtggttactccaaagcccactgcactgggggagaaggcagagaagaaaacggaagtagtgctctgaccactttcttttccccaaccccaacccaggaggcctactccatggccagacagttcaatctgattcctccagtgtgtgaacaagcggagcaccatctgtttcagagggagaaggtggagatgcagctgccagagctctaccacaagattggtttgcagccctcatccctgcctttaccttagcctcatccatggctaggtccttttcctgacacccagtgttcttcccttaggagttggatcagtcacttggtaccctctagcctgtggtctcattactagcaagtatgatgggcgagtcccagatacttgcagggcctccatcaaggtgagatctgggggctctcgatggcaggactgggctatatgggctgctttggggggagttacggggggctgctttgtgagtgtggtggtggtggtggtgatggcggggtcttctgttgattcttcttggcctccagggctaccagtggctcaaggacaaagtgcagagtgaagatggcaagaagcaacaagccaaagtcatggaccttcttcctgtcgctcaccagctgggctgcaccgtggcccagcttgctattggtgagacattgcaccctgcaggggccctgtctcctcctgacatgctcccaagcccatcctaaaactggtttgtccctagggaggacgcttgtcttcagagacacttctgaaatctatgtggtcactgttccccatcagtcctctttttttcctcctctggccccagcgtggtgtctccgcagtgagggtgtcagctctgtcttgctgggggtgtcgagtgcggagcagttgatagaacacctgggcgcgctacaggtgagccggggactcagaggcagagcctatctgtccccctccccaggagtcaaagccacgctatccaacccaggatggctctatcaggtcacccactacaaagtcctcactttgcaggtgagaggtcccagggccggaaagcgaggcaccggcacagctgcggctcttgccttgccacttgaccccactgtggtgcttccccggctactggaaccccatgccctttctcagtgacccagcatgggctgccgtcgccaccgtcccactctcctccaggtgctgagccagctgaccccgcagacagtgatggaaatagacgggctcctgggaaacaagccgcattccaagaagtagtctgtcgcgggcgcagggacccaacccggtgtcgctgcacccgcccgagccccgctcctcgcagccgcctctcccgctccggatccctccacgcagcggccggagccagactagccccgcccaccaacgagtcccggcttcgagtagtgatacgcatgaacaaagccatatccttttgcagtggggtcgagagagaaagtagcacgcccgccccctgctgcgtctttctaggcccttcttgcaaatcccgggcatgagctactcgccgtcggctctctgccacttcgtctcgctccctactctcctccccttattcccgaggcccagaaaagaaaacaaaaacaaaaacccagcacatacaagaaacatacagtgtacctcaaaaggggcccttgaaatgtcatcaaagggtaataacctagtgagtgagttgtgatgtcatctggaacataggaaatggggctcttagcgtattcggtacgaaggaagccaggctggtcctggcaggaagtaaatgataatctttgggaaaccaggaccctgcctcccagcccagaggtggaggagggcggtcagggtggggtctacagtggcacagcactgacaaaggtagagggaaatgtaatagcacatctacgctgcagtctggtgaaagtggccggggtggtccttggaaaacagttgggctgttcttggcaggaattagtgacagcctttccgtcacgggcagggacgccttgatttaaaaaaaataaataaataaaacgtctgggtatagacttttgagccttgagcagggcctcctacctggcagtggggaactgcagtcttcctcctggcaataaacctaaagcaataatgatggccccttctctgtaagacttcccaggtaactgtaaataaacctcagcttgatcctcacagtgtctaaagttgcaggggcttgggaggttagggtcacagtctcacttgtctggccctctcgccccctaacattagaaatctgctagcattagctttctctccattgctcattcaccttggtgacccaggcatcgggctcctagtcactgttctcatcaaggaccaagacaccagataccccaggccccagttttcttccttcagctaccacattccttagaacccagaaatctggcttcataattttgttcctcctctttctatgaaagacttagctatctgcctttatttgtttgtatttaaagtaatattagccata

SEQ ID NO: 679 - DNA, 68564 bp, Homo sapiens
gggagagcggcggagaagcgagtgaggagggcgagcgcgaagccgggaagaggggcgcgcgtggagggggtgccgggcgccgcgagggcctgctccgggcacctgcgaacgcgcggcgctctcaaggagcgcctggctctcgcccgccagcctccggccgcgacgcgcccagggcgcggagagggggtggggacggattgggattctgccatcgccctcaccggctgggccctggagccgctcccaggataactccacgttggggagggcgcccgccgagcctccccggcctgtgcagacggcgcgcgcggcgggagggcgcggaccagcgtccccagcccggccccgggcggaaggcgagcggagcgcggccgcgcgggcagcagacggcagacggtgcccggcgcccacggggtgagtgtgcagcttcggggctgacctgggcagcgccgccgccgccggggaatcgtggacaccgaggtcgctggcgtggccgaggcgtacgcggcgggagcggccggagcagccgcctcagggctcctggctcctgccccggcaccgcagctccgcctgacccgggtgggggccagaggagggccggccgctgccttccgccgagacgcctgcgggggagccggagacttgggagagggaggcggccgaggggcagagggacggagggctggagaatgcccagaagcggccagggagagggcgcctgggccttcgcctggagaggccagaacctcccccaaactgttgctgggtagagtggggccctggagatgtggaggagccgagaggtggcagtgaggttagggagggcgtgacacgggcggactggcaggctggaagcgctccagagcctggggactttctcctccttggagctcgcgagtctgtgcggagggacaaggtggccttgggtctgtctgaagtatctggaaccaggagctaggctcctcccgggccggctggctggggtccgaccgcagcctgggatgggacctttggggtgggggatgggccggcctggggctcagcctggggactcggtcagggggaagcggaaacggaagggtggctctgagcccaccgcaggacccaggagacaggatgggctggccagccacaggtgggccgtctgtcctgctggcaaagggtggcgcaggctctggctgcccagccggcgaggagccgcggggtgagggaactgagctccatctggggccgagcggagaagctaaagaggtgcaggagacccggaacctggggaggggccccgggggtagcactgtgctccctacccttcctcccccacccaaacgaacaggaaggaaaatgtcagctgggctttgtgctctgttcctcaggctgccgcagctcccatctgttggagccaacgcagcttctaactgggcgactggcagggttggagggggtgggctgggcacagcgctcagttgccagagatggactgacaggccctctgcttgagaactccaggacctagggtggtgaggagaacagcctccctaggtcagggcagtagaggtgactccctgccagtttggtcactgtcataggggaagatgtaggtctccccatgcacccaggccgatggcaggctccgtgcccccctttcccgccagtctaggatgggctctggcccagcgttttgtccctgaataagaaggccaggagctcctcccattgcccactgcttcttaaagatcccttcaaaaaagagcactgggcatggagggtagaggtgggctctgcactgggcactggagcccccttgcctttgggccctgtggctaccagaaaaagccacatgtgggtggcctgacccactttcctggccaggtgctgttgtggcgaaacgatggaaacagaagggcagagctagggatctgagcctcctaggccttcttccttcccctgtgctgactcaggcttctccttcttgcggagggctctctctggtcctgggatgggtcctcattatttgcaaagcatggaactaaaggcctcagtgcctgggagattgaggtctgcccagggtctggcacctaggaacacccccaaatccacaccctctccctaatgcagtctcctcccggggaaacaccgagtggcagtaagatctcagagatctgctaattccatccaggctagtacagcaggttccctctctaattcaacacagttcttcctcacttcccatcctattttccctgtgcctcccctcttcctcctccccctcatcctcctctccttccttcactcttcactttcctcctctaacactcttcacttcccttttccccctcacactgctcttcctcttctctcaccctcctcattcttccccagatatctccctttcttcccaggctctgtctccactttgccctgcttctcctgtaaactgcagcttaaaccgtaagccaggcgtgcacgcactcctgctcatcctgccagtgggagcacatgcactgttgactttgctgcatcccttttgcagaggagcctgggctggtgggcctggcagctgcatttgcctggccctggtgtcccttgaaccctgtcatttactcacctcccccttctactccccacacccttatgtcgtttatttgaaaggaaaaggaaactccatggcttttaaaaaaatgtattcattcaacaactgtttcttgagtgcctactgtgtgcctctcatgattttagaagctgaagatacagcggtaaacaaacctccatgtctcaagctgaccacacttgtatctggacttgccagctgattagctctgttcccaccaggctcgttcaaagacccacagcttgagggggcagaggtgaggaacatgaacaatgctagtgaattatcacactgagtgacctctaacatgccaggtaccgcttaagtcatcctgtccttaggatacttttctgacctgaaaggatggaccaggtcacatctcaccatttatctggcagcccagggcaagtagaaggctggtgcttcagacagagaagggggaaggaatcaaatttattattgaatacctattatgcaccagtctatgtgaggaacattacaaaagttattctgttcagtcgtgctgacaaccttctaatgtctgcattaccatcccctgtttcctagccaaggaaattgaggcctggagaggagaaaccacttgctccgggtcatatagatctccattttgaaatcacttgtatctgcagttgatttggccctatgatatctgtgacatctggtaacttgtacacttatactaaggcttacattctaacctaacttttcatggggccttatctcccagttagactattaatatgtataaggatttgctgaacggttgtgtgaataagctttcttaagtgatcaaggaaggcttcctgaaggaactgggaccctgaatgaggaggcagggagggcaatgacttttcctgtgtcatcctacacaggtatgtgacaacttgtaggcaggaagtccctcatcccacaccccacctgcattcaggtagaattgactcagggtcaggatatagaagcttgatctatggcccatctaatgaataaatgtcacttgtgttcttaatctatatggcttggactctttataaaagctccaagataaaggatggggactagaagctttcaagcctacaaggactccagggaaggacaaggaccatagttggaggcttgaatggggcaggaatggggagagtgaccaaggaacagaagagaaggaagacaaaggcagaagataaactgagaaacaaaaaacacttttgacaaaaatgaagtagctaaaaaagacaacaaaacaaaaccgaagacaagagatatgcaaaaaagacagcagcatgtgattagattgctgaaaggacgagtcagaaagatgcctttatctgttactttccagtgcggggcctgggtctccgtggcctacagctcagaggctgaaatttcaccaagttagcctcaatcaggcatttgcttattcagtcaacccatcttttctaagtacctactgtgtgcctggctctgtgctaggtgcaggggacaaagagacagatcagatgtccctgccttcaaggagttcaccgtcagagtagagattctagagccacacagctggagttcaaatccaggcttcaccacttctagctgggtgacattgagcaggtcacgtaacctctcttcgtctcagtttcctcatctataaatgggataataaaagtacctacttcataaagctgtcatgaggactacatgaggtgatacatgtaatgagcttagaacagtatctggtatatatatagtaagtgctatgtaagtaatattattattgttattattattagatgggggagtcagtcccatagacaataatgaaacaagtgttggactatagggataagcagataaaaaggcgactctcagccaggcttggtggttcacacctgtaatcctagggaggccaaggcgggtggatcacatgaggtcaggagttcaagaccagcctggccaaaatggtgaaaccccatctctgctaaaaatacaaagattagccgggcgtggtggcacacacctgtaatcccagctacttgggaggctgaggcgggagaatcacttgaacccaggtggcggagattgtagtgagctgagattacaccactgcactctagcctgagcaacagagcaagactctgtctttaaaaaaaaaaaaaaagtgactctctgtttgctgtttgcggattaggaaagggttgccaaatgatgtgatatttgaaccaaggcttgaaaaagagtcaaccaggcagagatggtgggtctggggacacaggtgatgagggtatttggggcacaggtatcgtgcatgaaaagataccagggtgtgtatgtgttcattgctctttgtgaatgtcaccatcaccgctgacacgtccctctcagcctctttttctccagagctgggagctgggcttccagtggggctggctggtcgcccagaacattcccacatgtcttggtgcaggggacctggtgcatccctgctgggggttagcctcatgaccttgggctcctgcacgttctaagcccgcatcaagcagactctgctccaaacccagagctgctaggccttgcactctgccttctggcacttcttagggacctgggagacgccttggcctgagggggctgccttttaggaggtgagtttaaccaggtttggtttggaattcgtttttttctgtgtgtttcttgcacccacaccttccctgctactcagcatttgatggacctgaagcgagttccaagataaagtgcagacagagggttcctggggcaataactgtttctcagcttctacctctcacgtggtaacaacactaattatgatacccagcatttattgagcatttactgtgtgccaggcactgtgccaactgctttacctgcattatcccattaagctttcaaaagtacccctattagataggtagttaactctcattatccctaacctaaaaagccaagaaacagactcagacttgctcaaggacatatagctaggaaagatccaagggagggagttagcccttctctctgactttaggactcctcctgcttcttcaccaccccggaatctggtgttccttgggcctggagggtgctctgggacatccagcccattctcctccttccctccctccaggaagaaagtcccctaagccagccctgcccaagccagtggctgcctgtctccttttcgggatcttcagagagggtctctgtgaccttttttttcctcctgctcctgcagggtgtgatatttaagatccaacattgtttccttctgtctcagctaagtgcctcggggccacatggagccactatcctcagagaagctggaccttaagagtcagtgcccatggacacatggtgggaaccaatgcaagggtggcttgctgggagacgtgagaatggggcctagactccagataaggtggagagagatggggaaggcttgggatttgtgctgtcagtgggatagctctaacaaggcagactcgtgtatttcaggaagaacaggtacaattgttcctatttacaaacatctcacaaggcagcttcttcagggaaaaacatatggaagaagggggcagggcagtgattattagcaaccagcctgggttccccaggaagaatgggtctgtcctatctgatcttttcagggggaaggaaaaaggaggaagagaaaagaaaggcagcaaaggttactttgctctctaaaatgttctcaaaataagcattcaaacgtggtcgatgaaagtatctgtctttggcttgggagggcagaggtggtgatgcccagaagggggaatgaccacagagggccagctggtgggaagtgagacatttaaaagctgtgtaggaggaaagagagaatttgacacttcaccctgcctggctgtcaccactcctcttcccctgccttctgctggggctcagacagcttcaggcctcgagcctgagaaagtgcctgcccagaattgggcccaggggttgaatggtggaatctacattgcgaggggacctgcagaatcatcctgtccactgcccatctcgagcgccaccaggcctcagccatctcagacatgggatggggctggagtctcttcgttcagcaagtatttgtgaggcatgtagccaggcactgagggcagacagcagtgaatgaccagacagacctctgcccttcaggagcttttagtttattgtctggggatgcagtaaaatagactcataaaggaaatggcacattggaggctggtaagtgctaaagagaaaaaacagggaagggaaatggaagagtcagttgggagagggggagtttgttatcttgtgcagggtggctacagagacctcactgagaaggtgatatctgaggagagatgagggggtggcaccacagtcggggcaagctgggcagaggggacagcaggtgcaagggcagggatgcagggctgtgcctggagagtcagaggcggcgtggaggctggcgtggctggagtgtggtgagggcagagagttgcaggagataaagtcagagggtcaggaggaggttagctctaggagaggtctggagctggtgaggagggggattttttcctcagagtaagatgggctcttgcagggttggagcctggggcggcatgatttgactttttaacaccactggtcgttggccatccattccagcttttccctcagcggctagtcaggaagtgctgcctggttgccctctgcagccattggagctgtttcagccaatcagtacatccccaccaaggatgctctgagcactgtcctaggcagtgtggggtgtgaggttgggaaggaaataaaaaagcacaggacacagtctttactggtaaggaaacctactgatcagctggggaggcagaacttacactcacaagaaataatgagggaataataccagacagtatttaaaaccgagtgctaaactgtgtgatttagactataaatgttatcagaactgtgagctctgtgtgggagttatatagggaacgcttcctcaggggggcgcggctgatttaggcttggaaaatggagtagattcgactctgcagtgggaaggattctcgcacggagaacttggagctggcagggtgagaggagagaagggtggtgctgctggaggggaggtcactgagtgggagtaaggcagcccacgtggcaacgtgcaagggcagggtcttctgtctctgagcagtccctgcctcccacctgggtttccaatgccccctgtactctttccagagacacggaaagccaccctttccagaaggaaatccattatccagtgtccttgccctctcctgcccgagaccagatgatctctgatcttggaagtcctctggcttcatggagtcccatttccagctccggccgttgtcccaggtctgcatgctgggaatctcggcctcttagttcactggtgtctggagccatgttctctggaattcccttaggctccatgtatctacccaggctgcagcagcttctcttctcccttcctttcactgcctgggtgggctcctgtttggtaggttactcctataacattcctggtcgtttcagatattgtgaactggaaataaaattgcaccaaaatgagcaaacttccacccccatgaggggtgagtgtgtcctctccctggatcttggggatatgaactcacctctgaagtatagagagagatcaccagagtggagtagactaggatccattggtagtgccctcacccacccaagacatggggggcgatgctctcctccctgcccccagcccccatgagaaaggggggcacacccgctgtaccccagcacaaccccctggaagacgcagaggctgaccctggggcttttgtccttatggcttacaatccagaggaagtggaatcagttggcattgggtcagaattcacagtccctagccacctgcccttgggcatcttaacctttccgagcctcagtttcctcatctgtaaatctgagttaataacatccacttcctagggttgttaataataataagagctaacgttattgagtgcttatgaggtgccagaagcttcactgcatttgtctcatttcgtccacataacgctgtgaagtagatattattttcccccattttgcagttgaggaaactaaagcctggaggccatgcacagccagcaagtggcagagccagaattcagcccccaaatctttctgactccagagccctgattctcaactaccacattaaatgagctaatctgtgtaaagtacctgctacaaagtagaagctcaataaatgttagttccttttctcaatttccccagggccactcctctagagaatagggttctcctacctcatcacatttcttttccgggatcccctgggacatatgatagaagtgggaatgggaatgagctgccagtttataccgagggaagaaaataaggctaagagaggtgagtaatttgcataaaatcataaaacaccggggctgtgattaatgcccagggcaccttgctcatagaagttattgagccccactgggtcccaagcagttggcagagggtgtcttgcagagatgagaacagaggttatgctgtatggaagaatgagaggccatcatctcccccagggtcaagaaagagcctgtctcacctgcagaggcgagagttgatcattatgggcctggaaagttgctagcagaagcagtacaaagctcagaaaggtctaagatcctatgttttctgagcttagctactgtatctagagtttgttctaaacaatctgggactgttcatgaatcttggaagaggacagtgttgaaggtcaaagtgtggaaagacaagatgctatctcacctttatgactgttagattggcatgccttttgcaacaggtaaagtgtgcatgggtgggtacacacacacacacacacacacacacacacacacggctccatgtaaccttgcatggaaataaaaatgagcagacaactgcagggtcatctgaatttcagggtatatagggaatggaggtgaaggagctgagacagggccattcccctaaaacagtcctcattctttcctccccggagacctcttttctggtgggcatagagacccatctctctgcacagcccacaaaacagcctaagcctgccaacattcacctctgatgggcagacccagagttcctctgcatatcccccatggagaaaaggagaagagcttaggtcatagtgcatcagaactgatggcaacaggaagcgctctggttctgtggctttcaaacatttacagaagttaatccatttttcaatgtatggtaggcagaataatgggccccctaagatgtccatatactaatccctagaacctgtgaatatgttatgttccatgacaagggagaaagaagattgctgatatctggcttaagaataaattatcctggattatctgggtgggcccagtgtaatcacatgggtcctttaaaggtggaagaaggaggcagaagtcagcatctgggtaatgccatgtgtgaaaggctggacctgccagtgctggtgttgaagatggaaggggccatgggccagggcctgtgggcagcctctagattcctgtctaagaagctgggaaagtccaggaaacagagtctctcctccagcctccagaaagaaacacaaccctaccgacacctagcttgaagccggggagacccattttggacttctggcctccagaactgtaagagaatacatctgtgttgtttatagccactaagtttgtggtcctttgctcacagcagcatcaggaaactaaatacaaggcaaaagccaagcggtggaccagaacccagttggcctccttctgacctcccagccaccccggagggattgcttcagaactcggtggctccgagaagcctggtttgaaatacagcgtgtctgaaatgcaacctgctaattctccagacaatgaaatcgaggcccaggaaggagtggttttgtgtgaggtcatgctgagttagtggatgagccgggactgcaacccacggtccactcctgttttgtcagaaatcccagatgcttacatgaattctctcatgaactcgtccgttacaacaattgtatgtgtatatttttacattttcaacaaacgtgtgcatataaaggcccaagcactgtgctaagaactgggcagaggcgacgtgagcactggcgcaggaagatgagcagctctgagttccagtcctgacctcagccccttcctgggcctcagctttctccaaacatccgcagccagcccaggttgctcagatctgtccgtgttctttgtcctggaactggtcaccaggtgggctttctcacagccacctgctctgagtggagacacagctctgggaaaggagaggacccagcccactggcccaggctgcacctgccctcgtgaagcttatgcagcatttatcacccataacaagctgcaggtgggcaggacccagggctgtgggagggaagggagaggagaagcaggcagaggcagatccttgcctaaaatcagtgccccagtagtgcgtataccctctgccaggcattttgaccttcccagctctccctgaaacacacctgagccaccggccggcccccagggctgccagctccccggtgttggtctccatggcaacctcacatttgccgttctggtttctaatgacttattggcatgtgtggtaatttgcagagcttggcaggaagagctgggagagtagtgaggaggggaggggaggggaggcagtgagggggacttggcagttggtggtggggggtgggtcagattttggatggggacagaggcacacttatcctgccccacccttcctagtccctgctgagtaacatccaaagtaagggagctgcttcaggtccagggcctcccctccctgaggagtattggctctctgcaggcccctgagagggagacagatggacagacagatatggtgcacagctgctcacctgtcaggcagatttgggcaggcatggggggctgacagccgcattcaaacgtggcaggtcagaccactcatgttttccaccactctcctatctgtttcctgggccctgagaacaaaagggtacctgggcccaggagtcacttggtcctgtggggagaggggtgggagtagagtatccaaggacagatccttgctgcttctaggcctctcacacactcaaagaaccaagcagggcagccctaaatgaaatgccagatcacttgggtagtggggaaaagcagggagggggagaaccagcctagcaatcacaggggctgagaggagcaggggccagacccctctccacttttcttcggcaaagcttagccaacctcagaacgatttccccagggcaaggcagtgggaagcctcaggtttactgtgtggctgcagtcttcctgcatacaactttgctgcctctgtctctttcggtcactcttgatgctgcaatctgttgtgcgtttgtgggaagcagcctgatgtgctgaagagagcaccttcttgaaagttggatccatctgggttagaatcctgtggcttctgcttcccagctctatgaccctggacgtgtctcagtctctcattgagcctcatttcacttatctataaaatgggtttaacacacccagttcacagggttgtgaaaatgaaaccagctcatgcttgtaaaatgcttggcacacagtaggtaccaataaatattaaagaacttaaaaagtcatcttttaattatctacccaaataaacaggaataatgtgatggataatttaaagaattctgatagacttggtagggtattgttttttaaatatttgagaatagtcttcatttagttcagtaaatgtttattgaacatctactgtgcacaaagtacagggccaagtgggtctttcctggtgttttatgattagggtgaatttaagttgctggtgcattctctaagcatatatcatctgacagagggagagggagggcccttcggaaggctagtagcagagagggggtggccctcggtcaaccatgtatgtggatcttacgtggatctctgagaagtggctggccctaagagaaagatctgcattgtgaaggctctgtctggatggtgtgcagtgagatatgctgcccagcttctgagaaatggtgagtctgtttttagagctggatgaagcggatgattgatggaactagtgggtggtcgctccttcactttcacaagctgctactgaggcttgagggggccggtgaccacccaactatcagctggaagaggagcaaggtgcacctgctctcacctgggcatctgagcagatcacagctccctcaactagtgctgggagggagggaaggagagcaagagggagctaggaaacttggcttctatctctgccagcagatggacttctgcctgcagcaggagtctgtctgttcttctatcagcctccatgcagcctcctccaagacggcgcgacagagatgtgcaaacagaacgtcagagatagctggggccctggagagcatctgtcccactgctttctcactgtcctcattcacattatagcacagaaacacagtgataatggctcagggaccccaattgacccaagggctaaagggtcatgatctcagcacacctgtacccatttgttgctccctagccccacttggggagccctatcttagccggtcctcccgatctatttttaatctatgagaaacttaagcaatggggagggggaaggacttgagatcacatagcgtattagtgcccttgggactagacagaaagctcctaacttctggctttgtgctatacctactacctcttctcaagactccttcttccactgattttcctgatctttcaccctggaggggctacttcatgtgcaagagaatgtaatgtctctaagacacgattattccccaaatctcgcaaaataaggcgacatcctccccactcacctttattctcactagccaccctcttcattcagggaagcctttggcgtgtgcccatagaccttctccctttccaactgtatgtctgtccatcatcctgggtgagattagtgacgatgtggacagcttcttctaccccagacccaacagtcccttcacgggctcacctatctcagccactcacttgcaagttcacactctgtatcttgccatcccctgaaaattacctagcagagtacccaactttctggtcatcaccttctacaccttttagtttcccagcttgcttgtccaaggactcccacaccaccacttattttttagccagtcaaatttagcagtgggagggttctatgacacccccactctttaatctctttgggaactttgctccattggcacctttgcttttttttttttttttttttttttttttaccatcaattaccttcctctgccttcccttctctgagtccagatagaggccatggtccatcatttttaagaatcctcctgccaatatcctaaactctcttgagcctctgtctttttattgtcctagtttgaccaagtccctgttctggattaattgctttatctgcttctttctacctgcattcaggaatctggacccgctgggacacacacacacacacacacacacacacacacacaaacacacaaacagattgctacttctacaaactcaccatcaccaacccagcttgctcttcaaaagtgcctggtgttcctaccacgttcctctggttctgtctcccctcagtctccacaatgactatttcacaccttcctccccaaacctctgcctccaccctcatgctcagctgaggacctcacctcccacttcacagagaaagagaagtcaccaggcagaactccccaacttatccccaccaaacccccaaactacctgcctctgggccagtcctctcctccttccctcctgtgtctgcagaggccacagcatggccatcacaggccagttcttccaccacccatgttctaggtcctctcctctgccttctcagaaacagccttctcaccatgctcaagtttctcatgtcttcaacaagcaaaacaacaacaaaaaccttcctgaagcccgactccacttgctgccaccacactgtctctcttctccgtacaagccaaatgtctgaaagggttggctgcaacagcattctccatctctgtgctacccactccttccccagccctgcttcagtctggcttcctcccccatcactctgctgaagcagctctccagattgctaaagccagggaacattttttagttctcagaagcattttccactcatttttttttttgacactttcttttcccttggcttctctgaccccacattcttggcttctctggtactcctgagtcgtctttgctgactcatccttcccgtcttgatctttaaatgttggtgttccttatggtctggctcaaggtattctcttctgattggatactctgtccctgggccatctcagccacacgaacggcttccgttgtcatccacatgcagatgacacccagcttcctagttggtgtcttttcttctgagccccatatccttatattcacctgcctagctgactaagctggatgtctcaagaaacctcagacttgacatactgaaagccagagtcgtgattctcctgctacatctcccactgccttctcacccgctgcctgatcctcctccagtgctgcctgttttgtgaatggcataacctcaaacctcagttctgcacgccatcaactgggagtcactgtcagctcttcccttttctctaccgccttacatccagcccatcaccaggccctgtctacctcctaaacagcacctgggtccatccactccactcctccccatctccacagcctccacactagttcaggctgactttgccttttcctcaggctgctggaatcaccttctcattggtatggctgtatccactcttgcatctccaattgtcagagaagccaagggaaaagaaagtgtcagaaaaaaacaaacaaacaaaaaaaaaaacgagtggaaatgcttctgagaactaaaaaatgttccctggctttggtaactgggtctctgaattgctgctggactgaccttttaaggacacaaatctgacctagtcacattatgttgtactctcaacactcttaagtgattcccatgctctttaggatggccagtgggatggtcccttgtggtatctgacctgtgcctgcactgaggcatccccactcccctccctcatgctctgcactctgcaccctggcctttttcagctctgactgctgagctccttttggcctcatggccttcacacgtgctgtttcctggcccttaatcactcttcccatcccttccttctcctccctaaatactagctatcctgcagatctcagctcaagtagcccttccttagaaaagcatccctgtaccttcagaattttaccaggccccagttaaacactctcacaatgtcctgtatgctttcttcataacacacatgatgatatctaattatacagttagggcttattagagaaatgtccatctatgccactaggctgtgactctatgagggtagagaccctatctgttgtattattgtatcattggtgtctggcacagatttggcttcagaaaatcttgggatagtgaattcatccatgagaggtctttaaatacaaaaaggatccatgaaaaagtccgaaaggaaagctattccttgtgtgtggcattggtagaccagaagaccatactcctgctcccttcccttccctgtctttccccaaccaaagattcaaaagtcattcactttgagtttccagtgtaggctcctcctcaccaatagatttttcaggaacaatagcattaatctttcacgtgtgaaaagctatttacagtcaggcgcagtggctcatgcctataatcccagaactctggagaggctgaggtgggaggatcacttgaggccaggagttcaagaccagtctgggcaacatagtgagaccccatctctacaaaagatttaaaaattagccaggtgtagtggccagagcctgtagttccagctacttgggagactgaggcaggaggttcgcttgagccctggaagtcaaggctacagtgagctagggtagcaccactgcactctagcctgtgcaacagagtgagaccctgtctcaaaaacaagaagaaaaactatttacaacctacaaaactctttcacatatattatcgtgttcgatttttttctctgtccttagagccacacccatgaggaagctggggtgtgtattatgatcgcctgtttcacagtgaagcaaactgcagcccagagaggagtggtggcttgcccacagtcacatggctgatcagtgaagagctagacttgagcctggtactcaggccccacttccatgctcttttttgagacagagtctcgctctgtcacccaggctgcagtgcaatggcgtgatcttggctcactgcaacctctgcctcccgggttcaagtgattctcctagctcagcctcccaagtagctgggtccacaggcacgcaccaccacacccggctaatctttgtatttttagtagagatggggtttcaccatgttggccaggctggtctcgaactcctgttctcaaatgatctgcccgcctcggcctcccaaagtactgggattacaggtgtgagtcaccacacctggcctttccgtgctatctctactgctgcatatccacgctttatagaaaagagactgctgcaagttcaaattatccacagtagtggaagggggagtggcaccacaaacaaacaccaccacccacaggggctgggaagaaggtgggtctggaatgtcatgtgcagtttggtttggagcagaccaagttagcttggtggggccagcactggcctcttgcttttctcagatcttcataggtctatgaggattcattccacgccaggaatggagtactctggaacaggagtgcccagagagtccacagagtgaggaacgaggatggtcaaagctgagggaagacagtggcttctcaccgcagactccaggaggataacgtgcgagctcttgagacatgcacaccctccctggcgtggcttctgcctactttgccagcctcttcctccagccctcactgcctcccagatgcccaagttaaagcagttgtccccagttgctcagccatctcacgtggcttcacacctctgagcttttctcagaccgttccttctgcctgggtgcccttcatagtctcctctcctggctgactcttaccagacttcaatactcagctctagtggcatcttttccaggaaaccctccctaaagccctgagaactcctcccatgaactgagcacagtcagcacattctattaaaagtctctctttgctgggtctttctcttctgctggattagcaactcctcaaaaacagagactgtgagctatttatatgggcactcccagtgtcccgcatgtagtagtaataaaatcacaacatatattgaaggtttactatgtactagatgctatttaagtgctttatattaactcgttgaatcctcagaataaccatatgatgtatgttttgcaccctattttttaaattgttgttttttaaccttttaaaaaaagtatggattaactggacaagcaaagaaatttacagggaagtccacagtacccttcatccagcatcccccagtgccaacatcttgcctaattatactgtaatgtcaaaacaaggaaactgacattggtataaccctagagtttatcggaatttcaccagttatacatgcactcctttgtgtgtgcctggttttgtgtaaatccaccacaatcaagctagttaaccacaccatcacaggactcccttgtgctgctcctgtatagccacgctaccccatctcgcactctgtcagccactcagctattcttcatctctataattatgttgtttcacagttgttatataaatgggaacattgagtctgtaattttttgctgttggcttttttttttttttttttttttttggagacagagtttcactctggcatccaggctggagtgcagtggcatgatcttggctcactgcaacctctgcctcccaggttcaagcaattctccggcctcagcctcccgagtagctgggattacaggtgtgggccaccacgcctggctaattttttgtatttttagtagagactgggtttcaccatgatggccaggctggtctcaaattcctgacctaaagtgatccatctgccttggcatcccaaagagctgggattacaggcatgagccaccgcgcccagtggctttttttgtattcagcataatttccttgaggttcatccaagtagttgcctatatcagtagttagtttgttcttttttgtcaccatgtagtataacatgatagggatgtgccacaattatttaaccatccacccactgaagggcattggcattacctcgttttgcaagtgagaaagctaactggcccaggatcacatgactagcaagtggcacttaataaatgtttagcaataagcacctaacaaacgtttattgtacaagctcaactgaatgagggtactttatgctcttcacttagcacctagcatggtgttttacacatagtaggtgctcaataaatgtttgccagtgaggatatggatgagatggcatttatatttacataacttgtatcatgaccaacttattcctatgcctagacattcacaggagaggaatatgtccctctcaatatcttacactttccgttttacttagaatatcaggaaaggaaaattggggcagtaaatatgaccacatacagggctggcattttattgcctaaaatgcccagagcttttggttccaaattaatatatgccatcttttcatagtattttgcatcgaatttgcaggttgctcattttatcaaaatgcaaagcaacccttccaactcctgcttcttcctgtaccaccaccctcccagcaggtgctgggtcaggctgtgccaacgcagtctgcagaaacaattggttgggttccgaaagtgtccatgctaagctgaaaagtctactggggtgtttttgcttgtggaagcagtgagttattttcactcagtgggggcctcaggaggtttaattgcagaggatttgtggagctgttggaagtccttaacctcaggtgtgaagagccaaatgtgattaagtgattggaaaggaaccacaagttggactagtctctgtcctgggcacagcgcccaggagatgggcttgcttgagcagctcccactgtccctttgaaaagtgaggtgacaagagagccaaccccagcctccagggacacattggagataagtggggtctccagggtgggcctttcacagagagtgccctgtggcgtcaaggggaacccatggttttggccaatcaaggccttaccatgggccacaagtaggagggacagataaaaagggtaaaactgtgggtcttgacctcaagcaactactaatgatgtcgactcacccctaaagcaattaagggctggctgtgggggtgctcatacctgtaaccccagtactttggaaggcggaggtgggaggatcacttagagcccaggagttcaagaccagcctgggtgacaggaggagaacctgtctccaaaaaaataaaaaggaaaaatgagactttaaagaagttttggccttttggcgagccatgtgggattgcgccctgagacccccgggaatgcatgatcactctgttgttagaggcaattctttttaaattttttttctttttttttctttcacgtccatctgtgatccaagttaggggcaattcaaaggaggagttgaagcattatcttcctaaagagaatggaacctcacctgggaagatgaaatggactgctggggaggatagaccggtgaggaagtggggccagtattggggtagagagggtgacgtgtctgatttaggacactgttctagggactcatggggaactttggtactttagggaactgaatgggatttgattaaagagctgaccatcaggctactgcagagtgtaatgagagaccagatgaggctgtaaagagggaccataatggggagtggaggatgggcctgccggacggcagaggactgaccccagagggagaatgggcacaaggcagacgcagaagacggggagggacttccaagaaggaagttggtagcgtggcagacgagcccatcaagagcttcccgaggctgaaagctgcaaaaatactgttggattgagaagagctgtgagactgaaaattaactcacaggggcttaagcaagaagggtctgtgctcagaaggaatcacaggcgaaaggggcatttatatcgttatttttaaaagtggagagagggtaagcaaaggagtgagtttcctgaggaggtgggaagggatgaggttggttttaaaattcctcttcccttaagtcagagtggagggagagagaatgaacgagctgcgcagaggtgtgggaggcacagtgatggagggcaaaggaggtcacatcaccatctccgtcggcctcaggaggtcaggcaaggcaatctgttctgaggacggcgtgcaggtggggagcacggtgaggggcagattcagaaaaggactgtgcagaggtgccggggcagctgcagaggaggaataaagggattgcagcagagaggactggttgaagctggaatcatgaatgcataatagtgctggcggcttccgtgttttcttctgcaatgctttgtggggagacaaacagagctgggtggggaggatttctaattttttaactgaggcaggggcagcaatgacctcagtaaccttcctctcattttgtggggcctaggctgcccagccttctgcagacagacacccttctatccccaccagcctggcctcttactgtgggcagcccagtggggaagcccactcacctggctttgccgtctgggggagctctccacttttcagagcttgtggtcatttctccttggcctgacgtatcagtggatccggttctaaaagagtcccatttgccctccattgttccctgtgcactgttttcatttttctcccctcgtcgatcttgcgacagcagcgtaatagcctccgagagggtcagactgggaagatgaatgctggcctgtggaggactgcatcctgcctctccattagtgaggtaatggaaggcagggagcagagaatggataatccaaggaaacacaaacagacacaacaagcagcgcacaggataacctacacagcatttcctcttgtgcttggagtgtgctgtgatgacttgagtgccactgatttgctggtctaattaggtctgacttggacaatgtgggttgcatttcccagggtagagagggcagtgaggagaatccaggatgggctaaaaacgtttgcttggggagaagccaccaagtgaaggatccccatgtgcatgcacaagcagacagaagagcctgtgatggctgccactatttgaagacttggtgcattaaatgggcccagatacccacaggtcacccaagaacacagctccctactcagtgtactcctcacatgttgtgtgttaactcctttccggccaagtcaaccaagcataatggttgggaaagtttctcatgagtagtgccagggtggtgatgcggtacagtttatctctgttccttgctgatatgctccaggtccatgagctgatgcctccaggtactttctgccagaggagccatgaagactcccaggggccactgccctgcccttctgcccagtatcagttgatgcttccttggtgccattggcatcagttcatggtccaaatgggggttggaggggagagtccctgaggcagacagagggcagattatagaattaatagcctaaaagccccctggaaatgaactatttgaggaaacatgagttctggtctccatgtcctatgtaatctcgagctgctcaccaaagctttctgggcctccatttcccttctgaggcctttttttttccagctcagtcccctgagccatcctgagaacagaaaggagtttagttaaacaagtttctagtgatcatgaaaccaggctgtaagtagggagggacatcttcaaattctcctgggtttatgacagggctggagtatgttttcaagtgtccagataagatattgtggcaaagttactcatcaaatgtgtatttaggtcccagttcccagatacttatcagctatttgaccttggacaagttgttctttacctgaagaccaattgttcatccatagaacagaacttatacctgcctcacacatgtttgtgaaaatcaaataagatcatttgtgagaaagcattttgcaagttcataaatgtcccatcactgtagcaggctgagagggagaggtagcagggaacatgaaaagatcgtgggactcgagtcatatggagccgagttcagattccactgtgagttgtggccttggacaagttggtgaacttctcttagtcttagtttcatcatctgtaaagttgacataagtaaattatgccagagaattactggaggattaaatgggatggtgtttgtaaagggtctggcatatggtagatgcccctgccccttttcccactccctgtatgtagctccccctcactatatcctagctctcccaggccctcaagtcaaggacagctcaagtcatcatttgcccacattttcaaatgctcagactatcctggcatttgtctatggaagtgccacgttgtctacaccctccccaaggtttcacctttagctgtgggtcttcagtcttgggttccttcttcctgttggacagaaggtgcctgctgaagatacagatacagaactgatcacgtcagtctccagaccctgcagagggatcaggctattccatgaaactccacatctgctggggtccagctttctgcagtggctacccttcctgtgccaaagccactccatgaggtttgcccagccatcctggggcagggtgcccagggtgcaggggtgcaggggtgcaggggtgcagcaaagcattctttgctcagagagattctcatccctgaggagaagatccactctctgtcctggtccttcttagcccagagagcagcccctcgtttcctgctaccgcttttgctgtcctcaccgtactttctctatgctgcagcatagtcaacctctaaccctccctgccaagggcatccgggagccctcagccacccagctgcccctcatggctcccagcaggatggcgcttaggccatctaactgggcagatgttcaagcccctgtgtggtcttttctggtctgtggaacacctgtctcaagatcacccttgggggtgtggggcactcagatgcagattcccgacagcacttcagatcaactagattccaggctggccagaaatctgcattgtagataagctcccacaggattcttatgtacaggaaagttcgaaaaccattggtgtgacttttccccccatttttattgaggtagaactcatatagtgaagcaaacaaatcacgtgggcaacttgagtttgaatatggggtatacaacatccccatattaccactcccaaatcaagatataaaacaacatgtaggacatttctagccccctaaaaggctctcttacactcagcattctagcagcgtagacctagtttagcctgtttttgaatttcatgtgaatggagtatttgtattcttttgctccacattgtatcacttctgcccactcttaaaagtacaaacaactcctcttccatcccatgtaccttaccctcttctgatagagagagagaaaaaaattaatcaatcaatcaatcaaccagatttttcaggacctagccctaactccctctcattgcagtttcctccatcctcccctcctcaggccttggggagatcacattcggccccaatcctccaagcattagtgcttccagaggcccaggagccgtcaccaatgctgctgtggaggacctgggcccactcccctgccagtccctctgtagacagctactgggacactcatttgtagtatatggcttgccagagagtccaggcacattccagatgaaattggccaatttaagctacaaatgaaaagacaaatgagatggaaattgcacagaacaagcctgcttctcatcaggaggtatcaatcctgacattctgagttgtgcaacttatttaggcctctccctgccaccactgaggtcagaagggctttcccaaggatgggaaacaccacctccttcacacgcacagccaggcagaagagcagcccaagaggctctaagacgaagtgagagagagagagagagagagagtgtgtgtgtgtgtgtgtgtgtgtgtgtctgtgtaaggcggggagaagggagaaagtagaggacacaaggcagatacctcagaagcaaggcaataaagaaagaggatttatcagtccaaaaaggaaaaaaatattttggacatctgctatttactaggccccattctaggtgttcagactgacaagataaacaagacctgcccttaaggaactcccagtccagaggaggaaaagaaagaaagtgagatgatggggatgacaacagaaaaggcaaggggagatggagacacatctataaacaggaggaaggacagctggaaggagaaacgagggtggagctggaaggagaaacgagggtggagctggaaggagaaacgagggtggacgggagacctggagaggagcaggagtcctgtgaacaagccaagggtatggagcttggcctgctgtcaccccctggaccaggaagaagcagccttgagggtcctctggaaagagacagctcacagatgcctttacaggcatcaactcattggttcttggtaaagtgtcaaggagtgggcctggcagggagttcaccaatccagtgaatggggcaaaccaataaacaaaatatctggatgatggcttattctctattatgtaaagaggggtcaatgagccaggagttcttagtccctgggtctctgtcttatctactattttttgttgagtttagtgagtttcaaagagtccaggaatgcaaatttgttttcatatggatccaagctaaatacagttttagtaataataatagcaaacacttataaggcacttaccatgagccaggctgttttaaacacttcacacatagtaactcatttgcatagtaaatacactggggaaaaaaatcctacaatgcatttcaaagccaaacacaagtgacttttgaactatccatcacacacacacacacacacacacacacacacctgaaggtagattatgaactgttgaccaccttaaacctcattctcttaggtggccgtaagacagatgtcctgggaggctgggtttggaaagccattccaggagcacttgaataattccagatttcagtgggccaaacaggcttaccctctccctcctcctcctctgagctggagcacttcaggccgggctccatgcagggtgctcaggctggatgaagaccccggagactgtcattagggtaagtgtggccctgtctccagggactgctccctgtccattaccagagccagaatccatgtgcattgcaccattgtggatgttgctaagcctaattgctaccagggaactagtttccatagtgacagaggtacagtaggcccttgacattctcaagggatacatcatagcccttcatgaatccgtggattagagactaccacataatttcccccataaaatgcagtaaagtatgactgagaaatgtaatgaggatggctattgagggcaaagtcacccaactctcagcttgccaggaggttcccctgctggtctcacagcactggcaagtcagcattacatactatttcatgtcagactgaggttggtcataatggcagaagccaccttatgataaacggagaataccagcgactgccacttttgaatgacagtagcaaggagggacttctgtttaaacatgatggactaacatctctggtgctttgtgctgcctccccaaaccacactagaagtaaaggagtaaaaaagatgcaggcccacaagggcaggggaggagatgaaagcgaataagaaatgtcagtacaattttggaacttgagaaggtaactgacttggcttgatagagaaagaaaaacccagaggctcccaaagaggggagtcaatgagaaatgggcagattcctgctataaaaccacagagaggctgagaaatggttggcatctgaagacagggtatggagtagggccagaaacaggagagtgatacctcagatcccttcctcaccccatgtcaccccatgtctgtccctgctttaccctagagcatcctgaagaaaactttgctctccaaagagactgaacccaaaaagtgctgacttggggatatgggtacaagtatgagtagagatgaggcagtatgttggaaaagtgagcatttgctcaaagtttccaagccaaatggggaagccttttggtcatttcttccagctgggtctaaaaatactggtagttggacaagtgatgatatttgggagacccccttcctctcagttaagccctgccctttccaatcggctgtaaatacgaaccattggctgggcacggtggctcatgcctgtaatcccaacactttgggaggccaaggtgggcaaatcacttgaggtcaggagtttgagaacagcctggccaatatagtgaaaccccgtctccactaaaaatataaaaattagccaggcatggtggcacgtgcctgtagtcccagatattccggaggctgaggcaggagaatggcttgaaactgggaggtggaggttacagtgagccgagattacgccattgcactccagcctgggcgacagagtgagactcagtctcaaaaaaaaaaaaaaaaaaaaaaaaagaaccattggctaaggcttactagaattttaagggaggtgtctaatgttaagaaagcataagccaaaataaacaataaataaaaacttgaagaaaggaaatactatgcagggagcaaaagaaaaaataaaaaccatcatcaccacctcaatttatatcctcagagagttgagagacgacattatacccacaaaagaagatcatggggcctttttaaaaaattgagatataattcacataccataaaattcaccattttaaagtgtacaatttggtagttttttatatattcacaaggttgtacatccattgccattatctaattctaaaacattctcattatcgcccccaaaaaactccatacccatcagcagccactcctcattctccccttcccccagatcctggcaaccactagtctgctttctgtctctatagatttgcttattctggacgtgtcatagaaatggaatcatacaattcgtagcctttgtgtctggcatcttccacttagcatgttttcaaaggttgtagcatgtgccattacttcgttcctttttgtagttgaatattattgcattgtatggatataccatatatatgcgtgtgtgtgtgtgtgtgtgtgtgtgtatatatacatatatatagacacatagatatatattttgagatggggtctcactgtgtcacctaggctggagtgcaatggggtgatcttggctcactgcaacctccgcctcccgggttcaagtgattctcctgcctcagcctcccaagtagctgggattacaggtctgcaccaccacacccggctaatttttgtgtttttagtagagacgggggtttcgccgtgttggccaggctggtctcaaactcctgacctcagatggtccacccgcctcggttctcaaagtgctgggattacagacgtgagccaccacgcctgtcagatataccatatttttttatccatctatcagttggtagacatttgggtgatttttattttttaaggaagatgcagagaacaagttcttggagacttaaaatatgttgtttccttcaatgaagatgattactttgcagatggcgaggatccattaggtgcccagcacaattaatgaagaagagaccctcacaaagacacaacattttgagatttcagaatgtcaggtataaagtgaagattccacaagccaggaagaaaaagacaggctttaggatagagcagacttctcaacagcagccctagacgcaaataggtcatggaactgtgtcttccaacatgtgagggaatgttatttacagtctgaaattatatttccagtcaaactgtcagatatggaggctcaataaagacatgcaaacatttgcaaaaatgttcgtgccaaaattttcaaacactcagactttcaagaaacttagctctttttcaaaagcaactcaaaaaagatgtactctaccaaaacaaggtggaaaacaagaaagatgacatgaacctcagggagagacaaattgttaagaatatttactatcataagaaaaagcctgaaaagatatgcatcaaaatgttaacagtggttatggcaccaggaggtagaaaaggggattgtttaaattttctccatgtttttctataccttctaatttttcgataagaatgtcatactgtacctaccagttactatatctttgacacacgtggatgcagacagccaagggcaggccagagatagagaagagacaaagaaagaatagaggggggccaggcgtggtggctcacacctgtaatcccagcactttgggaggctgaggcgggcagatcatgaggtcaggagatcgagaccatcctggctaacagggtgaaaccccgtctctactaaaaatacgaaaaattagccgggcgtggtggcgggcgcctgtagtcccagctactggggaggctgaggcaggagaatggcgtgaacctgggaggtggagcttgcagtgagccgagatcgcgccactgcactccagcctgggcgacagagcgagactccgtctcaaaaaagaaaagaaaaaagaagagaaggaaagggagggaaggaaagatatggagcgtggagctctgggggccactgtgctgctctgaacacaattatcctgcgtttcggtgcccttgtcctgtcggcagcccccagggccacagtcatatttgtgagtctgtcagtctgccctgctaggtacagatctccctcaggacagaggctggatcttgttcatcttgtatctattcccagtgcctggcagagaaaatacatggaattggtgcttgaatgaatgtagagaggaagagaaaggaaggaggagaaaaaaaaaaacaaaaaaacctcacctggctgggcatggtggctcatgcctgtaatcccagcactttgggaggcctaggatggcagatcacttgagcccaggagttcaagatcagcctgggaaataagtaagaccccttctctaagaaacaaaaacatttttaaaaaattagctgggcatggtggcacatgccagtagtcccagctacttgggaggctgaggtgggaggatcacttgagcctgggagacaggggctgcagtgaccccagatcgcgccactgcactccagcctgggtgacagagcaagaccctgtctcaagaaaacaaaaacaaaacccaccaaatgtagagcataaatttggtgagacctgaagtagggatgccatcaaggttttagcaccacttgctggggtggtcagttccgctgtcggagaacttacctcatttccactcttggaggacttacctcagctgggtccagccacctgtgtcccactgccactcagctgtttcttcaggcaaggcctgggggagcttggaatgtccacaggggctagagaatggagaatgtcttttgcacccattaaagtttcagaacagctacactcagaccacagctccccagctactggtagtcccagagctcttataaacctcctggggcctacttgagaggaacattttgggttcatggcaggggtgttgtgctgggggggtggcaagaagggaagtcctgatttgtagtgtttgccaattttcatagttttcagtatttccatcacagccaatttcaacctactatgtaatgttattgagggtggagttgggaagaggtgagctccatcagctctcatggactggggcaagctggttccagcacgcactggttaatgccaatgatggatgtaactaccaagtgccacttctgcatgagcacaaagttggatgacttggatgtttggatggaatcaaagagcttctggtccagggaaggatggaagtagccacatatgctatgagtaccgccagggagagtttggtggagagtttttgatcaggggatgcaaaaaggatcaagacagctggatgggacctgctatacaaagaaagaactttgtacaacttccttatcaactaagaaagcaggctttcattctaattgttctgatttgcagatgaaaaaactaaggcctaacaagctaatagtcacacagctaataaataggccaccgttgggacaaacccaagccttctgattttcattaagattaaacttgtctacagtattcaaacccataaatcttcagtgaacagctttgaacatttcagtacccagaaggctcctcgtaccccttctcgggtaattgggtcttctaattcttaatccagtccgctttacaccagtccttactgactttgggttggcagtatatcatgtacttacaagtatggcttcaaggacaatcttcctcagtggttaagcacacagactttggggccagactgccgagattcaaatcccagcttcagctgtttgaccccaggcaggttacttaatctctagatcctttttttttttttttttttttgtcagggtctcacactgtcaccaaagagggagtgcactggcacaattatggctcactgcagcctcgaactcctagactgaagtgatccttccacatcagcctcctgagtagctgagactacaggtgcatgctaccatgcccagctaaatagtttttctttttttttttttttgagatggggtctcactctgttgcccaggctggagtgcagtggtactaccctaactcactgtagccttgacctacagggctcaagtgatcctcctgcctcagcctcccaagtagctgggactaaggttgcacaccaccacacctggctaattttttaaatattttgtggagacagagtctcactatgttgcccaggctggtcttgaactcttggtctcaagtgatcctcctgcctctgcctcccagagcactaggattacaggcatgagccactgcacccgggccaatctctgtattttagattcccatttataaatgaggataaaggcatcacagggttgttgtaggctgatatgggttaatacaagtaaagtgcttagaacagttcctagttcataccaagtgttcagtaagggtcagcctatcattatttggcaagggagaagcagccgtcctggcccagaaatcagagaggtgtgaagaaattgattagagatcaagaaggcaatcagcctcaggcttccttcacggtttcccaacctggggtcagtggagccaactcctagagaaacttagaacttctgaattgagagggactagcaatcttgtagctgggtacttgtatcttgcagatgagaatcagaagcccagagttcagtgtgtgcccttatattaatattaggctagtgcaaaagtaattgtggtttttgctgttactttcaatggcaaaaatcgcaattacttttgcaccatctaatactagtcacttccctgctgtgggactctgcttcttccattgaaaaggaagcagaatgaggtggataccgaggtcccttccgcagaagctctgacctgaggaccaactcaccttgcttagatgtggaggctgcacccgggacagacccccacgtgaaggtagcaagttggtgggataggcaagacctcacctccctgccagcaccctccatctgtaggggaatggcttctgaaatggacccagttgcaggactgccctgggctagctcttttcccaggaggcagacccagctgcctgcattggaatcacctgcttggaagctgttcaatctgcaggtgtccgggctccaccctgaggagtgggatgggtatttgcatgttaacaagctctctgggtgattcgtgggcacgctcttagtttgagaaatattggattggagggctgggatccaggatgggaggtgcaagctctcatattagaaatagctgccatttatccagtacctactccatgtggggcactttttgacatctctaatctttacaaccaccaccctgcaaagtaggcattattactctaattgtacagaagagaaaactgagacccacagcaattaacttgccaggcatcatccagataatgagacaaggagccaaaactttagctcggtccttctttgctcttctgcctccttgctgaactcctaaacagctgcctcttacctgactcgaaacagcgctgggaggtgaccagctgaaccgggagaggggtgggttaatgtcaaggcgcctgcagctgtggttcagggaggcaaggaggaaggcggcgggggggcggggggggggcggtgaagaggagagggcgaaggggagagaggagggggaagggtcccatggcccatctccgtttttccgtctccctttctctctcaggcattcttcaggctcacagccgctgttttgacagggtgtgaagccatccgcaacctttgtcttctctgcttcccagcctcctattgtctcactaattaaagacggcttcaaaaatttcccctgttgtgtgctgcttggcagaatgccagcatcccactggggaaagccacagcaggcacctggtacccgggcactgggagacacctgggccctggcaggggccggctggggaagggagttgggccaggggagaaaggaagcagcctcggggcagggcaggcaggggctggtaattcttaggccctacagcaggaggatggggttctggaaggagggctgggagttctcacctatcctcagctagagttgctcagtccccatttgaaagagttttctgagcgattccccagcagcccccatcacctgctcctgtgtccgacagaacttcccttgggatgctttttgtgacaactcacctgaaagctctcattccccaagccattgcccaggccattccttctgccatatggtgacaagccatctggtttgcctggggctggggggttttggggggatgcaggacttaaatgctgaaactgggaaatggggacaagttggtcaccccactctgcttcctcatcatccaggtgtcagtcccttcctcaaagaggccacccaagttaacacagcaccaagtcactctcctctgaccctgtttagttcctgaaatagctttttattgctgccataacaaatcaccacaaacatagcagcttaaagaaacacacatttgccatctcacagctctgtcggccagaagtctgtctgggttggctcagccgatttctctgctccaggtttccaaaaggccaaaatcaaggtgccagccagctggactctatctgaagactctaggagatccgctcctgagctcattcaggtggctgtaggactgaggtccctgtttccatgctggctggcagctgagggtggtcctcggctcctagatggtgccttccagtccttgtgcacagcttcctcagaaccagcaacaggatatcagatcatcgcacgcttggaatccctcttctgcctgctgctggagaaagctgctttaatgactcatgtgactagatttgtcctactcagataatccaagacattctctaatcttaaagttcataaccgtaattacatctgcaggattccttctgccctggaaggtgacagattccataggctctgggattagagtgtgggagtctttggagccccatccctcctgctgtctgtcattccttccgagcccctaccactctctgatgtctacttacacatttattgtccatctatccccccaagtaaaatccatgagcggagagattgtgtttgagttgttcagtgccgtgtccccagccctcctgaagcaacacttggcacacagtgggttgttgatgtttgttgaatgagtgagtgaactttacagggacttttggatgcagagtggaagtgggaacttctggcaggtccaaggaggcttcctacatacacccctccgcagagcaggtggcatcaggtaggcaaagcaacccctcctggatgccaggccccagctgctggcatctcccagcctacctctctgccagtgttcttccctcttcccacctgagggtaagactagtaggacccctaccctcacccctgaccctcagtctctccctgcctgagaatcccaaagggcagaagccactgctgagtgtgtccctgaggggtggtgacgaggtaaaggcagagcctgtctggcctgcgctgggttcaaagccaatgcacctgggacttcaaacaattaatttccccagtctgcaaaatgatcagcttctgagggaaaacaattagcccactgcaaattggaattgtcatctcactcctgattttaatttggactaatgagggctaagtgattcctgctccctcccctcccactgcccctaggccctgagccctcacctgccagtgggcacttaaccctcagctgccccccttgcatcagaggctgaggaagtttttgggctggcacagggcccagggccaggctgggcaggtgctggcaggacagagggagggaagaagagagcacctccggctcagcccacaggggagctgcctgtttacaaggctcataggtaatcaaagttttattgaatggaattgactactggctcactccttgtcacagccagttacctctggctgcacagtctctggggaccctgcttccaggagtgtctgtttgccttcttcacgccaggttgcctctgcctggccttgctctccccataccccctactgccatggtggggagaggccatgattctctgcagccgggagagggctcacgtccatgtctgccagtcatggggatcagtgtgggaagtgaaccttggaccatttagtctaactccagttcctctaaacaaattaaggcctggagaggagaaggatctggtcaaggtcacacaggggtcaaggcccaggaggaactcacggcccttcatgtttcttcttattgcttgcttaattgtctgtcttctttcctggatactgctttcctctcttgcctgcacaatgcctggcatgttcagggatgcaggaaagaagaaaataaagcatcccgggcaaccctgtccatgttcttctaccacctcccacccccacttagcctcgtttccagttgggttggtttgattcattcatgtgcacatccattcgttcacacactgcatctgtgtgctgagaaccaggccgtgagctgcggatacagagataaataagacctatccctgccctctaggacctcacagtctagtggtttctgaatgtggggctgttcagcccagagcgcctgaccctcagcaggttgctcttaggcgagaaccaaccctgcatcctgagcagcagcaggtaagggagtcagctgcagctcctggctgcagactggccctgtgctcattcacctctttgagtcgccgccactggttgaagagtttagttaggaatcagaaaccctgagttcttgtcctggctttgatgctgatttgctctgtggccttccacaaatcccttcacctggtgtactttctgaagccagggtctgggctttggtgcatccacctgacttctgatgactctggcctgacctcatcccagcgccacgcagctgcctctccctccatgtgccagtggaggcagctcggctagtggaaaggcctctgttctggtcaggagccatctctgtctgggcctgccaccaccactgggtaatctcagttagctgtaaagtggggaaggtcaccaccttaagggttgggggctgtggtctgaacagctccacatttcaaaaccactagactgtgtggtcctggagggcagggatgggtcttatttatttctgtatccctagctcatggcctggttctcagcacacagctgcagagtataaatggatgaatgaatcaaaccaacctaaccaaaaagtaggttgggtgggggggcgaggctagaagaccaactgtgtggtaacaagtccatgcaggtgaagcctcccttgaataaaactctcagggccatacaagaggacctcattgttggtatgcagcggttgcttcttggataccatccctcaattcagtggacatacgaactggaggtgctgcgggggaagcagtggaaagcacatggaaggaatttcctggctctgggcctattttcttggggtccctggattggattctctttcaggcttcttccaactcttgacatgctgggatttggcattgagatgtacccagtagtgagggcagccttgggagaggttacagcttcttctgcaccctgcccaggccctctctcactgtgggaaggtgcagttggctgcacctctctgacattttcctcttcacattttccccactgtctgtttccacacatgctgccaaccccagcccatcctgttccaaccctgtgctctttccctatggtttggcccatcttgtcttcagtggctgtagctgggctcaccttccaagtgtccctgagtaagtggtggaggtgggatttgaacctaagtctttctaatccacagtctgtcagaatatagaaatgtatgttcaatagaaatataatgcaagctgcattaaaaaggcaaaaagaaacaggtgaagttaataacatattcacccaatatagcaaaaatatttcaaaatgcaatcaataacaaattcatgaatgagatgtttcacattcttttttcatattaaatctttgaaagctggtgtacatttacatgtccagcacatctccatttggactggccacattgcaaatacccagtggcctcatgtggggctgccaccttggacagctctggtctttgttcttgatactgctccttcctgctgagtcatagagtgactccgcataaaaatcagagccgtccatctgggctttgcttctctttcacttcctactgctctcagggaccagcccttctcctttgggctcttttggagttggtgctctctccccttccctcttaccttcttacctgcccatcctccacctcctctcccctcactccctctctccctttccttgttgtcagacaagaaacctttaaataggtgagacaaaggtgacaaatgttcctcatttacattcaagttctatctgcttttttggccctgttgaatggcacctctatcaaaatatctcatttggaaatgtcagagtggcttttgataagtcatcagtcactctgatggtagtagctgacagatgtgggtaacagtgtggtggtatctaatatactgtggaatgcatcttttgcaattgtgtggtattttatttattcaatgtggcatgaaatctctattgaaggaaagaaactattaaccctgccagaccagtctctttaaggccttcttttctccttaactttctagccttttttttttttttttaacctccttgcttcctttcctggaatcagaatcttgcaatcccagtcactgcaggccaagttcttgggcacccccttgcctattgcagcaaaagtcaagccagccacactcgtggaggctctgccatccctacaagaagtgggtaaaagcttctgggttgagacggaaccctggcttggaatccagttgctctttccccatggctgggctcatcttgtctttggtggctgtagctgggctcacctgccaagtgtccttgagcaagtggtggaggtgggatttgaacctaagtctttctaatccacagtctatgttagaatatagagatatatgtccaatagaaatataatgcaagccctattaaagaggtcaaaagaaacaggtgaaattagtaacatattaacccaatatatcaaaaacattatttcaaaatgcaatcaataacaaattcatgaatgagatatttcacattcttttttcatattgaatctttgaaagctggtggacattgacttgtccagcacatctcagtttggactggcccatgaatcttgcctgagtcccagctcccaggttctcatgaagggagaaaatctagccttggcagccattgttccccggatgtaacttctccctcctccctgccagctcccccagctctcccagagtctgccactgtagctgccatccctgaggggctgcactgctcctgggttgtagtaacccaggtgcctactatccctgtttccccataatttcaactcaaacaagagtagtttttttgaaaagaacgttcactaaaaactaaacgaaaaataacacacacacgcacacagcctaccccaagaaagcatggaaataaatcccaagttttgtcaggtcaagtatttctgatctaaaatacaggcagtcaggtccctaatgagatgggctggttcagtccaggcagcctggtccacgccccttctcccatttcacctgtgtctggagtcccccctccccatcttttctcaccatggaggtcttcctcccctgccaccactttttcctccggtccccctcccattttttgggggttgagactttggccaggtattgcaagtagccaagcatggtgggatgacaggtctctaaaggccctgggttgttactgagagaaatcactgtgctaacatagtgatatggtttggctctctctccccacccaaatatcaccttgaattgtaatccctataatccccacatgtcaagggtgggaccaagtggtggtaattgaatcatgggcgtggtttcccccatgcccttctcatgataataaatctcatgagatctgatggtttttataagcacctggcatttcccctgcttgcactcactccgtcctgccgccctgtgaagaaggttcttgcttttccttctgccatgattgtaagtttcctgaggcctccccagccatgcagaactgtgagtcaattaaacctcttttcttttcagattacccagtcttgggtatttcttcatagcagtgtgagaatggactaatacacagccattctgaagtttccttatcagtacatggagatggtaatacctgcctcagagagttgccatgatgattccgcatgcaatcacacatatgagaaagtgccttgtcgacctaaaccctactgtgaaatcattcttttacccatgtccagacacgatggaggaaaggctgcccagtgccaccttagcaactgacccagcccattctccacccattctttaaggagagatgccaacacacacacaagttttagcatgagcctttccctgttcctgtttccttggggtgctgtttgtgatttctgcagaaggcagcatcttataaagaaaagaactgttactctagggccagaccaacctggctccaattttagctcagtgcaacttattgtatgcctctgggcaaataagccgcctcagtttccccatctgtataatgatttaagtataccagtcacacaagagttggacctatgacactgtcaatgctcatgactgtgaattcccttcttcatccccaccccatcctcaccctctccctctctgtgcaggtgtaaggtggagaaagtactagatagctggcgaaagccctctgccctgccctgtggcttggagtagataggtgtggaatccagatgggatgagcctatcagtcctctaaccatcaacctcccacatacctagtctacacacaggcctgctccagcaggacccaagctagctacccttggggagggactgctacctttacaggaagcttctattaagagggtcccactgctagccctgggaaccatgttgtttattcttttaccccaagctgcatttattgagcactgaccatgtgcagaccctatgccaagtgaggggatgctagggatgagggaggcccagccagcccctgctcttgagaagctcagtctggggaggcagatggacttgccatggctcatgctaaactagggtaggtgttgtgggagcaagaggagagaaggaaggtgtcacaaaggagatgacaactgagctggcacttggaggataattatgagctccctaataagagaatggaaagacattccagaacaacaggttcaaagacctgaaatcacaaaagagaacagccagctcctgtccagggcaggggaaaaagaagaggaggagaggatctgaagaggtgggcaggcatggggctgtcgggggagctgctaggccagccaaggggtctaccctttgagaaaggagagaaagtgacctcccccatcaccaggacagaaagggagggaggctgcatggtacagatggaaagcccagatggcaactgtggaatgtcagggaagagcactgtaaggagagcttcatggaggagaaggggccaggtgtgaggatttggtagaatgtggtcaacagtgtaggggaaatgtggcttctgaccaccactcccattttactaagcagctgttccccccaggacctccttttctctgatattgcagtggtacagcagatgggtagaggcatgcatgtccctgcccatgcctgctgggaaagggaacccatttattgagtgcctgttgcatgctagatactatgtcagattctctgccagcatatcacatttaatcctcatgataactctgtcatatattattctcattttacaatatggaagttgacactcagagaggttcagtaatttgttcaaggtcacactggtgggaagaggccagggcaggatttgaactcaggtctttcacattctaaaggctttgttctttccactttgtggtgccgagcatttggttcccagcttcctgaggctgatcttcctctagcccctgggtttctggaggaatttatatgacattgttgctgccttcatcattagaaggctgtcaccagggtgacagggaacagtagatatggagctgtcacaatgggaaaaatgaggcgatgaggaaggcactccatcaccgcctctggattagaggcggccacagctctgcctggcacacactccctgtcatgattctgtttcggctgcaccccaacctcatcctcgccccctcttcaaatgggtggaatccaggcctcaaaatccaccttgaattccaaaatatgcagtcatcttcgtggaaaggggccaacccaccatcttcagaaccaagcaaggactagaacagcacttaacgttttgggaggccacagacccctctcaaaagttgataaaagctatggaccttcttgccggaaaaatgcacctgtgctcacattcacaaacaaacatgtttgcatgcaatttcagataattcccagactctgcagtccaactgaggacttcagattaagaaggctttctctctggagatgctgggggaacacatttataaaatacatagtttctgacgatgtctccttttctgaccccttctctgttcgtaagctcctggagaaaacaaaggaaataaatgtaactcagatgaagtaattgttttagaagagtgtgttggcaaccccatgtgtggggaggttgaagcactgaccaaagtgagagctttgggttatctgtctgtttaaatcactcagggttcttcatgtccgtcatggtgtgggtgggctgcccgacaatcaggatttgactccatgtccgaaaaacagtctatcaggctctgagcccctcaggatgctggcttgtgaaacacttaggtgctgcaccttccaggggatgggctggaaaatgctttgtagaagagcccgttgctgcaagaccctgatgtcctcctccctctcaccctcagctacctctgcaggttcatgttcctccctggcaggaagcacgtgtgctcttaatagagctgcctaatcacttgtttaaactagacattgtgtgggtaatgacttctggctgggaccagagaaagccatcagctatcccgtgtagggatgagtcctgccggacatggtccctgctggctgcagaggccggggcagttcttcctgaggcagagccagctgtgtggtggagcatagagggtggattggggactgtttgaaagtttggcaaagagagctggcacctttttgcctaccctgctactcctgggcacaggatgaacccaaatgtgagggctgatgggagcgcagagccgggaggcaggctgcctggggtcatttcacccctctgccagtggcattcaaagagtagctcctggcacaggtcagtcccatgtacacctgcacctgtctccaagctggagaagacagaaaatctggcaacacctaaggcttcccagtcccagggatgtgactataaagccagtagattcgctgtttgcccagagttttgaggtctggggagagaggtgctagagaaatgtcagttacagccatgttaattattattatttttatcattattacaggagagaatgttccccctgttaattccctgggaaaatggctgtgaaaatgagctggcaccatctgggccttgtgcccaggagagcaagagcactggctaatacagcctccaaatctgctcccctccaagctgctttacctggtccgccactgcaccctctgcctgccacctcccctaacacacacatgcactcacgtgcacagatacacaacacacacactcttccacacctgcagccctggctgcagagaggagggtgcatagctcctgcagcattggagagtgggtttggcccttgttcttacctcactgggagaaaaccagctgagctatagtagagccatgtgaaggggtgggggaagacccctgctttagttgttctggagttttgcacttacaaacactttcaaatgcaacatcccataggctctctcacagccaggtagttggtgtggtggtgaaaagtgacagcttcagcatcacacagagctagacttacattgtggcttttgttaatacatgtactagctgtgtgacctcagatcagttgcttaacttctctgagcctccatttcaccatcagtaaatataatactactctcgtagggttgttgtgtggattaaaatttttttaaagctttgtgaaaggcccaacacatagttaacattcaataagtggtgcctattaaaattcaaggcagatatttttatccccatttcatagatgaaaagaaactggggtcagtgaggttgtcctatagctggtgtcaacctaaacaatgaacagagaggctctctaaaagaaaaagatacttattttggaatagagcattgcactgggaatccgcatgccatagtaaactacatgtgtgtattcaggaaggtaaaagaagacaaagatttttaaaagaaaagatgaggaggattacataattgttttgaaataattatcctaggctacaaagatcaataacaagggtgataccagtctgaggttggatagccagctgtggacagatgtccttgcagaaatattttttgtgtaaggtttcaatggtctttgtgcaagattgtggtttttgcaatctttttgatagtttttgttatcaggcatccaggcatgagaaccctctcttcatggccttccctggctctatttgtcaggatgttttttgttttttttttttcttttttaaccctggtaagtgctagagctgttattagaactcctggatttagatccacattaactctcttaatgccaaaccctcaaatgctgctgttttcctgggagacttgggcggtaatgatgtggaactgtgtggtcttgagttagcctttttgcttcccctgcaaccagctctgtcctccctagcctgccccacacacatgaccatccatctgggggcttctgaaggtgtcacctagtggccgcagctgttgctcagtctctgccagtgggacaagggagtagagatgagtagaggagatcccagaacctcatggaaacctcagggcctcatggggtgagaaaagatggtgagggatggaaagcaagcatggggaaggggtagagaagagacaggagagtcaagaaaagaggtggggaagggagagaggagccaggcctcaccgtctcctcggaaggagctgcacagcctgttctacaggctccgtttgctacagcccctgaacgcccttccaggagggggagaagtcccactttcagaaaactgtttcttctatctgataataataacgcatccttgtttggtggcctctatggtctgaatgtttgtgtctccccaaagtttctgtgttgaatcttaacccctcagtgtgatgatgttacagggcagggcctttgggaggtgggttcatgagggtggagcccacctgagtgggattaatgtccttataaaagagaccccagagagctccctctcccttcctgccatgtgaggacacagtgagaagatggccctccatccatcaaccaggaagcgggccttcaccagacaccaaatctgccagctccttgatcttggacttcccagcctccagaaccgtgaacaataaatttctgttgtttataagctacctggtttataatattttgttatagctgcccaaatggactaagaccatggcaaatccagctatttaatgtacttttcaaatatgaagtgattgtgaatttatggtatatgaattatatttcaaagctgttgttaatatatataattatataatatatacacatgtgtatgtatgtgtgtaacatcataatatgatttgttaagagcatggattcttgcttcttaccagctgtatgatcttgggcaggaggcttaacttcttttaacctcagttttctcatctgcacaatggggataataatataatagagttttatgaggattaaaagagatagtgaatggcaagtgcctggcagagagtaagcccttaatgaaattagctaattgtattgcatctattttagctatacaaggcatatgtcattactaaattatatttatttatttacttactttagagacagtgccttctgtcacccaagcttggagtgcgatggtgcattcttagctcactatagcctcacctcctgggctcaagcaatcctcctgccttagcctctcaagtagcttggactacaagtgtgcaccaccacaacaggctaatgtttttaaaaagagttgttatagagacgggggtctcacttgttgcccaggctggtcttgaactcctggcctcaagtgatcctcccaactgggcctcccgaagtgctgggattacaggcatgagccaccatgcccggctattactcccattttagaattgaggaaactgagcccaggaggatgtttctctgtacatgtctggagggcagcaccttgtcttattcatctctgtgatcctgtacacaggattgggctcaatgaatctttgtagagtaaaagacgtgtcaccccttgctcagtggggacctggcactggaatgcacagctctgggctgctaagcctgggttctctccatcaagccaggctgaccagctagggaggttgagagagcccttatggcccaggagcctcctagaggcctatcgccctctccagagctacccagggggccgtgccaccacttgctcacaggggaaagactttcaaaggtgggagctgaggctgccctgccaggcgatggccatctcagggcagggtcattcagcaggctcacggagcccccaaaacccttccccagcctgggagcaggagcctgggggtggcgtcccactagccaggcagatgaacagcttctttggtctgggatttcactgaaagccctgaagccctgagccctgcttcacttggcacagattaggcatcatggggccctaaagatctccacatggcctcttggcaagtctaggattgcttcctcgctatgtactacttagaagacctggccgggcgcggtggctcacgcctgtaatcccagcactttgggaggccgaggtgggtggatcacgaggtcaggagttcaagaccagcctggccaagatggtgaaaccccatctctactaaaaatacaaaaaattagccgggtgtggtggcacatgcctgtaatctcagctactccggaggctgaggcagagaattgcttaaacctagagggcggaggttgcagtgaaccgagatcgcaccactgcactccagcctgggcgacagagcgagactccgtctcaaaaaaaaaaaaaaaaaaaaaaaaaaaggaagaccttgggcaagttacttcacatctgtaagcctcagtttccttgcctgtaaaataagggtgccagtagttctgactccaacggtgcggggggattcaatgaaatggtgcacaaaatcacagagccgagtcctgttgtgaacactaaagcaggtcggaggcctggccccagatcaccatgacagcgctctggctctgcgaacagtagtgcgtgagatcagtgctggtgattatattccccaggcctctgcctgcaggcctcatgccaaggcctgatgttcggggcggggggtgggtgggtgagagcaggcaatcactgttggggtccccctacgctcagtgaatgctttcacgaggcgggagggagaccagaagaaaagcaaggaaaggaaaagaaaaccctagtacattctcctctgtcctcccccagctccgcagctcctgggggaattgagctgcataatacaatgggatttaataaaatgcctttaactcacaaagtttgtctgctgccagctccttaattaaattgcctaatgctgctttgcgatgggagcacaaactcctgtgtttaaagagcacggtgttgccatggcactcccccacagggtgagcagggtgtggaggagcatacagatgaggcccgggggtcggggccttcccgcagaggagtcctctctaccaccctctcagcgactgcccccaaacacacacacacacacacacacacacacacacacacacacacacacacgtcacgtgctgcaataggcagactctggtctgggaaaggatttaatccttgctaagaatgctgagctgtggtttagaactgggagactcaggggcatctgcacagagcagagctggtcagctggtctggctgtggacagtggactccaggcacagcccttggcactcagggcagccctgtggggcctggggcaaccaagcgtctccctgagccgctccctctggctgccagcagccaccaccctctcccctggtgcactgtacaaatacactcatctatatgtgccctggcttgagaagggctgggaagcattgggctagaaagcattgggctagatctgattggtttgatgagaaagtagggatgttctttcacatgtggacggcagaggaaagaagctcatttgctttatggatttttccttcagaagtaatagttctcagtcctggcttcacattcaaaccatttggggattttccccccaatactttattatgaaaaattccaacataccgcacagtaaagggaattttacagtgagcaatcatctacccaccacctagactctaccattaaccttattattagacttgccttatcacctctctctccaactatccattcctctatctatcaatccatcttaattttggtgcatttcaaagcaaattgcagacatcagtacacttttccctaaatatttcagtatcaacagctatggggttcaatttttgcttacaatgtttttcttttgacataaaatttacaaagaaatcctgggaagttttttttaacaccgtgtgtggaccctactcagagattgatttaattggtctagagtgggaggtaggcatcaatatattttattttatttattctaaaagacagagtcaccctctgtctcccaggctggagtgcagtcatgcgatcatggcttactgcagccttgacctcctgggctcaagggatcctcctgtctcagcctcctgagtagctaggactacaggcatgcaccttgtagcccactgcccacagcaagaccagttggccagctctgctctgtgcggatgcccctaagtttttcagatcactatgttgcccaggctggtctcaaactcctgggctcaagcaaacctcccgccttggccttccaaagtattgggattacgggcacgagccactgtgcctggccagcattagtatattttaaaagatccccatgtaattctatggtgcagccagagttgaaaaacagagataacgggatgcaaatgattgtcatttttaagtccatgatcatccttcttttagtgtgcccctctgtgtgcatgtgaatccacttattttcatgttagcattattgggggatctcattatccaatgtgtatttaccaattacagaagccgcgtctgtttcaggttctgtatgcatcacagcaatgaggccatacgcatgttctgatggtgatcagggtagctatgatgaccaggattgtgacagtggctggaggagatgacgatgctcgtggaaggtattaagtgagtgtggtcatggcagcgagcaggggattcatatggcaaagatggggctggtgacattaacagagatggccggctgcaggtgtgctgaccatagtgatggtggaggtaaatctcacgatggcattgtgataatgagttgatattcctggtgatgctgctgctgttgcctgtccctgtgagggcgatgtgccaacagatgctcattccctgcagcgatgctcgtcctggaagaatgttggttgttacacggcaggaaggttggtccttccatttgggattgtcactgctgcaaggtgcagctccttccaaaattctgagaccacctgagaaccttctacctttgcagccaagaaagaggctcagcagagcagcagcagctccttgctcagctgcccttttccactgcactttaagacagagctctggtgttaagtatgagtgggtcattaggaacatttatttaagatgaacggttctgggagccagccgggtttgggataccagccatctcgtgatcgatagagattttatttgctgcctgcatggtttcctgttcccttcatgcctggtacactcaagagaggactggacaactgctgtggttctctctcccttaaaccctgcagcagggagcagaggtgagcaaagccccagagtagtcctgacctctctccatgagctaggatgacaccctctcaattgtactgggctgcggagagaggtttaaggatgagaacaaggttggggctgccaagacacattacatttaaaatatttatatattaatatttacttatatgtaaatatatataagcccagagaataatgctggaaaatacccttaaaataatattgtccaacgcttttattttacagatgagaaaactagggttcagtagtcagcaaataagatccttgttgagaacaacaaaaacatcttttatgcatatatctctaacaaagcagagtgaactcacacctgtgatctgatcggatctttagaatggtcctgtgagtaggcaggaaacttcctgcccacctgaccaatagctcctgaatcccttcccagattttttccactatgcagtgagcctaggtcatatctgtatagcacttctcagctcaccatgcatatttcacactcatattttcatttgagctgtacgtctctgtaaaaaagggatagtactagtcttagtcccatttttcagtagagaaaactgaggctcatagaaataaagcatcttgcccaagcttgcacagttagtaagtagcagagcaggaactagaactcaggatgcctatgttactggatggcttaaaacaacataaacatattgtcttgtagatttggaggctggaggttcaaaatcaaggtgtcggcagggccatcctcgctctgaaacctgtagaggaggattctttcttgcctcttcctgctttctggtggtggccatcaattggtggtgttccttggcacacagctgtagcacttccatctgtctccgtggcacatggcaccttcctgtgtgcctctgtcttcacatggcttttttttcttataaggataccagtcatattgaattagggccttccataacagcctcatcatcagatgattacatcttcagaccctatttccaaataaggtcatgtttataggtactgggggttaggacttcactatatctttttgaggaacacacttcaacccataacagtccctgacttccaagccaagggccttttacaacatgctgtttgcacagcgggctccatcccattcattctctcctccacgtcttctattcccaaggaccaggtgctcccctcccctgcaattcaggacatagggctggctgagagcacttttcattttctgctcttcccaaattattacaagctactaaagtaaaatcatgaaatataggtgggctttttgtcttttttattcccagacagtaaaaatcattaaggcttgctcttaattagtttaatttcaaagcttctaaatattgatttaacctacactcttttgtacttgccgcagtcattgaattatgcctgttattgatcacagatggaagcatttccttccacaggcttgggggctctgggagccgctggtcctgcagcaggtacactgggcttggaaggcgtggatgggtgtggaggagaggaagcctctgccagattggaaagggcgttctcttgaagaagggctgccgagcttaggccaggggccagtttctttctcttgggttggcccaggcccaacggagcttgaataagtcaactggaaatctcctcattctattccaggcttgaggaagtggaaggagagctgggcagcggggactggagagggtgatgtgggatcggggttagagcacaggtgttagggccagccagaagcaagtttgagtcctggctttaccaactgaatgttctgggcttggtaccttacttctcacatctgagaagtggggctagtaatttccacatcacgctcttactgtgagcattcaacacaatcactctggtgaggcacctagcccaaagcctggctactaatcagtgctcagtcaatgactaccattattatcattgccctctcactggaaaaataaagactggacttggaagcatactgtatcttctggcctcagcctcattacttgtttaggtgtgatcttggacaagtcacttatcttctttccactaaaatgaggataatggcccctttgacttcagagggctaccgtgagaatcacatagatcgtagtccatttgtgctgctataacagaataccacagaatgggtaattcataaagaatagaaatttatttcttacagttctggaggctgggaagtccaagacaaggtgccagcatctggtgaaggctgctgtctgctttcaagatggtgcctcgaatgctgtttcctcacatggcagaaggtagacagaccaaaaaaaaaaaaaattctctctgtcaagcccttttaaaacagtaatttatttcttcatgacctaaacacgtcccaaaaggccccacctcccaacactgttgcactggggaataagtttccaatacatggattttgtgggatatattcagaccatagcaacataggattgtgaatacagaagaatttttttttttttttggagacagagtctcgctctgtcgcccaggctggagtgcagtgatgtggtctcgactcactgcaagctccacctcccgggttcacaccattctcctgcctcagcctcccatgtagctaggacttcaggcgcccgccaccacgcctggctaatttttttttgtatttttagtagagacggggttttaccgtgttagtcaggatggtctccatctcctgaccttgtgatccgcccgcctcggcctcccaaagtgctgggattacaggtgtgggccactgcgcgtggcgaatttttttttttttttttttgagacagagtctcactctgtcacccaggctggggtgcagcggcatgatctcagctcactgcaacctccaccccctgggttcaagtgattctcttgcctcagcctcctgagaagctgggattacaggtgcatgccaccaggcccactaatttttgtatttttaattgagtcggggtttcaccttgttgccaggctggtctcaaactcctaatctcaagtgatctgcccaccttggcctcccaaagtgctgggattacaggtgtgagccaccacacccggccaatatggaagaattttaattgcaaggtgcatttgatctgaacagcctattattattgatggctgttgtagctattgccttttgtttgtttgggtttaagtttgcttttattgttagagacagggtcttgctctgttgccaaggctgtagttcagttgtgcagtcatagctcactgcaggcttgaactcctgggctcaagcgattctctcaccccagcctcccaagtagctagaactacaggtatgagccaccacacccacataggtgttttgtttgtttgtttgttttttggtagagacagggtttcactgtgttggccaggctggtctcaaactcctggactcaaatgagcctcccttggcctcccaaagcactgagattacaggcatgagccactgctcccagctggttactgccttatatgcctcctttggctggcctctgcctgggtattgtgtccagaccattctgcctctggcttgctgctccaacatcttcatcacatcacccacactctcaagacccacggggagccactcactgcttggaactcacttcatatgtttgaatcttgggacctttgctcctagtgtctcctatctatgcattactggcctatggattcccagcaacactacccctgtgaatttttcaatggctttattgaagtttaatttgcataccatcaaattcagccatttttagtgtacagtgattttttagtaaattcctctgaatgtttgtctaacttcctacatgaggtagaatcatgctgtctcccctagcttgtgccctgctgcccttgctctgtgacaacttttatcatcctctggtacactggtttagttttctttttaacctgtgaatccccacctgccctcctcataactttgtatttgcagccctcacatacttacagtgcctgggataaggtcagggatctatttcatgctcaatggataagagttcccttgtggccaggacagaggaggtgaggggagtcttgaaaacccaacctaatctgtcagggtataagcagctcttcatatatatatatatatatatatatatatatatatatatatatatatagaacactctaggtatcactcttcttggtttgtagacttctaatctgagctggagaggaggttagagatgagctagccagcaatcctcaaacttcagcatgcatcagaaccacctgcagagcttgttcaaacacaggtgactagactagggcccaccctcagagtttctgattctggaggtcttgggtgggccaaggaactcgcacttctagcaagtttccaggtgatgcgtagactactggtccggggactacagtatgagaaccgctgctctagcccaactccctcattttgcagatgagaaacccaagacctagagaaggaagaagacaccatccaaagtctgtccccaggccaggagtagagccagtcctgtcccatgctgcatctaccagccctgcttcccccatctggctttggagatgggtaaggagtggaaggcaggaagcagcctctgagaaacactgtccaccggcctgccctggcaagggggagtgcagagggactgcccagggagaggcctgtgggactggggaggggcacaggagaggtcctggggaagggaatggccagggcattggaggaggtggccaggacggacaggccattgtcttgcggttagtggggaggaaagacaaacccgggcctcagctgcagccatttatctccgggctgcctggacagctgacagggagcaggcagcgcccccgagaccaggactccttccgcggcgtgacttatctagagcttcatctggcaaacccgctgatgaaatgagtctctttttctctccgcctcatcaattttcattctgattttattttccttttccgttagaaggggcttggcctttctccatgtttaactgggctgctccccattctctgcctccctgtctcctcagccgccagagcccagcccctccgaccaggcctcacccacccccacccgacccttccctgagggtcctttcctcagtaccactgacacttggaggcaggaaacccaaacctccttaactaaggcctcattcacctcgaaagcagtggtgcttccctctgttcatccagggccataaagccactgtccccgtgctcgagcagcttgcagtctgagagacagaagatgagcattgtatttgatgtggatttttatttcaatttttattttatgtatagggggtccatgtgcagatttgttactgaggaaaattgcatgatgctggggtttggagtacggctcctgtcaccctggtagtgagcatatacctgatatataggtttttaacccccccacacaccctctagtagtccacagtgtctgctggtcctatatttatgtccatgtgtgctcaatacttaactcccacttataaatgagaagatgtggtatttggttttctgttcctacgtgaatttgcttaggacgatggcctccagctccacctacactgctgcaaaggccatgttcttttgatgcctgtgtagtattccatggtgcatgtattagtctgttttcacactgctgataaagacatatctgagaccgggaagaaaaagaggtttaattggacttatagttccacatggctggggaggcctcagaatcatggcaggaggtgaaaggcacttcttacatggtggcggcaagagaaaatgaggaagatgcaaaagcagaaatccctgataaaaccatcagatcttgtgagacttattcactaccacaacaatagtatgggggaaactgcccccatgattcaaattatctccctcccacaacacgcgggaattatgggagtacaattcaagaggcgatttgggtggggacacagccaaaccatatcagtgtatatgtagcacattttctttgtggatgtggatccttgagggtggaggaaggagcaagggactgattattttgagttggtggtagagcctggtcgtcaggaaagaccacataggggtgcagcataaactatgacttcagagatggaaaggaattccccagatatgcaggtgaggaaggggacttgtggcaaggtccctgcatgtgtgaaggcatgggacaggagagactatcacttgtattgctcttgggtcttccctccccttccccccgcccttgcctctgtcccagggatccactggggctaaagggatgtcctggggcccagactgctagaggagccatgctacagggtctgttcagcacccccacctgactcctgacgcagagaggtggagaagctcatgggtcagcactgggcttggctgcccatctgaggcctgcaactgtggccagcatggaatgtctatgggaggccatcagctgggacatttagaactcttctgggaggggcgctcttgacccttctggagagcatgtggggaagcagaggagctgctcccctaagccaggaggagctggtgctgagttgtttattgggtgagagttgtgtccaacaccaatgatctttaaatgaactgagtcctagagctgtccggaagactagaactaggaccccggttggagactgcagggagtgcttatagttgacatcggacagggcagctccgttaggaaggagtgtcacctgcactgggaaggttccaaggaagaggttgcctgccttagagaccaagtaccctgataggccagcatcaggctggcctagtacaaagatggtctcgaagcgcccccagggaaatgtgcctccaacaaatcgaagtggataaaaagggcaggacactctaatgagcaccgggcactctctagacatctttttcagattccccctcgctatgaggcaggtctgtctccatcttgcagatgagaatctcagtgaggaggttcaggatcacacagccagtacaggactctggtgccgcgccgtctctaaagcccaccgttcaaccactcgcctgtgctctcagagaggtcggtggaacctgcgggatttctggaaggggagcctgagagagcttcagaagggcgaagactgtcataggagcttggcaaatccagaggcaagaacttgagtcagagaaaaatgctctcttcacctgggggccagtgaccaaggaagggctaaagacgccatgtctggagtggcccgggtattgcccagggaagacaggctctgggatgatgtttgtctctttcctgtcaggaaggaaggaggcagggggtctgagcccagacactgcccaccccataggcaatggagccacctgagctctgaaatagccagccccctccctccccacttgccttgcctgccttgcttttcttttcttccctccctccctctttctttctttccttctccggatattctctgagctaccactgtgtccagactgttggaagaactggcaacttgaagcacagttcctgcctcagaggagctcacagtctggtcggggagacagcaagccagccagtttaggatggaggcacactagggcatcatgggagcccaggagatgggtgcagggggtcagaaaagttttccctgaggatcagcaaaagactggcagcaagcggcagtgagatgcagcctggagctgcctccgtgcccccaacaggctggctcggctcccctgcagccttttttggtgcagtgcacgcagacagcaatgactctgtgctacctactggcaccttccactcctaattaagaaataatgaggtaggctgccttccaggcagcagagctctaacactctctgcttgggccagccaggagacctgggaagacagagattcctgcctggggacagtccctcccctcccaggcccaacaaggggggtttcctggaaccctgacccctctcattccagagacgaggggagggcaagtatgaacaaagaagcctcacctttgcccagcagatgccctccagtcccttcccaccatgacagccctggaggtcaggcgagcgctggcaccggaatcatggaactggcaagggctggcgatggggttcggatcctggctcctccacactctcgctgtgggacctcagtccggccccttagcttcgcggagcttacgtttctcatctgaaaagtatgtccctcacagaaggatgggatgaggaacataaagtggctagcaaatagaagtcctggtacatggaagacactcaggaatgccacatctttcctctgagactttgctttctgttagcatcccagtggcaacaactagagttgaagggactcattttcccaacagagagattctcagagtaatggttttcaagcttttatagctacagccctaggcaaaaaaaaaaagaaaaagaaaaaagaaaaagccttgtatcatgtcccagtgcacaaatgcgtgtgtataaaatagggggcagcatctcaaaacaatgcttagtctggccgcatacaatgcagtatgatattttctattcatttttttaatgtagatcgtgacccacgttaaattgttttcatgacctactaatgggttgtgattcacagttcacggcagagcacccctcagtcctgcaagggaaagtgcacggtactaggctctagggacacaaaaatccgtaacaaaccatcctttcctcgaggagctctcagtctggttgggaagacagactcatggcctaacagtgaggaagttgccactgtggtttgttcagagagtctcgggggcagctgtgggaggaaccactcttctctaagggaaagcgtcacaggggaggtggcatttgggatgggttttcatggctgaagaggagttgaatagttgaagttgggaaagggcacggcaggcacagtgagaggcccaaggtgtggaaggaaaaatagccagggtgtggtgtgtctgggaatgagaggcagtcaggggaagtgtggctctctcaggtgagcaggaaagcccaaaagaggccaccgtacaggacaaggccagaagtgaaaagagaaggtaggtgtgagcattttggtagggggtgtgaggtgggagagggcagatgaagagggcgggcatttccagcctttggtggacggtggtgctgatggcaatgggaccaatgcagcacagccaggcagtgggaggagatgttgcatttaggacaagcagaatgggaggagcctctgagactgccgagtagagtgacccaggggatggatggttaggagtgcaggtctgggcccctccttcctggccacccccaatccatcctcttgcctagtgctccagaactctgtgatgagaaggcctagagggcacgggggccaggaggtcacccacatcatcctccctcaaggcagcatggcactcccaggcccaggccatgaggatgctggccagagctgggccccaaggctgagagcaatttttagatacgggaactctagaaagagagagaagaatcagcctctcttcctggagatcactggttaaacatgagattctaagacgctatagcccactttgaagtagggggaggaatgaagtggatttaaagttccctaatgccagagtaacctaattccaaagaccctggtcccaacttgtcatggaaaaggaaggggaattctgggttttcaagatgaaactgcttggcggcgatagaagtcgggaccgtggttagctccaggtgggggctggatattgactgggaaggggcacatacgtaggaaccttctggagtgctggaaatgtttatgtcttgatttgggtggtggttgtacttgtacctatgcatgttgggatcagggacatttatgtattctcccgtacatatgttatacctcaacaatattttttaagtttattacaaaagttgagagatgagaagtattaggtattagtattagtattaaaattcatggccaaaaccgcaattacttttgctccaatccaatgtatggtaagatgaaaggagaggctgcaatgctgggaagcaacagagggaactaacaggcacttcatgtaccttccatcccgtactcctcccagcaattccagaaggggtgcaggcattatccccattcccagctcagggatttggggctcgaaaggttaagtactttgcccaaggtcacacagcaaacagcagagccaggctcacgccccaccactcctccttcacataagttatttatggaattcagactctggaagagcagataaacgctgaggctgaggtctcctccagctctgaggttctggttgtgtgtgattaaatgggaggtggaagtgaggggccaggcttacctcccaggaggagctggaggccaggtatgcagatggaggactggccttcctcaccctcagcatccctcccacccagcgcttatctgctggtgaggaggccggagtttatcaacgctacactcaattatgccgcccatctctctccgcagctttgtggggagaagggtgtcctggcactgaagcagccaaggccaggcaatcgatcaccacctgccaccctccctctggaccctcagctcccgggggggggggtggggggggaaccgccagggagaggagggaggaggagaggagagaggagactctgcatccaccaataccaggcaggagcactagggctgtgctggggccgggggcctgagaagcagggaagggagaaagtagtgacagcgtctccaaaactcttccttcagacctttgccaaaggtcttagtttaatcaggggcattgtggattaattccacagtttccgctaaatccacagaaacagccccgagaacatagacctgacagggtttgcagcaccagcctttccaagagagaaacttgcccttggagtgggcaaccaaccctgcttcttggaatacggctctagggcttttgtctcctgtccctgaagcccacagctggccagcagtcactggctgcgcaaaaagcagcccccagcccccattcagaaggcaggctgaggtctgtgtgcagcagctggctctgtttgtccctgtggttccaggcccagccacacacacacacaggaacagtgtccttccccacactgtcccccaggggggttgttctaggcaggagtcaaggaacaggagctgaggggcccagcagggggcaggtgcgtggaggagctgaggactcaggttttctctgaagggatttgcaactgaggcagccttgccctctgctcctgtaaaacaggtgctgatccacattggctgggctggtgaggcaggatgtagagtcaaagaccctgggtttgaatcctgaccccactgcatagaagctgtgcaacctctgatgaatcacctaacgtttctgactctcagttgcctccctggcaaaatggagctaaataatcccttcttgcctacacacagggttgttggggggattaaatgcaatgcgtgttctctacacatttcactatagcaactctcaagcacctgctacatgctcaatcctacacttggtgctctggggacacaaaaagcatgtaagatatggcccctgcctcaagaagctcggaatccaattggggaaagtatacacgtgacagtctgaactcctgatcacccctggagattacagatgaaagacaattagctttctctgcagctccccggtagaaactgctaatcagcctgcatgagcgggccatgtgcaaggcagccttaggtggtgatggcaggtgagagggcagctctgagctgcatcctggaaagagctgcatgctcagcagtgagggggtggacttgtctgggcctttgccaagccttggggtcagaggtgcagtgtgaacatgagtcatcaagtcactgcctctggatcccgaggcccagccccaggctcccggcccaggagccacgacctctgcctcatccacccagcccaaccaggggagggaaggaaggggcagcagtctggggtgaaggggaaaggcaagtgcctggagggtttcaatgaagttttaaatggttccttgatcccctcagtgcagttgagcacggactcagcgcttagaaccaagtgttgatgaagaagggaaactggactcgggtagggtctaaaggtcagggagatgctggggcccagctgaagacccctctccacctcctccagccctcacccttctctccacttgggaaatgtcttgggctctcctagttgtttcgtgtttttgaacctgcctccccaactagcatggcacttgctaacttatcgagccctaggagtcctaggagccaacttctattgtcccctaagaagtcctatagctggagaacctcctgaccctgagggatgactggagctggaagagagctaacatttgtccagttctttctgtgtgcaacacactcatttaactccaatgacaatctcatgtaatacagaaggaaatggttgctcagagcagtcaagtagctttgcctcaggtacttgggtagtgagtggtagggccgcgatttgggtcctgatctatttgccggtaggtctgctctctcacagcaggtctaggtggcagtcaggggtctctggtatgtaagtgtggcaggattactggccatagatccagttccacaacagggacctctcggagactcagcttgttccctccttcctttccacccacctagaccaccacaaaattccctccctgcttcctgacccccatacactggcttgggtagctgggttccccttgcacaggtatgcaggcatgcatgcatgtgtacacatgtgtttgttcacactgagttttacgtgtcggtgcacacacacccctatcaaaacctctgtgcctttgaagtcgcggttgtttttcccaccttcagaaatagctgcagaggaaagtgggaagtagccaaatgtaaataggcttgctgtgttcctgctcagggaacgggaccctgcctccagctgctcccctcccaagccctagcatcctggaagcaggatgagggaggtgaagagcccctctggcccgctgagaggcacctgcctggatggtggcaggagacatagctccaagctttctgcagctgcctggtaaggagtcatcaccccaggggacgagaacaggcacagggcctgcagctgcagcattcagtgcatcccagaccctccagaggcccagggcagggtcagatcagacagacctggcagcacagatgtgaagtgtaaacggcacacagccccctggacttgggttgattcttgtatcttgctgctcaccagctatgtgacttgagccaagttctttaacctcttcaggacctcagtctcttaatctgcaaactggaggtattagtgcttatctcatgtacctgttatgagagtcatatgaaaaaagacattcagagtcttcaaagagtcctgagcaatggtaggtgctcagtaagtgtttgtgcatttccttgacacttgtagctaaaaacttacctggaatcagacttccactcaggagtcagaccaggctcaagaaggcaacacagtctggcccctttttgtttccatctttggttctaggccaaggctggacttgcctcatggccctggcatctgagagagaaactggataggttcctcatgctcaggatggaggaaacagcagtggcttgcattgttgattgcaggggtgatgtctaatctcctgaagaaaggaactctggagtcacagagattgattcatacaatcaacacacactgggcacccatcccgtactacaggcacaagaggcaagacaggtctctagttagagacgttttcccacggtgtggtcagaactgtgacagtaggaagcatgagtactgcaagagcataaagccagccccttagtcagccaggtggggaggttttggagaagacttctgcaggtggtgactgaacttaaagttgagcgttgaagaacaagtaggagttgtctggaagacaatgaggaggagacatcagaaggggtggcatgtcacggtaacctcaacccaaaaggtttgtgtgcagcgggtaagtggggtggtgacaagagaagccaggtgaaggggccgggccaggtcacagaaggtcttacctgcacagctgaggagctcagacccaggcttcttaactccactgcctcctcctgggcaacactgccaggctgttgggaaaggagaaacactcctgcctccagggtggggaagttggcaaacaccaaagcaatatccccacccagaagatcctgggcagcagaacaccccagcctgcctggatgtgtcaggtctgctgcctttcacctctagggtcctggggagcccatcccagattttagaagctgtacttatttccaccaaccctcacccacctcccacctacactgccagaggaacttctggaaacttatcattttatcttccatttacccagtgagccaaggaggctgggaggaaagaggtaagaaaggttagagaacctacctcacatctctctgggctcagaaggactctgaagataacaataatttcagcccatccactctccttccctcccaaacacacatgtgcatgtacacacacacatacacacacatacaccttcctctccttcactgaagactcacagtcactcactctgtgagcaggtcatagaaaaggacactaaagccttaaggacaggcctggccattacctctgcagctcctttggcttgttgagtcaaaaaacatgggaggggccaggcacggtgactcacacctgtaatcccagcattttgggagaccgaggtgagcagatcacttgaggtcaggagttcgagaccagcctggccaacatggagaaacccccatctctactaaaaatacaaaaattagccaggagtggtggcaggtgcctgtaatcccagctactcaggtggctgagccaggagaatcgcttgaatccaggaggcggaggatgcagtcagctgagtgcaccgctgcactccagcctgggtgacagaatgagactctgtctcaaacaaacaaacacgggaggaggggtagatactgcttctctgcaacctccttaactctgcatcctcttcttccagggctgcccctgatggggcctggcaatgactgagcaggcccagccccagaggacaaggaagagaaggcatattgaggagggcaagaagtgacgcccggtgtagaatgactgccctgggagggtggttccttgggccctggcagggttgctgacccttaccctgcaaaacacaaagagcaggactccagactcttcttgtgaatggtcccctgccctgcagctccaccatgaggcttctcgtggccccactcttgctagcttgggtggctggtgccactgccgctgtgcccgtggtaccctggcatgttccctgcccccctcagtgtgcctgccagatccggccctggtatacgccccgctcgtcctaccgcgaggctaccactgtggactgcaatgacctattcctgacggcagtccccccggcactccccgcaggcacacagaccctgctcctgcagagcaacagcattgtccgtgtggaccagagtgagctgggctacctggccaatctcacagagctggacctgtcccagaacagcttttcggatgcccgagactgtgatttccatgccctgccccagctgctgagcctgcacctagaggagaaccagctgacccggctggaggaccacagctttgcagggctggccagcctacaggaactctatctcaaccacaaccagctctaccgcatcgcccccagggccttttctggcctcagcaacttgctgcggctgcacctcaactccaacctcctgagggccattgacagccgctggtttgaaatgctgcccaacttggagatactcatgattggcggcaacaaggtagatgccatcctggacatgaacttccggcccctggccaacctgcgtagcctggtgctagcaggcatgaacctgcgggagatctccgactatgccctggaggggctgcaaagcctggagagcctctccttctatgacaaccagctggcccgggtgcccaggcgggcactggaacaggtgcccgggctcaagttcctagacctcaacaagaacccgctccagcgggtagggccgggggactttgccaacatgctgcaccttaaggagctgggactgaacaacatggaggagctggtctccatcgacaagtttgccctggtgaacctccccgagctgaccaagctggacatcaccaataacccacggctgtccttcatccacccccgcgccttccaccacctgccccagatggagaccctcatgctcaacaacaacgctctcagtgccttgcaccagcagacggtggagtccctgcccaacctgcaggaggtaggtctccacggcaaccccatccgctgtgactgtgtcatccgctgggccaatgccacgggcacccgtgtccgcttcatcgagccgcaatccaccctgtgtgcggagcctccggacctccagcgcctcccggtccgtgaggtgcccttccgggagatgacggaccactgtttgcccctcatctccccacgaagcttccccccaagcctccaggtagccagtggagagagcatggtgctgcattgccgggcactggccgaacccgaacccgagatctactgggtcactccagctgggcttcgactgacacctgcccatgcaggcaggaggtaccgggtgtaccccgaggggaccctggagctgcggagggtgacagcagaagaggcagggctatacacctgtgtggcccagaacctggtgggggctgacactaagacggttagtgtggttgtgggccgtgctctcctccagccaggcagggacgaaggacaggggctggagctccgggtgcaggagacccacccctatcacatcctgctatcttgggtcaccccacccaacacagtgtccaccaacctcacctggtccagtgcctcctccctccggggccagggggccacagctctggcccgcctgcctcggggaacccacagctacaacattacccgcctccttcaggccacggagtactgggcctgcctgcaagtggcctttgctgatgcccacacccagttggcttgtgtatgggccaggaccaaagaggccacttcttgccacagagccttaggggaccgtcctgggctcattgccatcctggctctcgctgtccttctcctggcagctgggctagcggcccaccttggcacaggccaacccaggaagggtgtgggtgggaggcggcctctccctccagcctgggctttctggggctggagtgccccttctgtccgggttgtgtctgctcccctcgtcctgccctggaatccagggaggaagctgcccagatcctcagaaggggagacactgttgccaccattgtctcaaaattcttgaagctcagcctgttctcagcagtagagaaatcactaggactactttttaccaaaagagaagcagtctgggccagatgccctgccaggaaagggacatggacccacgtgcttgaggcctggcagctgggccaagacagatggggctttgtggccctgggggtgcttctgcagcctcgaaaaagttgcccttacctcctagggtcacctctgctgccattctgaggaacatctccaaggaacaggagggactttggctagagcctcctgcctccccatcttctctctgcccagaggctcctgggcctggcttggctgtcccctacctgtgtccccgggctgcaccccttcctcttctctttctctgtacagtctcagttgcttgctcttgtgcctcctgggcaagggctgaaggaggccactccatctcacctcggggggctgccctcaatgtgggagtgaccccagccagatctgaaggacatttgggagagggatgcccaggaacgcctcatctcagcagcctgggctcggcattccgaagctgactttctataggcaattttgtacctttgtggagaaatgtgtcacctcccccaacccgattcactcttttctcctgttttgtaaaaaataaaaataaataataacaataatacgggggaaaggaacgaaaggaaaataa

SEQ ID NO: 680 - DNA, 2602 bp, Homo sapiens
tgaaatggagctgagatggctggagccagggtccagctagaggacaatgcccacgtggcatcttcggggccctggaggagggagtgggaggaggatgggaggggtgaggtgtcagttccccattggtctaggccaggtgttctgtggcggtccccacaccacacaagcacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccaggtgagtccttcaccactgtcaccctgccctgctcacaccccttctcaagccagacccctccacccacctcacattccaccaccggcctttgatccccaatccctaccactgggcatcaagccacagatgcagcctttcatatattccatgcctcagtttacccatctgcctgcctaacagcagacaatctgggagacctcctcagtattttgagaccccagggaatcactcacttgtccttagacttctccctttccaggcccatccttgagtccggactccctccccaaccctgacggggcggctttggctatgtgtacatggtgcaagtgcacacgtgtgagcgcctgcacgtgagtatgcgtgtgtctggcttcacacacacacctgctgagcatgcctgcgtgccagtgtctctgtgaggtgggggcctgggagtacttgtgtgattgaatattgggctccagtttttcttaccttgctcttgtggtttaaaatggcacgtgccggccgggcgcggtggctcacgcctgtaatcccagcactttgggaggctgagcggggccgatcgcctgaactcaggagttcgagaccagcctggccaacatggtgaaaccccgtcactactgaaaatacaaaattttagccgggtgtggtggcacatacctgtagtcccagctacctgggaggctgagggagaagaatcacttgaacctgggaggtggaggctgcagtgagctgagatcgtaccactgcactccagcctgggcgacgaacggcgtgagactctctctaaataaataaataaataaaaataaaatgacacttgccactgggcaggtgtgccctggacgagggaccccagtgcccaggcctcacctaccacttcagcatttctttcccatcccccatccccatcccagagagctttgggggctgggggaggggccatgcaacagcctcacaggtgcttcctgctcaaacggctctcttgccactttattttccccagagactctgctcctatcctccccacctccccctaactgagcagcagtcctgaggccctgcctcccagtccctccttgttccagatgtggcaaaatctggcaaaggcagagaccaaacttcatacctcaaactctggggggcggcgggagctgagcgagttggtctacacggatgtcctggaccggagctgctcccggaactggcaggagtgagttgccaatcctgccccccacctccctcctccaagggcaggcctggtgggtggagattcccactcagccgctcacacaacacacacactcctctaggactctggtccaagggaggggctggctgggatgaagtctgggctctggagctgagagcaagtgggagagcagagggccagtggacaaggtcaccttgtgaccttgggccaggggctttccctctctgaattccacaaatgcccagcatgtccagcttgctgtggagatgggtctctccctggctgggctcctgccaaaactgtactcctctcctctccactgccaccagctacggagttcgagaagtggaccaagtgaaacgtctcacaggcccaggacttagcgaggggccagagccaagcatcagcgtgatggtcacagggggcccctggcctaccaggtgatgcccggggcttggggataggatgaagctcctggagccttggtttgccccactgtgggctgggcagcatctgaggctcctgctgggctcccctaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctcacttcttttctctgcaaaaggtgcttgtggggctgggagtgcagacattggtgtttctgctgatgtcccttgtgaaaaaaaaaaaaaaa

SEQ ID NO: 681 - DNA, 11576 bp, Homo sapiens
agcgcagcgtcgaccctttgtggacgccgagtggcggtcgctcgccccgccccgcgccgtcgggcgctccttcctcagcggcgggaagctggcggcagcggcggtggcggtggctgagcagaggacccggcgggcggcctcgcgggtcaggtgagcgggcccggcggaccgctagggcgtctacggcggcgtgcacttttgtgctgcagggcgcggaggagcctgggggcggtgcgcggagtctgtggctcctggcgctgggtccggggcggaggcggcgcccgggaccaccgctggggctgccgcggcgccctcgccgccctcctgggcgctggttcccccgcggggtggccgctgctgagggggcccggggaacagaggggcccgggccgccgtctgcgttccttgcggagcgcggagctggggctttgccgaggcctgcgggcggccccacgcgggagccgcttcacgagggcccggctggggtacgcagcggcgtttcccgtacctcggctctagttgcagcggagggaacgccaggcgcgccgcagccccctctgtcggagcccggccgcggagagggccgcggatgtgggaggaggcccagaccccgggcgggtcggccagcgccgtcttccctgggctcctccggcggtgcgaggtgggactagggaaagtccccgagacacttgcagaagtcagacgcaagcctccctccgcgtcttcagacgcttctcgccccgcaaacaggatcgtcgtggcaaaggctccgacagcttgctggaatagagggtctccgctgcctcgcttctcctgtggccttcgtgtgggacgcacgggacggcgggacccagataaccgttctctcaaagcgagccacagaaaaacattgcctgttcacaaaacttacgttttatcaactttctacgtacaaccactctattttcaagtgtcaccgtgttttataattagggtggaaatccagaatacaaagtgagttacaccccttttctaggaagagtagtaggctgtatcttggaaaaggggctaggaagtttccctcaacttgccactggaacatgttttcagggaaaagaaggagtgtgtttcgttccaagtaacaaaagtacctgcaattggctgggcgcggtagctcacacctcccagcactttgagaggaggcctaggcgggtggatctcctgaggtcccgagttcgagactagctggccaacgtggtgaaaccccgtctgtactaaaaatacaaaaattagctgggcgtgatggcgcatgcctgtaatcataatcctagctatgtgggaggctgaggcaggagaatcgcttgaaccagaaaggcagaggtctcagccgagatcgtgccattgcactccagcctgggcgacagagcgagactccgtctcaaaaaacaaaaaaaaccaaatacctgaaattaacataacagtaattgttcatgaacagcctccaggagacttgtagtggaaggtggagctcccactcagtactcaagactgcagaccttgctcctcttctccctgtttttccgataaagtatttcaaagcttatctgatgtgtgaggaatggaaattgttgatgatttgcttaaaaacccgaaactttgaagtggctgcaagtccagctgtgaaggtgacaggttaggtcagagttgagtctgtccccaaccgtcccagccctactgatcagaatctgggaatctgcgttttcagccagcctcgtggtattgctcagccacgaaggtgtggccactgctgctgtagtgaaggaccagtccccgagctgtactctgcttgcctgagcagcactgcggggctgctccctgctggcctctgcctcggtgggcctaggttgctctgtccctagtggcctgttggctgttccacctgccatgtcggacatgtcctcagtccgtctggccctcttcgtttttctctgtctggtcggtgcttggtttagaagcctgagggcagtgctgggagttgactgagggcttggctgtcccggtaacaacctgtggagttggtgggattttaggcatttaactagatgtgtagaaagagcttcaaaactgagcagggggccaggcatggtggctcacgcctgtaatccagcactttgggaggccgagatgggcggattgcctgagttcaggagttcgagatcagcctggccaacatggtgaaaccccgtctctacaaaaaatacaaaaattagccgggtgtggtggcgcgtgcctgtagtcctagctactcgggaggctgaggtaggagaatcgcttgaacctgggaggtggaggttgcagtgagctgagattgcatcactgcactccagcctgggggacagaatgagactctgtcttaaaaaaaaaaaaaaaaattgagcagggagctaggctccacagccccaccggtatggtatagggccctttctcattccatattagaaggagttaagcagcctcaggcagaagtcacacaggaggccctcagggagctgggcccagcccaggcatccctcggggctggttaagaccatgctcttgctgactttgtcccaaacacagatataacccaattcagggtgatcctcacaggccagcttctccgggcccaaccttatcctcttcactcctgaacacatgttctgggtgacagctctttggggtcacgtgactgtaaaaagcacctgtgagctttactcttttttgtattaatagtaataaacttgtcagcattttaaaatattgggtacaacacagaattaacagctgctggagatttggaacattggagaggaatgatttgaagtgactgaacagggatattctcctggtaccagaatgggatctgtgcatgggatgagatgcagtggaggatgatggggattatctctcgtcccttgtagaacttgtgtaacccaggcacatctatgcaggtccctgggttacacaagtcctacaaggggcgagagagaatctccatcatcctggaggattctttctggccccttgtagcatttcccaccctgatggtggctacccttctgtgttttcacaacttagattagctttgcctgtcctgaaggttcagatcaatagaatcctacggtacatatttttgtgtgtgtcttgctgcttttattcagcataatgttttgaaatttatccgtgttgcataaatcattgaggtatgttgctgagttgcattcctttgtcagaatacaccagatcgtatacattcaacttgttttaagtgttttttttgtgtgtgtgtgttttttttttgagacggagtctcgctctgttgttcaggctgtagtgcagtggtgcaatctctgctcactgcaacctccgccttccaggttcaagcaattctcctgcctcagcctcccgagtagctgggactacaggcacgtgccaccacacctgactaatcttttgtatttttagtagagatggggtttcatcgtgttggccaggatggtctcaatctcctgacctggtgatccgcctgcctcagcctcccaaagtgctgggattacaggcatgagccactgtgcccgggctgtttaagtcctaaaagaatgcttgtggctgggtgtgatggctcactcctgtaatcctagcactttgggaggccgaggtgggcaaatcacttgatgtcaggagttcgagaccagcctggccaacatggcgaaaccccggctctattaaaaatacaaaaaactagctgggcgtggtggtgcacgcctataatcccagctactcgggaagttgagggaagatgaggcaggagaatcgcttgaacctaggaggtggaggttgcagtgagccgagattgcaccactgcactccagcctgggcgacagtgagactccatctaaaaaaaaaaagaatgcttacaactgagagtgatgaaactaggccaaggaccgccccccacctccccaggagcctctctggaggctcacacctgctggtcctgtccttgaatagacagaaaaaaggttccccctgttctctgaatttcttttcggtgtgatagatctcattgcctgtgcatttaacactcctaaattttataaaacgattatttctttggcatttatccaagagaaatgaaaaaccaatgttcatgcaaaaacatgttctagaatgtccatagcagctttatgtgtaataactccaaactggaaacaaggaaaaagttcccttcagctggggtgtggtgacactctgctccgtctgtgcctccagatcctactctgttgggaactgttgacacacaagagtttgcaaggatctcaagagaattatgctgaaggagaaaagccaacctcagaagggtgcttgctgtgggatcccatttatgccacattgttgggctgacccagagctgaagggtggcatggccagaaaaggacctacacagggaggccagggtgtctggtcctggcaggagagcagccgtggaacagggtaggaacacagacgtggagctcagtggaggagggaaggaacgcttagctgtggggcttagagacttggcaaaacaagaggaagctttaccagcaagtgtgcagaaatagtgcgggagaaagttggtggagcgttccaccttcttaggatgcagtttaataatgtttatcaagcctcttaaaaatgtacctgcacatcaccctagtaagtaaagagccgaggctaaggaagccaaatgctagaaataccaaaacacctaaagttagaaactggtatcatttgtgattgggaaaattgtcagtagtgtgaaacttccctcccttgtgcagagaggaaagtgctgggagaaacgactggaaaggaggaacccaggtggtgactgtgtttttctgagtggatgggatcctgggagaaaattcgttttatggtttttgatgctcttccagattgtctatggtgagctgtggaaataagcaaccaggtgagaacaggcagaggctgtttatccagagcttcccctagcaagggtgcggccctcctctctcgtgattggcagaaactcataggcaggtgagggaacaggagagctttacagtggaatccagggaagctcagggatggctgatggaggctgctgacttgggggactggggtggccagttagaagtggggctcctggcctggcacggtggctgacgcctgtagtcccagcactttgggaggccaaggtgagtggatcacccgaggtcaggagttttgagaccagcctgaccaacatggtaagtctctactgaaaatataaaaattagccaggcctggtggtacacccttgtaatcccagctactcgggaggctgaggcaggagaatcccttgaacctgggaggcggaggttgcggtgagctgagattgcgccactgcactccagcctgggcgacacaacaacaacaacaaagaagtggggctcctgtgagatggcctagaacatgtttggctttctctggttggtcctaaattggaagcagggacaaaaactggagaggttgtcggttactaatcatgtcctggccattttgggctgcttgctatggaaatgattgtttagcttcctggattgttcctagagaaagcagccaggcttcctgcaggtctgactagggcaacctggcttcctggcccgttactgaaggtaaagggctggtttccgactgatggcggcagataatggctgagagttctgtttctgtatgtggttccgccattgtttgttggtatattccctcgctcagagcagatgttattagggtgatttctgacggtcacgtattgctagtgctgcccttaggaccgctgacagcaccaggccaagcactgaattcatcctcttaagatccccagtgggaggcttctagtatccatatctggctttcagaaaagggcgggagggtctgtcgttgggtttggactcaggacctggcatttctaaggactcagaggaaaggaaagtgggacccagagggtcctaggagcttgggacagcttcttgaactggttcccagtgtggttgtgggtcttcttggcctgtcccattggtattcttgttccttctgtgagttgccctgattgccctgctcagtcgtgctgacctcctgtaggccccacattatgggggttgtgctgctgggtttccagagtcaggggaggcagccaggggttcttctgtctataaacttgggcttaatgcatgctgttcaagaggatttggtttgggtcctaaattaatccattgctatgcaggcttgggattgagataggttgaaagagaaactaaaaacctaaaaggtatattgacttcccacagaggaacccgtgggacttaatcttttccccaacgcagggtgtcctttgtagtttgacatagccttatgttaattctcgatatacttagcaattttaagccagtgatttaaacaatggattgggatggaaaagctctgaaaagttaaatttgtggctgacacaaagaactcgaatatttaccaaaagtaatagaaatgtgtaaatgtgttttggtggtaaactgtccttcatttagaattagttgagaagctggtgtatgcaggtgtgagaggcggtgcccagcctgagggctgtgcctgtggtgacactggcatgctgctctggggaaatgggtgctgtaggggaaataagctagggttagggaagttttcctttaattttaattttgaaataattgtagagccaggggaggttgcagagcagtgttcaggaggtcctatgtgcccttcctctgctccccagggccggcatccttgtaggatgcacagccaggccccaggtccgtgtgatgacacggctgccgcaggcgcatgtgtgcgtgtccggcgctgtgcagtcagggtagggccacccccacagcccaggagcagaagggccctcacccccaagatctccctgcgcaggttcctttctagccctgccacccctcagctctgggtcagcatgacaatgtggcataaatgggatcccatagcaagcacccttctgaggttggcttttctccctcagcctaatgcccctgtggaaggatccgtcctgtgtatcaacagttcatttctttctattgcagagtaggatttggtggcatgaatggagcagagtgtgtgtcaccgtgcccaggtgaagggtacattttccttgtttcagatttggagctactacaaataaagctgctgtgcacattctggaacatgttttttgcatgaacattggctttttctctgggataaatgcccaagaggtcacttagttttttaaaatttacatgtgttaaaggcacggggatgagatctgtgacactgaagggaaattcagagaacagggggaccctttcttctgttaattcaagggtaggaccagcaggtgggagcctccagaggggctcctgggaaggggtatgtttggcagccagttctcccgcactgcaaaacttcccatccttggtctccagaccccgagcagagacagcatgtgcctcccatacgccagctttccaagagcacctgggtataccctggtcacagggagccatcagattgactaagagaaaaagaagttccaaagtttgcatattcaaaagattgtaaccctatttatgcataacttgaattatttgaaataatatttcactacattacaagcatgagaagagagaaacttaatcatgcgtgagatgcttgtcctgtcagactctgccggccagtatggccctgagccagctgtcatcctcccagctccccgcaggcggcactggctcagaatggcatctgtcaaaagccagagcccaccctcctgtctgctctgcctttagtgccccagagatgtcccaatttagaatcagttaaaaaaaaaaaaaaacagtttgcacagacttgtacttctgagagtagacatggccaatgtccatctagtgcatctgtgctgtgcgtcttagtggaacctgcccagcaaggctgagccttaggtgccatcccggagttgcccaggtctggggtaagatccaggaatctgcatcttcaaccaacagcgccagtgctgaggcatacgccgagaaacactgccttggccagctctgggctgccacaacacactggtgaggaacccaccccccctgccccggacacacacataccctgccatgttttggttcctttgaagagaaaggagttgagatgagaggggaggtggcccctgaggccatggttgtacgggctggtcagagctctcgagtggagggcattgacctgagagatgtcaagtagaaagcagccaggcagagcctgtgcaccttgggagaaatgaactggtggggcgggtggggggagccaaggaatgggtgtgatccctaaggcaggcagcatgggcgggtgtgggagcaagggactgtccagggccacataggctcggccaggagaccctgtgtcccttggagaattgtgcacgaaacacagaccactcgctgcatgggatgagcatacagccctgcagtccttcccctgcgcgttcctggtggcacagctttccagcccggctgtctgcgacatatagaggcttttagtgaaagcattgagggggaaggcactaactcttctgaacgcagaagtgactttgtccgaggcaggatcctgagggaagtcagaatggtacgtgtgtgtgcccggccctgtccggcccccgccctgcgccctctgcaggctggcacggttcacattaatctcatgttaccccagggtctcttcttttgtacacaccacagttagatttttgaaacagattttcagccaagctctcgaacacttacatttctcttatatatttctcctatttttagttcatttatcttttttgctataaaacactgtcgtggtacagttgagaggtttgtcgtttctaacaacgtgactgtgcctggcttaggcaggatggcagctgatctgggggtgggggtctcccactgggctccacgtctcagctctgttagggagttacagctctgtcaagtccctgccagttacggagtcgctgctccttgcgtacagtgagggcagtcagacgaaatccaaggggcgctgtccgcagagagtctgccgtgtgctaagtggtgtcttccttggtttctgcaggacacaatgtttgcacgaggactgaagaggaaatgtgttggccacgaggaagacgtggagggagccctggccggcttgaagacagtgtcctcatacagcctgcagcggcagtcgctcctggacatgtctctggtgaagttgcagctttgccacatgcttgtggagcccaacctgtgccgctcagtcctcattgccaacacggtccggcagatccaagaggagatgacgcaggatgggacgtggcgcacagtggcaccccaggctgcagagcgggcgccgctcgaccgcttggtctccacggagatcctgtgccgtgcagcgtgggggcaagagggggcacatcctgctcctggcttgggggacggccacacacagggtccagtttctgacctttgcccagtcacctcagcacaggcaccaaggcacctgcagagcagcgcctgggagatggatggccctcgagaaaacagaggaagctttcacaagtcacttgatcagatatttgaaacgctggagactaaaaaccccagctgcatggaagagctgttctcagacgtggacagcccctactacgacctggacacagtactgacaggcatgatggggggtgccaggccgggcccctgcgaagggctcgagggcttggctccggccaccccaggccctagctccagctgcaagtccgacctgggcgagctggaccacgtggtggagatcctggtggagacctgagcaggagccctgagtgctcacagccgcctctgacgcattgacacgtgagcactggctcccacggagggtgcgcctgccgccagcggcccagccttgctgccctgtctgctgattctgagaaatcccagaacagcccattaccagtggggctgcagccctaggcccgtcccactcacctcccccctgtggagcgccaggcagaggctgttctggaaggcttcttgtcttctgacgtccccacagccctgggcccctcgtgtctctttgtgtcccccactgtagaggacggtgagccgcagctgcatcaacctccttttacctttagataggtgaatttttacaattcagttttacatgttttgggcagtattttgtcttaagatatattttttaaactttttataccttatctctttagattttttcagctattttcttaaaagtatattttttctataaacatcctttgctgctacattagaacttttatagcctaaacaattgcagttggtgtgtttcatttttttaaggtttaaataagggttttttgttttgttttgttttttgcagtgagcatcactacagtctcagtcaacagtgtgaatgtatcatgttttactttaaatgtgtgtgtgatacttcttcattatgtcctgcgctgcagtgagacctgggtgaaaatcaggagccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccatcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaatgggaatgtggtgttagttacgaccacggcctgaccctccagcaacctttctgcaggatcagttctgctgtattatctggtggtgctttctaaggtggggaaaggaattgcacttggctgcattaaatggacgctgggttacttttatttcccccccccacagggttgcagagcaaattctttttacattgttcagcgcccggctggagttgggggtgtccacgacctctgacagcccccgatgtcgaaagttaatcctcatggaccctagtttaaagggtatgtgttttataggaataaatctaaagcactattttgtttctgtatagcatttttatcttttagaaacatcatttgttcagc

SEQ ID NO: 682 - DNA, 6529 bp, Homo sapiens
cacaactcccagagtgctccgcgtccttgctttcgcctctacttgtgctccagggcgcacgcgcagccctgggagcgggttctcgcgcatagggaccacaactcccagggtgctccgcgtcctcgccgctgtcgccgccgcggagacaaagatggctgcgagtaagtgcaggttccggtggcgcacggggctcgggtagttctgggaacctctgggcggtcctgggactgaggtgcggcagggcaggggtggaagcgatggggtccgtgctggaggggaacgcagaagtcacgagggggctcctccagggcaggggtggcacgagagggttagaggtcaccgggggcagctacttgcaggggtgacgcttcttgccaccccttcaggagtcggcgccttcctcaagaatgcctgggacaaggagccagtgctggtcgtgtccttcgtcgtcgggggcctcggtgcgtgagtgctccaggcgcaaacttgcatcgtccacccccgtccccctacatccctccatcttgtacccctaaagccctatcgccgccctcgggtcccctctagtgtgtctgcacccccacggcatccccttatctatccccatacccattataacctctccaccatcgccccccgcgttcctctccacctacccaatacgctcttaacccctctaaatgagacgttctcaaccctgcttatgccttaacacctgagcaccaaaaaaaagtccagatcctcctcctccttttcatctttcctctcccccattctgaattgagttggcttgggtggaggtgggactggggaatctgtgtcttgtgaaaatccccgtatgatcccaatgtgccttgctgattgaaaatctctgccctctgccctggaactgccctactcacactttaattagcaccggagttcctgcagggatgggggcgggggattgttaaaatgtagcttttttttttgcgatggagtctcactctcacccaggctgaagtgcagtggcgcgatcccggctcactgcaacctcggcctcctgggttcaagggattctcctgcctcagcctcccgagtagctgggattacaggcgcccagctaattttttgtttttgtttttgagactgagtctcgctctgtcgcccaggctggagtgcagtggcgcgatctcggttcagtgcaagccccgccttccgggttcacgccattctcctgcctcagcctcccgagtagctgggactacaggcgcccgcccccatgcccggctaattttttgtatgttcaatagagacggggtttcaccgtgttagccaggatggtctcgatctcctaacctcgtgatcctcccaactcggtctcccaaagtgctgggattacaggcgtgagccaccgcgcccggccagcttttttttttttttttttttgagatggcgtctcgctctgtcttccaggctacagtgcaatggtttgatcatggctcactgcaacctccgcctctagggttcaagtgattctcctgcctccgcctcccaagtagctgggattacaggcgagcaccaccacgcccggctaatttttgtatttttagtagagacaaggtttcaccatgttggccaggctggtcttgaactcctgaccgcaagtgatctgccttcccaaagtgctgggattacaggggtgagccactgcgcccggccaaactgtaggttctgattctgtaggtctggggtggggcatgggattctgcatttttgaagagttcccaggtcttgtcagtactgctggtccaccagccaggcactaggttaaggttctgaacacttattcagtatggcagccaccagccacaactggccactgagcatttgaagtggtgctggtatgaattgaggtggtataagacactggatttcaaaaacttagtataacagagtgtgtaaactaccaataatcttttgttgattacatggcgaagtgatgttttggatgtactatggttttttttgtttgtttgtttttgtttttttgagacggagtttcgcttttgtccaggctagagtgcaatggcctgatctcggctcactgcaacctccgcctcccgggttcaagcgattctcctgtctcagcctccttagtagctgggattacaggcgcatgccactacacctggctgtttttgtattttcagtagagacggggtttcatcatattggtcaggctggtctcgaactcctgacctcaggtgatccacccgtctcagcctcctaaagtcctgggattataggcatgagccacctcgcccatccaagtatgtttcttaaaatttgtttcatctgtatctcttatttttactgtagctactagaagatataaaattatatacctggctcttaccatctgtcagacagcactggcctagaacattccttttatgaactgtaccccatcccccaggactcctggctcccaccctaaatggactgtggtcagtgactgttgtttgtgcaaccctttctcctccagtttgtaaggcttttttttttttttttttttggtgatggagtctctctctgttgcccaggctggagtgcaatggcacaatctgggctcactgcaacctctgcctcccaggctcaagggattcttctgcctcagcctcctgagtagctgggattacaggctcctgccaccacgcccggctaattttcgtatctttagtagagatggggtttcatcatgttgtccaggctggtcgcgaactcctgacctcaggtgatccgcccacattggccgcccaaagtgctgggattacaggcttgagccactgtgcccggccaaatttgtaacagtcttgatttctccagaacagtcccatgacactacccccaggatgctccatgatgaccctacactcaaacgtgctcattccatgaccaaccccactgctgcctcctccaggccccacgtatctgtgagtgttaggctccaacccctacctccacttaaccccccaaaaaagagttttaaaccctcctgtctataagtagggatcccaaggtaccaaggatcctcctggacgtgctggccctccctgctgccctccccctgcgcactttatcttccctttgccaaggctcaccttctcttcccctctcttcagagccaccttcccctgggcctcacccctgtgtctctccacagctgtaattctgcccccattgagcccctacttcaagtactccgtcatgatcaacaaggccacgccctacaactacccaggtgagtgggggccaggcagggatccccggaataggcccagcctccctgtgctggcgtaagggcagttatgggcaggtctttcctaagcagttatcagagattctgcagtggtgcccggaccccccgttccattttttaagaattgagatataattcgtatactattctgtgtttgtgcttcgtttttgtttttttgggtttttttgagacagagtctcgctctgtcgccaaggctggagtgcagtggcgcgatctcagctcactgcaagctcagcctcccgagtagctgggactacaggtgcccgccaccacgacacgcaaactttttcgtatttttttagtagaggcggggtttcaccgtgttagccaggattgtctcgatctcctgaccttgtgatccactcacctcggcctcccaaagtgctgggattacaggtgtgagccaccgcgcctggcctgtgcttcgagtttctattacctttccagatttctgtctctctctgggttcccatctgtggtggtttcttggtctccatcttctcaggtttctgtcctgtttccccatctcttttgaccctagctctctagtgcgcgggatctctccctcgctatctctctggttttccgtgtctctcagtctctgtatttcccgcctctttctgcatcactgattctctgacccttcccctctcacccctggggtcccccttccctctctgaacataaagcgacagaccagctcttctctccagggccctggagacgtgctggtctcagtggcccacctcctgccccacagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacccccgaacgtgagcatgtgtgtgatcagaggtgggaacaagtagacggtggccggggtgagtgtggggtcagtttattgggcatgcgtcagtcagaggctgggctggccagggtcgggtagggcagcagtttgtctggaccccgagaaacccaactggaatccagggcctcatctgcttcaaagccaaagtcttcctcaaccttaatctgcaggagataaggaacaaggtgttaacaggcctgggaatctagaaaatcccatcagcttcaccatttttgttttcattttgttttgctttttaaagagacagggtctcactctgttgcccaggctggagtgcagtggtgccatcatagttcactgcagcctctgcctcccaggctcaagtgatcctcccacctcagcttcccaagtagctgggactacaggcacttgccaaccaagcctaacatgttttttctttttggtagagatggggtctcagtatgttgctcaggcaggtctcagactcctggcctcaagtgatcctcccacctaggcctcccaaagtgccgggattacaggcatgagccactgcacctggccagcctcacagttcttgtctgcccaggccagtcaccttcctccttacacctcagaggcaatcccagtgttcctgggtccagatgttcttccagctttcctccccacactgggccttcccttccactccgtcttctctgatccttccttctcctctactcccagccttctctagctatttttccttctccaggtcttcctctttccctttccaactttgcctcctttttacccaagcctttaccccactttttccaactacttccctgcctgatcctaggcctccaacatgtcctggttcacctcccttctccaactttccccagccctgggcccctcggggtgcagaaccaaaacccaagagccctgaacctaactcagccccagccctggcccctccccttgagtcccccctccttacctgcactggcgccggctctggagccccagtccctccccttgagttcccgccttcctcacctgcaccggggccagctctggagtcagcgcatttcctgctcggcgtccatcccgtggcactcgccgcctcttccgcccactgggcccctcaccgggggctgggctgccgggttctgggggtgcaggagtccttctgggcggggacagtgtctctttctctggaggctcattctccgcattgcctggggtgggggcatccgtgccctggctgccctcatcctggcaggcaggagggggaggtaggtgatgggtgggtcctgagctcccagttcctgaccctcctggaggcccaacactcacctccagcacaatggtgaactggctggcccggtagtcatccccgtaggagtccagcactctcatgaggaacctgctcagggggagaagccaccaacggaataacttatctcctagcggctggggaaaagggccacaggatagagctcagctcccactccactcaacgccaaagctgtcctggagccagacggtcctgagctctggcactggaggcctgggagccatgcccttgaccagccttgagacctcgagcaagacaaggcaaccattctgaggctgagtttcctgctctgcaaacgacatgacaccctcggctggatgttgcagcggtgacactgaagtagtgacaccagacgatttctgtacttaatgtgatgtcagcacttagtaaacattcatatgtgagttataatttttattgataactgaagagaggggagtacagaacgctcctcctaatgacctcacctcttataaacacccccttctcttttttccccagcccctgcctccagagttccttaaggttcaattgatggaatgcctcctctgcaccagcacctgggcaggtttgttgttgttgttttgcgacggaatctcactctgtcacccaggctggagtgcagtggcgtgaatttggctcaccacaacctccacctccctggtaccagcgattctcctgcctcagcctcccgagtagctgggactacaggcgcctgccactacacccggctaatttttttgtatttttagtagagacggagtttcaccgtgttagccaggatggtcccgatctcctgacctcgtgatccgcctgcctcggcctcccaaagtgctgggattacaggcatgatgagccactgcgcccggcctatttcaacttaagtgaaaatctcacctgtggccagcggctaccgtgctggacagcacag

SEQ ID NO: 683 - DNA, 418144 bp, Homo sapiens
aaccatgtttcggaatagtctcaagatgctgcttactggtgggaaatcaagtcgtaaaaacaggtcaagtggtaagtgactatgctacatttattgtgcgtgatattttacaaatacaagttcttttagggtcctgaattaatgctgtaacactttattaatgcttaacttagaacttaaaagaaagtttacatttctttgggctttcatacgctttattaagaggtaggaacacttgaatgcgtatcaggaatagtcgaaagaaaggaaaaccttgtgaagaaaaatatttatttctaatatattagagagtaatgtttctgtgcatttgcttattaaaaaccttctagacctaagtttatgtttttgaattaacaaatgaaattattgcaatcctaggcactctttggggaaggaaattataaaaataactgtcctcaaagatttatacagaaagtgaaatataagttgaattttttatagccattaaaataaagtttatgggttttcttttttagaacaaggggttaagtcttaggcttttgaggtaaaactatatatacttccttggtaaaaaatattgaaaagaaatgtattagaatgtttgttttttattaatgagtggtagacttttgtattcttcgtaatcttctcaacttatttttctgcagtttataaatttatattggtactgtatttattgtcattgatttcaaaatgtttctgtaattccaattgtgatttcttcttgacccataagtatttggaagtgtatttaccagtttccaaactgttgctgattttttgtttatcttattgtaagaacaaactcccctacattaacaaaaggaaaactgttttttcctccactgctcacaccaacatttctggccaccaaatatgtgggttttttttttttttcctacagtgattcaattcagttctctggtagacaccaactgtatgtcctacaattcaattcaattctgacgctgtctaccctgagttagcacagaccctatgggttatggtctcagtcctacaagactgctttccacttcagacaccaattgcgtgtggtggatccccaggttacccacaacctctgtccgacttggctacaaatcggaggttcccatgacccctttctcaggttctatcatttgttagaatggtgcacacaactcatgaaaacagtttctttacaagattattggcctattaaagaatacagttcaggaacagtgagatggaagatgtgggtagggcaaggtataggggaaagggccctgggcttccatgccctttttgggtatgccgccttctcaacatcttccatgtgctcatcaacccagaatcccatcgaaccccatccttttgggtttttatggaggctccattatgcacatatgattaattcattggtcattggtgatgaactcaaccttcagcccatctctcctctctagaaatcagacggtaaggctgactctcatggtaggcctccctggcagccagcccctgtcctgaggctattcaggagcccccaggtacctatcattcgtctcgttagcatatagaaaaccacttttatcactctgaagactcagaagttttagagctgtgtgccaggaaatgagcagagacaaatatgtttttttttgttgttttgtgtgtgtgtgtgtgttttttttactacgtcatgcttcttcttattgaattctagcttaattatactattatcagaaaatctattctgtattattttattcttttgatatttattgagatttgctttacagttaatcatatggtcagttttggtgaatgttctgaatgtacctgaaaataatgtgaatgtcacagttactggattcagtgtggatcagttttgttaatgatggcactcaaacatttcatatccttacttaaaaaattatttactgagaaaagtgtgataaaataccacattatgattgtgaattttttttatttctcctgctagttcctgaggatttttgctttgtatgtttggaagctgtcttattaggaacattcgagtttaggattgttacatgttcctggtgaattgacctttttaaaaccactatgaaatgcctctctttatttctaataatgtcttttgtttaaaagttcatttttttctcatattaatataaggactccaggttttttttaattagtatttgcaaaatatgacttctttcatacttttgctttcaacatttctgtgtgcttatgctgttaatagcatatagttgagttttcttttcttttattcagacatttttttttctcttaagaaagtctttggtctgcatgaatttggtcagtcatatatttgggtatctgtgtgctgtctacttggcctatccattctatgcttctttctctcctatctttctttttcctctcttcctttcttttgtgttgatcaaaactttttttttttttttttgagacaggatctcactctgttgcccagtctggagtctaggggcacaaacacagctcactgcagcctcaacttcctttgctcaagcaatactcccacctcagcctcctgagtagctgggactacaggtgtacaccaccacacctagctaatttttttttaaattttttgtagagatgagatctcagtactttgcccaggctgttcttgaactcctggggtcaaatgatcctcatgccttggccttccaaagtattgggattacaggtgtgagccaccatgcctggactcaaaacattttttatgattccatattttcctctattaattttgaaattacatacccttttgaaattttttctgtggttacctaaagattaaaacaatacttagtttattgaagtttgatatttaattgatatgtttaccctcttcttggacaatgcaagagctttagattctcttcacctatctttaacctccacaagacattactgttctatgtagtcactgttacttagatatgcccatatatttgaccttttcattgattttcattccttcctgcacccctcactttctagatagaagtaactttatctgaataacaccctttgttttgttttattttatttttagagacagggttttgctctgtcacccaggctacaatgcagtggcactataatagctcactataacctcaaacttctaggcccaaacttcccttccacctcagattctggagtagctaggactacaggtgcataccaccgcacctggctaattaaaaaaatgtttttgtagagatgagatctcgttatgtttcccaaggctggtcttgaactcctagcctcaagtgatcttcctgccttgaccacccaaagcattgggatttcaggtgtgagccaccatacctggccaagaagactcttttagaatttactttagtgaggagtcatctatgacaaactttacttttgtttatctgaaaatgtctttattttgccttcatttttgtagatttttttctttttttttttttaagagatggggtctctctttgttttccgggttgaagtgcggtagttatttataggtgtagtcctaatgcactgcagcctttagactcccggactcaggtgatcctcctgccttagccacccgaggagctgggcctacaagtggatgctactcttcctggttacttctaggatacttttatgcgagtataattctagggtgcagttattttctttcagtattttacaacgttatttattgtcttctggcttcttccgtttttttctggtgatcagctgttagtctaattgctactcctttaaaggcaacctgccacttttctcttttaaggtttctagatttgtactggtatgcctaagagtatttttttaatctttatcattgaaaaaaatctttatattctggccaagtgtggcagtgcacgcctgataatcctagcactttgggaggccgaggcaggcggatcacttgaggccagaagttcaagaccagcctggccaacatggcgaaatccagtctctattaaaaatgcataaattagccagacgtgttggcacatgcctgtaatctcagctacttgggaagccaaggcaggagaatcgcttgagcctgggaggcggaggttgcaataagccaagattacaccactgcactctagcctgggcgacagagtgagaccctgtctttaaaaaaaaaaaaaaaaaaaaaaaaatctttatcatctattcatgcttttattcattttgtaggatttcttgactctgcggcatgatgtcttttgtcagttttggaaaactattacccattatgtcttcagattttaatttttctctcatttttttttctggaactccagttatacaattgatagaccatacgcatatcatctctgactcttaacattttctcttaatccttttgtctctatatgctttatgctggatattttcttttgacttaccttacatacttttcatacttttctttctgttcctcagattgtgtaatctcaattgacctatctttaaattcactgatttttttcttttgtctgctcaaatctgctatcatgtctactgaattttttttcaattattgaatttttcaattccaaaatttctatttgattcgttaaaaattttaaatctttattggtattctttatttggtgagacattgttctcatatttacattaagttctactgacatagtatcctttagttttttgaacatatttaaaataggcaatttaaagttgcttagtatctccaacatcagggcttccctcagagacaatgtccactgtttgcattttgccccttgtatataggtcatactttcttgtatctttgtatgtcttgtaattttttgttgaagcctggacattttagattatataatgtgttatctctggaaatcagattcttctcctcgccagggatttattgatgttgttttgattatttgtttagtcacttctctgaactaatttttccgagtctgtgttattgtgcatggccactaatgtctttgcttggtttgtttagtggtcaattcatactagacagacgttttagcaaaagcacaaattattacatactagacttttgaataactactgtgttagtagaaattatattattaaatccatacatgttaaggttctactgtagtattatagctaattcctttgattttctgggtatttagttatatcagtaatgatttttaggagtctgattctaatatttattccctggtttttcacacaaattgtttacaatttagaattattataaaaatagtgctttgtattgtgtatgcagagaattctatttgtagagaatcagaatttttttcatactaagagattattccgaggcaacaataaatgttatattaagagaaaatgtatttatggaaagatatcattagtgtttttattattacagtttttttccttaacccttaatgaataattgggtagatactttattctttatattaattgatggctcatggcttatttttggggttaataagggaagttttctcataggtatataattttagggttttcttttaaatcaacgtagtctttagtttaaaaagcatttgtaatgaagggaattatctgtcttaatttgtcttttaaatagctgatctgaatttttctgtgggccactagataaatatttcacagaaatagtttttatatcaaatttattaaaataagatatttatttatttattttttattctttaagttctagggtacatgtgcacaacgtgcaggtttgttacatatgtatgcacgcgccatgttgctgtgctgcacctattaactcgtcatttacattaggtatatctcctaatgctatccctccccccgcttcccaccccatgacaggccccagtgtgtgatgttccccttcctgtgtccatgtgttctcattgttcaattcccacctatgagtgagaacatgtggtgtttggtttttttgtccttgcgatagtttgcttgaaataagataaattttatctggcagagttttccccctaacgacatgagaatattagctttgaattttataacagttaattaagatttatgatgtgaaaattatttttttctgatgcttgtagcaagtactgtgaaattttcttaaaaaaaaaccgctgtgtggttcttttaaattaaatgagctataaagaaaatatgtttatattttctaaaagttcatatatattaaatgtttatatatattttcttatttttcctaactttatcaccttaaattatttaattaaaaaacttcaaatacgcttctttgagtcaagtaatgccgttgtttgatatcattgtgtcattgttttggtaaatcattattcaagtatgctggtgggggtggggagatactggcaatttcagatattcgggaattcagaaagattagtatcataagcataacatagcctttggagaatgtgtggaaggcaggagatagagaaacaaaagtgagcaaagtacgtaaaacttaaacacagataattgctgtaatgtactacaagaagtagaatttattccaagaatacaaagatttttgtacatcagaaaattaacagaacttttccaattagaaaaaaattttaaaccacattattatatgttgaaaaagtattttataaaatggtatagcaattaaaaacatcattaaggctgggtgtggtggctcatgcctgtaatcccggcattttgggaggccaaggtaggaggatcatgagatcagcacttcgagaccagcctggccaatatggtgaaaccctgtctctacaaaaaaaatttttttatggctgaataatattctgttgtgccacattttgttggtctgttcttcctttgatgggcatttgggttgtttgcatttttaatctgtgaataatgctgtagtgaacattggaatatgagtttctttgagttttttcatttcttttgggtatataggagtgggatttctgggtcatatggtaattttatgtttaactttttgatgaattaactgttttccacagtggctgcacacttaatattctttctgtcatggcataagggttccaatttctccacatccttgccaacagttgtgattttcttcctttttttaaaattatagtaggtgtgaagtggtatctcattgtggttttgacttgacttttccctaatgattagtgatattgaggatcttttcattaatgatcgttttatgtctttggagaaatgcctgttctagtcccttacctatttttgaattggattgcttgtgtttttgtcattcacttggaggagttatttatatgttctggatattaatctcttatcagatatgtgatttgcaaatgttttctcccataataggggttgtcttttcactccatggtcatgaggatttactcctatgttttcttctaagagttatggttttaactcttacatttaggttgttgatccatttggagtaagtatttgcatgtggtatgaaggaagggtccaaattcattcttttgcatgtggaaatctaatttccctagcactgttttttgaagagactattctttctctactgaatggacttgacacccttgcgttacttatagatttttagatttcattcatgttcctggttcataacagaaaggatgactaatcccttatcagtaaatgataaagataaatgatgaagatagtagatattttctaaattaaattttttattttttactaaaatgatacaaatgtatgggctgctataaatttacagttaactgatttttttaaagaactatttctttagtttcatttttaagtttttgttcactgttctgttgtataggattttagtttttatacagtgttttattaatcagctttaaattgatgcacatggaatacagggtcgtgtcctgagtgtcttctattcgaaatggttccccttaagcccaaacaaattctgaaacatttctttatctccaggtttccatggaaatcatgttacttttatactctccagtcactcctcagtggattcaaggttttctgttcagactagacatggaacgagtgtgatacaatttttttgttaacaaaacatctatttctagtgtaagaaaaacagttatgggtactaaacctcaaattggttagagattattttttaatgaaaaatgtttcttataatttatagagcgagtaattactagaacttgtgaacaatatgacagcagcagcagggcgcggtgactcactcctgtaatcccagcactttgggaggccagggcaagaggatctcttgtggccagagattggagaccagcctgggcaacatagtgagaacttgtctctaaaaaaaagaattaaaaaatagccagacatggtgacatgtagtcctagtgaggcaggagaatcacttgaccctgggagttgtttgaggttacagtgaactgctaatgcaccactgcactccagcctgggttacagagcaagaccctgtctatgaaaaaaaaagagcagttattttctaaattaaacgttttactttaaaataattgtagatttacctgcagttgtaaggaatagccaggcgccgtggctcatgcctgtaatcccagccctttgggaggctgatgtcggcgggtcaccgggaagtcggggttcaagaccaacctggccaacgtggagaaacccgtctctactaaaaatacaaaaattagctggcacacgcctgtaatcccagctcctcaggaggctgagagaggagaattgcttgaacctgagaggcagagattgcattgagctgagatctttccattgcattccagcctgggcgacagagtgagactctgtctcaaaaaaaaaaaataaataaataaataaaataaacaaaaaataaaacaaaaaaaggaataatatagagagatcttgtgtatatttgggttcccccagtggtaatctcttacaaaactgtatagtataatatcacaatcaggatattaacattgataacagttgagatactggacatttccatcaccacaaggattccttggtttgccttttaataacagtacccccttccctctcacacctgctcccttgttaacccctgataataactgctaatccatttgaaaaattttatcacttcaagaatgttatataaatgagttgtacagtatgtaaccttttgggattggctttttaaattttgcataattctcacaggactcatccaggttgtcgtgtatcaatatttgttgcttgttattgcatgtattccatggtatggttataccactgtttaaccattcaccctttgaaggacagctgaattgtttccaatttgtgctattttgaataaagttgtgaaaaatattagtgtacagggttttgtataaacataattttttatttctctagggcaaatgtccgggagtgcaattgccagctcatgttttaattgcatgttaatttataaaggaagtgccaactcttccattttacattcccaccagcaatgtataagtaattcagtttctcctcatccttaccagcatttggtcttgtcactatttttaatgttatttatttatttatttattatggggacagagtctcgctctgtcactcaggctggcatgcagtggcgtgatcatgactcactgcaacctctgcctcctgggttcaaacaattcttatgcctcagccgcctgagtacctgggattacagttgcatgccatcacccctggctaatttttgtattttttgtagagactgggtttcaccatgttgcccaggctgatctcaaactcctggcctcaagtgatcggccctctttggcctcccgaagtgctgggattacaggtgtgagatactgtgcctggctttatgttagctattttgataggtatatagaggtatctcattgtagttttttaaaataatttttatttatttgtataaatttattgagtataggtgtggttttgttacatacctagattgcttagtggtgaagtcagggcttttagaatatctatcacctgaataacatacattgtactcattgagtgattttcatttttgtaatggctcatcatgttaatcatcttttcatgtacttatttgctatttgcatgtctttggtgaaatatctcttcatgtcttttggctgtcttcaattggatgtatgtgtgtgtgtgtgttgggttttgagagttcgctatatattctagcctttgtcagatacatggtttgaaaatatattctcccagtctatagtttttgtttgtttgtttgtttgtttgtattttgagacagagtttcgctcttgttgccaggctggagtgcagtggcctgatctcagctcactgcaacctccccgtcccgggttcaagcgattctcctggctcagcctccccagtagctgggattacaggcatgtgccgccatgcctggctaattttttatattttcagtagagacggggtttcaccattttgaccaggctcgtcttgaactcctcacctcaggtgatccgcctgccttggcctcccaaagtgcttggattacaggtgtaagccactgtatagtttgtatttttaatcctcttaacagggctttttataaagcaaaagtttttaatattgatgaagtccaatttattgttttattctttttcttttttttcaagacagagtcttgctccattgcccagtctggagttcagtggtgtcatcatagctaactgcagtcttaaactcctgggctcaagaaatcctcctgcctcagcctcctgagtagctgggactgcaggcacacgccaccatgtctggctaatttaaaattttttttatagagacgaggtcttatgatgttgcccaggcagaagttttacttttattgatggtgtgtttaatttctgtcaacaaatatttattcattaatcattaagtactaagtatagtatgctggttgcttgatatttgagtctgggttaaattctgtgtaccccatgtacacaaaagtcagttcatctgtaaatacaaggtgttgttagaatcatgtgtgactgtttgtattagtccattttgtattgctataaaggaatacttgagactgagtaatataaagaaaagatgtttgtttatttggctcacagttctgcaggctgtgcaagaagcatagcactggcatctgcttggcttctgatgaggcctcaggaagcttttactcttaggggaaggtgaagcaggatcaagtgtgtcacatggcaagagtggaattgagagaggggtgtaggagctctttaaaacaaccagctcttacatgaacgaattaagtagaactccctcattaccatggggagggcaccaacccttcatgagctaccctcatgacccagatacctcttgaggccccatctccaacattgggggtcacatttcaacatgagatttggaggggacaaatatccaaaccatgtcactggaatttttttatccattgcatattgaacttagttaaaatttttattgcgctctgaataatgaatgctcataataaacgatgtatgtgcaatagtatgtaatgcaagtatttttatactagaaaaatatattttttcttccagggttctgtggtttgaatatgatgtgttcccaccagaagtcatgttgaggcatggtccccgatgtggtagtgttgggaggtagtacctttaagagatgagttaggtctttaaggtggattaatgtctttcttgtgagactgcattagcttttgtgagagctggttgttataaagcaggtcagcctcctttttcccctgtctctttcaaatgtgcctgcttgaccttctggtctctgccatgagttgaagcatcacgaggccctcaacagatgggccacctgatcttggacttcccagccttcacagctgtgagccaaaataaacctttcttctttataaattatccagtctcaagtattctgttatagcaacagaaaatggactaagacaaaattggtactgagagagtggagttgttgctataacaatacttgaaaatgtagaagcagcttgaaagtgaataatagattgtagagggaagaatttgcaggagcaggctagaaaaagcctgtattgccatgaacagagcgttaagggtaattctggtgaagacaccaagaaatccctaggactaggggaatctggaacttctttgagattacataagtggtcatgagcagaatattgatagaaatgtggacagtaaagaccattctgatgagatttcagaggtaaatgaggaatatcttgttgggtactggaataaaggctattcttgttagtagcaaagagcttggctgcaatgtgtccatgccctaggtctttatggaaggtggaatttaagaatgacaaactaggccgggcgcggtgggtcatacctgtaatcccagcactttgggagtctgaggcaggcagatcacgaggtcaggagttcaagatcagcctgggcaagatggtgaaaccccatctgtactaaaaatacaaaaaaagttagccgggtatggtggtgggcgcctgtaatcccagctacttgggaggctgaggcagagaattgcttaaacccaggaggcagaggatgcagtgagccgagatcatgccactgccctccagcctgggccacagagcgaaactccatctcaaaaaaaaaaaaaagaatgacaaactaggatttctggtggaagaaatctaagtagcaaagtgctcaagatgctgtgtagctacttctggccacttacagtgagctatgggagcaaagggatgatttaaagatataatttataattaaaagggaagcagagcataaacatttcaaaaattcccagcctggccatgtaaagaatgaaaaagaatgtttggaaagacaaaacaagagtgtgacctgatgaccagttactaaagagattagcatgaataaggagccaggtgctagtcatcaaattcatgggaaaatggtccccaaggtatttgagagaccttggaggctgtacctcccatcacaggcccagaggctgaggagggcagaatggctttaggagatgggctactacccaggacttcaggtgtctactccttgcatgccagtgtggtcctgcttggctgcaccagctgtgtggctcaagtggccccaggtgcagcttgactcacctctccaaaaggtacatgccatagattgtggcagcaacatgctgtggttcaagtgagcctagatgtggcttgtgccacagctccagaggacgcatgcagtaagcctggcagtgtctgtgtggtgctaattctgcaggtgtgcagaatgcaagaggtgtggaagagtgcttttcttcaagatttcaaagaatgttgtagaaagcccacaggcccaggcaaaaacttgccatggggtggagccaccacagaggttccctacaagggcaatgcctatgagggacttggaagtggggctgctgctgcagccactggcagcatgcaacactggcccaggaaagctgtaagcaccagtgtacaactctatcctgtgagaacagttatgtgggctgagcccagcaaagtcatgggagctgggttgcctgaggccttgggagctcacccctgcccaacagggggtattacctagagtgtccaggtgatggcacatagagcgaaagattattttgtgtgtgtatgtgtgtgtgtatgtgtgtatttttttaagacatgaggtctagctatgttgcccagactagactcgaactcctgggcccaaacaattcttgcacttcagcctcccacgtagctgagactacaggaatatgccattgtgcctgtccctggccgaaagattattctggagttgtaagattcaatgtctgctttgttcagtttgggacttgcttggggctgattactccttaatttttgcttctctcctttttggcgtgggaatatttacctgctgcctgtcccattactgtatctttgaagtagataacctgttttgatttcacaggcttacaggaggatgttagagttttgagtttgtgctgaaatgaaacatctttcaaggaagtatcaaaatgtggccttataacagaaaataaggattctgatttggtggcagaggatactgtgctataaaataaaatgtgactggagagtgaactaagtgctaagaactttgaaattgcatttgaaacaaatctgaactgactggttttgtttatattccacaaatttgtagcaattctgtaatagtgcttctcatcagatagacacatgtattcacactcatgtgttcatatctatttccattcatcctttttttattgttgttttaatattagggttttactaactttacaagatgaattgtgataatttctgtattttgtggtgcttctttatcatataaattatttattccttgaaagtttaatagaactgttaccagaaaggggtcccgatccagagcccaagagagggtttttggatcccgtgcaagaaataattcggggctagtccatagattagagtgaaagcgaatttattaagaaagtaaaggaataaagaatggctactccttagagcagccctgagggctgctggttgctcaattttatggttatttcttgattatatgctagacaaagggtggattatttatgcctctcctttttagaccatatagggtaacatcctgtcattgccatgacattcgtaaactgtcttggcactggtgggcatgtagcagtgaggatgcccagaggtcactctcattgccatcttggttttagtgggtttgggccggcatctttactgcaccctgttttgtcagcatggtctttacgacctgtatcttgtgctgatctcctatctcattctgtgattaagaatgccctaacttactgggaatgcagcccagtaggtctcggccttattttacccagcccctattcaagatggagtatacacacatttgcgtgtgttctgtatttcacagaggaaaaggacttttatgtgcattacctaatttaatctgtgtagcaaatatgtgagagactttataggtgagatattaaatgtattgcccaagattatacagctagtaggaatagaagccattgaattctcactgtatgtatattgctgtccctgaataaatgagacagttgagtggaattaagtctaaactgagacctggaaactgtcttttctttgaagtagtgactcagatgtaagagattttaagttgctaaggattataccagagcaacaagtagccaaaaatttggtggcttcttgtgctagagttgagaaatactttgagaaatttgtgtaagtttttgctctttgatttttttcttgtttttcatagaaacatattaaatatgtcagtttcctatatgttttattatttgaaaaatcaccctattagacattaaatgtaaactaaactaattaccattagtatttctccatggctttcctccttattaactgtgtgttaatacagttgatggtaatttttttttaagtatgctgtagaacattggtctcaatcattttaacctgcttatatgttcatacaatatttactgaaaatgttagggattccctactagagtggcacatgtgatgattagaagttggtgaatgaagtttcataatgtcttccggttgtggacgccttcttcatttttactatctttgggtagaatctttggagatgggtaagtagggagagagggttggaaggtagaatggaatgagaaatagtgaaggctattgaagaatttcagcaatgaggtgccaaatacagtctttaaataagagatcacggggcaggcatggtagctcacgcctgtaatcccagcactttgggaggctgaggtgggcggatcacatgaggccaggagtttaagacaagcctgggcgacgtggcgaaacttcatctctactaaaaataaaaaaattagctgagtgtggtggcacacatctgtaatcccagctacttgggaggctgaggcatgagaatcgcttgaacctgggaggttgaggctgcagtgagccgtgattgcaccactgcactccagcctgggtgacagagtgagaccctatctcaaaaataaaataaaataaaattaaattaaaataaaataaaataaaataaaataaaataaaataaaaaataaaatatcaacatgagttggttaggtacctatgtccttccatgattctgtaatatctgttgctggtgacctttgacttcgtatcctgtaaatctcccttttatttttgttcattcctttaagcaacattaacctcctcctactcgaggactcctatgcatgctgctccctatgcctagaatgttagttagctcccttacttcattgatatttctaatcagaaatcaccttctcggtgaagtctttccttgccaccagatctaagactctaaccccttcttcatgtcacctttttattttgtcctcccttttaaattttgtctctgtagcgattatcattattcatcttatatgtcttgcttttctgctttattatctgtctttcctactagagtacaagtttcatgtaagtccattctcttttacactgctgtatcctcagtacctgcccggcacatagcaagtacttagtaatatttgttttatgaatgaaaacattctttatgacattttaaggataactctggcatcagtgtatagaatagactgcagtgaggaaatactaattaagagacaatgaaaaggctcaagaagtgacagtaggaataaagagacagaggatacacaaggaagacatttttgaggtagactatataagatttgtttactagagtggctgggaagtgaaaagaatgggaagaaataatttgttctgaaatttctggttagagagactggcacactggtacattgcattgttccaggctcatattggatattcagtgatcatatattgaatgaataactattcagagataaaatgttaaacttttgcactaaattttgctttcaaatgtaatttatttagctctgtggtttatttccatactctgaatttctttgtaaattactcttattccaactttaggattatgcttccccaggacctcagaacaattttaaatgttacaagcctttttagcactgtactgcaatattttagcctaaagatttattccctgatcatctactttcataggttggtactttcaaagtttgctgcatccctccatgttggtaaagaaggaagacagaaagctatgtaaggcttatgcagtcagcacaagtcgttttgtgactaattctttcccatttaaaggaagttcattttcattctatttagtttcttcctatcctcaacttgtacaaggcacttgaaatttaaaatagtggtttcttagtactgattgaagtttccctggtaaaactactttcataaatgatcaattcacattttaacaacaatttttttaaagtattaagttaaacaatttaaactggtttagtttggatgctattgctgaagatcggttactgtaaaaatccaagtgtatatcagtatgccacttataattctacattcataaatttgagagtgcaacgaagaaaaagaaatattgagtaatagactgatttttgattctttaaaaaagggatttaaataatgagttaaatatatgattttgtccttaatacgctatttttcataggtatattttgatatagaacaatgtttgtgccaaattaaaatgataaattattttaatactgtcaaaattttcatctgaatatatttagatttttgttttcttagagaactttatttcaaagaaaaaaaacctcttgataacagatttgtgcttttgcaaatttatggtattagtctataccatctcatggtctccttatgataatatagttatgcttctgtttttttgagatatatgggaattttaatacaaacccatacatgtactcataatagtgaaaagttaatgatagaaccaagaaatgagtgcgatattaaagggagagcaaatgatagttttaaaattggtatgatacagcaatcatagactctttgtcctcaagggtctctagaatacatttctataaatgggaagcatctttcttacatattttattccttacgttaaagaaactcagtaaccaaaaatttgaccttaaaaacaagttccgcactcccccacctcattccattttcatagaattttttttctattctattctggttctatttgactccccagagaaaataggttaacttacttttttccagatttagagtgctctgacctagagtcatgattctttgagttgtcactaaaaatcttgccatcagaagtcccggttctttagaggagccccaaatggatctttaataccttaccgagatggaaaataagctggtcatgtctgtaaaccaagaatgaacaaggtagggtttgttttttcctttaatattaatttttaaatatttcacttgtgttatattgaaggaacaagtaacattgaaaatgttgtctttattattagaatgagacagaatgttttgcctgtataggggaagtaaaacttcacttctactctcagggtctccagctggacctgagaattaaattgacataagacagattaatagaggaaaagcatacagatttttacatgtatgcctccacagggaaatgatgacctagacatatatgtactaagttggacaaagagtagtaaattgtaaaaacataaaaagacacaggggcttgggctagggcagttaatcatggagaaatggctaggaagataagggcttgtcttacaaggttggttggttcagatttgcctcaactccccatctcgggtgataagaatatttcttttctccaggtacaggaaggacagcttttacattggagtttcatctccacttttcaggaagaaaaaggaaagtcagagtgcccttcttggatctgctggttttcaagtgcctttagttcaaaataatccttatgccaaagttacatgttttggggtagcatattctgccatctttcatatggtaactccatggctcaataactttctactgaaatgtcttttataaaactacttcatatgttctcaggccagtgttgttgttaaaagaaaaaaagggaaaaaggaaaacaattacttcatgtagtcagtaggatatatcagtgaaataatattgataaaaagatatatgataaagatataatactaattttatttatacaaaaaatggttttactattttacaggagcctatggtattgaagtatccttatgtatttgaagatttaaacttggaaaaaaatactttgttcatctcttcatacagttgattcagattcagcatacatttattaaatgtttattatgcaccatgttaagtactttaaccagagttatcctcatatattacacagcctacgttagcttgaaatgtgtataaaaatttgaaaattttgggattatttcctttttgttcactaaagattttatttttggactccatagttttgattaggaaagaacttggtaaataatatttataattattgtaaagctgcttagccagtagtctgtgccagaccaagagtgttacttggaacagaaatatctcttatccattttgtatccttggtctatagcataatgttttataatacatatttgttaaatggcataaattttctgagaaagtcataattattctggtcttatgttttgtgatttaaaaaaattagatataactagttttcaatcattttgaaataatttacaaaccctttagaacagtgctgttcagtacaactttctctgatgataggtatattttataaatctgtgttgtcttatactgtaatggaaagaacttatggctgcctccaattttggttcattaattcactccacagagattttttagtgcttactgtatatcagaaattgtgattcatgatggagatatttcctagtctcagggagctcaaagtctaataaaggagagagatttctaaaccaacagcaacaatatacttggaggataggctgggaggagaggagaatgcaagttgaattgtgaaggacaagttaatagtggtccaaatagagaaagcagcatttgctagtagatggagagaggagactatttggttcattccagtaactgcagtaattctttctatttctggtacctagggtgagtaagaaagttgctaaaaagaatggacagttaatcacagtaatcactcatcagttaatgacatgctttgtgtgccatgctaaagactttgcattatatccttaaagctgcaagtgagccactgcagggttttaaactggtaagtaaaaatcattttaacatctaagcttagtcctcttgaccccatatttattaaacttgaactttttagaggaaatatgaactttatgttaaaatttgaatttgattagatcccgtagagtctcctccctggtcagttttgttattgtggtagttaggatggttagaattactagagatacaatttaaaatactgagacattgaaggggatttatacattcatataactaagaattccagcagtagaacaattacaggtaaattaattctgaagctcaacagcatcaccaaagactcaatttctttctctctgccattttcagtgtattgtttattgttctcaggtttgtccttacatagctgcaagaggactgcagtaccttcaacttttacatccacacacagcattgttcatagactactagaacaactaatcccttcttgggtccctttttaagttaagggaaactttccagacagacaccccatgccaccccccaccccccgattcacctcacatccagttggccaggttatatcacttaacctttcttaagccaattaatgaaattgcaaatgttgttattgagattcatttactaatcaaagttcaacccctgagaaccagcctcccttgaagcaaatacctaaaataaagtcagcgttcttttagcatgaaataaaggattggataggcaactagtggagtctgccactttgtttttctaacctagttttgttttttttaatcttaaaaattagcagtctttctcataccaagagttagaaggacaagcccaaatttgcctaagataggaaagacaagaccaccttaagtttgttaataatccaaatattttgataagaagtttgcagaaatgaggagctgttgtagtataaattaatctttctgaggcttaccacttcgaagatcttaaatgacatggttcttgactgcaaagctgaggactgggccccaaactataggattttagtatcagaggcctgcctgggaaaccaaccagcagatcatcccagaagatagatttctatgattgttcttgaccaggggaattctcttctggaataggagtggatgggagatttgctcctatttaatttctttcctaaatgtataattttaatgacataaatcttttttgtacctgaaagaggtcaggtttttccaaactcaagtattagaaacatatttgtctacttttttgttgtcacctttcatcctaaccacagaaggcttggctggggaatgttctttgggagaaagagaatattgaagaaaaaatgatttttttcaaagtaaagcctggctatactatttgcttcaaaaatttacatcacacttcatgatcttagctctggtattattcatatactagtcactatagtcacttctttactcagaatattgtgttactttgctgttctactttgtttccattttaaaaaatggtcagaccattcagttttcctttctgttaagcttccagtggattcatgctctaaggatgaggtattattagatacttctttccttcctttctgtgttatttttccatccctgattatagggtgagcacttaatgtggaccaagtagagtattgggggacacagcttacttagaaataaaagagatagtctttgccagattatactgcctgtaataaataaaccagtattactaaaatatagtatgagaagtattgtgatgaaccttctacatggagtactaagggagttccaagggaaggactcaatctcagactggagggaaatggaacaattcttggaggaggtggtgactatcaccaagcctacatagcagttagccactttgagaaatggggaagaggatgtttcaggcacagagtacagcaagtgtaaagacgaagttgtgagaaaacttgacacattttgtgaactatatataggtagtttggtactgtggtggttcactcccatttcttatatctatttctttctgcatatctatttcattctcttgcaaccttgcacatttgttttagttcaaatagtagaacatagctaccaacaactgagttttgtatgttatagtccaggcacccagagaaggatactgattcagttcttttgttttcacatccataagctcatgggtaggtcaactccggtcttatttaggtctggtgtccaccctttgacaagtcagttacactttggactagggtgtggctgaggtttgtgatcatctcagcttgggttagctgcctatcccagtgcaaatcatctatggtagagggagggagtaaattagtatgggagtgagagtttttaaagggcacttcccagaaaggggcgtatgtgactctgagtaggcaaaatgacatgccatctgtaggagctattgcagcagcatccaggcaagagataatgagggtctgaactaagagcctggtggtggtatggagaaaagaatcgactgaactacatgattgattgggtgtaggtcaaatgaaggaagagccttagtcttactttttaatttacttaacaaaaatacttatcaagtgcttgctagagctactggagatacagcagtgctatatatcagatcactaaaagaacaacttgttctatactcacacattctgacaccagatgtgttccattaaacaattctccaactcttccaaaaccaactgagtatcctacaatttaattctgatgactaggagttagttagaccccacaggttgaggactagtcccacaagacgccccccacttagacactaattgccaagtctagacccttgtacttcttctgacctacaagctataatttctaggtgcccatggctccctccttgggttcagtaatttgtcagaacagctcacagaaatcaggaagacacttaacatttgccagtttattataaaggatattacagagaatctatatgaacagccagatgaagaagtacataggataagatctgagcatgggaactctgctcctgtggaattggggtgccccactctcctgacatgaggttcactgacccagcagctctgtcaaccccattgtttagagtttttatggaagcttcattatgtaggcatgattgatgaaatcattggccattggtgattgagctcaatctccagtccttttccgttccccagaagttggggtgggtggagctgaaagtttcccctgatttgatgattggttcctctggcagtcatcccccatcctgaagctattctggggctttcagccaccagtaatctcattaacatacaaaaagacactcttatctctcctggtagtaaaataccaaggctcttagtagctcttgtgtctattactgggtgactgagatcaaatattataataaaagatgcccttatcatcccaacactataagcgtttgaggaaactataagggttttagaagctctgtgtcaggaactgggggtgggaggcagaaccaaatagatgtttcctatgtcataatgatataactaaacttacattcaaggacaacaccatgtttataaaggaagtttctgggttaagtgactgggtgaatgatggtgctcttcatttgaggtttgggaggaaatgtaatgaattcattttatgaaatgtgaaatttgaggtgatgatgggttatccaggggatgttagatatttgggttatggacccacaggagaaggcagaggaagagagagagaattggaagtcatgaccatccagtggtaattgaagtttttaaaaactataaagtcgaatttacttttttattttggtgttcggttttatgaattttcacacatgtgtaaatgtgtgtagctaccaccacaattagcatacatcaccttacaggttacatcatgatattcgtttctggtcactctcttcccccgtccttcacctgggaaaccaatgagctatgaagatggttacactaaacaacagattttcaatgtagatgaaacagctttgtatgggaagaagatgccatctaggactttgttgctagagagaagtcagtgcctgggttccaagctttgaaggacaggctgactctcttgttaggggctaatgcagctggtgactttaaattgaagccagtactcgtttaccatttccagaattctagggtcctaaagaatgatgctaaatatactctacctgtgctctataaatggaacaataaagcctggatgacagcatgtctgtttatagcatggcttactaaatattttaggcccaccgttgagatctactgcacagtgctctgatggaaacattcaaggagattaatgttattctcatgcctgcgaacacaacatttattcttcagccatggatcaaggagtaaattttgacttttaagtcatattatttaagaaatacatttttcaaggctatagctgccatagatagtgattcctctgatggatctaggcaaagtgaatggaaattctggaaaggattcaccattctagatgccattaagaacatttatgattcatgggaggaggtcaaaatgtcaacattaacagaagtttggaagaagttgattccaaccctcatggatagctttgaagacttcattggaggaagtaactgtcgatgtgtgggaatggtaagagaactaggattcgaaatacagcctgaagatgcactgaattgcagtaatctcatgataaaacttgaatggatgagaagttacttacagatgtgcagagaaagtggtttcttgagatggaatctgtgtctggtgaagatgctgtgaacattgttgaaatgacagcaaataatttagaatatttcataaacctagttgataaaacagtgccagggtttgaaaggattgacttcaatttgaaagaaattctactgagtaaaatgccatcaaatatagtatcatttgctacagagaaatctttcatgaaaggaaaagttatttgatgtggcaaacttcatttgttgtcttattttaagaaattgtcacagccacaccaaccttcagaaactaccccccgatcagtcagcatccatcaacatagagaaagaccctccaccagcaaaaagatcccaacttgctgaaggctcagatgataacattttttagcaagagaatatttttaaatgaagttatatacatttctttttagatataatgctattacaaacataatacaaagttaatagattatagtgtatcataaacataacttttgtctgcactgggcaaacaagaaatttgtgtgactcgctttattgcgatcttcattttcttgcagtggtctggaacggaaccagcaaaatctctgaggtatgcctgtgtatgacctttgaagactgacttctttcacttggcataatgcctttgagattcatctgagttgttgtgtcaaaaagtactagcgagtgttcctttttattgctgaatggtatgccattgtatggatgtattgtttgctcatttattcacccactgaagaccatttggattatttccaattttaggtgattatgaatagagccactataaacattcatatatgggtttttgtgtgaacataagttttcgtatctgtagggctgatgcctaagaagtaggattgttggatcatgtggtagtatatgtttaactacacaaggaactgccaagcagttttccagagtagctgtacccttttcattcccaccagcaacatataagagttccaaatgctccacccacttggtagcacttgatattgtcaattgtaaaaaattttagctattctgtgtgtagtggtatttcattgtggttttaatttgcatttctctgatggctaatgaacgtcttttcatgtgcttgtcttccgtgtatcctgtgtggtgaagtgtcatcagatcttttgcccattttttatttggttgtttgttttctcattggtgtattttaagagttcattgtgtgctctgtgtacaagtcttctgttggatatgtgttttgcttgctttgtttattctcttaacagtgtttgataaagttcatttttctttttttaatggttcatgtttttgctatcatatttaaaaactctttggctaatcacaagtcataaagatttctcctgtgtttcttctgaaagttttatatttagatgtatgatttattgttttttatataaagtgtgaggttaaggttgatgtgtttgtttgtttttgtagggttgtgtaattgttctaacaccattgttgaaaagactacactttctcctttgaatagcttttgcactgttgttaaaaatcaattgactgtatttatttagatgtatttctgcactgtctgttctgttaactgatctctttgtattcttttgccagtactgcactgtcttgattactgtagctttagagtaagtcttaaaatagggtagtataattcctccaactttgttctttttcaaaattgtcgtagctattttagatcctttgcttttctatataaattttagaatcatcttgtctatctataaaaagatccttctgggatttggggtggaattacattaaatctatagatcaactgggatagaacattttttccatgtgggatcttcttttagtacatgaacatgttatgtctttccatttgtttagttcttccttgatatttttcatcagcatttggtagtttccagcatatagatcttgtacatgtttcattagacttacatgtaagttttttttttttttttttgagctagtggtacaatagtgccctcttgtccagaggggatacacaccacagcccccagtagattcctgaaactatggataacaccgaaccctatatgtacttatgtctttttttacacatacataggtacctatgataaagtttaatttataaattacgcatagtaagatattcacaacaataacaatagtaaaatagaacaattattataacaatatattatagcaaatataaatgtggtcttttctcgcaaaatatcttattgtactttattcatccttcttgatgtgatctgttgatctgataactaagatcactactaagcatatccaaacgactaacgggcatgtagggtatacagcatggatatgccagaagttactaacggcaggtacagtatacagcagtagatatgctggaagggatgatttacatcctgagcaggatggcttgagattttatcacactactcagtatggggtgtaatttaaaacttatgaattggtaatttctgggattttccatttaatattttctgaccgtagttaactgtgggtaactgaaaccatagaaagagaaatcacagataagggggtgggtggactcttgtttttaaaattttggtttcttattgtacattgcttatatttaaaacatatatatatataggctgggtgcggtggctcacccttgtaatctcagcactttaggaggctgaggcaggcggattacctgaggtcaggagttcaagaccagcctggccaacatggtaaaaccctgtctctacgaaaaatacaaaaattagccaggcatgctggcgggcacctgtaatcccagctactcgggagtctgaggcaggagaatcacttgaacctgggaggtggaggttgcagtgagccaagattgtgccactgtgttccagctgggcggcagaccgagactccatctcaaaaaataaaataaaacataagtatatgattttttttttactttgtatcctatgactttgctaaactaacttattagttctaatcgatgttttttgtttttgttttttagtagattcctttgaatcttttaagtggacaataatgtcttttgataatagggagagttttatttgttcctttccagtatgtatgctctttattctttttctcattttatggcactggccagcacttctagtacaatgatggctaagagtcgggggagtggtattcttgccttgtttcctgagcgttggctggggggaaacattgcttttcaccaataaatatgatgctagctgtagatattttatggatgttctttatcaagttgaagtagttcccctgtattcctagttttctagttttcttcaagtgctaattttttaaaaaaatactttttctctgatcaagtaataagatcatatgagttttcttctttgaaccgttagtatggtagattgcattgaatgattttcaaatactaaactagtctagcatttccaggataaaccccacctactcatagtttgttgttctttttctacattactgtattttattttctaatattttgttgaggatctttgtttctatgtacataaagggattttggtgtgtagttttctttttttggtaatgtctttatctggtttgacattcgagtaattccgtcctcataaaatgaattgggagtattttctgctcttctgttttctggaagaaattgtagaatttgttatttctttaaatgtttggtagaattcacctgtttagttatttgggcttggatatttctttttcataatttttttttaaactatagactttatgtaatagttatagcaatatacaggttactgtttaatcttgagtgagtttcagtagttattaagtgtttactaaaaaggtgtatttaaaagaccaggctgtgctatagaataactttatgaccttgggaaaggtactttagccttaacctctctgtccttaatttgttaatctgaaaaatcaaagttttagatttgtctttttaaaggtttcttccaattttttaattctagtggataagagtgtatgtgtttgaagtttatgtgaaaggactgtgaccctctgtttcttgttttatctgtcgtttattgagtgagcattgatttatttagattcactttgccttttatcagataagttccatatttcctcctaataaatgaattatttgttgatgaaaggtatgggaggaaggcctgtttatgcatttatacatgatatggtatgtaaaaaattactttcataagctatttatgtgagaaaattaagacatatcgtgttagtctttaatgttaaattttcttgaaaaaattatcagtttagaattttagaaatgttagaaatacatttctcttttggtgattgtccttctgaatcttcatgattaaaaaattcatttatttttggctacttaatagagacaatgtctatataagtattttttgcaaaatcatctggcatactcttgtgcattctgtccttttgttggattaaagcaaagtgaaagtagcatacagatttactgctgaaagaaacattaagttgcaggctgcagctggaggattttacgtaggcacctgtgggtttgagtgcgttcaatatacagactgcagtaggaggctggcactgactctgctgactccagtacactccttcactgctgttctgacaatttctccactgtccagaagacaaacaaaatggtgcagcacgtacagggcttgggaaaaagataaccgtcaatatgatccagaggtgagtttgctacagtgaacaggagagaaaattgttaacaagataaaagccttggatgtggttcagtatgtcagatgtcttcagctgttttaatatttgattctggccagtaaggatgaaactgttgtagttctaaaatcttcatgccctctatataaagaggttcaggtatattgcatttatagcattactagatgcatgcatggtagtttataaacatttatatttatactaaacatgtgtaatgtgtgtgtctatatagataggtgtttgtgaaggttatatctattaatactggatttttaaaaagtaagcacttttagtttttatattttctctgttgtacatttgttgcagctcctgccaatgtctctttccctatattgttcattttataatagcagaaaacattagtagcgcactctgtggtgagatatggaaaatcagtagaatgaaccttggagttggcacttcatattttattgatgactgtaatgcagtgtgagttcgcattgcacatagtcttgatttaaatgattacctcttttatgaaagcaaaatgtttgtaagaacggccatgttgtagacagggagcataaaataaaggagaggaagtaggacaagtaacatttctctgtccttggtttcttgaacaatgttcagcattgactcaaggcactgtcatttcagaagtacagtatagaaacaattgagcatcaagcatagatgaaacatggaggcttagtttcccaccccctccaaaagaagcactttacttatgtactcacatattttcggtttctgtggctgtgttactgggtagctgtccagttgagacgagatgtttacttaagccacacccagcagagtcagcttttaatgtgttgggggcactattttaatcctgtgctgatttgtaaccatcatctatgggatgcctttgagttgtaaaaagagggaaaatactagattcacaggttgcagcttactatgtttttgaatatttgagttgctgtattaatagcacagaagagcagtatttaagttatgcagcatttatctatggcagagagagatagagaatatgtgtatggttccattacaagtgtaatgcaagtattctgatcatatagctaaaaatgctgctggtatattattttagttagtgttgtgggtagtaaattggagtatgacattcagagttcagattttcttatttgagaaaatatttgtccaaacattttaaatacttaatttttctgtgcttttaaaagatttgcaaaggattcagcctgagcttagaaatgtataatgttttattccatgctaaagacattttgtatgtgataagaattaacaactgtatggctggctggctgccactgtgttggattaccttacccaccttactgtagacaaaaataataaggattcagcactaatcctagtagtctccatagtactcatattgtatattttcagaaactccttttttatagccaaagcaaagtgttctccccaaaaagaaaaaaaaattaaaaacaaatctctcatttgtactatatttctttgattttatcgaataacacaaaagagtaatgtgagattttttatgtcaagtttagtgacagtaactaactacagattgaaatatactatattattgaaatgtttcatggatctaaaatgttatataatcctgatggaatgttgcagatgaaacaaagaaatctgattggttcctcacaagatacagcagcctcgaaatccattctaactagaggcttctacagcagcctgggtggttagtatcacataaaaacaaaaatgcctcggagatgggaaggggtttggaagagaaaatgaagtcgctaaagcacttcagtaatcttaatcattgaacattttttttcagcttctctttttatttttattttttgctttgcttgttgttgcttaaagggagtgttatattcaatcgagttaatgaactttctaagtagtattctgtaatgaactagaagagtctctctaaaaagagttttatgttaactgatagactgggttaatgaataacataatttcagaacacttatgaaatatgaatgagtgggacttgttgggggaaggagatggatgagatggaaaagagctctgaagagcaggacactcatagtaactctttggtcccaccctttcccatcatattaaaattgcattagataatttgtcatctaagactttagtgatgcttggtgagggcacattgttattgacacgcaaacagcaggatgctgcaagtcagaacaggtggaaaattgtttgctgtctgctagctattagaaatacccttgagatgtgagaataatgtatgttagcttttacgtatttattattcttggctagatagtctgctggaatatagttgcaaattatagtaccaaatattcaacccttctgtgcgtttacagaaaatatttaaaatatgcctgtagtttattctactaaaatttgaaaattcttatatttaaatggtaataggtcaaattcagttataggatctgggggagggaaagttactgtgagcaggaatgagcatttacattaaaagaatgaataatattgaaaggaagtaaagcatcataaaataaagcatattaaagaaaatatatatagatatgtcctgataaaagtcaactatattttgtagtttctgttctgtgcttattttctaaattatccaatatgctaatagagtcaggctgaaggcagctggctgcaagtgttacaagctgaaaacaaaatggctggcaaggattactactgtaaatttgcaatagagagctggatgcatttaagatatcttttgttgaaagagtgttaaaaagtaagatgatgagggaatgactgttgtataagctgtttttgacaataaacattgtattaaaaaatactcgattacagcatgaaaacaaaaggctttacattcattttcaactaagcaataaaaaactcttgttagtatttatttagccatcattgtctttgtaattttaagacctaagtagtttctgagggtattgtttatgaatcgttcagattcacagtgtggttaagggtagaagaaattaacagtgaagaatttgttacattcttggaatggggaggtggaattgagagctaagtttctgggagttttatatattttttaatcttctagactagcctacattaaggatggaagacatagagtaactggaaaacttagagataaaaatgaaaatatagtttacaaagtaacaacatccatagatctgtattttatttttttctattgaagacctgttcataaaactatttgtattttagaaaagacttttctttgtataaccataacctatttcaattgatttttagcaattgttgaaagattacatgacatgaaaattgttgataggcttggttagattgagaaatagcttcagcaattaattagttaagtagattgaagacagcacatacattcacgtatcttgtctctcacattgtaaagtctatgtactttaagagggcaaaagtgtaaatatgttattgccacttctctagcacatagtataatgccccatcacttaatgggttctcagtaattgatgtacagataataatcacaaacatgtttgattagtattcacacacacatatacgcatataaacccatacataattataaacccatatacatacatatataaacccatacataatgatgctgatttaattttcacaaccttgtggaataaattctatcattttactcatttaacagatgaaaaaactgaggcagagagcaagaagttaagtgacttgaccaaagtcatatagtaaatggtggagtcgggacttgtactcatgtactttgaactctttcatcatcttttcctctagtaattgaagattaagctgtattagcattcaacagtatctttagccctcagaagcatacattatatgtatattctggcagaaactgcaaagcagagaaaacttttctgctacatctttcaaaattgctttaactgatgttttgttttctaaaatcccttttcaatcatttagatgtagctgatggccattatcatcatcagctaatgcagatgtacagttctgaaagcaatttaaaagcccatagcaggtatatacaggaagcagttggaaaaatatattaagttttctgtactccccaaaatggctgccaacatctatcagtcatcaagcccagttgattaaaacttctgtgtatttctgaactttgtcttctctttacttcttcattctcatttcttcagaatctcatgtcacttaaattattgtgtctccaatctcagtaccctttagttcattctctattttgcgttaagaatgaattttcttaaatgttcatctgatttttctaatatgtgcattccattagttctccaaataaaacatggcttggttttttactggttctctttgctgtaactgtatcctaacacagatgcacacagatatagataatatatagaccagacagatttagaatttgattttaaaagattaatgtttgaatctcctttatcagagatgaagattatcagtataaatgtatccatgaacgatttttgtttagtattgtgtgttttaaaatataataggtggtatcatttcctctatgtcattctgcaacttgcttttttgctcttgttagaaacttagtttgtttcttttatgtattgtacagtatgtttcttttatgtattgtatagtattctattttatgagcccatttcttccatccatttccctcctaatatgaatttgaattttctggtcttttttgtgtgtgtgatcataaataatgttccagtgaatatccttacccacacattagtttttctaggaactatacctagaaatggacttgcaaatgtaggttatttgcattatcacttttactacatgatttcattactttgtcactttaccaatttatattcttagaagtgtctgagagttttttctttttcctatccagtagtcatatggtcagatttcttcctttttctcagtctggtaggagaaaggtaatgtcctagtgatttaatttgtttccttaatttatagtgaggttgaacatcttttcatatgttttataggcctttagagttcctcatttgttaataacctctttatatcctttatgcatttttctgttggattatttgtctttttcttattgatttataggaattctttatggattctgggcaggttcagcaaactgtagcccatgggccaaatccagcctgtgtggcctgtgagctaaggatggttttcccatttattttccaatcattccgaaaaaaaattaaaggagaataaaatgttgcaacctatcaacattacaaaaaattcaaatctcagtgttcttgaatagttttagtgagatacagacgcactcatttatttacatattgtctgtgcctgcttttgcaccacaatggcagagttgagtagtcgtgacagggagcatatgctctgcaaagcctaaaatatttactttctttatagaaaaagtttgcagacccatgttttagattgatccttagcctgtgacatttataacaggtatcttctgtcagtctgtacactgtcttaaaacgttccctttggttttaggacggaaactccaaacttctgttaaatagaagtttaaaatttcaatttattcaaatctatcattcttttttatactacgtgttatttcaggaatctttctttactcagagactacaaatatattcttctatatttgaaatagttttgaagttttgtttttcacttcgatatttttaatacatttggatttttttccttttttcttattgttttggtaaggggattatggtatgagaaaagggtctaatctttttttctcatgtggagaaagccaattttccccaccatatttgttgttgaatacccttttcttacatccagtgatttatcatcccagctttctcatgtactaagaatctgttatatttgcatatgagtcttttctgggttcttttattcagttctttccatattctttttatttaaaaaaattatttttaaaaagtagagatgggtgtctcactatattgcctaggctggtcttgaactcctgggctcaagtgatcttcccacattagccttccaagtagctgggactgtaggcacacaccatcatgcctggcttctctctttattctttgattaaatatttctatattctatttggtcataatgattctcattatccaactacttaatcattgtattcacttttcctagttccttgggagaaaaatacaaaatgtaacactcaagaactttactaatgataagtttagggaaaggaatattgttgttaaattttgtatattgcatatacaaaggtcatactgttatctttattaaattctttttttttttgagacagagtctcactctgttgcccaggctggagtgcagtggtgcgatctcggctcactgcaacctccgcctcctgggtttaagcgattctcctgcctcagccttctaagtagctgggactacaggtgcgtgccaccacacccagctcttttttttttttttttttttttttgagatggagtttcactcttgttgcccaggctggagtgcagtggcgccatctcggtcactgcatcctccacctcccggattcaagtgattctcctgctgcagcctcccgagtagctgagattacaggcgcccaccacaatgcttggctaatttttgtatttttagtagagacagggtttcaccgtgttggccaggctggtctcgaacttctgacctcaggtgatccacctgccttggcctcccaaagtgctgggagccaccacacccggcctttaataaattctttaacatattttaatctcaaatttctagtttcattgccattattattataatcaagtaatatagtacagattaagtacccacaagtgcatggtattatgctaagtactttaaaaaacatttatgcataaccagtaaagacaaaatattatttaggcataatgggatgaataaagtataatttatttgaaaaaacaaatttgaggaatatttacataatatatgattatttgactttgtattactttgattttccagtgagtgtctatatatttgaatttacttatcagtcaaaacagaaagaggttgtgtttttttcttggaagtgaaatggagagggggagatctgatttttagtctatcagtagctgtctctctatatagggagtaagaggtttcttgtgaaccatgtgacataaaaatagcctattactaatatcttttgaaatttttatatcttcatatacgaaggcagggattttaggtgaaaactgttttatccccactccttaggtatacagtagttgtttttcaggtgtctgctttagacatctgaaggtagagatcagaaactgaaagaaagccaatattagaaaaacaaaagtagatccaattagaaatgaagctggaaaagtagaaccttatagatcgtgttcaattttatatcttctgacgggagaacatttaaacattctaagtataaagtgaggtaactgttagatttgcatttctaaatgattactcagttatttgtggatatatgttgagaagagaatggatataggagtggatgcaggttggagatggagacaagtggatggattcaagagacatttaggagagaaaatcagtaatatttgatgatgaattcattgagatggggagctctgttggagagtatcaggtttgaagggatgaaaggaagtttagaatttcatgtttcgatactttgagtttgaggtatatttgagacatccaagtgggtatttcaaaaaggcagttgttatatagacagacttttccaatttatatacaaataaatgaataggggctccctagtagaataatggatttaaaagtatgtagaggaagaaaaatatcttttcttcattcatcactaggttcatgacggagacccctaaaacaaaagacagatttgttaacaataaaaaaagcatacaaatttacttaatgaattttatgtggcaactgaagccttcataaggaaatgaagacctgaagaaacgggtaaatctgtgtatttttaatgttagatttgatgaataagtggatagctgtgaagaagtgtgattggataaaaaagtggaattttatggtagtaaactggggttggggtgtgggagtccttagcaagactttttatcaggattcttttctgtatccctctgtcttcagagataaaggcgtttctttaccccaggtataggtaggacacctcttgaatgagggtcttatgacctgctttaggagaagattaaaaaatcctttctaggttttaggagtctgctttaggaagaagtgtgaggggaggatgagagtgatctttctgcttctgttctgttaaatgccaaggtaccatattttgaggtatcatgtcctgaactccatcaagtaaaacataaatatttgggttgagtattgagaattattgcagaactccagtttgagaacaccttatttgttttttggaaaaacaaaaagggttagacaatttcacttctgactgttcatgtttccctccatctagctctagacctggaattaatgaggtgctaagtagggtagttatacatttaagtctttaatccatcttgatttgatttttgtatatggtgtaaggaagggatccagtttcagtcttcttcatacggctagccagttatcccagtaccatttgttgaatagggagtcctttcaccattgcttgtttttgtaagctttgttgaagatcagatggttgtatgtgtgcggccttatttctgggctctatattttgctccgttggagctggaggccattatcctcagcaaactgatgcaggaacagaaaaccaagtactacatgttctctcttataaatgggaaataaatgatgagtacacatggagacaaagaggggaacaacagacagacactagggcctacttgagggtgaagggtgggaggagggagaggatcagaaaaaataactattgagtactagccttggttcctgcatgatgaaataatctgtacaggaaacccctgtgatacaagtttacctgtgtagcaaacctcacaggtacatctaaacctaaaataaaagataaggagagtaagtcagattttaaatttagcccttagtaaaacggaatattatttctccttcccaaccctccatcttctgttctcttaatggtattataatcaagcaagtgaaattcccaaattcccaaagaattctgaggcatccagaattcccttctttctcttgttttacttatgcaaattaattaattcaacagctattttttgagtaccttctatgtgtcagatactattctaggcatggctaataaagcattgaatataaaattatttgtcctcatggaatttatattctagtgggtgaagatgaccagaattaagatgaataggtaaaacatagaatatattagtgataagtactaggtagaaaaataaagcaaggaagaagtaaaaaatgtgtatctgtgtgaatatggtggtggtggggtaccattttagagtgatgagggaaggcatgattggggggacagttatgtatctacccaaaggagatgcaggacaagccatgcggacatctgggagagaagtatttcaggcagaggccttgatatgagtatattcttagagtgtttaaagtacaatgaggagagccagcatgcttcagaaaagtcagagagcaagagtggtaggagatgaggtcagagaggtaataggggccaggtaatgtagagctttgatctaaagactttgacttttacttacaatgagaaacctttggagggttttgaggagaagagtttaatgatctattttgtgttttaacagaaccattctggttgcagtattgagaatagattgaagctgggctgggatggaagcagagaaaccaggttagtcatgagggtggctgggactcagggtggtggtagcagagggtgagaagtagtttgggtatatcatgaatagctgacagcatttactgttggattgtatgtgcagtgggagagaaaaagaggacttaaggatgactccacggtttttggcttatacaaccaaaagaaaggagttgctgtttacagagatgaggaagactgtgagaggagcaggttcctggaggactattaggacatgttaaattttgagatacctgtgtgatataaaagtggaaatgaggctgggcacagtggctcacacatgtaatcctagcacttggggaggctgagttgtgtggaccacttcagcccaggagtttgagaccagcctgtgtaacataacaagaccccatcttaaaggggccttaagcataacctccaaaataaaaattagccaggcctggtggtgcacgcctactcaggaggctgaggtggatagatctcttgagcctggaaaattgaggcttcagtgagccgtgatcatgccccagcacttcagcctgggcaacagagcaagaccctgtttcaagaaaaaaaaaaaaaaaagaaagaaagtggaaatatagggtaggcaactccataaatatgaacttcatggatgaggtccaggttagagatataaatttgggaaccatcagcatgataaaacataaaaccatgagtctatttgagctaaccaatggaatatatatggcaaataatacagattaaaaagtgagccctggggcagtctatcatgtagagactggggagatgagaaacaataagccaaggagacagaaggagccctagagacaggagcaaaaccaggcaagtgtgacatcttggatatcaagtgaagagaagacttcaagaaagaaacattaactgcatcaaatgttgataaatcaaaaaataaaactgagaactgactgttggacttaacaatggactttataagagattttggtaattgtggattatctggaatgatagggacaaaagtcttatgggagtggatttaaggaagaaaggaaaaataaattgatggcagcgattaaaatgactctttcaaatgagtacagtctttgcaattctgtgtcctaaatatttcacaagcctacccttttcttcatagtctcaatgttagtgcatttatttaggctttcctttcctctgagcttatggcagtgatctctttacttttaggccatggtccacaccattgacttaaatatatagttgccaaggttatcttttgaaaacacctgtcagatcatgccactcctttgcataatgcccatcattttcttccctacatttatagcataaagttcaaattgatcatcatgaataatatttatgccttttgtgattatgctttttatgattatgcctcagcctacttttctagtttcatatcctgcttcttacccatactttctgtgttctagttacattgaactctttagatttctctaagtgaccttttctttcatttgtgtctttgcaaataaaatctggtactgttcctgaaaaccctagctcatacttgagaagctgtggcttccctgaggtgtaggttaatatgaagaaggcagaggctgttctagcttttagagtcttaggaaaatgatttatttagttaatttgtttatttatctctggtattatctgttgaaactgtatgttgagggggatacatgtggatctcacttttggctgcatatagactgatccaggaatccatggatcagtcaaatattcataaattaaactttattatagctatgtatgtataaatggttcctgacttaggatggttgaatttaaatgatcttccaactatgattgtgtgaaagtgatgcatgtatagtagaaactgtactttgagtacccatacaaccatattctttcactctcagtacagtctttagtgaattacatgaaacagtcaacactttattagaagatagtgttatagttttaaaaaatttgtgttaggtgattttgcccaactgtaggctaatgtcagtattatgagtacatttaaggtagagtaggttaagctatatgttctgtaggttagttgtattatatgtattttcagcttatgatatcttctacttacaatgggtttatcaagacataaccctgtcgtaaggtgaggaaaaaacatagtgcacatcctgcagataaggcgggactgttgtatgaataacgtgctgaagaagcacagaagagagaagttctttctggtaggcatccagaaagtctatgtaggaagaggaatgacatctttcagtaaaaggaacttgttgttgatcatgaatatgatagatgaagattccatttgtttagtatgtgcttactttgtgccagatgtcgtcgtatattttgtgaatgttactacatttgtttctcacaaccacatagagcattatgataacaatttcacagataaggaaactaagatacagataattaattttcctaaagtcatataaattgtaatagttcaaagattgagtccagctcaactctgctagacacccagcacgtacatattggctataatttcattatacagtcaagtggagggagctacattttatgcagaggagagagcataaattgatagcggccttataatatgtttgctttttgaatgtcattgagtagtttggtgctaccatagtataggggagtatattatttaggatttttatggttgcaagtaacagaaaatttgaatcagaatagcttgatataaggggttagcaaactttttctgtaaagtaccaggtagtaagtgttaacttatatcctatggtttattccctcttggtttataagatagcagccagcatattcaggggctccattgatcttttcccatgtttagggagatacataatcttttccagaatttctttctaatcacttgaacttaatcccatctttgttacaactactgaactctgccattgcaacacaaatacagtaaataatttatttgctgttatgactgtgtactaataaaactttatttgtgaacactaaaacttgaatttcaaatattttttgagtcacaaaatattgttttagttatttgcagtcatttaaaaatgtataaactattctgagctctccggctgtgcaaaaataggtggcaggccagatttggctcgcaagagtgtgctgacctctggtttttatgatgaagataatttattagattgtataactctagtccagagatagggtagttttcttcagtaattcagtgtcaacaacatccttgttatgttccatctcttcatataatctttgaaagtgttaatttatatctcatggtttattcccttctgtgtttacaagatggcagccagcatatccagggacctaccgtctttgtccatgtctagtgagagataaaaccttttccggaagttctttctaatctctattgaacttaatcccatcgggtttcacccctgccactccacagagagagaccatgctaaaccatttacactggctgaatgcagtgatcaattctcaatcttcatattacttgacctatcaatatttaatatttgatcttttccactccataaaaccccttctttgtttctatactctccttgtcttgttcctattctcacagtattctccccaggctttcagcctctacatgttcgattccacaccaagtcttagtcctctgacctcttttctctctttttgtgtctcattcttgtatatactctttccttggggatctcatgcagtttcatagtttaaatgggatttatttactaatgatttgtgtgccgatggcatatctatatttctatgcctatttgtctaataagcatttgaaacttagtatttccaaaactgaactccgcatagtctcctcatccccaaatcagttcttttgcagtctttcctgtcttagtaagttgcaagtccattttttaggcccaacatattagaattgtcctcaatttctttatcttactcttctgacagcagattctctttgccatatcttcagaatatatccagaatccaacctcttctcactacctccactaaccacttagtccaagtgttcattcttattctgaatttttgcagtagcctcttaattggtctctctgctttgtctacttctgctctcttccccttcagcagtagagagccttgaaaaagaacacagttttaaagccagacaattttgattttagtattgctacttactagtggtgtgatattgggaaagtcactttacatctctgaatctgtcttacatttaaaatggtagtactacttgtttcattgaattattattagtactaaatgagataatgttataaagattttactagtactatatccagcagaaatgcctaaaccaagtctagctccttttctcttttctaccccaaatagaagagctgctcttcatttcttctgtttatcagagtgcttatgtagccatggaatattttaagcatatactttttcatacgtagcctttggctcataaatgttgtttttgtttttttcttttgagatggagtctcgctctgttgccaggctggagtatagtggcgcgatctcggctcactgcaacctctgactccctggttcaagcaattctcttgcctcagcctcccgagtagctgagattacaggcatgtgccaccatgcccagctaatttttgtattttttttttttttttagtagaaatggagttttaccatgttggccaggatggtctcaatctcctgaccttttgatcccccagccttggcctcccaaagtgctgggattacaggcgtgagccaccgtgcccggccataagtggtctttagtttatgttcctgctccttccttttgtattttctttatatttcattcatgtcctctaactcatgtgtgctcttattggcattaagtgtatccagttcttgcagatttgtatctgattagtaaaagggaccagagttcatacctgaatagtaaaactttaatctatatgtatccattgtattccttgtggttttaataacctccacccctcctattagggttctgtattttagtttctagagtattgaagacaacctccttcaacattttaattcataaaacctagtattctagcagatcatttagctgagaacactaaagatgagcttcggctagattaagttatttttcaaccgtcatgttttgatcctggattgagaggaatagtcacccagttgcaggaaataacacatttttcttggacttatttattcactttcttattagactttctctaacttaaattccttcataggaaatcattatatatggaatattcctacataaatgacatttctttactaggactatgttggtgcctaaatatagctgagtttaaagctgtctactctgtgaggtaaattctaatgacattttcccttttgaaataatgggaagagaacaatctattaacagtatttctcagtattgaaataatattgttttatattatttataaataattgctggatttaacagtatgctgattaaaaaaacagcagtattctctgatgtttatctgaaatctaggaaaccccaattgagatgggcagctagatcttttttttatttctgcacttcttacatcagtgggttgtcctttgtaaagtttatgatatatttgaagtaagtctttaacttaagtttgatgtgagtaagttctatcatcatgtacatacataactctattctatttcctgtactctggggtaatcagtattatgcaaacatcttcactttttttttttttttgacaactgaaggccttctgttttgtccataaatatagatgcaaatattatgtgaaggaggccttatctgtaatgaaggaatagtgttaaacaagcaaaaactttaaagtactgtgtatcattgcagtcttgcttttttgagtaatggattcctagattctatgaggataccacaaccacttttaaagaggtttctaaggccaggtgcagtgcttacgcctgggagaccaaggtgggaggatcacttgagctcaggagtttgagaccaacttgtacaacgtagtgagacctcatctctaccaaaaaaaaaaaaaaaaaaaaaaaaaatatatatatatatatatatatatatatatatatgccaggggtggtggctcccacctacagtcccaggaacttgggaggctgaggtaggaggatcacatgagcccacccaggaggtcgaggttatagtaagccatgattgtgtccatgcactccagcctgagtgacagagtgagactctgtgttaaaaaaaaaaaaaaaaagtttctacaccatcttggggcagtggtgattttaattattttttttaaaaatctgtatttacttctacctgagagctaatgacgacttttatgattagtttccactggggtaagatgtaattaaagtttcagtcttagagaatttttcaaacttactgaaattttactgtaatgtatttctgattcattttttaaaattaaggatgctgggtgtggtgactcacacctgtaatcccagcactttgggaggccaaggcaggaggatggcttgagcccagaagtttgagaccagtcctggaaatgtagcaagatccgttctctaccaaaaaaatttttaattagctagacaaggtagtgtgcacctgtagtcccagctactccagaggtttaggagggaggatcacttgagcccaggaggtggaggttgcagtgagttgagatcatgccactgtactccagcctgggtgacagagcgaaaccctgtctcataaataaaaaaggcaattaaaacattttagattatgattgtgtcaaaattggtgactttttttgtcttaacatcattggtttgctgacttgaaactatttcttaagccatttcttatctgtatttctcctgtggattgttttgttgaaactctggcattctgcagattgcataaatttaaaattattggaagatttgttttgtatttattttttcccttttattgtttaggagaacagtcctggtgaggggaaatgtctatgttttattgatgttacttctgacataattcaaaggcaaggatttttttgtttttttttttaagagacaaggtctcactgtgctcactatgttgcccaggctggcctccaactcctggtctgaagtgatcctccagcctcagcatcttgagtagctgggactacaggtacatgccatcatgtccagttgagggcatgttttgatgttaaaacagagaatgcaatgcatatatgccattttatccacatagaaaaataagaaaaatgaaaatttatgacatacctgcataggagtgttgtttattataattgactcccaagtaaaagagaagaagtatacttaaattaaatgatcacaaggaaggaaaattgacttaagactgtatttacacatcctgatacctctgatataagatgccatagatttctgttttgttaaagtgaatctttattctacaataatttaggactttataatttttttctttttataaaaacttttattttaggtctaggtttacacgtgcaggttgatttataggtgaatttgtgtcatgggggtgtgttttacagattatttcatcacccaggaactaggccttgtagctaatagatatattttttttcgatcctctctctgctctctcccttcacccttaagtaggccccagtgtctgttgtttccctctttgtttccatgtgttctcatcatttagctcccacttatgagtgagaatgtgtggtatttggttttctgttcctgtgttagtttgctaagaataatggcctctagctccatccatgttcttgcaaaggacataatcttgttcttttttatggctgcatagtattccatggtatagaagtaccacattttcgttacccagtctgccattgatgggcatttagattgattccatgtctttgttattgtgaacagtgctgtaatgaacatacatgtgtatgtgtccttatggtagaacagttttgtattcttttgggtatatacccagtagtggaattgctgggttgaatagtaattctgtttttagttctttgaggaattgccacactgctttccacaataagtgaactgaatacactcccaccaacagtgtataagcattaccttttctccgcaatttgccagtatctatcatttttttacttttttagtaataggcattctgactgtgtgagatggtatctcattgtggttttgatttgcatttctctaatgatgtgatattgagcttttttttccaaaagcttgttggccacatgggtatgttttcttttgtaaaatgtctattcatgtcctttgcccactttttaatggggttgtttggttttttaagtttcttatacatgccggattattagacttttgtcagatgcatagtttgcaaaaattctctcccattatttagattgtctatttactctgttgatagtttcgtttgctgtccagaagctcttttgtttaattagatctcatttatcaatttttgcttttgtggcagttgcttttggtgtctttgccatgacatctttgccagttcctatgtccagaatgggattacctaggttgtcttctagggtttttatagttgcgggttttacatttgagtctttactcaatcttgaattgatttttgtatatggtgtaaggaaggggtccagtttcagtcttctgcatatggctagccacttatctcagcaccaattattgaataggacgtcctttccccattgtttgtttttgtcagctttgttgaacgtcagatggttgtagatgtgtggccttatttctgggttctctattctcatctattggtctatgtgtctgtttttgtatcagtttttgttactgtttttgcatgctgttttgattactgtagccctgtagtatagtttgaagtcaggtaatatgatgcctccatctttgatatttttgcttaggatttgccttggctatttgggctctttttgggtttcatatcaatttttaaatagtttttttccagttctgtgaagaatgtcattggtagtttgataggaatagcattgaacctgtaaattgctttgggcagtatagccattttaatgatattgattcttctgatccatgagcccggggtgtttttcctttgtttgtatcatctctttgatttctttgggaattaatttttttatgttttttttaaaatctgttaagagatctgggtcattggacctgtagaatttccttcagtctgaattatgttgtttgtgtactcagacacaacttaacattttccctttgcttttcttgaaaatcagtagctggattttgttgaatatgcactcaggaacaattaaacattttcttctgtactttgtttttcctgaaaattgacagctatattcagaagtttgaccagattcaggtttggtagctttggcaaagctgtagttgtgttcctatcatcacttgtttttactctcttttgatgtttttaggcactgagccccagtgcctatacagctattaattcattgcaagttgcagaatggtgatattctaattccatcttttgtgtcccacttattatccaaaataatttttagggagattcctcttatgtatcctttggctattagtaatataggtaaggcagcatcaaagcttgatttttttttttcattttcccagttttcaagataattggtttcttgtcaacctcagaatgtggccagttagtgttttgttttgtttttttgttttctttaaacattttatgatctcctggccagtgagaccctcttcactaacctttttgacatgaccataattgagaatagtcttgatagtttccttactattggggatgtcagatgttccaggttcatttagtacatttccttttcagaccagctagttctttaagaagtccgggtttcttttaatggagaatggcatttcaagatcacaacctgggcactagacatgtccactgctactggatcagtctgtttctaggcgttttcagtggatagagttaggatatacctgtgatttataagattgtattgatgtttccaatatagattcagtattacagaatttttactgtacttctgtactaccttcatagctcctttcttccacactgagaaatctggttcgtaagggaagatagaaatagtgtgtcccataattactcgcttgctttatccctccttatatagagagtggtctgagaatattaccaccaccaattattgaaatcagttaatttttgttgttgttcatgctgtctctattcttccccattcacttatggttgtactgtacatgtattgtcagatcatgtagtgattacatactacaatctctctctttaaaagtcctcgtttgggctgggcgtggtggcccacgcctgtaatcccagcactttgggaggctgaggcaggcagatcacctgaggtcaggagttcgagaccaacctggccaacatggtgaaaccccgtctataccagaaatacaaaaattagctgggcatggtggtgggcgcctgtaatcccagctactcaggaggctgaggcaggagaatcacttgcaccaggaggcagaggttgcagtatgctgagatcgcaccactgcactccaacctgggagataagagcgaaactctgtctcaaaaaaaaaacaagtcctcatttaatcttaattctggaaacaactgcatatttaatctcaccactagtgcttattttgatatctttctagttattttgttggcttaaagttctttttctaatggaactaggaagaactaataacagtattcactgagtttttacatgttgatagcagtttgtctttaccccttatacttaaaggtaagttttactgaatgtaaaatctttagctcagattctttgtgtattttaaatatctttttccattttattctgtttctttttctttataaatcatgttttggaaatgaggtttgatgtgtgcctacagtcccagctacttgggaggtggaggcaggaggtggaggctctttttgagcccaggagtttgagaccagggtgggcagtgtagcaagaccctgtctcaaaataaacaaatttaattaaaattttaaagattatggccaggcacggtggctcatgcctgtaatcccagcactttgggaggccgaggtgggcggatcacctgaggtcaggagttcgagaccagcctgaccaacatggtgaaacctcgtctctactaaaaatacaaaaattagccgggcgtggtggctggcacctgtaatcccagttactggggagggtgaggcaggagagttgcttgaatccaggaggtggaagttgcagtgagccgagatcacgccattgctctccagcctgggtgacaagagcgaaactctgtctcaaagaacaaaaaaacaaaaaacaaacaaaaagattacatgatagttttgcttaaatactcaaatgatccccccctttttaaatccagtaattttagtagaatttagtgcattgatctaagttgataatgtcaagtatacagggtactcttgaaatacatagtttcaagtatgtgtgtgtgtgtgtttatccttccatgtatatatgtctatgtatgcatatatgcatattaacataaatacatatataactagatgtatatatacatatataaaacatacatatacatgcagggtttttttttctgaaaagggatcttgaattacagtttttctgttctctctggttttctttagagattcctatttatccttatgctggaccatctttgcctgtcttcagtatttgtcactttcctgcaaatcctttttaatccctttcttctctttatttgttaaaaactttcctccctttaaccttctctttctcttaagatcattttgtttatttgatcttgcgtttcttctagtttagtcttcattactgaaatgaattttatttataattcttttctgatttctgtctcttcatttctgagtttttctgattctgatttgtattgctctttgatgtgttatctaattttcttaacatttttagaactttttgaaattgcacattacagttttgaattgtatattacagctttaattttttttaataagcctttttggtgtagtttcattggaggtattacgatgctttttattctctttctttcctttcctgtctttgggatttgaccctgatgctttcttgttgatcatttttgtttaaaattagtttacccaagtatgtataaggagacatgtcatgatagctttttctaactccacatagctttctcttttgttgtttttttgtgaagtgttacattgcagcttgccttctagcactgttctcctcttgtactttgatttagactttctcttttctttgtcccttttgtccattttctgctgaattttcattccacttctaggactttctttttagcatggagccgtagcttggcacatcagtttcaagagtacacatggctaaactggtccagcctcttctgaactttctactgcaggccccatgtactcatttgttcttagagtgggcaaacacctttcattgtcagctggtgttatcaaattaattctttgtattttccggtgagttgcattctagtgattgccagtttcgtggtctgtcatacaccctattgctccccagccccctcctccccattttgtctcatttagatgctcattaagtttcaggtctatagctgttttgtttgttcttagcaatacccatttatattttagggtttgcaaggataccttttgtacaaaggaaaatccaacagtattcttctactatactcttcatacagagcacttctgtgaccagatgtgtgggggcattttttccccaccacgcaattcttcaattctctgaagacaccaatcaggtgtcctataattcaattcaattctggctacttagagtttagagtcaaatcccattggttaagggctcagtcccacaaacatgacagtcacttcagatgccagttgcaagtctgagtttctagtatttctgacaaggaaaaaaattggaggtccccacaaccccttcctcaggtttgagcatttgctagaatgtctcatagaactcagggaaacactttacacatgtttagctgtttattataaaacaatatgactcaggaacagccagatgatagagatgcttaaggcagggtattggataaagagcccggagcttccatgcccccttgggggcacaccactgtgcacatattcagcaacccagaagttcccaaactctgtagttcaggaatttttatggcggcttcgtcacgtaggcatgttggactgttaattaaatctctagtccttctctccttccaggaggatggggcatgatgggctgaaagttcctagcttctaatcatggcttggtctttctggtgaccagcccccatccaggagcccaccaagaattaactcattagaacaaaggacactcccgtcacccaggaaattccaaaagattaagaggcctgtgtcagaaactgggacaaagacgtgtgtgtgtgtgtgtgtgtgtgtgtgtgtgtgtgtgtgtgtgtagatatatctcttacagtatcacacttcgttacccagtattgtgtgtgtgtgtgtgtagagatacatctcttacaatatcacactttgttacccagtattgtgtgtgtgtgtgtgtgtgtgtgtagagatatatctcttacaatatcacactttgttacccagtattgtaattcttgttcctgggtagttgttttactctctgttattgttctgatgatacttacgttggaattttggaagatccaaaaactgttccactgccactaccttttcacgattttctctataattttttgatggcccagagttcttaactaaggtgtcttccatcagtgtctgacatgtttaaaatatgtgggcttttatctatattctgagcttttaaagatgctggacatctactgagtatgtaatcttcaatatatatatggacaggttctacataatgattgctaatgctgtataactgtaaaatgacatgaatcagtcatataattaattcaaagaagtctgatagaatgaaaaagtaaaagtaatttggttccattcaatttgggaggtataagaattatagtctttatattaaaaaatactggggccaggcacagtggctcacacctgtaatcctagccgtttgagaggctgaggcgaaaggattgcttgagcccaagaattttgagaccagcctgagcaacatagtgaaaccctgttctttacaaaaattacaaaaaaaagttagccagctgtcttggtgtgcctgtggtcccagctactcaggaggctgagatgagaggatcacttgagcccaggagctcaaagctgcaatgagccattatcacaccactgtattccgttgtgggtgacagagcgagaccctatctgaaaaacaaacaaacatacaaaaacaaacaattatacagtcatttcactaggagactctcagaattacttttaaagtatctcttaatctcttaagcttgatctaatattgatacataaatgcctgtcctattcaatgataaactccttatagagcctttttacaattttccttttatatatttccatctttttaaatatattccttttcaaatggttggaatacaaaaattattgtggattttattgtctctggataatctattaatctttatatactgtttattgtatattaagttataatttaaaaataaaagtatatatttatgacatacaatgtgatgttttgatatatgtatgaattgtgaaaggattaaatcaagctagttaacctatctaatgtctcaaacttttttttttttgctttttgtggagaatatttaatatctgtactctcagcaatttaaagaattatgcagtgcactattatttactatagtcaccattctgtacaatagatttccggcacccatttctcctatcaaactaaactcaataccctttgagcagcatttccccgtttctccctgcacacccctgctccctccaagcccctaacaaccaccattctactctgtttcagttattttgacttttttaggttccacatataagtgagacaatggagtatttatctttttgtgcttgacttagtttacatagcatgatgtcctcctggttcacccatgttgttgcaaatgacagaattttcttctttcttaagactgaatagtattacattgtgtattcacccacacattcaccacattttctttatccattcattggttgatgaacacttaggttgattccatatctcttggctattgtgaacagtgttgtaatgaatatgcgagagagtgcagatatctttttgacatactgatttaatttccttcagatatatacccaaaagtgggaattcttgaatcacatggtagttttattttaaaatttttaaggaacctccatactgttttctataatcgctgtactaattttatattactaccaacagtgtacaagagttcccttttctccacatccctagcaacatttatcttttgtcttattaattatgtatgaggtggtagcttattgtggttttaatctgcatttctctgatggttagtgctgttgggcatgtttatatatacacctgtgggctctttatatgtcttctttagagaaatgtctattcaggttctttgcccatttttaaataagataatttgttctcttgctattgaattgagttccttgtatattttgaatactagcttcttatcagatgtatggtttgcaaatattttttccattttgtaggttatctcttcactctgttgattgttttctttgctgtgcagaaggtttttttcttttttctttctttgagacagggtcttgctctgtcgcccagactggagtgcagtgggtgacagattgcacccagtggtgcgatcatggctcactgcagtcttgacctcccaggcttaagtgatcctcctgcttgttgtctgtgagtcaagtcttggtcctgtagcctgggcctgcaaggtacgtcctgttgtcagggtctattgggatgggcctggacctgggtcagctggagccttggccctcagggtcaggcctggatcctggggccacagatgctagcctggcaaagggtgggtctgaagcttgggactttgagagctggcctggttctggggctagtgtggagcctgtggctggcctggagtctgagtagttaggagcctgcctatagcatcaggtcccttggaatggcctggcggtgagataggtctggagccctgggtatgtggggccagcctggtggtagggcaggtctggagcatggggctgcagggtctagcctggagcctgaagctgtcggggctcacctggcactggggcaggcgtggaggctaggtttacattgtagttcaaaagctaggagtggtgaccagggcacaaaaagagatatctacagtggaagccctctaaatctgttttgaggaatgagaaaggaactcaacactcagaatatgccaaatgctcaccacccctttcctgttgttttattttctgctgccccaacccccgaccttagtggtaacatcaagaattcacataagccaaaatactgagaaaggggaaccatcctctctggtggagctatagtaccaagagttgtcaggccattctttagattattaatgaaagcttttttttttttcattcttcctagcactgtgctccagacacagatatagtcatgaagtacatgcagagcaaggttactatagccctaggtttgtcagggtaccaaaagaggagtcttagggaaatggaaagtgctgaaaagattgctgtgaggggcacctcaaagtcaaccccattaagtttttatgagctcctggagtcacccctgaacttcacaggtgtgaatttggtcctaattgtcataccatggactttagaactgacctaacagatcactgcccagcaccctgactgaccacttcagggtacacaggcagtacagatatcaatagcaaaggctttgaaaaatgtaactaacatttcctgtagtattaaagaagacttggagtttcataactcaaaacattcataatgtccggatgcaaccaaaattatatacaaagattgacatacaaattacatatgaaattgatacagaaagaactaggaaaatagcaatttgcaagggaaaagacaacagataccaactccaagagatgaccaagatattggaattatctgacaaagattttaatgcaactattataaaaatgcttctctttggggtgaaataatgaaggaaaccttttattgttactataacaattgatgcctctcttctgaagtgtaacatatttcagcctgaaaagtcttaaatttttatctctcatgtatgaaattaaatcaacaccctattttttattttattaaaaataataataaataaattcccaatgggaaaaaaattaaaaaatactccaacaagcaatcatgtgaaccttcttgaaatgaaaggaaaaataaagtcttaagaaagaaataggagatatataaagaagaacctaatgaaaattttagaaatactaaatataaagacccaaacaagaagcaaacttgatgggttcagtagcataatggaagtgactgcagaaggagttagtgaacttgaagacagatccatagaaattatccaaatctaaacaatagagagaaaagcaggggatggcggggaagagaaccacagggatctgtaggataataacagaagatctagattcataacattggagttccagaaaaagagaaggaaaaatgtggtgttaaaataatatttgaagaacttatagctgggaatttgtcaaatttggtaaacagcacaagtttacagattcaggaagctgactgaatccttaataggataaatgcaaagaaattcatactctatcactatgtgatcaatctgctgaagactaaagatgaagaaaaagtcttgaaagcagcccgagagaaataacacattacctagaggggaacaacaatttgaatgactgtagatttctcatcagaaaacgtgcagatcagaaagttgtggcaaaaataggcagaggatataaacaagaatatacacacaccaaatggccagtaaaacatatgctcagcttcattattaatgagggaaaggcaaattaaacaagaatcagataccaattcgcgttgtttagcagaaatgaaaaaaacctgagtagtattcgtgagattgtgaggaaatgggaacattaactttttgtggaaataaaaattaacgcaactgtctttggcagaaatttggttgctcttatggagtttttgcattatattatttagtagtttcgcttctatatcttgaacatgtgcacaaggagcttatatacaagcagattagacatgtgctataggaaatggttcattgcagacttccttttgaagtactataaatttggagactatctaaatcttcattagtaagagaatagatacaattgatatattcatacagtggaatactagagttaaaatgaattcgacagataaatttcaaaacataagtattaagtaaaaatggcacattgctggatgatatagtttcattacacttacatagtataaacatttgtggaggcatatatatgtaataaaagtataaaaacatgcatgtttttattctagagttaaaatgaattctagagttaaaatgaacgtccacacagataaatttcaaaacataagtattaagtaaaaatggcacattgctggatgatatagtatcattacacttacgtaatataaacatttgtggaggcatatatatgtaataaaagtataaaaacatgcttgtgattttacatattaagatatagcggttaatttggggagggatggaagaagggaaactgtattggagaactgtataatgaaaatatcagctgtgtacaactggtagtgttttagtttaaaacaaattgatgtaaatatgggaaatcttaagatttggtgaagtttgatagttgctatatcagtgtgagttatatttttcaccgtattttctatatattaaatttatttacaataagataattaacttatttgtatataattttgataattatgattgttatgaacatttacattatgaacatatttctcagctattggcactgttgaaatctgaggcctgataattctttgtggtggtaggcagtcctgtgaattctagaatatttagcagcatccctagcctctgccctttagaaatgagtagcactcttccaattgtaacaaccaaaaatgtccctagaagtccgtggtttgctcctggttgaaaatcaccaatttagagactacaaagtgctgtcacatgtgttagctcatttgaacctcacaacagccttcagaagaagatgttactttgacctcagttttacagatgaaaacactgagactcagagaaatcatctaaaaatgacagatatggaactaaaactcaggtcttattatgcccacatactgactttttgttcatttgtatgtacatgagtatatattcccacacatttcctggtaaccttactaaaagtagaatacaaattaaacattctaaaaagtttcttatttttgtatttcattcacaggcatattatttcatatctcctctagtaatttgttgatgtctgtctcaggcatcttagtgattactgggttccattgtgcttttttcatgaaaacttcttataaataattacaaattaaataaaaggagtaggtcctctacagaggactgttgtattcttctgttttgcctgggtctgtcttttttgacatgccatattttcattctgcatttggagaaaataggttaccaatagaaacttttgctgggctgcttttatttccttattaactatcatgaagtgtttatgtaaaatacttgtttacagaaatttttataaatggattttcatattcaaaatataattttggtttcaaacccaagtatcaaattcagactgtagaaattatgtacacattagtttttcatgaaaataggaaatgatattaccacataatctagatattgtggttttcaacaatgtttatttagaataaaaaccataaacttaaggggaaaaaaaatctctttcacagtgcattgtgcacttttagtcacctcgcaagagcctttcttgggcacagagaagattgagatgtaacatgtaattaagcagtcaggtattccattcatttggggtggttttttgggaattttacattttactcactaaaggatcacctagagagagccaagaaaagggtccttgagcccatgcagccattaaactttcaatggcccctaggccggacatcatttgcagagccgccttctcatccttactggccttactctcaagtcattcaactcattccttttcacagagattgctctaattagccttctaaactaatctccctgcctttagatcaggggtcatttcccactggccaaatctaggtcactcctagtttttgtagggcccataatctaagaatggtttttatatttgtaaatggttaaaaaaaattaaaaggataataatattttgtgacatataaattatatgaaatgaaaattttagtgtccataaagaaaattttattagagtagaaccacatgtgtttgttcatccagtatcgaaaaccaccaccctagtctctacactactataaggggtatctttttaaaatgcaaattattctaggtaaatgtgtttaaagatttttttaaaaaacattaagcaggtcagggttcttagttgtttctcacaatgtaatttctatgacagcacatgcaggttaacattgtgcctcactataggtgagttaaaaatgtttccatctcaagtggttgatttgataagagtaattcatatatcagtgtcatgagcattgaccttttcactaaaaagaaaatgtatcgtattttcacactgtaagcatttagaaagaactacttttacttacttcttttcttgttagagcagcttttttcttgaattccttgtaaagcatgtatacctaagcttgctgtgatagatttcatagatgtggggaatagatgcatgatagggactttagttacctaagcatgggtatacagaatgtcaggtgccaaattttcttaatagagtgtagaatttttttttttaaagagtcaaggtctccccttgtcacctaattggagtgtggtggtgtgatcatagcatagctcattgtaacctcaaattcctggcctcaagcgatcctcccaccttgggctcccaaagtgctgggattacaggtgtgaatcattttgctcagccctagaatttcttaaatagtggtcttcattagaaaggagcagtaatatagacctggagagggagggttatagggttggcagtgtaccagaattcctactgaggtactttattttggttgtggccagttgattgtcaagagaagctctcttttagtagaatgaatagacagagacaccaaacatggcttttgggaaaaacatttttttttctttagagaatatatcttttgattttatattggaagcacataggaaggttatattgtaagactaagtcttcataacctgctttgttagaatgcctctattctgtaaaggaataattgctatagttactgattagtgcttttttaacatcgtttttatgagaaaagaataaaacgggaacatgaattgaactcaaaatatttaataaatttgggtagaaattagtatcagagagatgtattgagtcaaacatccttgggttaaaatccagtttcatttttactggttttgtcattggatttcagttagtcaccatgagtttcagtgttctcagctgtgaaataggtctttacttcatagggctttgatgaactatgtaaaatacctggcagagagtacatagtaattattggctgcctttctgttcttaaatacattttagaaagaagagaaaactttaggatttttggacatattgaatattaattcacaagagagtgaggtagaaggaatcctagagggtttaaaacttagaaattaaatttgagttggcccagttgaaatactgagccttattaaaaagaatccatatttatagagttgtttacttagaatttgatatacagttaagaaggattgtaaatgttcacatttcctttaaaaggacaaaattaaagaatttaagttttaatttcaacagaggcagatcagccattcagagatgataatccatgagtagatttttgctttaatttttaaaaataatgtcaaagaaaaatttcttatatttgtctttcagataacaccttattttgtcaacatgtctatttttattcaaatgtggtaacttatatagtaacagcagaactaaaataaactgatttatatttaaaaagtattttcatactggaggaaaaaatatggttgcctatcactttgagtatctttctatgtgataagttattttacaaatctgactaaattagtggagtgttttactagattactgtggactaagagatatgaatatttcctggcaatgtacttattattttgtattgtcgtcgtatatttggaatcgattgattaaatgttactgtacttgctagtttaacagccctctacaaaatagagaatagttgatatatatacatgaattggatttaattattgctaggccttacatataataaatatacttaaaaggaagctttatatcaataatgaattaaaaaacaggccattctgtttaaaaagcaatagatgttactacacgagctctattaaaaacaataaaccatagaataagtagatgacagagcaagaatactctttattaaacctgcttgcagctactaccccttttccctgtcaagttaaaaataagacaagtgattgtatgaaagaacgaacaaaggaaattgtttgatgccttaatgcatttttcatctgattaaagtgataacaaatttataggtgtatagaccactatgttaaagattttgcttggtttagtttcatattttatattatactttacattcttaatatattaatttctgttttactgtgcctattttaatgaatttatgatgcataatttttctgtttctatataacaaaattgaggcaattatttacaataaagtaaaatttgttttagcttttcttaacatgcatgagggaatatactgttttggttatttcttaaaagaagatgtatacaatgaaatggatttgtttctatataattttaaaaatcatggtaaaataaactcaagatttatttggtttttagcttttattgatttattttataggtttattgatttttatttcataaaacatacgaatgtaattcttattatagtaaaacagtactagggattatttgatgtgctgttgtactttagacagaaaaagcagctgtaattaatttaaaagattgttttaaatcaggccttcttaactggaattctgtgactgaactttggtgttgataactttccttcattatatgcaaagtagagtatatacatatgggggaggggaaaaacacctacactttcttaagacttcaagaggggagtgtaaacccacaaaaatcagggtaagaaccattggtttatataagaaaaatcctcaaatattttaatgatccggattataggaaatacaaataaatgatcgatatagtagttttaaatgtagataatgtcagagacactgttatgtcaatctcattatctatttgcttatgctccttttaattttatgcagatggagggagcgaggaaccaccggatcgaagacagtcaagtgtagactctcgccaaagccgctctgggcaaggtaaattttcatcagattgattattaaatttcaaaaaataacgatagatatttctttctagtacttaatttggagactaggatattgccatggtatagtttagatattctagtttctcatttaggatttaaatgatatgatgtaaaaatctatatattatttattcaagatatatgaaaattaaatattgtcttgtgcctgtttttttaaatgatattaacttttaagtaattttgaagcattatggtatatatctggatatcacttttggaatggatccaaaagtgaattttcaacaccaacatttgttggagtatcatcacacactggctttttaaatttcatcaatatagtatttgttgtcttagctgtctcagaagaaatggtttttgttggtaattgctatattaggatcttcctacttatttttcttttctatttaaaatttattatcataggcctttgattaatttttgaagggacaacttcaaaactaggtaaaaacattctgagtcagtgaaatacccagttagaccttttctaacttatttaacattgcatgaccaccagctctctattcctttttctttatagtacttaccaccttcctatttattctgtttattttctctgttcaaaactagaatggatgttgcgtgatagcagtgatttttatgctttgttcactgctgtatccttatgtgccaataataagtacatagtatatagtagtcactaaataaatggtgaatgaatgatctgaaagagaatgagttgagaacccaaaatgatgaaaaatagattataaaatttcagacaatcatttattgagtttggttttcaaagaatctttaatagcataaaataaaataaagctgagatttacagatgtgcagtttttaatcctgtaaaagcttcagatttatttattctataatcgtgtccctctttttctccaagtttgctcttcccagtttttagagctgtactatttttataaaactgtttgttgcagattaaaaagaggaataatatgagttgaaaattttaacttatgctaatacttaatcatacttaagtaataagcatgtattatgactatgtctggaatttatcttattcactcttattttccctgtaaacatattttgatataaaaatgagattatgtaaaactctaaaaataaaattagtacaaattactactaaaattgtaattattaaatgtcaaattttattaagtatcaaatatagatgtttgaaatcacttatctaatttactctgagctttgtcagttaaaatatttttcaaatcaatgagcgtaattgaattttattaacaaagctaaaacttcaaacaacaaaaccagggatttctgtgatccagaggacaactacgtgatctcaatttgaagtcaccaggaattgtatcattgttagagttaattgatagtaaaagcatgtttcttaactttttagagattttatttgtaatatctctttattcaaaagaaatatatatatttttttatatggaatcttgctttgtcgcctaggctggagtgcagagtgcaatggcttgatcttggctcactgcaacctccgcctcccgggttcaagcgattctcctgcctcagcctcctgggtagatgggattacaggcccggctttttttgtatttttagtggagatgagttttcaccatattggccaggctggtctcggaacttctgacctcaagtgatccattcacctcaccctcccaaagtgctaggattacaggtgtgagccaccgcgcctggccagaaagaaaattataaaaaactatcaataatgagttgaaatgaatgagaaatagtattaggagtaaaagatgggatgagtataaaacgtttgttacctcgagaaacccactgaaagatcagtaaagaaggattggaaggagaaagtatcaacacagttttagaaactggagagtatatgaataattgaaaactgaactccaacagtagcagaggaaatcaacaaaacaacctcgagaggtctcaaaaagcttgagaatggcagtgtgtggaaatggagatgcagtgacaattggttgaaagtcagatgaagaagcattgggtttctggaacttcctccccaaaaccacctaaccagtcagctgggcaaatgctgaactcctcacccctaaccaaaagcaaaatttatccttaggagtggggaaaaccagaaacactgtagcctgggagacaccaggcatagttgagggcagaagtcccatgctaaaaatgggagaattggaccttagatatctctctcctgttttctcctactgggctcccagaatactggcagttagaccttcagatttcaggcaggaggttggaaaaaaaaagtcttttctggagaatctgaccaaaaaaaggaagataaaagaagaaagaggaaatttagtcatcagagattcctgaaataaacaggccagttagctcactccatgtatcaaagctccaaatcagcttttcagtcccctgcccttaaatatgagcagctaacaaagatgagtagatatttgaagaaactctctaaatgtatgaaagatagaagttaaatggaataaaacaacttggagagacatacatttttgcagaggaaaattatagaactattatccccagaaataagagaaaataaccatgaaacaagaaagaagtacataaaagagtgatattatgactttaaaaaaggctcttaggcattgaaattctgatagtaaaaaccaaaagcttcgtagaattatcagagactaatgtgctgaaagaaactctgaaaaaatagagcaaaaggacaaaaataagaaacgaaggaggagtgttaagaaaaatcacaggatcagtccaggaatttcagtattcaaataatagttgtcaaaagaaacaccagagaaaatggaaaagaaatcatcaagatgattcaagataattttcttaactgaagagcataaagtttcctgattgaaaaggctcactttgtgcttagtacaatggatgaaaatagatccaaactaaggcacattgtggtgaaatttgaaatcactggagccaaacagatcgttcatgcttctggggggtgggagggaatgagttggctttgcacttctcagtcgtagcattggaaactgaaaaataaagcagcatcttcagtattctgaaggaaaataattttcaatctctgaattccatatgcattgatactattattcaaatataagaatagaattagatgtatacattttcaaaaacaatctgcctgtcttatacactttctaaggaatctgttggaggatgtgatccatcaaatgaaaaagtcagccaaatgaaagaaatgaattacaagagacaggaaagtcaataaagcagaaagatccttcagaatgacaataaaaagaaggggatagagggctagcagttcagattggagtgggttagaagcctccagaagagtggtcttcaggaaaatgagattggtagaaacctgatgcaattaattgtctttagaaaagttttagacaactgatgagagtctcaaggttgaaatggtgataaatacataaaatagtaagcaaaagaaagttctgaactacagggaagataaataatgtgtaagaaaggagatgttagaataatgtcgtcagttctttagcagaatccagagtagttgatgtccaagccagtcacctccagtagaaaacgtgatcagtttacttaattatgtggtacaaatagcttcattatttatttgatttggactattatgataggaaacaatgctctaaaggagggcaagtctgacctgtgactttgtttttgtatggttggtgtatttgatttgctaagaatttaaattatttttgcatctatattcacatggaatattgacttttcattttcttgttttctaatgtctttatctggttttaatatcagaataatgctggcctcatagaataagttggaagtttcaacttcagtttcctcctcttcagtttcctaagctacatcgtgtagaattgatattatttcatccttaactgtttgatacaatttctcagaagctaattgggcttggaattttatttgctggaaggtttttaaatgtgaattcaagttatttaataaatataggactattaaaattatgtgtttcttcttgagaaacattttaatatctgcataatctgtagtgatgtaagcattctcatttctgatactggtaatttgggtattctttctcactgtcctgatcattttggacaaagatttgtcagttttatacatctcagagaatcagttttgtatttggtttctgtattgctttcctgtcttctatgtcattgatttatactttgtcctttattattttctttcttctgcctgctttgggtttaattttatctttttcttgtttcttaaggtagaatctggggtcattgatatgaaagctttctcttctaatataggaatttagtgttataaatttctgtttactgctttagttagttacatagattctgataagtagtattttcatttagttcaaaaatacccttttgattttttctttgacccatgtgttatttagaagtatgttgatgtagtttccaaacatttggaagtttttcagatatctttctcttattgattcttacttaaatttcattgtgatcagaggacaaactttctgtaggttgaatcattttaaatttgttaagacttgttttatggcccaggaaatgatctattttaataactgttctgtgtgcgctttaaaagaaagtgtattatgctgttttagggtggaaggttctataaatgtcaacctgatcacgttgattgatagtgttatttaagtcttctatcttcttgccgattttctttctacttgttgaacagcaaggaatattgaaatctcaggctataactgtggatttgtctatttctccttgcagttctgtcacattccttgtaccactggtcctctgataagaaaaattcctcttcctcagagatttatgtgtctcttcagctatagctgctggttgtgagatgggcttgcttaggaacagggctggatgagaaaggtaaaagaagaaaaagccaggggatttcccccattcacgcagtcccatatagaggccctccattcccactttctaaccagaaagagaagacttattttgtatctctttgtgtttgttcctggtgtgtagctccaggatttggattcaggcttggggtttggggtacataaaaaacagctggaaactcattgctgaactggttgtactttaagttctagttttcttccacagtttgcccactattgttttcttttctgagtctcagattgctggttcatcattctttccaggattttcagttatattcaggggttttagttacattcagttaaggcatagtgtgcttacttcatcttaaccttctgttttattacaatatagatagcactcaaaatattttaaaattagtatgcatgaacatcaacctaccaggacagatgctagttcattcagaacaaacgctagctgtagacagctgatccccatataggtgcatactgcctgataatctgccctgcctgattgtggatacagtttctatttcatgtttcttctccagtagcagcagaaatatatgttgtctgttggactgtgccaatgtcttaccctctgtgcatgagggtccttttctttcctttgtgttaacaagttccttggtctctgatctgtctctctggtacagtggattttgactcaaacatgctcatactcactgttccagtttaggggcagagacctccaatgtcttctgcttattatatgtaggagatgggagacaggctcttgaaatgtgactgtaaaactgattgtgttagtttaaccccagtatgactgccgcaggttaggtggttattttctactttccaatagcgtattatatataattgcactatattacttactatattttgtcttatttgtctattgggtctccatttttcctagtaatgtaagagtttattaatagcagggtctttgcatacagaacagtgctagtgccttgtatttaggttatcaagtttgatgaaggaaactacaattcctggaattcggattctgtatttcagaaatcttgagttactttatcagagttggtttttttgtttgttttactggctccattttctgcattaaatgatttttttcattagtgatcatatatatgtaagcaacttacttggttctagacattaagtgggtagatgaaccagcatgatatgattgaaacccagtttttattttcttttgcaaaaatagcattatgcaggcattgagttctggtgtacaagatgtgtactggtgtaatgatgtccacgaaaccagctcatgctggaagatgggaaaatgcggacgatgtggctttgcatgatttccattatttgtagccaactttatttgattaatacatgctggtgtgtcaatagaactagtatattaaattgtcaaatatactatattctgatcctctttccttgcaaatatgtaaaatatttagtagaaatgagatgtttatgctcttgaaacacacaaattattcttcagtctggaaagttacagtgatttctttattgaaccaactgtggttaattacgtagagtgacaaggaaattatttcaatattcagtgtattatttctttatctcagtataagaatatatctagtatagtagcattactaatgaataagaccgttctgtttatgtgccaggttgtaaactaggtgcataatcctcatttaattatcagaatagtgttgtgaaagtactattattttcctacaggaaatattaattttatattatattctggctttatagttatctacatcccaagtttcaaatcagtattgttggtagcatgtatttagaaccttttcattctgatatataaagtatatatttgtttgttggtggttggataatatttggaagatctgagcttaaatgataaatccctctgaaatatctttattgcttgttctgtatttcttcagaaatttaatttgttgtagattttttaaattaaaacactatttttataaaattaaacttgagatgccttttggaatacgtagccccaacttgaggccaataattcattattatttagaatgttagggatatgtcttagaatgtattgttatagtttcattaattttttaaaaagttaatttataccaaacaatgtagacatttaaaaaggatatgttaaggcttcttcctgttccactctcctaaagtaacaaatacctacattcagtttgtatctttccatgttttcctctgagctcatactggcatatgcaaggatgcgtatgcatatataaaccagtttgaaggtttttgaaaaataaaatgcagttttagttctccccttctctctcaattaacagtatagcatggccatccctccaggaacatacttaaattcttaatttcttaaaatctgtatattggttgatagtctaagtaacccattatgtattccactgtttccgcatatatgagtgttcagatttgcaaagtgattatgataattaatttataatcttaagctcttggaatacgtagccccaagcacattttgtatcagaacatattaaatagactatttagcttatgataattggcccaattaacactagaagccttgtagaagccgctccttgcttattcacctttatgatagaaaaggaataaaagcatgacaactaaaaagtttggaaggccgggcacggtgcctcatgcctgtaatcccagcactttgggaggcccaaggcgggtggatcacgagatcaggagatcaagaccatcctggctaacattgtgaaaccccgtctctactaaaaatacaaaaaaaaaaagttagctgggcgtggtggcgggcgcctgtagtcccagctacttgggaggctgaggcaggagaatggcatgaacccgggaggcggagcttgcagtgagccaaggtcttgccactacactccagcctgggcgacagagcgagactccatctcaaaaaaaagaagttcagaaaaggtatgaacatctagaaagattttattttaaaatattcttatgtgaatttttctggtaagagataaaagttataaaaaaactttgtaagtctttttgaagggtcataaacagttggataagaaattattaggaaggtatctattggtaaagcctggggaaaattattatagagttgatacattttttgttttgtttcatatgaagagcagttggttttaatgtttttttcctagtgaaagtttgaagagctagttcccacaagggggcagaataagacaaacctgaaaaccttcacactataaacacagaagtggtaaataatgtaacaaaatttattttaaatttatagttgatttattaagaaggaaggggaaatcacaaggagctagaaatgagcagagaggtaattttctgatcgtcctatgaatggtaccatatattggcatatgtacctacctgtcccccggcacatgtatggactgtagggtgatcattcagctgtggccttagattagtattgatgagtggaagttcattttgctaagtccatgtataaactccatccctttgttaatgagggtagggtagagtggctggttaggccattttcattggctgagactgactgagtccccagaacaggccatcttgtttaccaggttaagcagccccttctctgctgtgtttgctctttgtcaggtattcacatggggcatagattacttcatgtgtgttccctttcaaagagatacagccaaattctttgacaccagatatctttgtaatcagttttctaattgttccaagtctctgaatatccagtaaaaccattaaacactgtccatgagtcagtatagaacagtacctctgttatctctccttacaatcaaaatggacaatcaggccctgctcaaatttctgccacagggagggcttcacttcttcacttcaccactccttcaggaccacccctgaatggggctgctgtgctgttgtcatctacgtgtcatgcagagccatgacataactactctgccagtcacttcctgtagctgtgtcttcatccagaccaagtgatgagagaacagacagagaaaaaagcaacagcaatgaggatgtacttcacacccttgggaccacaactcctgggataagagaaaaagattcccttctctcagacttcaggtgcttgcccagtcaccactaccatatccgcctgggaactgggatggaagaaaagggggaaagggaaaaaaagggggagatttcctccagtctcttggagccataagggcccctttttctggtcctcagaccagaaagggagggattctcttggagttttttctgatcttacccagtagatacttctctgagttttgagctctccaagccaggtaaaatgcaaggaaaaaacatagtaaactcagtaccacttcagaactttaagttctgtgctccttccccagtctgcctgataatatttgttttcagtcttcagacggcttttggatattgtcaaatgctttttatggatctgatcatatggatatgatcatgtgatttttcttctttagcctgttcatgtgattgattttgttaattgattttcaagtgttgagctagtctggcatacctggtataaataccacttagtcatggtgtgtaattccttttatacatttttggatttgatttgtaaatattttattgagaatttttgcacgtacgttcatgagagaaatttctgtagtgttcttgttgtatctgtctggttttcatattaggataatgctgaccttatagaataagttaggaagtagtccttctgcttctaccttttgaaaaagattgtagagaatatgtgtaatttcttccataaatgtttagtagaatttaccagtgaacccatctgggcctggtgctttctgttttggaaggttaccagttactgattaaatttatttaatagttataggcctattcagattgtctattttttcttgtaagaattttgccagattgtgtttttcaaggaattggtcattttatctaggtcatcaaattgtgggtgtagaattgcttataatattcctgtattatccttttaatgttcatgaaatctgtggtgatacccctctttcatttctgggattagtaatttgtgtctctttctctctctctcttttttagcctggctagaagctcctcaattttattgatcttttcaattttttttcttttcaaagaaccaggacttggttttgttgatttttctctattgattcccatttccaatttcattgatttctgctctagtttttattatttcttttcttctgcttgctttgaatttaatttgctcttctttttctagtttcctaagatagatgcttagattattgattttagatctttcttttctaatatatattaagcactataaatttcagtctatcactgcatcccgcagattttgaaaagttgtatttttatttagttcaaaatattttaaaatttcttttgagatttcttctttgaactgtgtgttatttaaatgtgtgtttactatccaagtattttgggatttttcagctatctttctgttattgatttctagtttaattctgttgtggtcttagagcaaccattgtatgatttctattcttttgagtttgttaaggtgtactttattgcccagaatgtgttcacttgtaatgaacattccatgtgcgcttgaaaagaatgtgtattctgctgttgtaatgtgaagtagtccataggtgtccattataaccagttgatggatggtgctgttgagttcaactgtgtccttactgattttctgcctgctggatctgtccatttctgatagaaggctgtcaaagtctcaagtgtaatagtatattcctctatttatccgtgtagttctatccatttttgcctcatgttttgattctctcttgttacatactcatcagtcaagactgttaagtcttgttggggaattgactcctttaaagttagttttttgtaagtaacacattagttgggtctgtttttttgacccattgttacaatctctgacttttaattggtatatttagattattgacctttgaagtgattattgatatagttggattattatctgccatacttgttactattttctgtttgttgcccttcacagtttctattcgtcttctactcttttctgccatttgttgttttaattcaaaattttatataattccattttctttcctttcttatatcacttcttttttcaccttttttagtggctgcctaaaatttgcaatatatatttacataaatttaagttcactttcaaataatactgtactatttcacaggtagtacagatactgtgtaataacaaaatatccctaattcctccctggcatcccttatatcattgttgtcatttattttactcacacacacacaagcatacatgcacatgtgtgtctgtatgtgtgtgtgtatatgtatattatacatatacacatagcacacacaagcatacataatcaaatatattgttgctattattattttgaacaacttatgtgttagaacaattaagaattttttaaaaagtctttatcttcacgtattcattctctaaggcttatcctttctttatgtagatcagactttctgacctatatcattttatttctctgaagaacttttaacatttcttgcaaggcaggtcttctggcaacaaattttctgtttttgtttgggaaagtctttatttctccttcacttttgaaggatgattctgcagggtatagaattctaggtttgttttttttttaaccactttatttcattctatcttttcttgtattgtttctgaggagatatcaggtatattaataattttttctttgctttcctgtaggtaaggtttttttccctctggtttaagatgtttttgtttctctttgattttctgaagtttgaatgtgttttactgaagcatagtttgtttggcatttatcctgctgggagtactcggagctttctggtctatggtttggtatctgacattaatttggggaaatcttcagtcattattgccttaaatatttcttcttctgttattcccattatgcatatttacaccttttgtagtggttccacagttcttaggtgttctgttcttttttctgtttgcttttcagttttgaatgtttttattgacatatcctgaagctcagactctttcctcagccacgtccagtctgctaatgaggccattaaaggcattcttaatttctattctaatgtttttgatgtacgttttcttattctttcatagaagttccatctacttatattactcatctgttcttgcatgttatctactttttttcatgaaagcccatagcatattaatcataattgtttacatttatagtcagaaccagtttatagcagggtgtttaatccctgctgttgagaggtgaagccagctggacttcctgggtcaagtggggacttggagaacttttctcttacaagaggtttgtaaaacacacccattagtgctctgtagctagctagaggtttgtaaaatgcaccaatcagtgctctgtaaaaacacaccaatcagcgctctgtagctagctagaggtttgtaaaatgcaccaatcagcattctataaaatggaccaatcagcactctgtaaaatggaccaatcagcaggacatgggcggggacaaataaggaaataaaagctggccaccccagcctgcagcggcaactcactggcgtccctttctgtgctgtggaagctttgttcttttgctcttcacaataaatcttgcagctggtcactcttggttccgtgccacctttaagagctgtaacaatcaccacgaaggtctgtgtcagtgagaccacaaacccatcggaaggaaccaaatccggacacactgtaactgggtgtgtttctaatccttgctctgtctcttccaacagtatctttcgccttttaatgtgtcttgcaattttttgctgaaaggtagacatgatgttttgagtggaaggaactgtggtgaataaacctttagtaatgtagtgttcaggtgtgtgggaaaaggaagcatctaagtactttggtaagttcttgtcttttggtgagcctgtgccccttccctatgaactttaccagtgcttctctgtttttttctttgtttttctttgttttttgttttttttctcccttctcatagttaggtggaacaggatggctagaggaagctgaagtttggtatttttctttcacaagtgtggttaagctctgggaaaataatttctcctgatggttaagaagaataccattctctggtacatttcaaaatggttactttcctctgcccctcctggaagtaggagtggatttttcctcaatactgactgagagtctcatagtgctccaggagataaaactcacaaaagattggggcccctctgaaactgggtcccctcagaattttgatttctcaggcttgtctgcctgagcctccaataattcatcaactacagttcaggttttcctacttctgtattggttcccactgaggttgctgcttgtgcgtttctgcattctctatagtcacctgtctctctccaactttggcacagcagtttacattgtgacttcccttctctaaagaatgtaagaagagttgttgatttttcaacgtgtttagttttttacatgttagatgaagtgaaaacttctaagctccttacatgccagatgggaaactagaattaagctctatgcattctttccagggtttatagttgtattcaatgagagagacgaggtagggtatgcgtactccatctttcctggaattggaacctaattaaatttttcaaatatatgtccttactgatttttttaaacagtcatatgatttgtttccttgtattaattctcttgtgtagaacaagagaaaatttttggctaaaggccttcctatgtggtatatagtcataaggtttctttccagtgtgacttttcatatctttaaaggcaagaaggactgttgaagcttttctaacatattcattacatatatgatttctctcctttatatgtcctcacctttttccataggcataggttgaataacttctgaaaaccttcccagtcattgcatttatagcctttcttcccagaatgtgtctaaacatgttcagtaatattaaagttcctgctcaagactttcctgaattcaccgcattcgttgtgtttctctcatgtgtgtatagccattgtaaggtgaaagtttctgctttttcccagtcagtgctgttgtcgagttttctccaacatggatatctgctccagtgcacagtaaaatcagcgctcctactaaaggttcccacagtctttgtgttgagtttttgcccagtgtatattctcttgtgcactataaagcaagagctgtttttgaagaaatttacacactgattacagtcataaagtttgtctttggtgtgagatctcatgtaagttttggaggtgactgtagatcaaatactgtcctgctctaaaattgttcaaagggtttcttttcattttgaattctcccatgtctctgaagggaataacggttaccgaaggcttttgtagagtctttacactcatggtttgtctcttgtctatgatttctgtctcctgcagaataacattagcactccttttgaaggcttttccatatagatttcattcatagaatttatttcactaggagtcctctctgtttgcatctcactgatgcagacatactattgaaaagctgaaagttgttcattttctcatgtctgctattactactgttcaagtctgcactggagattctagtcagggcattaaagcctctgcaagtaaagatgtacctcctgtgctgagattgtgagacgaaaacaccgaaagaagaccctgggacagagcattccaggcagatggaagggccagagctgagtctccacagaagactggaggcctgagtcagctttgcccctctgcccagctaggggctaccctaatacccatgtctcaatcagtctgagttacgtgatatacaaacgagagaaagtccctactgttaagatactttcattctggaggagtgagagaaataaaagaagaaagtcatatcaggtaatgataagtgctgtgtgaattgagggggaaagtgggaagggatgaagtcagagaagttggaaggggaggaggtaagacaattaagtaggtgggtgccagatcatgtagagctttgtagaccgtggtaaggatttgggttctaattttcttctgttgctgattgactgtatgatctttaattagttattaaactttctctgcttaattttttttaatatttaatagtatgtgaatgtgtgagataattgcagtctcagagtggtataaatctttgcatgaaagaacattaggaataatttaggccaaaccccattgtttcagacatacatgaaagacctttgagaaattatgcattgttattgtgtgtattatgtttaacatgcctacagtcgttttagggaccagactaccacctgtgctgttattttaaaagtgtactttggagataaaatatccaattagaaaagttcacaaatcataagtgtacagtgagtatgttattacaaattaggttttttaaaagtcaggtttatttaatttatataagtaaaatttgccattttaagtgtacataccatgaatttttaaaacatatatagtcatgttaaataccactaaatcaaatatagcttatttccataaaaagttccctcatgcccccttgtaattagttgtctccctcaacctaatccctagcaacgacttaagtgttttctaatactatagtatttcccagaatattctgtaaatgaagccatgtagtatatagtcttttgaccgtattactgacttttttttttgagtttttttttttttgtactttaagttctagggtacatgtgcacaatgtgcaggtttgttacatatgtatacgtgtgccatgttggtgtgctgcacccattaactcatcatttacattaggtacatctcctagtgccatccctccccactttccccaccccacaacaggccccggtgtgtgatgttccccttcctgtgtccatgtgttctcattgttcagttcccacctatgagtgagaacgtgtggtatttgctgtccttgcaatagtttgctcagaatgatggtttccggcttcatccatgtccctacaaaggacacgaactcatcctttttcatggctgcatagtattccctggtgtatatgtgccacgttttcttaatccagtctatcattgatggacatttgggttggttccaagtctttgctattgtgaatagtgctgcaataaacatacgtgcgcatgtgtctttatagcagcatgatttataatcctttgggtatatagccagtaatgggatggctgggtcaaatggtatttctacttctagatccttgaggaatcaccacactgtcttccacagtggttgaactagtttacagtcacaccaacagtgtaaaagtgttcctatttctccacatcctctccagcacctgttgtttcctgactttttaatgattgccattctaactggtgtgagatggtatctcattgtggttttgatttgcatttctctgatgaccagtgatgaagaacattttttcatgtgtctgttggctgcataaatgtcttcttttgagaagtgtctgttcatatcctttgcccacttgttgatggggttgtttgttttttttttttgtaaatttgtttaagttctttgtagattctggatattagccctttgtcagatgagtagattgcaaaaattttctcccattctgtaggttgcctgttcactctgatagtggtttcttttgctgtgcagaagctccttagtttaattagatctcatttgtcaattttggcttttgttgccattgcttttggtgttttagacatgaagtccttgaccatgcctgtgtcctgaatggtattgcctaggttttcttctagggtttttatggttttaggtcttacatttaagtctttaatccatcttgaattaatttttgtataaggtgaaaggaagggatccagtttcagctttctacatatggctagccagttttcccagccccatttattaaatagggaatccttcccccatttcttgtttttctcaggtttgtcaaagatcagatggttgtagatgtgtggtattatttctgagggctctgttctgttccattggtcgatacctctgttttggtaccagtaccatgctgttttggttactgtagccttgtagtatagtttgaagtcaggtagcatgatgcctccagctttgttcttttggcttaggattgtcttagaaatgcgggccccttttttggttccatatgaactttaaagtagttttttccaattctgtgaagaaaatcattggtagcttgatggggatggcattgaatctataaattaccttgggcagtatggccattttcacaatattgattcttcctatccatgagcatggaatgttcttccatttgtttgtgtcctcttttatttcgttgagcagtggtttgtagttctccttgaagagctccttcatatcccttgtaagttggattcctaggtattttattctctttgtagcaattgtgaatgggagttcactcatgatttggctctctgtttgtctgttattggtgtataagaacatattacccatttttaatttttgtgcacacatcagaagttcattctttttattgctgagtaagattctgttgcatgtatatgtcacaatttgttcattcatcagttgatggacatttgggtacttttcagtttgtggagagtaataatttttctatttgtgtgtgggaggagggacatatatcttcatttcttttgggtaaattcctaggagctggatttctgggtcatatggtaggtttacttacaaactgccaaactgtttcccaacttatatataccagttgatattgtcaccagcagtatatgagagctgtagttcattcttgtcagcactcggttttgctggtattttttttttttagccattttactaggtgtgtagtagtaactcctagtttgaattactgtaatgattaatgatgttgagcatctgtattaggccattcttgcattgctataaagaaatacctgagactgggtagtatataaagaaaagaggtttaattggctcacaattctggaagctgtacaggaatcatggtgctggcatctgcttggcttctagggaagctttagggaactttcaatcatagtggaaggtggatggggaagccaccttctcacatggcgggagcaggagcaaggggtggagggaggtgatacatacttttaaatgaccatatctcatgagaactcactatcacgaagacagcaacaagctatgagggatccccctccggccatcatccaaacacctcccaacaggcccaccttcagtattggtgattacagttcaacatgagataggggcggggcaaatatccaaactatattatcatccatgtttcttacttagtgaagcgtctgttcagatcttttgcccatttttaaaattgggtagtttgcattcttgttcctgagttaagagttcttacagcctaactactagtcctttattagatatgtgttttgcaagtattttctttcaatcggtactgcttttcattttgtaacactatcatttgaagagtagaaatttttaatttttgtgaattccagttcatccgttttttaatatggttcatctttttgggatcctttgtaagaaatctacctgacccaaggtcacacagattttctcctgtgttttcttctaaaatgtttataattttatagttttatagtttcttctaatagttttatagtttttttttttaacattttcagtctgtgactaatttctctttgatgttttcatgagtagaggtatgcttcaaggtccgtgtttttgcatttggaggtctagtagctaacaaaattatttgttgaaaatatcctttctacactgaattatcctttcacctttgtcacaaattagttggctatatgtgtggttctttttctggatgctctagactgtttcattcattttgtgtccattgtttttctaacaccatctaagctctggattactgtaccacatagtaggtcttgaaattatatactgtttggactccagttttggttttgtttgttcaaaattgttgtggctatcctagttcttttgtttttctgtataaattttaaaattagcttattgattgctataaaagttaactgcctgctatatttccattgggattgcttcaaacctgtagatcactttggagacaattgacatagtgttatggagtcttcagatccataaacatggtacattgctccatttagcatttttgggttttgttttcatttttttagagacagtatctcactatgttgctcaggctggtcttaaactcctgagctcaagcatttcttctgtctcagcctcccaagtagtagctgggactacaggcacatgccacaactcctgactctatttaggtttctaatttctcttaccagtttcttgtagttttcagagtacatggtatgtactctgtcagatgtattcctaaatattttatgtttttagtagtgttattgtaatgatattggttaaatgttttttaaaattttccaaatgttcattgctagtatatagaaagacacttgattcttgtacattaactttgtaacctgtgaatttgccttactgacttattttttcttatagcttttttgtagataccttagaatttttacataggcaatcatgttgtctgatcatatgatcctatactcgttgttaaacttctcggggcctgtttcttgcctgacgtgtggacttgtaaggatgttacagagtcacagagtgatgatacgagctctgagttaaaaagacatttggaataatttaggcaaaactcctttgcttctgttacataatgcaaaatcgctttgtctttaggggccagtttatcaccatgctatatatttttttcctgtgtactttttaaaagtaaacttttattgaagcatgacatgtaaactgaaaaattcaccaatgatgtatacagttcactgaattatcacaagtgaacatattatgctagaggtttttgatttctaggtttttatttgtggttatttttattacttgaaaaactagaaggcagttctctagaatatgtattgtcttcaatggaagagtttctctgttaacttgaactttaatatctaataatcatttatgttaagtataatacctcgtgataactgaaatttcagttggatcatagtcactcctaacatttctttggtgtccatacactttagattctgctgcattctgacctcaacttctgaatgtctagtcaccaggtgtccagcataactgaattttttctgtcaagttagcagtttttaaattctgccacatctccatcatattatctcagtcacttttaatttggttgactgaagcaggaaaagaaaagtagaaaataaatattgagtaatgtagagtaccagtaggtgctgtcttacatgcttggtaaattggattcctcccccgccccgccttttttttttaacttcatgttataaaactatacatgtattccttatgctatgcaactttgcagaagctcccactggtataggccaagtatatgtccctgccccactgatgcttctcttggctccatgagttccttgggccagtggaatgttagtgagcagagaggtttttctttgttgtttttttcagtagagacagggtcttactctgttgcccaggccaaagtacagtagtatgatcgtagctcactgcagcctcaaactcctgggctcaattgatcctcctacttcagccttccgagtagctgggacgacaggtacgccacgcccagctaatatttttcgtttttgtagagacagtgtcttacattgttgcccacatcgatctcaaactcctggcttcaaacaaccctcctgcctcagcctcccaaagtgctgggatttcaaatgtgggccactgtgcccagccttgagcagaagtcttaagtatgttcctttgatttgacttggcctcctgcactcctcttttctgccaagaagagcatgctatgtctgttcacttgccttcagtgactgggcccaatattgaagacacatagcagtgttctgaacctgaccatagtactggtatctagctagccctatcatgcccaacctagatcagctgactcagagtcagtctgaaggctcatgagcatacaggcaatgtaaaccactgagattttgaaatcgctatttacccaggaaaaaatggtatataatcaaattctctgctcaccagtactttaaacatgtatttttagttttttctctgtagctacaataagttcaggcacaatttataggacaaagaagatggaagaaaatagttttaagcagaaaagtaaagtaggacagccaaactggactaattgcagtattattccttaaggagtgttattagtttctaaaattatcaactaatttttaacattggaacattttaagtgaaaagaggtgcttcactaaatcaaatatattgctttcgaaatactaaggctgatttttttcaataaaaggattcctcagttaaggaattacactaatggcatgcctctttgtttatgtaactgtaaaatactgcaatttcatatgaatcaatgtcagatatattcatgaaagattggaaatcaaggatgagagaaagagacttgaaaagtaagtctaggagatacagtattcatctgaccagaattccagagagagaaaagaaatgttggaagagaagatttagtcagcatagtaagtgaaagggcccagagatgaatgagaagaaaaaaagttaatcctaataaaattcctgaaatccaaggatagagaataaatcctagatttctcccaacagaagtttgggataagataatagtggcctcaactaaggtcatggttgaagaaatggagagaacatggcagattgtggatttgcctctcctgaacatttcatataagtggaataatacaaatgtggtcttttgtgtctggcttcttccacttagtacgttttcaaggcttttgaatgttgtagcatgaatcagaccttcattctttttatggctagataatacttcattgtataaatatgccacattttgtttatccgttcaccagttaatggcatttgggttgtttccactttttggctattatgtatgaataatgctgctgtgaacgttcatgttcaagtttttgcttgaaaacctgttttcgtatctttgggtatatacaaaggagtgaaatggctaagttatatggtaattctgtgtttaactttttgaggaaccaccgtcttacatttccaccagaagtgtatgaagattttaattttgccaccaacttttttttgttctcctatttttttattatacccattttagtgggtataaagtggtctctcattttggctttgtttttctgtaatgattgttgagctacattacatgttcttgttggccatttgtgtatcttctttggagaaatgtttattcaagtactttgaagtttttttttttttctttttcaagaaatggtctcactctgtcacccaggctagagtgcagtggtgtgatcatggctcactgcagcctcaacctcctgggcgcaagtgatcctcccacttgagcctcccaagtagctgggactacaggtacatgccactgtacctggctagttttttaaaaaatattttttgtagaaatgggatcccactccgttgcccaggctggtctcaaacttatgggctcaagtgatccacttgccttggcctctcaaagtcttgggattataggcatgagtcaagacacccagctttgcccatttttaaattggattgtttgtctttttgttgttgagttgaagttgttctttataccttctattaaaagtaatggcaaaaaactgcaattagttttgcaccaacctaataaatcaggggtgtccaatcttttggcttccctgggccacattggaataagtattgtcttggaccacacataaaatacaccaacagtaacgatagctgataagctttaaaaaattgcaaaaaaaaaaaaaaagtaatgttttaagaaagtttataaaatttgatttgggccacattcaaagctgtccttgtccgcatgcagcccacgggctagataagcttgttctagatgttagactctatcagatacatgatttggaaatattttctcccattatgagcattgtcttttcactctcttgatagtatcctttgttgcatacagtttttaattttgatgaaatccaattgattttttcctttaatgcttgtgcttttggtgtcatatctaagaatctatttccattctttgactctccattcatcattttaatgttttcttctgacgtatcttccagtttactgatttgatgtctaatctacatttacatctatttattaaatttttaatttcataatttcattcctctgctaaaattttaaacgtttattttcttaaacatatttagcatattattttaaattctgtccctcattgttttgtattcagtattcttatgagactatttctggtttatatggcttctgtatttactttgttcatgttatcttatctctgttattgttaattaagggctagatgctgtatgtgatcaattatataaataatttgagacctacgatgatattaccttcctccacaaagatttatgtttgtttttagtaggcactgtcaatgcaaaactgtcttaatttaattttatgggaaatatttagagctgagctttagtccctgtgagaaccagtcaagtttcagttcctactttctcctagagtatagttctttgggcttttaacaaaagtgttggagttttgctatctccactttcaccccttggtgggccttagactacacacacacacacacacacacacacacacacacacacacacacacacatacactctctctctctctctctctctctctgtgtgtatatatatatatatatatgtaaaaatttatatatatataattttataccatatgtttatggttctaattttccttgggaaaagtttatctgaagtacataattctgccattaccagaagtggaagtcaacagcatataagtagaagtaaacagcatgtaattactctttttaaaaattagaacagattcaaagatcattatataataatgtcagtcttacccacttgaatttttatgtattttcttggaggaggggagaaagaaatagagttacaatgatcctactagcaattgcacacgatggcttgctaagcagataaatacctttaatgtgtgtcttatcagaaaaaaaagtaagatcatttctttatacaacttatgtggaaattattttcttgtatttccttatatgattgcatctctcatgagatagtgaacaccttataagaaggaaccttagtttactcatcttcagtttcgtagtgctagacctggaattgagtacatagtaagtgtagaaatgaatgcatgtagtgaaaatactttgatttttcacagtgaaaatatttgttgttctggattatcctataagatgtattttaatagggaaggcaggatcttttctcaccagctcttttgttccatccccttctaacaggtggcatctccacagaaagcgactgtgcttttgagccagactacgctgtcccgccacttccagtgagtgaaggtatgcagcacattcggattatggagggcatgtctcgctctcttccatcctcccccttactcacacatcagtctatcagtgttcggctccagcctgtgaagaagttaactggtaaggactttacctaaatttagtatgtttaacaggaaacctaacgatatgacactttaggtcacgtcagatgtgtatatttgcatctttaggtttttcctctctggccttcctaatgtcacagactcttgacactaaaaaaaaaactccaactgattttaatttagagaattagaacagtactcagtttgacagattgatgtatttattttctaaatgacccatctgttgtgaacatatttttctaggttttcaggaagttcctggttttgccagaatacactgttgttctgatttcatttatcagcttgttcatgtcaggttaacagatggagacattctaattttaggataataggagcttgatagttcagcaaaggtacatcagtcgtattttatttgaaattgctatttgtatattttatatatttttttaaaagataatttagatattttcctctacactggacattaacttcttaggatatttactataattcataagttatggattatgttgactttaatatgatctcacaatatgtattacccatttagatcaagttgttaggtgtgaaactgtggctttattaaatgaacttttgtccttttacgtcttttcaggaaataaattttaatatatagttgaagaatgcttatgtgtgaaaatatgtaatcctgggtcactttgttagatttcttctagcattatcaatatatccctgatgtcagtaagttggctagtattgatgggttctaagtgcatggaggcatgaaattaagttattcacaaaggatatgtcgactgtttcctgtctgacattgagctagacagtagagaagtttgattatcattatgacaattcagaagaaaatgagaaatgaaatttttgggcacttctgtctatgtagagtgaaactttttcactgtttataattttcattaaaataatagcatttcttctatagttctacaaagcataaattatgcctctttacattgtgtattattggcattttcaaaaaataaatgaatcaaagtcactttggccgttagatacttcagtctaaagacactttggtcattagattaaaaaaataggtaaaatagcctaaaaacataatatcctgaaataccagttcccttctaatgtccaaaaatatgatgaattttatgtgattaggcttaaataaaatctcagtgcttagaaattctccctgttttacagtcaaaggtattattgattactaaaaatataaaaatcccaaatctgttggctgtcatgtgatgtgtttcattttaccacacagagtggaaaaaatagtaagtccagtttctatgtagaagtgagctggattgcctgaagttttagagataccgctttcctatcccatttgcctatcttaatttgaatgtcaacttaatagtcaacgtttattaagagataactattaaatataacaaagtcaataacatacctaatatcacagaggtattgtagtgaagcagtaatgcagagtgtaattgattaatgacatgtatgaacttttgagttttaattttacagtatttgaagcttctgtaatttctcatagtttaatttactgaagactatcaaaggcctagcaatttaatgattaagaatgcatttttaaattttggaagaaaacaactttactgaaagagtatgtcaggaaaatgtttctttggtcaattttctgccaagtgaagcagatgataagaattgtctagtttaacctggaatgaaattactttgaaattcaaaataaaaacctcagtagattattcatccattatcccttcttaacctaatcatcagttaccccttcttttctaattatatcttgttataagtaagtaaaaggaaagttgaatggaaaaaaattagccgaccgtaaagaaattttctccaaagaatggttctttcttggcattaattatcaaaatgcaataatttaatcaggccattaggactacacttagtaatttctccatttccatacattcaaactttcaagtgccttgtatgtattcatattaccaaccaaactgaatgaatagggccagaagagtcatcatattctattttctttgtgactttctaatagtctcttgtctctggcacagttaaaagcagtttgcttattattcttcagtgctttttacttaatcattcaacagatatttgtctaaggcccattacatgcctaggcactgctctagatatgatagagtggtgaaaaggaccactaagacccctgccttcaaggattttatatttcagttgagagaagatgtaataaatgcatagccagtaaataaatacttgaattttaaatggtggcaactactacaaaggtaatgcaatatggaaggggatagaaactggggttgaggtagagtttccttctatggaatgactggggagagtcaaaggaggagataattgagctgagttttcaatttaagaaggagccagccatgggaagatctgggatcggagctttccaggcagagctaacagtcagaacaaaagtcctaaagcagaaatgagcttggcatgttcaaggaatggaaagaaggcaagtgtggcctgagcagagtaagtctgaagggacagtagtagaaaatgagttagagctggggcacgatggctcatacctgtcatctcagcactttcagaggccgaggcaggaagattgcatgaggccagaagtttgagaccaccctggacaacataatgagaccttgtctctacaacaaataatttaaacaaaatagctgggtgtcatggcatgccacccatatgtagtcctagctaccaaggaggctacggtgggagtgttgcttgagcccaggaggtggagctgcaatgagctctgatcgcaccactgcactcaggcctgggaaacagaacaagcaagaccctgccactaaaaaaaataaaaataaataaataaataaaaagagttggagaggtgggcagaagccacagtttttagggtcacggtaaggagcctactctgattgcaggatttttttttttttaccttatttattctctctctattgttttttcctttttatttttatttatttatttttattatactttaagttttaggatacatgtgcacaatgtgcaggtttgttacatatgtatacatgcgccatgttggtgtgctgcacccattaactcatcatttacattaggtatatttcctaatgctatccctcccccctcctccctccccccacctctggacacaggaaggggaacatcacacaccaggattgtacgattttaaacagaggaggaacaggtagtagtatgatccaatttaccttgtaattgaatcttgttggcatgtatgtagagaatgaagtatgagggactagagtatcacatattcattagccttgtgcagtcagccctctgaattcatggattcaaccaaacacagattgaaaatatttttcttaaaaaaaccatctgtactgaacatgtagatttttttataatccctaaacaatacagtctaacaactatttgcatggcatttacattgtattagatattataagtaatttagaaaggatttgaagtatacagaaatatgtgcctaggttatatgcaaacactgtgccatttcatatcaaggatttgagcataatccaaggaaggtcctggaaccagtcccccatggatactgggggacagccacataggttttcctgatctttaaatagtcattattagtcattgtctccacttctaataaggtgggtacttatgttttcattttgtaagatatgacaaaggagtatccttttcctatcattgttactctgtaacctttatactcttaacatatttatcttagtcttccatgccggtgtatataaagactcatttgcagatataggtccatttccaaatagtttgactcattttcagtctggagggagtaagaatgggtaaagaccagctcaagaatagatatagtttagagcttgaaaactaatttttaaatgtatacacacctcactctattcagtacaaaaataagttaatgtagtaaatgtgttcaagagagacatagactttgtggtccgactgtttgggtttatatcccagctctgagtgtcacgtcacgactgtttgcttctgtttcttcatctgtaaaatggggataacaataatacaaccgacttcatgggtgtttgtcttattcttataatcacattgttttatactttttaaaaaccgtgtttaagggctcagaaagtgttagccgttattgttaataaaatttgttgagaaatttgtaaaaattgcttttcatgttagataccagtgggaactttaaagcttcatatgtttttaaagtcgcactttttaatgagtaatagcaataataatgacaataattttcattataatgcctgttgtgtggcatactcttattagcttgtgtttttgtcactggtgtctccactttacagatgagcaaattaagttcatagagaggtaaatgtcttgctgaaagtaaaatgtcttgtggaggataatacagctaggcagcggtcagagttaggattaatccccagtccctccacatgtgtctcattttaccaagaagaaaatcaaggtttagtgaaattaaatagctcatccggagcatctagtatatcaattaagatttttattgtttcaagtaataaaagatacagccaaatggtttaagcagtaaagaagacctaaaaattgggcaggtttcaaggttcgttgggcttacttaggtattgctgtgctttgggggcgatgtggaaaagagtaagcagaggctccctgtggtctctagattcttgcccagtgctccttccaagatgctttcccatagtatcataaagatcctcagcatagatagatgattaaggatgctaaaacttcattcattcaactcttacggaatttatattatttacccattatgtacatttgttaaatttagtaaaacttaaattttgcatatacatactttgggtaggggtgaaaactggtacaaccatttttatggcaatttgacaatatgtatcaaaattataaggcacataatccttaatacaccaatcttattactaggagtttgttttacaaataagcttgatcagatttgaaaatgtgtatgtatgtgcgtactatatgtgatattgtttatatagcaaaaaatgaaaatccaaatatttctcaataggaacccatgtgtgtttttaaatgatacatatgcagacatacatacacacatgcatgcgtttgttggtagcctagagagataactcttactcggaagtgggagagggatgacataagttgtgctgtatagctttctgtaagtcttatcttgtataaaatgcaaaatctcttgagacagtataacaaaatgaaccctgtcatttcctgactctgtaatctcgctcaaatttgtttaaagtctctgtacttcaattcccttatttctaaactagggttgataatagtatctaccccataggagtaataagagaattagattaattagtacatgtaaagcacgtaagacagcgtctggcatagagtaagtagtcaaaatgttagctaaattattattatagtttctaaagagatgtgggtattgagtgtttatcagctatgtcaaatatgtgttctgagcttttgcaaggtagccttcaagaaacaattacgctaagtcagtcagtctacttttctgaggagtaatcttcaaataccaacatcaaatagattattatctaatctctgggataaaaaatggcctgattttcaaagtatttgttgccaataaattggaatgaccatgtggcaatccaatttggatggtaaataagtcacaataactgatttgatcatgctgagcctggatattttagatgctagctatggccaaagccatgaataaaaaggaaacatttacttgttccagaaacatcctggggaaatctttgaaaagctcttttgacattgaaaagggcctatacatagtgttattctacatagtctgatatattttagtatattcatgatatgttctttgcataataatatacttatcctgcaatttttgaaaacctactagaattcaagatgtactgtggtgaattttatgatgggaaaaaaatacagaattgctgcaaagattaaataagatttcttaaacatatagtctaacataacaaacattaacaaatattatttttcttctcatttatatcttggaaaaaatggaaacatagtcttgttttataaacatcctggaaaaattactgaaaagtgaattggaaaatataaagggcctgtagatagtattagtctctatagtcaagatttatttcagcatacttataatactgtggcatctgagtaaatatcttgcaattttaggataaacattggaattcataatatagtataatgaatttgttagattaaaaaatataggagacatgcatggtagtcttaagttccatcattactaactgttagagaccacatgtttttgtaaggttaaatgaggaaatatatactaagacttttaagctcttttggaataatagactaattaaactattagatctggacctcattcagggtactgtttctaatttggtttctaacttcagattctctggtttatgagataaagattaggctattgtaaaacagtgtaggattggaaaaaagggggggcccttatttccttgaagaggttatttctgtagtcttccaaatcaaaagtagagaatgttagagggttattacttaattcaatataataatttcaattatcatgagtcagtattgttaaagaaaaccagagctcgacagtaaagtggtaaaaacagattttagtaaggctctattgcaatagtatagaactgggctcaattctgaatatagtaaagaatgttggggatttatagctaaggagcagagtggggcagaggatagaatcagtggatggaaaattattaagaggaagcttcaagagtaaggggattattgccgaaccaactaaacagtgccttgctgaaggcaagccatgttgaccagattatcaagggtagggggattctcactaaactgagttagcaggattcttgctacaactgggccaggaggcgtgaggacaaggcccacgcaagaacgttgaaaagaggtatcagaggaacctgactaaagtttggttaaggggtgagcctttgccactgcgtatatgttgaacacctaaaaggcggcatgaattatcaaacaaataatccttttgtgatatttgcacacactggatttcaaaataattaaaccttctctttttatatttaacctgtgaggttttagacaagaaagtaattttctagttttttttcttttcatatttgaatggaagtcactcatacaaagtgaaagttttatttatagtattgtagtgtttatttataaaaggattatttgtagtaagtgtagtattactgtatgtattcttttgaaatatagtagccttgtcttcctacctctattcagccaccactagggaaagtttgcgaaagtgcccaaatgacccttaatgaagagagagccaaaataacaagtcattgatacttttaagatgaagtggtttcatttctgtcaggttagatgatttgcaaggttatgatgaaaattggaatggaagaaaaacaataagaaaaatatttttaaaagtcaaataagataaaataagttgcttgtcacaagaaagtgatttcagtttcccttataaagacaaagttatcagaatgtataaaaagcatttccagggagtgttatttataatagatgcttctaaacaaattgagaggaagcttacaaataaaggaatgaaaaatatataccaaataaatgttgagaaaaggatagtattatttgcaataatattaaacacaaataaaaaagttttatttgatattttatgcagatacaattcatgaagtagatgttaacgattattgcttttttatgcatgagacaacatggcatcaaaatgtataaagttatccaagagaaaagaaaacatatgttcacaccaaaacttgtacatgtatgttcatagcagcattattcataatagccaaagagtgaaaacagtttgatgttcatcagctgatgagtggataaataaaaagtgatatattcgtattatttggcattaaaaataaatgctttcatgatccatggtgaaccttgaaaacgttacactaagtgaaggaaaccagtcacaaaagaacatatgttatacaattgcagttatatgaaatgtccagaataggcaagtaatctatagagacagaatgttaattggtggttacctaagggaaaggggtcaccaacgatggtataggtagtgaatgcttaagggtatagggtttcattttggggtgatgaaaatgttctaaacttagattatgctgacaattgtacaactctgtgaatgaactaaatccattaaattgtacttatatctcaataaggaagttttttaaaaataaaaacttcatatagtaaacattagcaatgaaagggaaagttgatgaatttatatttaacccatttatgccagaggctacaaattttttcatgtcaaaaatcagaccttggccatgaccttgagcagtaggatataaataactcccacaagcttagcgttccaatagtggaacactaggcataaatgagttaaggcagatttcatgcctcataaaatgaacagctcattaaaggatatggataatttgaataataagcaattaaacttaactcattatatttcagaattgctaaaatacttggaatgttctaaacaaaaagaaataagtgtttgaggtgatggatatctcagttaccctgatttgatcattacatattatatgcctgtatccagatattacatataccccataaatatgtaaagttaatatgtgtcaagtttttaaaagcttaattcagccgagtgtagaacctcatactgaaaaacataagatttcttatacttgtattgttttccagcacttgtgaactgtttataaaagttgattataggccagacgttgtggctcacgcctgtaatcccagcacttcgggaggccgaggcgggcagatcagaggccaagagatcgagaccatcctggccaacatggtgaaactccatctctactaaaaatacaaaaatcagctgggtgtggtgtcatgtgcctgtagtcccagctccttgggaggctgaggcaggagaatcccttgaacccgtgaggcagaggttgcagtgagccaagatcatgcggctgcactccagcctggtgacagagcaagactccatctcaaaaaaaatataaataaataaataaaaataaaaaattttaaaaagttgattatatagttggccataaagaaatctctgtacaatgcacatatttttcattgaaaatcaaaatagaatctaacaacaaagaagatagggagaaatttcttttctacttctaaaattttaaagttttaaaataactttttaaaataacttttgggttaaaacagaaaccaaaattgaaaaaaaagttggaaattaacatgtattatgtattaaaacttatgaaatgtagccaaagtggtactctatggaaaagtcattaccttgaatacttttattagaaaacaagaagtactgaaaataaatgaactaataaggagatcgaggaagacatagtaaacatgaagtaatcaataaagttaaaagggaaaatgaataagcaaaaaactagtacttgatcagtaaagccagtttccttgaaaagactaagataatagagcaatctttgatagaagtgatcaaaatgaaaaagagggagtgagaaaagataacatacagaacatacagaacaagaaattagtcactaatctttttattataagggaatacagcatatagctttatagcaaaacaatacacacaaaaaaaccttgaatgagatggaagaaaactgctgtaaatttgactcaagaaaacttaaaattatgactagcctggtaaccatagaaatcaaagatctccaagagtcatcagacctagatgattttacaggcgagttttagctaaacttacaagtaataattataataatagtagtagtaattaaagataatattttttgagctgttaccctattctagacagtgttaagtaatttacctatatgagcaaatttaatcttcacagcaaacttagtggatagtcaacagtctctgtgtgaacactttcagtgatagtgagctttcttctttgtaacatagcctgctcctttgttcagtagttttaactgtcagttctctaatttacatggatggaaatgtcctcctttattgctcctacccattagtcctagttctgccttgtagaactatacgacataaattaacctcttctttcacgtggcagtcttttatatcctggaaagcagccatgatgtctacttttctgtagcttaaaagactttatttacagcctgtctgataccaagatggtagtacagctgtgttattttcatcatcttctgctctagtaaccatatgaaaatgggcatgagattactttgaaattactcttccttgtgaccccttatcaactttcagtgagcattttttttcttttgagaaattgaatagaaactcctagtgtccacattttgacatcctttagtcctgtagttctgtgaagttcctgcatggctttacagaaactgttattggtagtttcatgttcatgtcttcctgtccttttagaattctgaaaggtaaattgtgtgggtctggattttgattatgtgtattttaacttgtcctcaaaacttggtctttaatgtcctcttaatgatgtttattaaatataattttcttaatggagaacattaaagcaaaatcagagttgtcttaatttgtttaggttgctataagaaaaaacctctgggactgggtaattcataaagaacagaaatctattttctcacagttctggtggctgggaagtctaagatcaaggcaccagcaggtttggttgtctggtgagggctgctgtctgcttccaagataacaccttgttgctgcatcttccaggagggagggacatttcgtccacacctgagggaagatggaggtgtgacataacctaactctgtagcctctttgataaggtcttaatcccagccacaaagggaggagcctttatatggcttaactaccgcttaagggttctacctctttctactgtcatactggcctttaaatttcaacacctgaattttggaggacacgttcaaaccatagcaccaagggttgagtaatggattgttctgtctcttacttagagcaggatattgttaaacatggcagactttggagtcagatatacttggttgaaaccgtgactttgctacttattaactgtatgaccttggccgtgtcacttgactactctgagtatgttttgttacctgtattgtattattggtatttctgcatcacagagtattgtatggattaagtaagatatcatggccgggaatggtggctcacacctgtaatcccagcaatttgggaggccaaggtggaggatttcctgagctcaggagtttgagaatagcctgggcaacatctcaaaatcctgtttctactaaaaatacaaaaaaaattagctgggtgtggtggcatgcacctgtaatcccagctactcgggaggctgaggctggagaatcgcttgaacccgagaggtggaggttgcagtgagctgagatagcaccactgacagagtgagactctgtctccctgccaaaaaagtaattaattaaataagatgtgtgtcaagaacttagtaaagagtttagctcgtagaaggtgattcataaatgaaagcttataataaaatcactacataatttatctttcccatgcagcagatctgtcctgtccttgtctgttttttaattctaaaaacatcccagcaatcctttttgctatcttcaaaacatagctcttctcaactggggctctattcttcgtggacaatattgttagatggttttctactcttcatctttgattatggttttctactcttcatctttgattatttccccctctctttgtatatttctttttcaggcacaatctgtctttatcaaaaaatttctgatatggcaatatttttttagatgcttccatatgtttatgattgtataaattgctttttattttatttatttatttttttgagactgtatctcactctgtcaccaggctggagtgcagtggcacaatctcagctcactgcaacctccgcctcccaggttcaagtgattctcctgcctcagcctcctgagtagctgggattacaggcgtgcaccaccatgcccagctaatttttgtatttttagtagagacggggtttcaccatgttggccaggatggtctcgatctcctgaccttgtgatccgcccgcctcggccttccaaagtgctggggttacaggcgtgagccaccgcgcccggccattgctttttatttttaatctataccctcaaaccatattctcttttaaaattattgaccatgggctcatagcttcttttctctacatttttaaagaaatgtttgcctaaatctgaagtgttgaattgacggtccagcattccttttagtgctgtgaccaatgaagggtcaaaccaaggacacctaggacctgagatggagaaggcaagttagtaagataacagtgtggtagcactcatgaagtagatgcataagcagaccctaaagattagggtggatcagcagtagggtaattgttaggtgtcacaggaagtaagtggaacctgttaatccaagggaatctagggggaggcagtaggcaaagttccagggaggacaagtagtcagcaccaagaaaaatgtctaacattgaggtcactgtgtaaggtaatgttgtttttcaacagatctttatggaatgtctgtaatgtggcagggttaaggctcagaactctaggacccaaagaactgatagggtcacactggtcaagaacccagctgaacgaagaacccgtttagagttctacatagtcatttgtaaactctgggcagattagttctttttgatcttctgtttcttcatatgtacagtgaagataataacaccttaaggctgagaggaatacagaaatgtgtgtagagtttctttttgtgccaagcacttcttgtgacaaacaaggggaaataataaaaagaatcctaacatgtgaaaaagttgtcaatcacttgattaatatcctttttagctcctgtgttgtgtttccaagaattgggtatcagttttaaacatggaaaataccatgaagattacagaaaaaaatccttcattgtccatccttcttctgtgaccttccccagaaaactcaccatgatttatgccatggtccctaggaagtctaatttttttacttaattgaccttgtccttctttacttgcttaacttcccacctgctatggaatgtgagcagtttagaaagtggcaaatgtggaatttaagggctaaacaattttggccatgaggaatacttttcagtcacaaagcatcacaaaagtcaaataaatatccacgattcaaaagaaagccttagtaactctctaaacaggaaataaattatagtatgggataatataaagcttagaacagaatatatgttcacattataacaacagaaatttttataatgctaaactatatatttattctcattatagaaaattatgcacccaaattgacattcagcccataagagtaataaacacgtggcatggcagagtaactccctctcttagaggaggattttaaacaccagagggcagagtgttccagaggacattttcagttcagctggcctttcttaattgtaaatgcgcatccttaccttgtccgtcagtcattcatgtcgtgggcagaatttcaaaagttaagaaatgtggttatttcattttacttatttttttcttaagacacagagtcctgctttgtcacccagactggagtgtggtggcacaatcactgctcattgcagcctcaacctcctggggtcaagagatcttcccacctcagcctcctgagtagctgggactacaggcgtgcaccaccatacctggctaattttttcattattttgtagagatggggtcttgctatgttgcccaggctggtctaaagtcctgggctcaagcaaccctctcacctcggtctcccaaagcactgagattacaggtgtgaaccactgtgcccagccaagaaatatggtcattttagaattgtctatgtggtattatctgttttgatgactttgtttagatagcacaatgagcagtgttttgagttataccagagttggttgaacatctctgttttccccatttctggttaatgttcatgtttctgatttctgaaaacgatttttagaaaaaattatgtatacatctatatcattcagtaaattttataactttagattaatgaagtaagtaaagtgagagaaaggagatttgatatgtgtatcttatggctcagtatgcccttttatgccctgcttatcaataaaaacattctgaaagaaccacctgccaactcatgacctttttcaaatgttacaattatcatttagaggtagcatcacacatttgggataattttattcagggtttagatagtaaagtcaacatataaaataaaaactgagtataaagaaaattatcctcagaaatccattacatatcattcacgacattcattaaacagaaatactgcttctcagtatatccaaccctgccagtttatcctttagagttgtaactattttactctttactctctttttctttgaccaccagatgaagtagttggctgatgtatagggatcacatatatgatttttaagaatatatttctttttcttctctgtcactcattaccctactgctgcagattgaagtcctgatctgaagcagtagccattgctaggaaagacacaaccccgcgtagaaagttggccaaagcttgaattgctatagctagtagaatggttactttcttaactcctgtgagaatagagatttcgtatgtacatctcttcataaatattaccctacctttaagcacaatagagtttagcacggatgattactccttagagaaagcttttaatatagcaagactgaaaaaagaataaaaataaaaaagaatgtaaaactgtataagttttagcatgacttacctaaattaatcataaaggagttaaaaattagtaaccaaggggaagagcttaactccttaaatctctctccacccttaagttaaatccaatttttcaagcaaaacaaaacctgtgtactttgtcttttgaagtattttaatcatgtcctcatcccagttagctcctacacagcataagcaacgttagaaaaaattatttgttgtccaagtttacattttttgcagaacttttctggtatctctctaatgcaaagatctgctcaacatgacttgatgatggggaggtgggagagaaagttgctctttttacctaagatattgaataattagtattctaaaaagtcacaactgaagagaatttccctcaaaaataactactggcacaagacaatatttgagttaaaaaacttactaggtagaagagattagattatccaggaaacagaatgagataggctgtccatggaatttccaagtcaaacataatagctcatttttgagtttgccctacagttttctagttaggtaggataaaaagtaataggttattttaaacaactcaatcactttgcatgttctttgatattaaccattccatagaaaccacttatacttctttattaccaagttactattttctgaagacatttataagtcatgttgaggcagtagaattacttgtacattattatattaaataatccttgaacgctagtccgcagtatctgtatctactataattctaaaaagaaatagctactagctacttgtgaaaagtatatgcagtgtgatgggacacaatatccagtcaaacataaaacctagcctggaaaaatatttaccctttcaggcaattttctgtgtttatggagttctattgaaattccacttttcatttttctttgctgttttgcttagatactattaaaaaagataatatagatgtttagaattttaagcctttgctttgtatttatttttttctattcccacagtagctttaggaataaggtagaaaatgctttactgagatgaatcagtgggtcagagtagttaggtgccttactcagggttatatttagaagtagcaaagctgttagtccaactacagtcaagactagtcaaatgcatgtccatcccactacattgcaattctttttagtcacattttactgaggttcttcatttatggagataaatgcatcataaatctatgaccaacaaatacgtaacttttccagaattggtattataatggcagtgttgcccatgtaagagaatggtataataggtaaatttacctaatattttgctttgtattgtatctgaatattgcattaaataaatggtgatggaaaagtaacacagagatatgatatagaacaatttcatatagaactaccctatataaatagatgaaatatcatagcatcagtgacccatgcttaataaatctaatgaaagatatttttctgcaccagtcatctcagagcaacatccagaagactatagagagagtaccattacgacaattctatgcattggtgctttcactggctccctcttctcctgtgataccgtttggaagctatcctactatcccctggaagggggagctcttcctaattcctgggaggtgagggaaaactatgacaagaaaacgattgtccaggcccagttagggagaggcctttagaagcatggagtggaccagtaaccctgtcttacaagtgattgacggagaagttttcttgttcatgaatgaaggctatgagcatttttagtgaagtaagtgtcttttgaaactttctttatctagaaggaatacaggtgatagtatgcctctctttgaaattggtgtcattgctactttattagtcaatcagttgatagtgctgcagttttggcatatctgatgcataccatctgaatgaaaggcatttaattagggttttaatatctctaagtatttaaaaatgaattttctgctatctcaaactctagacagttccttacattgcaacaaaatcactgtataattttaacacttaataaattatggagatactgcagacctatattagcttgctaaagtattaatattttaaattacctcaattgcattttttgttggtgcctactaagtaactgttttacagcgtatattcacacagctctgattcagaaaatcagaagagcaaaacatgagaaggaaacagtaagagaggagtttacagctttaaggcatgaggagcttacagctttttaatataaattgttcccagaatccatgtcacagatccttatatggtgctgcttttttcctcttggttgctatgacaacagcagcactgcaccattcatcagctctggacctgggctgcactgctagccttccttgttactcctgaatgttaagaagaacatccgtgaatcattcactctgttaacgctgcgccattagaaacctaagaaccagttcttccagtaatttgctctaacagagggtgaactaaactgcgccacagagaaaaattgtgtaaaaatatttcttttatcctaatggaatcatacaacctatatttgctgcagtattctgaaaggacaagcttatgtcaaccaatctaatgaaaagaactcgtctgtgtaatctcttgaaatcattagttgttcaaaacagaataccacagtgcttctctggatacaaaaagaagcaggtgatgttgttaggggttctaaacccctttgggagcatctcttgtgctttgggaccataatcaacatctgctataagaagtatcacctgtaacgcacagtaagttctgggcagcgtaaagagctggctggagattaaagtgtgggtcattcctgatgtgtcaggtctgataacaacatgaccagtgaataagaagcctttcagcttttctaggggaaaagactctgtagtattgactagtgaggaagaaaaactaaaacctgtgagtatgatgagtagagtatttgttacgtggatttctgagctgtaaagtctactttgttctttatagaaaaataaacacagcctaagataatttgacatctagttttcaaggaagccattaagaagctgtattttggcacatttatttaatttttaattgtgtgttcttttgctttatatatttatatgcatatatgaaccttttgaaatggttttatattttaaaaaagaatatgcattgcagagaagcctgttaaaaactcaatttttcaatgtaaatgtgaaggttagattgtctctcctgttagattgcaattccagaatagagctctacttcctgttgcagtatccttataaataaaataccttttttaaaaaataacaatatggaaatctagaattttgtaaacaagctttcttaatacataaaatcattcttgttatttcattaactggagtgtttacaaatggactttcttagtttaagaattttttttaacaacacaatttgcaagttatgatatttattgtcttattttctcagttgagtttagactaaattagaaatttacctttgtttacttgtatttttagatcatttggtaattatcaacaagatatattgattttatatactgacttttcttaaaagactctttgttttctggcttttaattattttctctttttagttcctcagctaaccatggtaacttagaaatgtcttgaaagtaggaacttggtttttcaaaattaggatatttgtagtgatcttcagccacttcaaaaaagaaaaagatattttcatttagtcttattctttcaattacttgtcttcctaagttgctcttattgatttattgattgattgagacagggttgcccaggttggagtgcagtggtgcaatgatggcttgctgcagcctcgacctcccaggctcaagccatcctcctccctcaccctattgagtagcttggactacaggcatgtgccaccatatccaactaatttttttttttttttttttttgagacagagtctcgctctgtcgcccaggctggagtgtagtggtgcgaactcagctcactgctgcaagctctgcctcccgggttcacaccatactcctgcctcagcctcctgagtagctaggactacaggcgcccaccaccacgcccggctaatttttgtatttttagtagagatggggtttcaccatgttagccagggatggtctcgatctcctgaccccgtgatccgcccaccccagcctcccaaagtgctgggattacaggagtgagccaccacacccggccctccaactaatttttttaaaacatttttatagagatgaagtctcatgttgcctaggctgatctcaaacttgggctcaagcagtcctcccaccttggcctccccaagtgctgggattacaggtatgagctgtggctcccagtctgagttgctcttctgaaatgcactttatttggaaaatatatacgtcagtgatatgactaggttattttaatttacacaattagcaaaagaagatttttgttattttgtcattataccattcaatttctattccttcttccatttttgagactttgcctatctgtttatacaagtgcctttgcccaatgtttagaaagcctttaaatagggagaattaatatgttaagggataatgaaagggttaatcatttgtattaacagttatatatgtcattaataacaagattttgcttccgtcatctataacggatcaaataaatattcacattttaactattgctctgcaagtaaataaaataggaattttaaattttatgtatatttaataattgtgtacattataagttaatgcttctttatgactatcctcacacatgtatgtatagaaacaaaggattttatatatccattatctctgaaactataatttttattaacagtagcaaagaggccgggtgccatggctcacacctgtaattccagcactttgtgaggctgagatgggaagatcccttgaggccaggagttcaagactagcctgggcagcacaaggagaccccatctctacaaataatttttttaaaaaattagccaggcatgattgcacatgcctctggtcccagctacttgggaggctgaggcaggagaatcacctaagcctgggaggttgaggctgcagtgacccatgatcactccactatcactccactgcactccagaccaagtgacatagtgagaccctgggcaacagagcaagactctgtctcataaaaaaaaaaaaaattaataacaaagactggtttaggtactttttaatgaggttagtatttttattagcagatttattcattttcaagtaatctttcttgaccatatcctttggtattttttttttatgtttgggatcttattatatattccttaaagattgtatattaacctatttgtttgtttgtaaactggctaatgtaaaatccactatagacctccctattttaagagatgctgcagtaagtccttttataataatccctattatgctgatttggtgaatctgtatgtatgttaggttttcttaaaggccatccagtttatttcagcatgtaaaaattcaagttgcagatttaactggcagagttctatgaaaaaaataagacttaatactttggatgatcatttagcccctcaatttcaaactagtttgacaacttccatcttactttctgaaattctttaaaaagtcttttcaaggccaggtggtgactcatgcttgtaatcccaccactttgggaggctgatgtgggtggattgcttgagctcaggagttggagaccagcctgggcaaatggtgaaaccctgtctttacaaaaaatacaaaaaattatccaggcatggtggtgcacacctctggtcccagctgcttgggaggtttaggtaggagaatcgcctgaggctgggaaggtaaagttgtagtgagccgtgattacttcattgcattccagcctgggtgacagtatgagaccctgtctcaaaaaaaaaaaaaaaaaaaaaaaaaaaactattcaatattgttcatataacatacaactgggtaaaatcttagttaatagtaggcgttacttttttggggggagggaatgtgctagtgaatagaatataacaatttcaaatgtaaactcttaggttttttcccctggttttcactaactgaaacttaaacatgttgtcctaataacacttctgaatatctgggaatttgttagtaataagcttttattagaaaataaatacctcatttctgttagagtctacattaagacatgaaggactcctattggtgataaattattttaaaagggtcatttctagtcatcctagctattttttctcatgggaattaatcataatatttcggtgataaatgtgtgttttttatcactccaacattatgtaagaaaacatttttaccactgtaaactttgcagcttaggacaggttaacttctgtgaggtttctcttctataagatgaatgaagtagtgcatttttgtagtgtcattgtaggcattaagaaaaatatatagataaagcatctagtatagtacttgacacaggggaagcattctcttagtctttgatacttactttccccccattcctctccattggcctacatcagtgatttttggacttttctttgggagctcctttaaggcaaaggcatttgaatacttaccaaagggatctgggatgtagcctgaagtggtacccaaaaggaaacctggaaatttcttgcaaatctcatatttctttaaaactgtgtacattctacatgtatttttattttataataaaaatgtttcccaaaaaaatctttaagtaaaactcactcttcaggaaaatatactacattttctcctataaatttgcataccccaacataatactcctcacctatatgtattccccagttgaagacatgctacttagatcatcgggtctgggtatcattttaaaaatagaaattctaattagctgggtgtggtggcatacatatgcctgtagtcccagctacttgggaggctgaggtgggaggatcgcttgagcccaggagttctaggatgcagtgagctgtgattgtaccactgcactgtagcctgggccacagagtgagacttcatctcttgcggggggaggggggaagagggggaggggagggtgcatatttccctggagaaagagattgagaatcaagaggcaaggatgaaaaactcaatctggttgaatctggaaggcttactcagttcaaaaaagtgaatagtggtttgaagttgagttaagctgtagtgggatgagaaaggaatatttcatgtcggaactagagaagaatgatgatagagaaacggtttagcattttaaagcctgagaagtcctacaataaagggaactttttaattgtttaatctagcatctctaaaacttgacagcagacactttatttcttacatgcccctgcaaaaccatgtggaacaagtaagtgttccaaggagcatgctttaggaaataactgaccaaagaaagttatgtcatttagaaggaaagaagagtggttaactgcacaaaatgaagtatgaaagaaatcatcttagcactccagaagatatggaaacatggctgggtctagtggctcatgcctgtaatcccagcactttgggaagccaaggcaggtggattacttgaggtcaggagtttgagaccagcctggtcaacatggtgaaaccccgtctctactaaaaatacaaaacttagccaggcatggtggtgcatgcctgtaatcccagctacttgggtggcacaagaatcacttgaaacctgggaggtagaggttatagtgagccgagatcacaccactgtactccagcctgggcgacagagtgagactgtatctcaaaaaagaaacaaaacaaaaacagaagattatggaaacataatttactcagattccccagataaattatactttgctttaatattttaaagatgagtgtgttttttaaattggagaaaatattgtttattatgtagactagaaagtaaaatggtaaagtgacttaagtaaaatctcagaagcaaaagtgtacaaaatgcattcaagtggtaaataaatcagtttgtctggaacagaggtttcatgaaggatgctctggaagagacaactgggaccaaaatgacgaagccattagggcagtgataacctaacatggtagccatggaaaatgtataaagagaaaaagattttggaggaataagcagattggtgactggccagctatagagtacaggaatatgaaagatctgccaaagatgattatacaattttaagaagaaaaatgatggctttgctaataggaaaagcttagacagatagctgattttaagagattgatagacattgagttcagggtggtaggacgatataagaggggaaatgtgggccaggcgcggtggctcacgcctgtaatcccagcactttgggaggctgaggcgggcggatcacaaggtcaggagatcaagaccatactggctggcgcagtggaatcctgtctctactaaaaatacaaaaaaaattagccagatgtgatggctggcgcctgtggtcccagctgctggggaggctgaggcaggagagttgcttgaacccgggaggcggagcttgcagtgagccgagattgcgccactgcactccagcctgggcgacaaggtgagattctgtctcaaaaaaaaaaaaagaaaaaggggaaatgtgttttcagcactttgaaaataagtaaggttttaagctgtaaatttggaagttatacccgtagagagtatagttaaaactgtagagtaggtaaaatctttttttttttttttttttttttgagatggagcctcgctgtcacccaggctagagtccagtgacactatcttggctcactgcaacctctgctcactgcaacctctgcctcctgagttcaagcaattctctgcctcagcctcccgagtagctgggattacaggtacctgccaccacgcccagctgattttttttatttttagtagagatggggtttcaccatcttggccaggctggtcttgaatgtctgaccttgtgatccacccgccttggcctcccaaagtgctgggatcacaggcatgagccacagcgcccggccataaggtctctttaggatgcgaattgaacaaatagaaaaggtagaaagtaaatatttcataagaatttacgaggaattttcatgtttactcattttgtcttttcgttggcactttgaattattatggccctaatcttatttatgaagaaaacaagacctaatcaggctaaccatgaagaatttaggcataagagatcagagctccaacttagacctctctctaacttcagtatctgttctcggggatcaagaagtaaatcttaagaaatacaacctaagggaccaaaagagaaaaacccactttaaaaaacaaatgagatgaataaggagcagtatgaaagatattgaaggaaccaagatggtgtaacttttgctggaaactgaggcttggaaccgtttgagtgactaggatcatgattttcttgacatatgattctgccttttgctctcctgaactgtagtccaaactcttagctgcagtggtctacatttggcaaatatttgtattctgtttcattaaagaggagaaagaaagagagaggctacataaaatcggtgggagaaggaagcatttaatgagaaacttacagtcaaatacacttcttagagttctaattgctttttggtgtctgtgatatatagtcacatgtagcagggatccccaacgctcaggctgcagactagtaccagtccgtggcctattaggaactgggcggcacagcaggatgtgagcctgcaggcgagcaagcattactgcttgagctccgcctcctgtcagatcagcagaggcactagattctcacaggagcatgaaccctattatgaaatgcacatctgagggatctaggttgcttgccccttatgagactctaacgcctgatgatctgaggtggaacagttacatctcaaaaccatccccacccccaacaaaaattgtcttccgcaaaatgggtctctggtgcccaaaagattggggaccactgatacataggactctttaagacttttaaaaatgaaatgtttctctttctccattcaacatccttactccagtaaatttctcgttaagatagctgaaaggatccctaaagcagttaactgttttaccttaactcctgcaatatgatgtaatagttcagatcctgcgcttactagcagtgtgacgttgggcaagttgtataacttctctgtgcttcagtttcctcatctgtgaaatgagtataacaactcccttaggatttgtaagaattaaaggaatttttacaggaaaaatgcttacaacagcctctagtacatagtaactgtccaataatgatagttgatgatgatgctgtcacttaatagcaactgcatgatcctatgtatctctctatacctttctttaaagtcctgtgtacttttcctttttttctttgttgagaagggaagccgttttttacctttactaggtaggctgagttttttaagtgagcagagagtagttacaacttgaatcagaaggcttaaatttatatgacaatataaacatgcctggatttagaaaacatcttgctgtcaaatggatactggtggtgtcctctcctgataacagtaatattgtaaccattaatgttcagagtatttcattgtgagtttatattacttcctgtgggaactggtttcatattcagtccaaaacacttgataagtatgtagtttctccttccttgttttatttaaaagaaccctttaccaaaaaagtatgataaatatattgtcacattgttatgatataatgagaagctttgatataattgtggtaaaattatacattcagtacacagcaggccttttcatcttagcatttattacaaatttaagttttaaattagttagcaatataatgtagcgtaagcttatcttacatagtttgtgtactctggagccagactgcctggatttgaattctgactgatatgccttacttctgtgtccttgggcaagtaacttaacctctccctcagtttccgcatctgcaaaaagcaggtagtaatagtacctactacttcctagggttattatgaggattacatgagtgaatgactttgaacagttttgatcacaataagtgctcaattattgctgttattatttagtatttgtgtggtttacgtcttgtctccctaaaagggagagagagtatttgtcctttttattattatatcctcagtctttagcacaatgcctggcatatagtagatgttcaataaatatttactgaataaatcaataaaacatcctgcacttacctagagcttcaataatattcttagcttgaatgccttcggctaagcaggccaaagcagataacactattatgatgttaagagcctttactcactaaggtttttttagtggggggtttagttgttgctgctgttgttttttgacggagtcttcttctgtcgcccaggctggagtgtagtggtgcagtctcggctcacttgcaacctccacctcctgggttcaagcgattctcctgcctcagcctcccaagtagctgggactacaggtgcatgccaccacactggctgatttttttattttttaatagagatggagtttcactgtgttggccaggctggtcttgaattcctagcctcaggtgatcagcctgcctcggcctcccaaagtgttgggattacaagcatgagccaccatgcccgactcactaaggttttattaaagtgagatcttgaaaatttgtgactcactgttttatttattgatcagacttgtgatggtaaacactttacaactgaggctagaagtaagtatgacacatgagtcacgttccttttacctccccaccccccactgattcttaggactctaacagtattatagtgcctagaaaagaaagaaatagctctcttcatgctgattttgacctgtttttaaagcttattactgaaaggttataatgtaaaaggtactgctgatatataaggtactgcttacctaagcctgaggctggggacatactgcagttatgactaagtttctcatttttaagtaccaaaaaatggacagatttagcttgtcaacactgcgattaaaatttgctgttttttcttgttattaccgctgggtattctctgttgtgttcaataaggaattcttcttatggtactaaatgtctaatattttctacccttctccattctggggataaatcattgctttaatgaaccatttttgtagatatattaatgtctagtctagtttatacttattttaaatgatatttcatttgtttatacaatgtgacattgaactatgagctacctcttctacttctaacttaattttaatttgactttaattctaattatataatttttccagattatgccttggattttgaaaagacatttcttatcaaggttcatctgtccaaaatagttttatgtttctcttatgcttttgacactttacttcccaaatcatttattattgagaaaatagctagtaaaatgtcacaaaaattgtatagattagagactgaaatgtgacaaagtagaaatgatttctttatgaaaatctattcatgctttaatttcttactccatcatggtcctttcagttatgggcactggctctcattagtcaccataagaaactggcaggattttatactctgctttatttccaaatctaaatattgacaattagtgccttacaagcatggtggcatatgaaaatgttgttagacttctcagacctttctcattttatttgcgttctgcatattaccatgccctgcacactgtgagctaactctaccagttagaagagaagatttcttaactgaccttcccctaatcacttgcaggattaaagttttcattccctttgtgacacctactgactgttgtcaggacaagatgtatattagaggccagtaggctaccttctaatgcacctgggtacttctgttattcctgtggtggcctgtgcttacttaatgagaggcagttaagttaatgcccattgtacttcttattatgataatataattaaattatgtatatgttagatacaaatacagaaagaaagcacctataaaagagtttctaggaaaattatgttaaaagctttggaaaaactcaatatcaataaaagtaaggtgctaaaaaaatgctgtaactggatgactactcaataataattgtacattttaaaataactaaaagaacataattgggttgtttctaacacataggataaatgcttgaggtgatagataccccatttatcctgatgtgattattacacattatatgcctgtatcaaaataactcatacgccccacaaatgtatatgcctactgcgtacccccaaaaattaaaaataaattttcagtgaatttgggtgaaggtattttaaaaatctgtctttacttaggttgtctaagatttggtttattttgaaaaaattgactagattatacattttagtgcagtttacacaaaaaagaaaagttggaattcatattcaaacaaaaggccttggccttacagcaagagtttgtttaataaatgtacatttatattttaagggaaagtgtttaatacatgtaccaactttttctttgctcatttgcaacattttagaaaaaccaatccgctactagtccctgtcggtgtaggataagaggacttctgtatatattaccttcatatttttcggtagccctgaccaagtttgggagaatcctgagaaaaaccacaaattattctcaggagaatttgtggaatagacctgtgaattatggtcttgtctgtatatgacttaggtcaaaatttaattgtgagtggaaatttgtgtttagtaacgtgtcattcctatctgttgagcctactaaatgccctctcaaactagagagctatgtgtaaagaatcttatgttcttcttggttcagttgcatacttacggacggtttatagaagtagttaagtagccagactttgtggggttttttgtttgtttttttgagccagggtctcgctctgtcacccaggctggatggctcacactgcagccacaatctccagggatcctcccacctcagcctccaaaatagctgggactacagatgctacaccatgtgtccggctgattttttttttaattttaacttttgtagagatgagatctcactgtgctgccccgtctggtggtaaactcctgggcccaagcagacctcctgcctcggcctcccaaagtgctgggaatacaggcaccatgcccagcagtacctagactttgtagtaagacatacaaggttcaggttccagcgttaccacttattagctgtgtgagttttttacatgttattcacattttccaagtttcaatttcctctcttataaaatgtgcataacaagagtagctacctcataagaatgttatgaagatgaacagtgtatgtcaagtgcttagcaatgtgcttaactcctgaggtcaggagtttaagaccagcctggccaatatgatgaaaccccatctctactaaaaatactaaaaatacaaaaattagctgggtgtggtggtgcacacctgtagtcccagctacttgggaggctgaacataagtagctgtacatgagaacaactatgagcaagaaagttggcttcatatctatagtattttacctgttgtaatgatgagtccaattagattagaaaaataaattataatcaccaccttatattttctttatagtaatcttatatatctatacagttataaaataagaaattgtgtgcatatgatgagcactgaatattacatcatctgtgtatgctcatagacattcaaaacttttaagtgatctttattattaataatgtaataattttgaaaacttttatagaagtatgtgatagatttactaaagtacacttatggacaacaacacgtaagaacaactatgagcaagaaagttggcttcatatatacggtattttacctgttttaatgatgagtccaattagatcaaaaaaattataatcaccaccttatcttttctttatagtaatcttcttatagatgtatagagttataaaataagaaataaagctgggaaggctatttatatttcctctccagtatccaacttaattgtttctctcatcttaatcatttttgttgttatttaggtagcacaataaaacaatttacttggccggctcagtggctcacacctgtaatcccagcaccttatgaggccaagccgggtggattgcctgaggtcaggagttgaccaagaccagcctggccaacatggtgaaaccccagctctactaaaaatacaaaaattagctgggcgtggtggtgcacacctgtagtcccagctacttgggaggctgaggcaggagaatcgcttgaacctggaagacagagattgcagtgagccaagattgtaccactgcactccagcctcggtgacagagtgagactccatctcacaaaaaaaaaaaaaagatttaaaaaccaatttactatcttttatttgctgttttgttaattcctttcctgataggagttagtgttgacaatcactttatctgttagtttactgcatatttacatttcaaggggcatagtctaacctaaactttattataattgagtctgtataataaagagttttattgtggttattactactacacaattatacatatcctttattaagggcaaagtagtttattctgccttgaggctcccctgagaatttaaagctctgattcagtaagtttagtaaacactaaatttagagctgcttgtggtaatatacataccttactgcatcttaccttgatatgcaaagacaccactaaaatccctggataataaacattttgtttttcaggaatccaaaaacaaagcacattaactttattccttcagagttgtgggaaagtgagtttagcagagtttataagagtcaaccagcatcagtgaagattcagggagctgaaactgagaaacatgaggcagatcacaagaccaaaaacactgcatggaaacacaggaaaggcttttcaagaattgtgtctaaatagagtttacctaaaagaaaatagctctaagcaaattactgtggactgtgttgtagtataacaacagaaatataagactgattctccaccacagtttttaagttcacagcacagtttcataaagtaaaatatttaatggcaagaataatgtaattactgttacatcagtatgcaaactaaaacctaatcataataaaatctagactttaaaaattgtcatgtagaaattctgaggctctgctgctgcagatgtaaaataaaagctggtctgggcaaagaaagaggttgggatcacttgttggttgatcatgttggtttctttctgaacaatcccattccactcccagaaaaaaaggggaggataaaacatgtatttcttaccaaatatcacatcgttattactgtttaaaacaattactttggtttttttttttttctacattacaccagttgcttaggttggaatgtaaatttgctttcatcacaagactgatccaaatatccagtattaacggatatttaagtaaacataaccagctttcaagtttgaaagtaatatcatttcatattatcatttaaaggacttgttaaaacacagattgctgtgccccaccctcagagtttctgacacagtcattttagtgtggtgcctgagaacctgcactttgaacaagtttccaggtgatgctggtccataggccacactgtaagactcgccagcctacatgagctccagggttccatcaagatttgaaagctattgaatgcaggagcagaacctcctcaataggattttgagatttttgtctttcataaacactgaaactttctaaagttatttgtttctagccatggaaatatttatgcattggagtgcatacattcagcttaaatctagctttagtgcccaatcttataaaaactttggttttattgttttcctccttaacatttgttgttccaggctttaggtaattctgtttttctctttaccatacagtgttacattagtaaaatgacagaaatcacaagaagatgtatcgatttatttctattgagatttgctgtttagcttccattcctctttacaatattttgcagcactgcttctacctctatcctactactaggatttttttttttcgaatcttaaacaaaataatgtgatgaatagagcaatatattttatttagtttaaaaaccagaggtggcaagagatttatgaaaacccaacaaaagaaagacctctgagccaaatcagcatctactttttaagtatttatagaacaccctcttgctaccatacaaccaagaagagtaaggcaaacagtatctcatgcctttgtgtatttaaggaaagccagaataaaaattcctgcttctacccctaaatcaaagccttctctggcagaatgctagttctgtctctccagctagctctcttttttcatggtttactttccaccagagctttctataccctgtttgtctcaggaattaatcatcttcttatcttccctcttctctgctagccagattataccagggttttagggagattgaaaagcaacttgtcctcttacaaataatagaaatttctgacaaatattctaaggtcagagaaatatgattctttactcagggttagaattactaagtattctctgttgtgatttagtagcaactgcacattccagcaacaagccggaaagctactggccttcacacttaatctttgaaaatgcctcaatagtcattttagtctatgagacaaagactcactttgtttttaatttatccttacagaattgtgttacagtactggcacaatgttcacatatatgcaaatagtagcaggggttttttttgttttttgttttttgagatggatgcttgttctgtctctcaggctggagggcagtggcgcaatctcggctcactgcaacctccgccttctgggttcaagcgattctcctgcctcagtctcccaagcagctgagattacaggtgtgtgccaccacgcctggctaatttttgtatttttagtagagactgggtttcaccatattggccaggctggtctcaaactcatgatcttgtgatccacccgcctctgcctcccacagtgctgggattacaggtgtgtgccaccacgcctggctaatttttgtatttttagtagagactgggtttcaccatattggccaggctggtctcaaactcctgatcttgtgatccacccgcctctgcctcccacagtgctgggattacaggcgtgagccaccgcgcctggccagtagttttttacttcccacgttgattgactaggatcttcttcagcttactatcctgaagtttcgaaaaagaaaaaaaaaaatggaataaccttccataattctttttgttttctttgttaatgcaagatcttttgggtctgccatggagaactcaatttggaattgtcagtaaatgatggctcactgttatatacttgcttccagtccaagtctgtttcttcctcagttctttattatatgtaaaactatgtttgcaaggaatttatgtaattttacctagtcagcatattttcagccattattgacagctaatgcaaaatggaaaacagcaacatgagtgcattgtgtattattctcaaaacactattctgagatgattttcctaaagcccctgccttaaaacagtttataatctagtagagtttgatgattcctacacatagaatgggtagaatttgtactgcaaatttataaaaccagaatcataaatccaacattagcatgattttaaatcatgctaaaccaacttagcatgattttaaatcatagttggtaaaatattcaaaaaggaactggtttctagcattcatacaaacacctcttatccaacatattgtacttttccctgttaaacatacaagagcacttgtactagtatcctgttataatatgtattccacgcaagggagtaactttcacctattaaatagcagttatccttcttgtggggagaggtggggaaagggacagacataactgaggtaagaagcgtgagtaaattacttcttgtaatttttcatccgctctagatgccaaacattctgaccaacttcttataattttgttggtatgtctccatgttcctctattgcctgtcatatcaccacccccactaccatggtcattatatactaataacacctagcattgagcacattatatatgcaaggcactatgctaattttacagaaatatgttcatttaaatcttttaccttgagaggtgagtggcatattattataataattacataggccacttagcttaaagatgtatacagagcatctgttgtgtacatgatcactaaatcatgagtccaagatccatattttagtttctgttccagggtaacttggtctgtggccttgagtaatgcattatacttcagctgtctattaccaaagaaaaataaatactaattattttttagtcttatctatattttaccctataaatttaattatcagaacaactcagattatggctcacattttaaagacaaggaatccaagcttggaaaagttaaataattggttgaagactacatgataggctgtgtagcacaagtcttgcttaaaagcccctccattcagttactgtgttttttactttatcctataatttcttttatcatactccacataaataagagaagataatacatatgtaatatttctatcttgaaagatgctggaaaagatttttttcttccaatttagggggcatactaacaattttgacaacacaagaacatctagcctgttactgtggcgcacacctagcagtttgggaggccgaggcaggaggattgcttgaggccaggagttcgagaccagcctgggcaacatagtgagatccatctctacaaaaaatttaaacattagctgggtgtggtagcatgcgcctgtggtcccagctacttgggaggctgagatgggaggattacttgaacccaagaggtcaagactgcagtgagccatgcttgtgccactgcaccagcctgggcgacagagtgagaccctagctaaaaataaaaagcaaaaaaccccacaaaaacaagtacatcttgcctcataccttacagtcatatcactatctgttatgtactgttgcatagattgaatttgtaaatatgtaagttaaatatgtaaaatctattttgagatatttattgagaaggtgagagttactcaacaaagaaagacagtgctaatattcatcttaataatagtgatgcaactcataaaatgttgatcagtgaatttccttccacttttaggttctcaatattcctttcaaaagccatacatttgaaagagaagtcatcaatcacttttagctttttttttgttgacagtaatactttatataaaatttaaaaataggaaggccatatattacaaaattttaacagagataggatttctggtaaattttatttacaccattttctcttatatattttatttttcctatgatgaaccatgtttatataataccttaaattttaatggagttatttatcatagctactttaaaactcagaagttggtctgacaaacagttagaattgctcgtgtcagtaaagcagtaatcacgtattagccaatatatccaaactttgaaatttggaactcctttttatattgtcaaaaacctagtactctttagatatacggaaatgaaacctaataacgttaaacttattggcagttgagtattgtgtttcagcttagcacgtttaaaaggcttttctgagctcagattattgatttgtatatgcaaaaataataaaataggtaattgaaatttacactgccttattttatctcatacactgagttttgctattcactgctgtaaagagatgtcatttacaacagttgcaggccatagtaatttgcctatttccttataagataaagatttacagataaatgaagatttaaatctcagtttcttcttgaaatgagaatttctttaagttattcaaaatcccattgaagtaatgtctgtaggaatatcctaagttattgtggtcattttttgagtaactgtttctttggatcagtatgttgtctccatatttattgcttctatgttctatctgtatatcaatgtgtctggtatatccttttatgtggcacaacataattgcatgaaaatagaacttatgtagaaggaacatacttattctgagttaccttggatacagcttggaatccccagttttcttaggccttaagttctaaatagatgaaggacatgaacagatcacttatacctctataaatatctacacaaatgtaaactagttaattcattcaacaagtaatagtacttgctctgtgcctggcactattataggcagtactaaggatatagcagtatataaaacagacaaaggctctaccttttgtcagccacagtctgaataataaacatatagaaaatgcaaattaaaataacaatgagaggcttcttcctactatgatgaatttaccagtaacggacttgccttcccaccagaaacaactgttttcagacattggataattgacagcatggtaatgtgatccctgagagaaagggcgtgggttgagggtgacaagaactagatgaatcctggctttctgacacaaggtattctgactgtggagaactctagcagagaatgacagtcttgctgaattgagatcagagattgaggcggcaagggcaaccagaagttacagagtactgaggacagagctaatccgagacaactgcagaactctgcagaggggttcttttgcatctttaatactgagtttcagagatgtgcaatgagactccacgaggctaaagaaagaactgaacaattcctagagtcccaacaggaatgggagatttttattttttattttttattttttttcattctgaccagaaagatcttgttaaaaacctggagcattcagtagagatccaagtaagaacacacattagtagtaaggctaaactagcctcagagtaaaaaattactccatacctgcctaaatagagcttaaaagtaagttcagaaggacaaactgatccacaattgacttacctgctttggagggccaggaaccagctacttggcctgactgttaaaagtaaggcataaagaagatgttgatttcttttgtgttgtatacttcaaatatccctcaatgtgaaagagccaatacacagctaaagtgtcttttcttttcaaatgtgtttcccttgtaattcttctttgttctcagtgtattttgttggatatcttttatagaaaagaatccagtcattaaagctagaaattaaatggttgtagtcattataatgaagatagtttatataatctgtttgtttcatgaaagcctctctgtgtttctcaggtgacaaagatttgttttatccatgagcgctttttaagactcactttgtatagtaaaactcttatttgtaatgtctgtctttgctttgattctctatactattcaattaacaaataatgattaaccagctatcatatgccagatactattctaggcattgtaatataaagcattatatttgatgaaaaaagtctggaaataaataaataaatttaggttgatcttaggtcctgatgatgtatattcagcccatttgaaagaaagagggctaaatttaatacaggatctgctactttattagctctgcatctcatttttatgagtgtccaaggtattatatagagtatagcaaagaatactatctttttataaaacctgttctccatttttcctgggcatatgggtaaactgcatgtaactgcatattccagctttccttgcacttaagtgtgtcacatgactgagcttgaaggaggtatgattggaaacaatgtgttccagttccagacgtttcgcaaagttcagaaactttacatgtgcaatttgtaaaagacccttccccctcccaccccctgcgtctctggatgcagagaatccaacaaagaactctggggctgtaagatactgttggaactacattatagaaagaagcttcctactgaatacgcatattgaatgagaaatctattgtattgggctactgagataaagttgtttgtttcagctcttggcctaccctaatacgaggagaaaacataattgtactgtaactgtagtgatacatctttgtgagaggaccataatttttataaatacataggctgaaattgagcttgagaaacttcagtctttctcaaacagttcattaagatgaaaacattgctttctttcttttgtattagtgctaatagcccttgttctgcttggacggttgttggaagggctactttaggctgtgtacttgcatatcctgtcccttcttgtcaatctgtattcttcttctatcctctgaaatgaaatacgtctcttcaccatcttacctatcttttcctttctctttcttaatgatcagaaacatgtttttaaaagatttttctttctgtgccaggtttggtcatgataaaatccttcacatatttcaaagtgtggtaacacaatttagaaactttgagtgagaacccactctaaagctttcaagaatgacctcatgatttactctcactttaatacagtaactacagcttttctgtattgacataccacacttgtctaagttacgaagctgcattgtaaccatggacatagattcttcacagattacacgtgtgtaccacacacagattcagtctgtgcttcctctttcttcacttttgacctctgactatgccatccgtggaattgaaggctattaaaagtatagagaactggattggcccttctgaaaagatggcaaaaattttttaagaggagactgctctgattatctatctcatcaaatgactagattgctcaaataattatgtctgttcatatgagaagtctttttttaacttattactttctctgtttatacttgttatctcccaattctcttattacctaaccagtattccagtcatgactgtaatgccacttgtgtccttcatactgaacaccaacttaaatgcacttgcctaaatgttttgcttataactcaacacaaactagacagaaaatggagaattaagtcaagttgctctattgaaatagagtttggccgggtgcagtggctcactcctgtattcccagcactatgggaggcagaagtgggtggttgcttgagctcaggaattccagaccatcctggccaacatgacaaaacctcatctctactaaaaatacaaaaaaattaatcgggcttggtggcacaggcctgtagtcccagctacttgtttgatcctgacaggtggaggttacagtgagccaaaatcataccactgcattctagcctgggcaacaagagcgagactgtgtatgatgaaatagagtttggccactgggcgtggtggttcatgcctataatcccagcactttgggaggctgaggagtattgcttgaagcaaggagtttgagatcagcctgggcaacatagtgagaccctgtctgtacaaaacatttttataaattagctgggtgtggtggcatgcgcctgtaacgccagctactcaggaggcagaggtaggaggatcacttgatcccaggaggtcaaggctgcagcgagctgtgatcacactactgcacttcagccagggtgacagagcaagaccctatctcaagaaagaaagaaatacatgttggtacctgcactgtttcttaatttcattcatttggtataggattttcatgatttttgccccacctgattataactactttttgtttaacctaatattttcttggaatttcatgcttttgtttaaataatttacttttaaagaaactttatactactagtcaaactagaaaatcaatatcatgaacataactagaagattaactagaacattaatctggctacttaaaccttcaaatgattctgaagctcaactctctctgttaaaaaggaggattagctgatactagccgcacattaaaattttcttcttgacagattcagaaggattgacagataattgaaaagagtaacttttgtagcaatttcattagtcagaataggctaaactatattgccataacaaaccatctttaaaatggcagcagattcatacaacaaatgttggtttctaattcacccaacaaatgttggcaactctccagggcagctgtcctttattgctgcttcaatcttgtagtttcactatctcaacgtgagactttcatcatgatttttctgtcagaggaagagatacactgtagaatcatgcagggactatgtcacttctgcttttatttcattggctcaaactagtcttctaaactgcacaacagctggtaattgtagtcacccctctgcctagaagggaatggagaccaggatattggtgggcactagtaatgcccactgcgctatgtaattcagtgctatttactgccgtttttatggatgattttaaatcatcttttacatcctaaaatcagtcccataccttgagaaacagttttttgttttgtttttgagacagagtgtcgctttgttgcccaggctgtgtgtagaggcaccatcttggctcattgcatcctctgcttcccaggttctagcaattctgctgctgcagcctcccgagtagctgggactacaggccctcaccaccactacacctggctaatttttgtagttttagtagagatggggtttcgccatgttggccaggctggtcttgaactcctgacctcaagtgattcacctgccttggcctcccaaagtgctgggattacaggcgcaagccaccatgcctgcccaggaagagtattataaatgaaatattataatatttgaaatcaaaatatcaggatatgaatctgtgatctaccacttaattactgtaatcttggacaagagatcttatgattctgttttcccatctgcaaaacaggattaatgtattttacatagaaaaattacaaaggtcgaatgagcttaggtaaaaatttaaataaaagtataaaataggctgggtgtggtggctcatgcctgtaatcccagcactttgggaggccagtgtttgcggatcacttgaggtcaggagttcaagaccagcctggccaacatgctaaaaccccgtttctactaaaaaaaaaaaaaaaaaaaaaaaaaaaaaaaaaaaaaattagcccggcatggtggtgcacagctgtaatcccagctactccagaggctgaggtgggagaattgcatgaacccagaaggtgaggttgcagtgagcctagattgtgccactgcacttcagcctgggtgacagagcgagactctgtctcaagaaaaaaaaaaaagtatttttatttgtcgttacatagctttttttgaaagtgaggtaattgtttttagagctgtgtacctcacattagaactgggctctagcaagaagttttgcatcactaactaaaagaaataggccatctataagacccaacagaatgatcccatttcatcagtctttctaaaacaaaatttagggatgttttctcttccatttaaatactcattttaaaaaaaattgttacatttaattcttatttgagtgccaaataagatcagagcaaaattaaaagtttgtataaagctctataagaaaactaccgtctatagatgtaatgttggaaaaagtttttaaacttttttacttgataaacattaaaatggtatcattaatttttaaaacaaggcaaagtgtgatgatatttattttaattgattgaactaagttagaacaaactaaattcataagccagacattgctacagatttcttatacactgttggtataaagtctagccacatatatctgaagtaacttgattttctaagtcacttgctcctgtcccaacttctttcttaattttctggtggagtttgtaaaggagtgctattatttcttcttaaggcagttgttaggattcaccagtggtgacaactgagactgggcttttttgtggtaagatgtttaattactaattcagtttatttacttgttataaatctattcagatttttccatgtcttaatgaatgagttttgataatttgtgtctttctgtgaatttgcccatttcatctaagttatcaaatttgttggcttaaagttgttattaatatgcccttatagtcctttacgtttctgcagagtcaatagtgatggccccatttttattcctaatttgatagttcatgttttgctgtttctctttgtcagtctagagtaagttttttctattttgtttatcttttcaaagaattaaattctcgtttcatcattttcctctgaaaagcaaataagtttatttgctgtttcattgagttctgctttaatctttatggttttatttttctgcctgatttggggtttaatttgtgctttccaaatttttaaagacataagctgtgagcatgtttttctccagttatttttcaattgttgtaaccataaaattttcatgaaactttaaaaaaagataaattagtgaaattaatgggtcttctgaaacgagtttcttaaaatcaccttataattccaattgttaatagaaaattaacatatattaaactccgatgagttggggggcatctgcaatacatttttctctttaaattgtgtagcctatgttttgtcccattttcatggcacttggctttctcctgtttgtatcatagctgttcttcttctgtcttaccccctcattaagttcctttaggctggacactgtcttaattatgtttgaatcccctgaagcatttcttactgctctgtgcacatggtaggaacacagaagcattcattgaattgaagggaacagctcatatgttttatggaattggtttacaaatagttattgcaggtttctaacaaaataattttcatttaaactgtcattatttgtatgtgaaaatttcatgtagcaccaaatttgcatttttaacacatctgagttttcatgtttgtgaagtatcccaatactctcagatgattatgctaatccttaaaaagttatcatgatgcctcttttcttatttattacatagtaacatttctagtagagagtggggcctttgttatgtcacattttttatgaaatgtttaaagaaggagataaagatgaaaaattaaataggaatgtcataattattctagagcttttagcaatatttgcctgtgtataaaattatcaatttatatttcacagctataacttctgaacaagaaatgactaaatacagaaaagcatttagctctgatatcacaacctctttattttaatcagtagaaaactttattaatatatttgttataatacatgttttgaaattgttacctgcaggtaaatatgctagtataccttctcaaattccattatttttgctatttctttgtaacaatttgctgtgtcactattagtatatagttatttcatcccttattgaattatttatagattttaaatgatgacatttcagttatttggctctggttactttagagtttttgttttattttcattattaggagttagtataaaagtctttaggtgataagtactttctttaaaagaatttaatattcacattttgctgggtacaggggctctcacctgtaatcctggcactttgggaggctgaggcaggaggattgcctgagtccaggagtttgaaaccagcctgaacaacatagtgagaccctgtctttaaaaaaaagaaaaaattctagaatttaatattcaaatgctaaattttcaatagactcaaagtcagaatattttctccacacttagctctgtattctttatggtatatattctagtggggcctgtgtttatattgagaccatatgctacgagttgttgctgactaggtagatttcaatattttttaaatggatataattgctgtgttaatcttaaaaatggtgaaactatgtaatgttgcctttttgcttagatgaaatgaatcgttttttcatttctacagttgttcactatgataaatagggataggaaaggttcatatgagagtccatagtagataactagtggccacatactaattgatatttgtattggtaaacaaagtcatctttattttgccacactgcatacatgttatatttcctttatatttgtataaatcacagagaaatcagatatctaatagtctgttttcagaaatgtatacatatactatatctctagctacaataatatacattcacatttaaataaatgtgttccaattatttgacacttcagcataaattggatgtaaaactacacacaacagtttttatatgaaatttggagtatgtcgagtagggaactaaaaggcataacacgtagtattggggaagatagagggagatgagaggtttataaaacatgtacttcatttttttatacttacatagaagaaataactagaaagatactttgcagctgtgtattaatttataattggtttcagagaagtatagttttatttgcattatgaagagtcagaaattgtttctacaatagactaggctttatttgataaagattatcatatcaaattttcattttctttttctgcattgtatcttttttatttttgtttttttcttttctttagatagttactttctcagaattaacagggaatatgaattatcatttttttcctcttcaccatttttcacttttatctaccctgtgccaaaatgtcagattctactggtttttccttctctctgtttttttttgtgtgtgctttattttatttttatttattgttcttgatccccccaccattttgcaggaaatgaataattaaaagggaaaatctccttgcatttctgctttcttcaggatgttgcttatgtcaccgttgaagcacaatcatgagaaatagttaatcagcacattagatagggtaggaggatgcccttcccacctatttccagattttaaacctaacagagatccagggttaataagaaggaaacaaagaatgacacaaacactatctctccttctacccttctttcccactcccactacagaaaattcatgatattcaaaggtttattttctagtaaatgtttaggaactaaaatgttataagattctgcatatgaaagctttgttaaaactttttaaaatatagttttctctttccagataaatttctcaatgtttctctctacttctttacaattctatagttcaaatcttttctttctatgttgcttcaaagagttttacaattttagctcttatttttaggtctttgatccattttgagttaattttttatatgacgtaagataaggatctaacctcactcttttgcatattcagtttcctcaaaaccatttgttgaaaagactgtccttttcccactaaatggtattaatacccttgtcaaaaattattgatgatacggtttatttctggccagccttttctattccattggtctatatgtctgtctttatgccagtaccatactgtttagactactatagctttgtagtaagttttgaaatcagaaagtgtgagaaatccaagtttattatttttttcaagattgttttgactatttaggttcccttgagatttcacatgaattttaagatggatgtttctatttctggggaaaaaaaaagtcattgaaagtcgttgggattttgatagggattgcattgaatctatagatcacttgggtggtgtaccatcttaatattgtcccccagtccatgaagaatggatgccttttcatttatttgtaccttctttaatttctttcagcaatgtttgatagtttttggtgcacaagtcctttgtttccttgattaagtttatgtctacatattttatttttttgttgttgctattttaaattgaactgtctccttaggttttttttctcagattgttcattgttagtgtatagaaatacaactaacttgtgagttgattatgtatcctgcaactttaccgaatttattagttccagcaggtatttttctggagtctttagggttttctacatataagttgtcttctgcaaacagataattttacttctttctactttggatgccttgtatttctttttcttgcctgcacaaacatttttattttcctaccacactggacaattaatgtttattaagttatcttcaggttaactttactaaatatactttataatctcaaatccaactttgtgaaaatactttcttggtacttttattgttctgcctatctttatatttatctttcattttacattttcttgatctttgctttcatttggtctgcctccatactgttctctctgtatattcttatctgagtcttctgccagtttcctcctaaaaaatcccttctgctatgaaacatttactaaagacaatacctcagtaattatttattattttaatgcccttatatttctttgactagatatacttcaacattatctacagcattccagcatacagaggaacctcgataggtagattttctcttttcaccattagcattcctgtgtgatgaatctgattgctcttatcctccctcaaccacctgcctcccaggtgatcatgggaagaattagtgagtatagatagtattgttatttcttcaaaatagaccccatatggttaatactttataacttaggactctttaaaaaacagcaacaacaacaacaacaacaacaacacaagagttaaatcggtaaaagaatgactgaaaagaaattctaatagccaggcgtgggtggctcatgcctgtaatcccagcactttgggagcctgaggcaggcaaatcttttgagtccaaggagttccagaccagcctgggcaacatggcaaaactctgtctctaccaaaaaaaaaagaaataacgaaaattacccaagcgtggtggcacatgactgtggtcccgactactcggaaggctgagatgggagaatcacttgagcctgagaggaggaggttgcaggttgcagtgacctgagatcacaccactgcactctcgcctgggcaacagagccagaccctgtctcacaaaaaaaaagaaaaaagaaaagaaattctaactttaccacacatgttgatactctcacagatgaggccttgatttgtatttcattacagcttttttcttaagaaaattttcttaatgagcagtttgcatgtggtgttcgtggattctctaatccagtgttcacaaacttcagtgtgccatacgatcacctgcagggcttgctgaatacagattgctgggcccccaccttccagagtgtctgacccagcttatctggggtgaggcctgatcatttgcatttctgacaaattcccaggtgatattatactgctggtccaggcaccacattttgtgaacccatggtctaaagaatactgtttaacttccattctgtaccacatatttattgttgtctaacttagaccattttgatttggatactctactaaggcataacatattgtattttcttcaacatgattcccttctcaattaaaaaataattggtgatatcactgttcacatccccttagacatctttgttttactacccccatgcctcaacatatatgcacggttcagacttccaaatcatgctgaatctgtgatgacaacagcaaaaacaataataacagctgatgtttttagaacatttattctgggctaggtactgttttgaggattttatttgaattaatataatcctcacaaattgtctttgatattattagcccaaaataactgatgaaaggaaacaaacacagaaaggttcttacagctagaaaaaaaatgaatgaaataggactctaatgtaagcattctggtttcagagcccttacccttaattcctgcactctcaaattcctcactaatgtgctgccatgttatgctgtctctatagtatgtctgaaactactttcttactttgttttctgtagccgtagccctcactagtccatgtattaataaacttaataagtgagctatatcactgtatccaagcactgtgcttaaatacttatacatgtttggaattagttaagcctcataacaatactgtgactttatgaggaaactgaggcttggtaaggctaaataacttgcctaatttcttactattaatatatgctagaatcaagacctagatttttcagatcactctacttaacctctaagccgatatgcattcatctgctcaacctctgccagattctgtaactcaagtcattgagggcataagaatcgatgttcccagtgtcagttccaatcacttatttgtgcagtagtttctgttatctcttacatcacaataaaatgccaagtttgggctttagattgttcctacccatctcatctcaaccactttctttcttcttttaactatcagagaaggccttttaatgtggaattctcttactcacatgaatcatcttatgtaccattttttacaatgaagcatattaaaattccaggcttccaggtaaaacattatgccccatcttccaacttgcccttctatgttctccaccaagcaatattatgactattgttcaacttatcatatctgtgattgtccctgctgtgtttgacttacaaatgacactagttttctgtgacttggatgagaacaccattatcatctaccttataaaacagtttaactttattattagacaagcacagtaccccatggatgagggaagaggtgaagagtagatagaagaaagaattaaatgtctcctgtgagctataaagataacctcagttggaatttcctgagaagggaaaataaagaagttggtatacatcgagcttcatagatctaaaataactctctttgctggagaattgtgtattttagtaagaggttttattttttttcctctgccagatctgtttaacttctgattaacaccatatagtccatactctcttcacagtcttcagctatttccttttttctgtatgatctctagaaccctgatcttttcccttgacttcatctcataattcttgtacacgcctcatacctcccttaagttctcctgccatccttcactttttttcttacatttctaccttaagtttctggtctgtctactagccctaaatttcattatttaaaaaatgtttttaagattttaagatatatagagtcccttgagcagggacctgtgctgtctttgtcagaactcagcaggtaaaacagttactctgatgccatgacaatgctttaataaaattctagtaaaggacttaagagccttaaggattaaattactatataatcatttttcctatactaagcagtattgaataaataaactgtttcattatttttaaatctgttggtgaaattataatgaaagagattctaatattggctattagtagcctgcatatatacatataaatcacttgagatctttatttgtaataatgatttttaaaaacaggctcaagtctcacactcatagcaaaggtgagagttctgctattccaaagcttgcttttgacagaaccatactgttaggactcttaatgttaggcctttgttgccatggagacagtaacaggctttattattttttaacatatactgaaaatatacataccctaaggtataaagcgtgacttagttgtctgttggttttgagtattgacacattttgaaaatagtttctatatacttttaatacttgatttttatccttcaaagaaaatgaaggagatttctgaccattgtgataacagagttgtatattactttttacagggtcttttaggaataacgtagaatctcttgtgggtcagtaatggatgaggactttgaagaacatgcagaaacttttgagaaaagtaatgtgatcttagacacatgtcttggccacctatgattatgacactaatatataatacaaacaaatcaatttcagattcaactaatactttgtgccagtactgtgctaagcactgtcaccctattatagtttatttaatagaactcagtttgaaagcacctaagcaatcctcatattttaacttttacaataactgattattcgaatgtgtatcaatagcattcctgaatttttcctcctaaaaattagtaaataaaatgtgtacatactttcaataagtaaaactttcaattcatgagttatactttattccttacaagaatgaatggattccatggcatgagatattaatattccataggcatcatgattaaattggtaactaaatcacatgtctttagcttctagtgtcaaactagcagggcctagttaatgctttagtccaccagcagttttgacttcttacattaatagctgagaagtaaggtaattgattttcttgttaagctacgtagattaggcctgatggcttatatttaatcctacttatggtgtttatcatgaccaagtattagagtagttatttctggataacaaaaaccttttgattacagttattataaacaaaaccttgaaacatagtcctgtgctttccttagttaacatctgtatttaatggcaaaagaagccaaagtaagaaagctctttgctttataaagagagagaaataaggtaacagacaatcacaatttatactaatagttttgaatattagattttagcttttccagttttcagtgacttttaacaagacccatctcctctatgaagaatgcagttagttttttttttttttttctggctcaaaaaatagggtaacctgatctgagtctgacagagtgtgtcgttcatttaagtgcttccatctgttgcctgctgttccccttactcatgacccctctatgtttctctctttccctttttccttctctttccctgtttctctcccttcctttctctttctttctctcttgctctctctgtctcttgcttgctctctctctctttttgttcttagcccctctgaggaaggcaaagtttgttgagagcccacgaattccagaatccgagcttggctcaccaaccctcacttcagctcagaaactggacgtggatgcatactgccctggtaagcatgcatgcaaagtgtctgctttgaaagagggaggattggatcaggcccatccagcagagcagtgttttgcatgtatactactcataaaaacatgttacctcttttgcaactgattgcctattcttcttaatagaacatagtttttactgaatgccctgttttgactttgatacaataatgagagtaagtattgaaaataatttcaaaggtaattttcaaaagaattaaaataattttggtagataagtagttttaggtaagtagggttacttttgtgatttgagatacttaaagaaattttgctgtggccatgtgcaaacagaaatgttgaagatgtgaataagaatattcattcaacactagacacaaaagtgttctatgcaacacttttgcatacaacctttatgcctaattcctgttggatttctggtgattatagaaaatacttgtgatgctggaaacattaaacttgaattagaaaagaaatataggtttccgagatggactccttttggatacagatacttacttttagaaatacctcttgtgaatggcctgtaaacacatgtgagagttcactaaaacccttcttgtgtgggagccaaactgagaaagactcattatcaatgcttagattctttcaaacttagatgagttgcctggcaacatcctttacactctctctacagtcagtctatagagctgtgtcagaaatgttcacagctctagctgagtatacagattagagcattagtaaaggaaggaccttggaagacttggttttaggtcttttgtttattcctgctcattaaaattgatgttaaaccacagtgaatacaactactacatatttacagcatgaggggtcagcagagtaaaatgattcctagttctggggaagatatcagtatctgtgatctgaaatgtcagtataatataccttcgaagccagataggacatagtaaaacaaaaaacaaaacagtaggagaaaatttgggccaaacctcataaaatgagagacgtttcattttatgagtcaattttgaatactgaaagaccttggggattttgctttccttcggggtattgaaacggcttcatccactcttatagataaccattcttttctaaatcaatcacagttttgtattaggaaccagcttttctgttttcaaaaggaacaaagtagttctttaaatggtactatagcacacgattagaagaatctttcatgttttgaggtattgtcacgcttcttgggcagtcgaatattgtactttgcatttcttcatgcaaattttagtgttataaagtaaaataagtgtgctaattttctatccctttcttgagttttagaaggaaaaccctatcagaggccttttccagatttgcaagtcagaatgactgtcatgggggcctaatctttcacttcctgattgcccatctgacatctttaatctaatctaaagctaaagtcttactcaggtgattatttatgtatattttccacaggcatgaattctttgttgaattagaattaaactaaagctcggttatgatttttagaaagcaaggaagaaactaaaacacaatatcaaagtgctgctaaaaaagtctttccttttcttatctgaaacaattttaaagcatagaaactttatagtgatttgctcatctctaatcaagttattagatgctctgaaaattagtttctaccaagataagaatggtaacctgagggttgaagctattatctctacatagtatcaaaaattaacaataaccaaatgaattgatgagtatactcacaaaccaaaaagattttgcattttttcatgcaaattttagtattataaagtgaaataatacttaatttttgaatttctttcacataggatatactaacaccactgatgatattttattgtacattcatacagagtaatacagttaaggctactagtgttctgataccttcttgtctgcctgctttattcattatcacctgaaaatttaggaaaatactttgtctcccagaggcaacaatcacaaactgaaggttagagcagtggttttcaaactttaacttacttcagaattacctggaagatttgtccaaatgcagattggtgggcccccagaatttcttactcagtaggtctggagtgggtcaagaatttgcatttctaacaaaatctcagatcatactgaagctgctgtttgagattctatgctttgagaaccaattgggttacagggctgctgcaggctactcactgtacagtcattgttcagtggttcagtgaacaatgctgaaagtctttggggttccttctaccactattgatatctggggagtaactgccagtgttgtttctgtgttatctaaacttaaaccttttggtagcttttgtgtctgagaaatagacttatatatttttcttggtatgtctttttgtacctgacatctgtgtacccacgtctaacttttctgtgttgtcctgcatgtaaaaggaaattgtggatcaaaccaaaccaattcactgatggttaagtccaaaagtgtagggaaagctactctggagtatagctgttgagctggaatattaaattgagtgattcattatatagcattatcttctataatatctaattaaaggtttactgttcctcaagttacatttgttgtatgcaaaaaatgtgggaaaaatacaagcaaacagtatgttttggttctgcagctacaactgtggagataatcgatggtgttaagtaaactaccagaataaaggggatgttccgggaattgtgtgtgttaattgtctcacagtggggaaactaagatctagagaattcaagtgatttgtctagggtcacaagcaggatttgttgttcagctcttgaagtggacacaatatagtccaaaaatatattgccctctaatcctgtcactgtgtaaattccatgagcattccttactgtccttagatttaaaagcagaaaattcagttaagtatgagatagtcatattctatttttatgaaaaagggtaaccaactgttagtgatttcaataaagcaatttccaaaataagaaaatagattcatcctacactctatcacttttctatctacagtattacttattaggtgtgtgatttggggcaagtcacttaacctttctacctgtttcttcatctgtaaaaatagagatgataattttaaatcagtttaatatatataaagcacttagaagaatgcttggctcatagtcagtgctcataattgttagttgattttattatttttgcagtgatgatcctaaggtataagacaaggtcttaatcagaaaaaatacttaaaggtttagggtcattttttgttaagtgtgtcctgttgcatttcaattctgatttttctctgatgaatcttatggtctggaacatgtcacttaacttttccattccacagtctcctgtcacagcaacattatttctataatttaacaaattatgcttttatatagatacatgaatatatattcataggaaaaaatttctggaagaatacaccaaaccgtaccactggttgcctaaggaggggagactttgaattattggaaagttagagtaggattgttgtgagataatattagttagcagagattatatctggttggtggcattacaggtggttttaattttctttcttgggcagcatgtattagtgaataagagcttatgttctggagttagatctaggtttaatttttttctcttccacctactagctgtgtgactgataaaaatagacctatctttaaaaaaaacaaaaacaaaaacaaaacaacctatcatctcataggattgttacagagattaagtgaaatataatgtatatgccacatgcttagctcaggcaaaataaacaagacattagcaccctttctgttactcatcatcatcatcatcattatacttttctgcattttctaaaatttctacaatgaacttctgttgaaaattttcagtaatctgatgacactaaatgatggtgatactctgtttttattttagttttttaagtgtttctgtttcacattataatataaaatttcaagtatagaagtgacctttgacacagataatggtaggccaagttgacagttttataggacttttgactatatgtgcatgaaaggttaagggccaaagcccacaccagtcttgaaataggcaggcttttatcaacaccaaatatattcagaggaatttgagattaatctttttatatggattcttttaaatctcttaaaaaacggtagtgtctttcaaaggacagtgttatttaaggtgacagcaaaattagcatatatttaaaactcaaagagaaaacagtttgattacagttagtgcatattcatatttgtgtatattctgcacctgtaaaaatttttttcatttggattttttatctgtattgtacattctatagcataagcacaagccattgtaaacaaagtgttttatttaaagtgagtagttccttgaactgtcttttcccaactcctgtatagtcatggtcatttccattaaaatcaaaggatgatatttttttcattttctttcttccatttaaaaaatttccgagaacattataaaatgttatctttatcctaaataattaaccatgcttctttggttttgctacaaactatgtgcttgtacataaaatcttctgtatgattttgcattgtcctatgagtaccaagagccttttcctcctgtttcatatcttttgttatattgtgtttgtattctgctttattgtaaatacaataagtatgaaacagaatttttaacctgagtaaaattgatgagctttggggggagtcttagccctttaaaatgataagtaaaaacttgctacatgtacatatgtactttttccaatcacaggttctcaaaacagttggtaacctcccttgcaccaaataaaaagaaagaagaaatgctattgtaaaggttgaaatggaaaaaaaaaaagcacctgttaattattagaacaacaagaacaaaaagctagaagttgtatagtggatagacttgagaggagaatgaaaaaggaaataatagaactatgggattggcctatcaggatatgaagtctaaagtagagattaggagacaaatgaaacagaaataagttgtgtattagaagtatgagatactgccttattactggttatggaaataagcataagaactagaatatgaatataaatggcttttcttccccaaactttcctatccatgtaagttcttttttttttctctctctctctttaaatagagatgagatctccctatgttgcctaggcatactgcaaccaccaactcctgggctcaagcaaccttctgcctcagccccctgagtagctgggactacagactcatgccaccacacctgtttaatttttatttttgtagagacagggtctcacaattttgtgtaggctggttttgaactcctggcctcaagtgattctcccacctgggcctccctcagcacttttgctgagattataggcgtgagccaccatgcccaccctactttgaacatttttagttgttttcctgatctttagtttttcattgtttgtgatgtgagttttaatcttctgtagctaatgaaattttaggaaggggatcggggacaattgtgttcctctttggtgggtccagtttctaggcagataagggaacttcagagaacagcctcatcctatgctttgggagaggcagaagattgagacaggaagtgggaggggaggccagaaagcccttgaggttgcttctttagttcagcatgtcaagagaccatattttggggtatgattttctgtgccccagcatttagaaggttaataatctcatcacactaacttttagataacttttctaaggtgttttacatcacaaaatctgaaggcttggcctctgaatgtggtgtttagatctgtaatttagttagatatccaaaggggcaatattttcattaactgtaaaaccattttaacttccagcttttgaagaagtaaaatgttctggtttagagtaaaatgccagtggtttagagccagactgcctgtgttcatataccagttctgctacttactacttgtgtgactttgggcaaattacttaaccatgatttgttaatttcctaatttccctctgtaaaatggggatgataatattacctatatcacaggaaggttgtaaagatacgacatattaaaatatgtaaaataaaaatataaacatacataaatacataaaatatgtaaaataaaaatataaaatatatttatttatttttgagacagagtcatactgtgccacccaggctggagtgcggtggcagggtctgggctcactgcagcctccacctccagggctcgagcaatcctcccacctcagccttccaaagtgatgggattacaggagtgactaccacacctggcctcataatgttttatgttgactttttactgccttttatctaaggatattgtaggtaaagttatatctttttttcaatgaatgcttcacaaaaagaataaaatttcatgtatactgtagttattgggcatctttacatgcagtctatatataaatactaagttgtgttgtgtgtatgcgtgtttatttttaatggggtcagtttttcatagtggtgtctagttcaggcttgggaacagagaagcttgagttcagttctggctgtgctactttattagctggtgacttttatttaatatctctaatctactctggttccttgtctataaaatgaagatagtaatatcactcactccataaggtgtttgtgatagttaaataagctagtacctataatttacttagcacaatgcctggaacatcagttattgctaacaacatatttctcacatgtatatactattacacatttacttcttggaaaaaaatgtgtttcttaagcagaacatatgttcctgcagcgcagtgttcaggaagaattctgtgggagcaaagaagggacagaaaggtactcttcacttgggttttgacacgcaagaagctggaattctgtatctgatgtttccactgccatcctttacctctaagtcacttaaaatcctcttagtctttttgttttttcttatctagaatttataaattatcacatttaaatttgtaagacttgcaggaagtgttggttaaattctgtttattgagtgttcttcagagtaggtatttgtattagttatctattgttgcataacaaattaccataaaatgtaatagcttaaaacagcatttgttatctcattttctatgtgtcaggaatccaaatgcagcatagcagggttctgtggctctcacaggttgcaatcaaggtgacagctgaggctgtagtcatcttgaagctcaactagggaaggatcttcttttgtgtttatacacatagttattagaaggattcagatcttcatgggctgttgaactgagggcttctattcctcactggttttcacccaaaggccaccctcagttccttgctatgtgggcgtctccgtagggcagcacacaacatggcaccttgtttcatgagagcaagcaagcaagaggtagaaagggtaccagcaagacagtgacagtttttataacctaatcatggaagtgacattctatcactttttgccatattctcttcattagaagccagccagtaggtccaactcacactcaagacactcaagtggagggaattacaaaaggtcatgattacagaagggacggggattattgggacccattgaagaagttatgatcttagttctcttggtttaaaataaacttaagtgtctagtttctattggaaacataagtactgtcaggaagttttctgaagaatgttttcactgtcttttgaaaatatttttagctcttatttaaaaagttatccgtattatataaaatatcaactaagctaaaataagaaaatatacataatccatgaccccactaatcagaaagccattgttaatattttggaatatagcctagcaatctttttacatacagttggccttccatatccacaggttctacagccataggttcaaccaaccacagatttaaaaaattcacacacaaaaataataatacaagagtaaaaactaatacaaacaatatggtataatagctatttacatagcatttacattgcatatggtattgtaagtaacctagaaatgatttgaaatatacgggaggatatacgtaggatatatgcaaatactacgtcattttgtatacaaggagcttgaggatccacagattttggtatgggattgggaggggggtcctgaaatcagtctgttgcagatactgagaaaaggctgtattttattcatctgctcaagctgccataacaaaataccatagattgggtggcttaaacaacaaactactgttcatatagttctggaggctagaagttcaagatcaaggttctggctgattcagtttttggtgagggcatttttcctggcttgcagataactgccttctcactgtgtcctcacatgcttttcctctgtgcatgcatgtcaggagagggagggagaatgagagcagagaggtttctcttcttatagggacactaatcctatttggatcagggctgcacacttataacctcatttaacattaattactttctccaaatacagccacactgggaattagggtttctacaaataaatttgggggagacacaaacattcagtccataatacgtacttttaaagtaaaggcgatagactgggcacagtggctcatgcctgtaatcccattgctttgggaagctgaggtaggagcattgcttgaggccaggagttcaaggctagtcttggcaacatagtgagaccccatcgctacacaaaattaaaaaatagtttaaaaaacttaaggtgatattgtatatatcatgttttgaaattgactttttaaaattacgttgtatgtgtttttaccttaacaactattccatcattttttctcctggtagggcatttcattatataaatgtaacataatttttaaaaaacaatatactgttgctgaacatttaaattgttttaatttcttgttgttataaaggtgcttcagtgaacatactaattgctgaatgattgttcatatctaccgttatttccttagaatgaattccttgaaatggaattgatagaaatccaggattattcaaaatcttaaatctttatattactagatttccctctggtacatttcttccagaaatgtatcaaaatattttcctcagaactttcaccaatactacatatttttgatgagtattgcttttggcttttttaaaatttatgtgtgtttgtctcttcacatgtccttcagaagccttttgtatcactttaaccccccatggtcatcctcaaatatttttggcttttatagtctgtcttatatagaaaagcattgtgtatttgattttgttcacatgttaactgtgtctccttacccagatgtattatgactgaaaaggatgtagaggagtggtaaggcttgccaaacgaaaaaggatggataggcttgctcgctacctgaaagtgcagttgaagcctcatcctttaatgagttttctcaaaacccaaaagttttcttcataaccattgtgaaataaaatgtataccagcctgggcaacatggcaaaaccccatttctactaaaaatacaaaaaaatagctaggtgtggtggtgtgcacctgtggtcccagctacttggggggttgaggtgggaggatcgcttgaacccaggagacagaagttgcagtgagccgatatcaagccactgcactccagcctgggtgacagagtgagaccatgtctaaaataaaataaaataggtagattccatatactctgaacagctttgtgtttttccatttgttgcagtcactttcttccctctgcattgctaaatctaatgcttgtttccagttctcattttatttaacttacctgcaacacttaacacagttactgactccctcttccccaaagcacttattctgtgactccaagttatcaccttattcttgttttcttcctaattctcgggcatcattttcatagtgtattttgctacttccttttcttctcccacttctaaaagttggaatactctaagacctggaccatagatatcttctctgtgctcactttgttggtattctcattcaggcccacatcttttaaggacatgtatatattgatgactctgctgtcatcaccagatttactttgatgacctctaagaccctgctcaagtgtacatccaccgattagtagtaggtgctcatgctgtcccagttgttaaatatttttaatactagccctaccctgttcccttgccttttttaagatctttgctaaaatgtcaccttttcattgagactttgcattgacactattaaaattgcaacctgcaggttactgacaatcttgacaagccactttggtagaatcttgatggcagaaatttgattgcaggctgggcgcggtggctcatgcttgtaattgcagcactttgggaggccaagacgggaggatcattcgaggccgggagttggagaccagtgtgggcaatatagcaagacctcaactctacaaaataaaaataaaaagccaggcatggtggcatgtgcctgtagttccagctacttggaaggctgaggcaggaggatcacttgaacccaggagtttgaggctgcagtgaagtatgattgtgtcactgcattacagcctgggtgaagaacaagaccctgtctggaaaaaaaaaaaacaaaactgagggtttaaaagtgagtgggaaagagaaattgtaatcaatgagtataaactgctctttcaaagaattctgtgatgaaagggaacagagcagtagggaagtagctgtaggagactatgagacaagcaaggattttctaaactagaataaatttcagtttattttaaataaactagaatgctgtgctctggtagagagaggaaattgatgatgcagaagaaagataggaaatgctgaaataacacacttgagtagatgacaaatgagataaaaagcaaaaatgaaggggttgactatggaaaggagtgaactaactagaaaaaaggttatcttatgggaacagatgcagcaggtaagtaggtagatatggtgacgtgagctggtagaaagcctcttctgattgtttttattttctaaattaaatggagagtgatgtaaccagctgaaagtgaggatgaggaaagaaatattgagatttgaagaaagagaagaagccatggaatgtgttccgagagtgaatggattagggaaatgtagtaggattgctgggcagtactaatgtcccacttaacgttagtggtcattaatttaacgagggacttgttagcagacacgtttaactgtactggaactgtatactggagttacacattaggtgaagaattggaccttaaccagggttggggtttggccagattggaatgagaagattaaagaggatcaagggagttgagggtatttgcaaaggagtgattatggtgatgactgtgaaatctaagccaagcaggagaggaaatgagaacatgaggggtgaaggacagtgaacttttgtagattcagtgggttttaggtaccaataggctcaaagaaatgagctagaaatatcaagtggttgtcagaggcatttaagattaaggttatggacagtttgtagtcattagtaatgacagtgttaagaatataactatgggagtgggtgactgaaagaggattggggaatgagatcaccggaggggaggaagtcaacaaactgaggccagaagatcatctgtgtgaatagaaaaattgttattgtaatactgttggagagtatgagagtaaaccaatagctataatcttcaaagaatgagtggtctgacctgaagtctagggaaactacaagaaggaaggacagttattggtacaatttgatgatgtaggattttaagctggagtgttacggaagaaagtaacttactatatactattatacatctctaatctttaccactaccttttattctgatattttccttctttgaaaggaaatatttaatatttgtttaatatttaatatttgttgacgactatagtagtaggcattggtctgaacacaagggatgcagtgatgaaaatgctgaatagaatcctgtattcatagacctcgtagtttagcgtagctcatttagcacaaaccaaatctcagttccctggatcctagtttaggaaatcctattctaaggatatctgtcttaaatcagtaaatatagtccaagatagtaactgggtatagtaattttctataatgtatgtaatacatgtttgttttttggcataaatacatttggctgtttaaagactggctacatattgatgagaggaataatgttatactttgaaaattttttaaatagtagtagtagggaaagatacagtacaaatgggtgctaagttacttttgttcttgaacattcctttctgtgttgatcaagaaaaacaaatcactactgggagataaattagcaaatcttagctgcagcatcagcagctttttttttttttttttttgtaagagacagtatctcgctttgttggtcaggctggagtatagtggtgtgatcatagctcactgcagcctcaacctcctgggctcaaacaaccctcccacctcagcctcccaaaatactgggattacaggtgtgagccactgtgcctagccagcatcaaaatcttaatatggcaccatgagagatttttctaaacccagacctcatgaaagtggcatgaagtatattacatatttttagtcaatatacttttatataaaagccaaaacacatcacagtaaatacaaaggaaactgaagctataactgcagtaattataagttttaaatgaagcagtgaatgtattagtcagggttctctggagaaacagaaccaataggttatagataaagatacagagaaaggcatttattatgagggattgtctcaggcaattatgaaggccataaagttccaagaactgccacctgcaacctggaagcccaggaaagctggtggtatagtaatccagtccaaaaccaaaggcttgagaaccatggtgtaagtctcagtctgaatccagagggctgagaaccaggagcaccaatgtccaagagcaagagaagatagatgtcacagctcaagcagagaaagcaaattcacccttcctctacttttttcttttattcagaccctcagcagattggacaatgtccattcacattggtgaagatgatcttctttacttggtctaccaacttaaatgctaatctcccctagaaacaccctcactcaccagaaatgttgttttactggctctctcttagcccagtcaggttgacaaataaaattaaccatcagaatgcactgtctggccaggtgcaatggctcacacctgtaattccaacactttgagaggctgaggtgggagaatcgcttaaggcctggagttttgagtccagcctgggcaacataccgagacccacccctctacaaaaataaaaattagccaggcgtggtggctgtagtctgagctacttgggaggctgaggcaggaggaacgcttcagcccaggagtttggggctgcagtgagctatggtagcaccactgcactccagcctgggctgtaacagagtgagaccctatttaaaaaaaaaagaaagaaatgcacttgacaaagttccagtttatgcccaaaaagctttcaaattggagatacctggtttagtgtgtcttctctgtatttcggcgtatttgatatgtgccattccattgcctggaagcatgaattgttcatccttgtcttccaacagaaaagttccatagtgctactgatactctagccttttcattttaaaagctccctgctgcccttcttataacggtctgtaggtctttcccattacccggtctgtactgctacactgcagtggattacttcttcctagaatggtgcttttcttttaagcctaggtaattacatcatattatttattgtgcaacttctagaaaacatcccagatttggaaaccaacagaaaataaatttgtcatttagattaatgtgacttttgatgatatgatattactttccttactctgatcagtgtatcaatgcctttctttccacatttgaatgaattgtgctattgatgaggaaatccaggccaataagggaataatatggaaatataacactgcagaagtagtggatctttaccatattttgtatgtcaaacatatgtctgttgaaagcaaacaatagaaacctcagtttaaaacccaaaggaacatttcagtaagaaatatcagtcttagaaatttcagtcaagcactgaaggttcttgagctggtcaaatattgtatcccatttaagccaaatagtcatcatcatacattgatgtgcatgtagtaccccttgtagactgggggcagttttgtatgccaggaaacactagtgcaagagttgctaaacagtgaatactttccacctctgtatatcccatctctacagtgattccagtttccaatgggagagaatcagaagagtaggaagttgtgatggaagattgtagtgtaagcatttgaaaccctgttcccctaccaaagtgccaaactaatgaattctttaatgcaaaaggaagagtttgtaatgtcataaaaattgtattcctagatagcacagagagagagagagagagagatagagattgtttggaggactttttttccatttatctgtgtatgtctaagttatgtacgattattaaatactaagtagacaaatttacttactgtttttaggaagcatataaaggaacaaaggcaaatagttagaaaatcacttaatcgtagaagcatagatttctataaaacttatattctttattagcttctgctaggagtcctgagctctgaaagaaaggtcagagaatttaagattctaactgcaaaagaaaaccattaaactcactgccttaggtttgaatgtggagctcagaacagtaatgttgagaatattagaacttgtcccattggttgaatttctcattaatggagaagaaccctgtaagaagtcaaagctggcatctttaggtataccacttctacccataacagtgttagatctccacagccccatgcagatggctacaaaagcttcttttctcatcagatacatatatatggggaaaatgttcgagttgtaagggtttggttgaaacatagggtttatgtgttcctgtggggctaagaatggtgcccataagcactactggtaggtctgcagttcagttaaggggataggaataagaaagagaaaaaaaggagacagaagcttaggtgagtggagagaatacaagaaggaaggaaggaaggagagggaaaagaattatgaatggagaaagaaagcattctggtagtgggaattccagtgccattcattgacgctatgccatagatgtaattcttgtgcacacagtaaaattcaagaaccattggttaatggttagaaactaactttgatctaagtttgaactctgtacatttgtataagctacttaacctcctcagtctcaggttcctcatctgtgaaatagaggtaataatacctacctcatagcattgtcatgagaattaaatattacctaagtaagtaaagggcttagcacatagtaaatactcaaaaatgataatataatgaaaaaatataattatattgtatgttctacaagtataaaatttcagaaaatgtggttgggttggtggcatttacatgacaatctgttcattaatgggtacactacagtgaatgttattttcttttgttttctaacttagtttatttcatttttaaactggcttaatttttgcttatctttagttcagtggttcttaatttttatggtcacatgcccttttaaaaaactgatgaaatgtattaattaactctatagaaaactacacttacatacaaaattttgcccactgtctgggtttccaaaaaataaataaataaaacatttaggtttgtttgcccagtgtaatagttttatgtgaaaactagtctgaacaaaccaaaattaataagaatcaaagatttagagtgttcaggcctggcacagtggctcacccctgtaattccagctgctcaggaggctgaggcaggagaatcacttgagtccaggaggcagaggttgcagtgagccgagatcgcaccactgcactgcagcctgggtgacagagtgagactctgtctcaaaaaaaaaaaaaaaaaaaaaaaaagaaaaggaaagaaaaaaagatttagagtgttctaaccaagttgcattattgctagctcccattctataccctaaagctaggcatctaaatactcccctctgcaactagagaaattccctaaaaattgattctttaacttatgccctaggtgagttaatttttaaaaggcagtagctggccagatacgatggctcgtgcctgtaatcccaacactttgggaggacgaagtagaaggattgtttgtggccaggagtttgagaccagcttaggcaacatagcaagactctcatatcttcaaaaagaaaaatcaaagaaggcagtagtttcggaggagaggtagaggggatgaggaagggtaagtagagaaacacatacttttcaagagatgaggtcctgtgatttcatataattttgtgtggcttccctaattaggcattatttttccccagttgcatgttaataatgactcgtgccattgatagcttaatatggatctagtttttctacctacctgcaagggaccattcttcctacctttctgttctctggacccttcacagtgagagatgtgaaactatgaaaaacatctcagaccaccatcttaacttccaacttacatttaattttaaaacaaattattctagagaatgtatccaaaaactggtaagccagcatatacttaaaaattagaatgccttcaggctgtatttatactctgcaattcaacatatactttatcatgtcctataaccattacccctagctatgtgagatatgttaaaactgcttgtgtcctgaagatatttgagtttgtaacctttgctatggcttagtgggattccttacttttttttagaaggtggcaaggaaggattggagagtgggagaatgaaaatatccgttactcacttactgttaaaacatacagtttcaaaggatttgcagacttctcaaacagcatttatcagagggtctcagatcaagagttcctgatttagatcctttattagcttagacatgtatgctactgtttggaatatcatttgttctcagctattatgatttagctatacccggaggattcattatacatgactgaacaatttaaatgtgaagttgctttggaaaggaaagaaaggagagtttcctcaaccagttacctctagtggtgttggagaaatggtcatcaaatgactcctgttcctgtaactttctctttccttcctccatctccaccactcatcctcccaaagacactaacccttttacaccttatttttacagtgttaagaattatcttgtgagattagctatagtcctctaatgctcacctttactatttccattgcctattacttatgttagttcttttgtattttcatgcccctaattatttgtatatgttagattcagtatttggaaatatttgtagaaataaatgaagctaggatgatgattttttctctctctctccagctgatcagtcatttctccctggttaacagatgcttcccagtgctgaagtggctctctctaggcagtacctccattctaaattccatcttctccctgatactgtcttggtgattcatcaccatcatgtcagttctttaatgctttaagaatttttaaaatggccgggcatggtggctcatgcctgtaatcccatcactttgggattggatcatgaggtcaggagatggagaccgtcctggccaacatggtgaaaccccgtctctactaaaaatacaaaaattagttgggtgtggtggcacacccctgtaatcccagctacttgggaggctgaggcaggagaatcacttgaacccgggaggcggagattacagtgagtcaagatcccgctattgcactccagcctggcaacaaagtgagactccatctcaaaaaataataataataataataattttaaaaatttatggcaggtgcggaggctcacgcctgtaatcccagcactttgggaggccaaggcgggcagatcacgaggtcaggagatcaagaccacagtgaaatcctgtctctattaaaaatacaaaaaattagccaggcgcggtggcaggtgcctgtagtcccagctactcgggaggctgaggcaggagaatggcgtgaacccaggaggcggcacttgcagtgagcggagatcgcgccactgcactccaactgcactccagcctgggtgatagagcaagactctgtctcaaaaaaaaaatttattggcggggcatggtggctcacacctgtaatcccagcactttgggaggccgaggcgggcagatcacgagtcaggagattgagaccatcctggctaacacggtgaaatcccatctctactaaaaatacaaaaaaaaaaaaaggttagctgggtgtggtggtgggtgactgtagtcccagctactcgggaggctcaggcaggagaatggcgtgaacccgggaggcagagcttgcagtaagccgagatcgtgccactgctctcacagcctgggcaacagagcgagattccatttaaaaaaaaaaaaaaaaagaaagaaaattattttgttcagttgttattagttatcctcagctggaaggtcttcaattactgaaaagtccctgccattatttcctttgggggaaaaattctagcatttgtatttttaaattgcacacacatactaaagtatgtaaaagtatttttttattttgtgctcacaatgaagctagacaggagtagactgtgctctaaaagactcttagaatgccacctatttggacacagaatccccattaaattctggggaattctatatattctgaaatcgaaatggtattattaaccagttgattacttgtaatacaaagaagttcccttttcaaggaggcttctagagttggactacaagatccatctctttgagcaaactgtcttatttggacttggtactaaatctcaaaggaattagaattttgcatcaaaattttgacaagttttgcctatcattgttatggtactacgcatgatactgaattgctcaaaaatttgcctttctgcttctgatctccatttggtgttactcaatctgttggcattagattgggagtggggtgggatagagaatatagtctacttcatccagccacaaatcccaaatgtcccaaatgtatttctttcttttttttttttttttttttttgagatggagtcttgctccctcgcccaggctggagtgcagtggtgcgatctcagctcactgcactccacctcccaggttcaagcagtcccctgcctcagcctcccgagtagctgggattacaggcgcacaccaccacacctggctaatttttgtatttttagtagagatagggtttcaccatgttggccaggctggtcttgaactcctgacctcatgtgatccgcctgcctccgcctcccaaagtgctgggattataggcatgagccaccgcacccagccccaaatctatttcttagatcattgaagtatgctcagcattattattttctgcttttatattaccttctacagtagtcacaatagttacattataattctgagtaggtgaagctgatgtttatattgctgccagaaaaaaaattttaatagagaataagagctatcatgcaaaacaactggagaatttctttaagggtttgaagaggattatgagccacaagctttaaaatacagtctagatttctgtttcttggctctgttgcaaaccaattttgaaaggaatgttgttatctgatgaatgttatctgatgattaatgttttattaaaactgagtatcaaaaggcacataatacatttttgtattataacacaagatgcctactatatctacatattaaagacttactcttctgttaatccctgtaaatcctctttggtactgtggaacagaaagctgcccttaaaatctaaaggtattatttgttttacatagtttcttttacatgtcttaaagtgaaagagcattggttagaattcatttgtgtagaagtaaaacttccattacaatgaagggcataaaatatggatgctgttttctggttccttaccagagcaatgatattttattttcttggttaaaatttattctatacagtgaattatccagtacaataactgccttatctcgtccctaaccaagtaacattttttataatgacactgattatatgctggttgccctggagagaagaaagaattaaactacagctgagtcatcacagcatttttctttttctttcttttcttttcttttttttttttttttagatggagtttcactcttgttgctcaggctggagtgcaatgacacattctcaacccccgcctctcaggttcaagcgattctcctgcctcagcctcctgagtagctgggattacaggcgcccgccaccattcccagctaatttttttgtatttttagtagacagggtttcaccatgttggccaggctggttttgaactcctgacctcaggtgatccacccacctcagccttccaaggtactgggattacaggtgtgagccaccgcccccggccatcacagcatttttctaatgaaaacttttaataactgcagtccctcagtcatttcttctcaaacatccaaacaagaaaaataaacactaaaattatgaaaatcacccatttaaataatttaatacatcatctcctttatgcctgctactgtatccatagtgatgtagtcactgaaacatagtaggtgttcactaaatgtgtgctgaatgagtgaaatgaacctaagaactcagaggaagggaaaaagaagaaacttagtatgttataaatatatataaataacatatgttctctctactaagaatttctctttagactttctaatttactgcaaaaaggcttataagcctgaacaactacaactatgacttcttaatctgtgtttataatctaatttcactaccttgggggttaggagggtagggagtggtatatcttttagtggtttttgatttttcattgttttaaatttctgctaaattatcttcttccatggaagggaggctacatacaaggtaaatgcgaatggcatatcagaaggaaggtgcgtaaaactttactggatcagaattctgccatatccaccacctaagatcaatcagtgtgagggaaagggaataaatgtaattagataacataattgtctataaaacaaagagaatttcaggaaaatatctgttagcaaaatataacacatttatcctcaaaaatcaaggaaaaaagagaaatacatgaagtttatcttaacactatcctttgagagactgagtgtgtagacagacagtgaccatatataaaaatagaactctgtcctctggtctgcagcaaccaacccaagaaaccaacctgctatctacaagtcagaccactgtctctagcagacagtccaagaagataacagtaacccttgtaacaatcaggacaaaatggccagggcttgattattaactgatgacctctctaatttttgcccttgcttccaacttaagaccaactggagaaagccaaatatgcacccctaatcaatctcatggtatgccctgtttctagttaacctgcctgtagcttctccaagccaggtgcttccagttagcgcatatctgaagcctttccttttttctattataaaactttcccattcctgtgcctgcctttgggtctctgccaaatgcaggtgattgtggctgactcccctgctgtagcaagtgctgaataaacaggcttttcctgttaatattggggtgatcttcacttcatgcccttttcacataattacactgttctaagaatatgtatgacttccatgcttgaacatacatacacaaaataaattttttaataataatcagacttattcatataaaaaaattaagtgatgtaactggcttccttatgctttatgagaacaatagcatagcaccgatggtagtaaaaatgacaagaacactatttcacctggaacaatagctactataattccactctacaagttctttcttttactggcctgggttgttaacaccttcaccttagcatcctcccctacagccacttgtgccattctcttttgttggtaccttatgaacttcatgacagctgccatgctgtcactgccagtgacgaaggcagatttttgacatgactttggcatctattaatgtcttagtgatgcataattttccacattaattgatttgacttagtcatctcttggcagtaaagctatgcagggtgaggtaaagcccttttctggtatactctttcaattctttacagtacttctagttttacagctcttttgttaccctcattttcttacagccttatactacctccactccacctacctttatccccacttggagaaacttgaaatctgtttcctggaattaagttggaaaacacaaagtttcaaagtgttgcccccccaaattgttgctcctacgaacattaaagaaagtttctgtatacatttagggacatgcttgaagaattgagaatgtaatctttgtccatctccgtttctggtttaagaaacctgatgctagagctaattaattccttagcatatcatcattatttctaccaaatttggtgtaaataaagcccctggtaacctgctttgatatgtcagtattccagagtaaatgcggagattcccctctcctactctaactacttttacattacataaatatgtttgtatgttagcagagcaatatataaacacaaatacctgtaatatagatttctataattgcatttatataaatgtaattacatatataaatgtgttcagaagagaaggtcagtgaggtcactatataaaaatgaatggtattgctatattctagcaaagaaccattggaaaattaaatccaaaaacaatttaatttacaacagcatccaatatcataaaattatcagagataaatttagcaaaatttgatcaagacttgtacactaaaaattataaataaacattgttaagaccaattaaagacaaccaacagatttctcatgtttatggattataagatccaatattggtaaaatagcaatttccccaaattgagtgaacataatccaaagaaaaaaactatttgtagacatttgcaaactaatacgaacatgcaaatgacctagaatacccaaagcaatttttcaaaaggataacgaagtttaaagcaattttacaaaagaataataaagttaaaggacttatttttaaataaaaatgttagggaaattaagtggagaaatggacattgacccttacctcataccatacacaaaagttaagatttagctgaggctgaaggattgcttaaacctaggagtttgtgaccagccctggcaacctagcaagatccggtctctagaaaaaatttaagaattagccaggtgcagtgctgtgtgcctgtagtctcagctattcaagaggctaaggcaagaggattgctggagcccagtagtttgaggctgcagtgagctatgttggtgccactgcactcttacctgggcgacggagtgagaccctgtctcccccgccaaaaaaaaaaaaaaaaaaaaaagatttagacctaaatgtaagagctaggactgaatctttgcaaccttggggcaagcaaagatttcttggataggacatgagaaatgtgagtcataaaagaaaaatgtgcaaaattggactttacctaaatttaaaagttttgttcttcaaaatacagtgtttagaaaatggaaagtggagccataaaataggagaaaatatcagtgtacatatacctgacacccttgatccaaaataaataaacccttactactaattaacaagaagacaactgaattttttttggcttgaaacaaccaccattttattatgacaactgaagttttaaaatggatgaaatatttgaacagttgttcacaaaagaagatgtaagagtggtcactaaacacgtgaaaagatgttcaacaccattatcaggagaactgcaaattaaaaccagaatgagataccactgtgtatttattagtataactaaaattaaaaaggctctcactgccaagtgttggcgagaatatggaggaacaggaactctcatgcacagcctgggagagtataaagtcaccagtcactttggaaactggcaatttcttatgaagctaaaattataaactttataactcagccattacacacctatgtgttttccaaagagaaattaaaatatatgtccacttaaagactttacatggacatttatagcacttttatacatatcagccaaaaactggaaacaatacaatgtttatcagcagggaaacaacaaaatgtggtatccatacaaaggaatactgctcagctatgaaaaggagcaaactattaacatactcaacaacatgacgatctgtaaaacaggctgaatgaaaaaccagactagaatacatactgtttaattccttatataacctatttaattacttatataagcttatgtaagattatagaaaatagaaactaaaataacagaaaaaaggccggttgcggtggcttacgcctgtaatcccagcactttgggaggctgaggcggacggatcacaaggtcagaagatcgagaccatcgtggctaacacagtgaaaccccgtctctactaaaaaatacaaaaaattagccgggtgtggtggcgggcacctgtagtcccagctactcaggaggctgaggcaggagaatggcctgaacccgggaggcggagcttgcagtgagccgagatcgtgcagctgcactccagcctgggcgacagagcaagactccatctcaaaaaaaaaaaaaaaaaaaacaggaaaaagatcagtggttgcctgggactagagttgagagtgagtttgcctgcaaagggacacatacagacttccagagagtaatgaaaatgttcagtatcttgattttggtagttttaccagatgtatatatttatcaaaatttactgaattgcggctgggcacggtggctcacacctgtaatcccagcactttaggaggccgaggtgggcggatcacttgaggtcaggagtttgagaccagtctggccaacatggtgaaaccccatctctactaaaaatacaaaaaattagctgggcatggtggcacacacctgtagtcccagctactcaagagtctgaggtgggagaatcgctagaacccaggaggtggaggttgcagtgagccatgactgtgccattgtactccagcctgggtgacagagtgagactctgtctcaaaaaaaaaaaaaaaaaaacacaaaatttattgaattgtatatgttatataggtaatagtttattatttgccaattatagttttagaaagagaagatcagtagatgaataggaaatggaattgaatctggaataagatagcaactagatggtagtgagtgagtaggaaaatgactaagagaatgcttagattgagcagaaaatatatggtaagaaaagccactagaattttatcgtagtctgctaattaagttatggttgtatttgagtcaaatacctaaaaattaaatgcctacaataatggtacatgagaaaccactccaaaacttacagcaaccaaaaataagcactttaaaaaactcatgggcttgcaagtattggttgaaatggctctgattcgtgctgtaggttggctggatggctctagcattcaagttgagctcatcatctgtgattgtttctgggttcaggctgaaggggtatcagccaggagcttctcctggtgtatcaccagagcacaagaacacaagttaaactgtacaggcacatttcaagcctctcctcgtaagatcgcattgtccaaataaagtcacttggacaaatccaaaaaagttttattgtgggaagtataaataaacataaccccaaggtacttctatgtccctatcctccagtttcaacaattatctctattttgcaactcttgtttcttatatttcttccctcttctattatgctcaagggcactaataaatatggagcagcgccttaaaaccaactgccctgggccaggtgcggtggctcacgcccgtaatcccagcactttgggaggccaaggtgggcgggtcacaaggtcaggagatcgagaccatcgtggctaacacggagaaaccccatctctactaaaaaaatacaaaacattagccgggcgtggtggagggcgcctgtagtcccagctactcgggaggctgaggcaggagaatggcgtgaacccgggaggcggagcttgcagtgagccgagatcgcgccactgcactccagcctgggcgacagagcaagactctgtctcaaaaaaaaacacaaaaaactgccctatgggcgcacataagctagaggtggttgctttgattcttgaaaagtagtgggcattgattctcacagctaggagctcagttttggaaggatgtggaagagcttccgtgcctttttcaacatttgttgtgacaaattgcggcccctgcttttagcagctgcttattttctaacattcctcagaacaatgaaaaattcaggtaatcgttcgagaactaagaaatgaaaatatagccaggtttgctttggcagttgggccaaactaatcattgtttttacaactctgttaaagagaaagcatgagtttatttgattaaatatggcacagatttctaagtcttgaaatagatgagaataagcagtttataatcaacaaatcagaaaatgtaaacaatctgatgtgcaaatgctaaaagaatgctgagaattaagagagtctggggaactagagatatagtgtttgtgtattatttgtgtgcagcttgccatgttaggaatacagattaggaatttggatacattggctattagacattcatttcttggcacagttttaatcattgtttaatccctgtgcacactggctaccttaagtagaaggtacttttttcaaatgttgtaaagtgtaaaccatctctgactggagaattggcatcatcaagaaaataatgaccaacatatattctgaaatattcagtacctgcttttttacagaatcctctttttgagggggcctgtattatatttatcacagagtttaatttactgtgatttaattaaactttatttttttatttcccccgtgagactataaactcctcaagaataagggactgtgctcattgtatcatcagataattctgctagatgctgttaaagataaaaatatattaagtagctatttagacaatttgtacttaataatcacagttttcttggcaggatgatgaaatggttgagaacataggctcaagaaccagattgcttggacttaaatattgtctctgttacttaactaactctgtaaccatagacaagcaagaacttaatctttgtgtacctcacttttgctatttgtaagataagaaatgtcgtgaagattaaatgatttaatacatatagtgcatttagaaaagtacagtaatatctcaataagttattgttacagtcatcactactactactaatagtactatcaacattattccagaaataaacttcaaacactgttttaaaataatattaaatatgctgcatttaatcagttgtgatcaagtcctgtatttatgttgaattggcaagtcaaacaatttgaacctacaaattgttccctctgctctttttccctgactctactgttcaatgtcaaactcatccattaatttcaagtacaccctcctctaagaatcctgttccatccctttcctcccctcaccctcccaaaataaggataattgttttgtctctgtgctcttcctagcacttcctttaatttacaaaatatttcttctaggctgggcatggttcatgcctataatctcagctctttgggaggtcaatgcaagagggtcaggaattcaagaccagcctgggcaacatagggagactacatctctttaaaaaaaaaaaaaaaaaaaagccttggtgtggtggcacatgcctgtggtaccagctactcaagaggctgaagtgggaggattgcttgggcccacctgggagttcgaggctgatcgtgtcactgaactccagcctgggttgacaaagtgagaccctatctcaaaaaaacaaaaaacaaaaataatggcttccctctagccttaatgccattgctccactttaagttgttagctgatatgagaagagtggtcaagtaaagttgtttgtgatttgttggaagatgttggaatatgtttaacactcaatgggaaaaactcatctgaaagcacgagtatgaatttgagaaagactaatcttttttatcaagtttccctgaggacaggcttcagtaagatccaaaatataattggaaagattcattttagataggaaaagggacaatattgctgttaaaaggagggaaggatgatagagttgatgggttcaggacaagtattactatttaaacagtatcactatttaaaaggatgaatgatgtataggcagatttatatgtttgtgttatcaggaagctgagaaactttctagtctttttgcctcatcctcctccaatccattaccctcaatgcaaccagaagaacctttattatattcaaatctgattgtgtccttctctaagaagtacttacttcatgctttcagaaaatatttcttgaatgcctcctatgtgttaggcactgagaatatagtagtagaaaaaagtaggcaaaggcctggcatggtggctcacacctgtaatcccagcatttgggaggctgaggcgggtgaatcacctgaggtcaggagttcgagaccaacctggccaacatggtgaaaccgtgtctctactaaatatacaaaaagtagccggccatggtggcaggtgcatgtagtcccagctactagggaggctgaggcgggagagttgcttgaacctgagaggcagaggttgcagtgagtcaagattgcaccactgcactccagcctgggtgacagagtgagactccatctcaaaaaaaaaaaaaaaaaaaaaaaaaaaagagtaggcatagtgatgtaatttagctccgaattagagggacgtgtgtgttcctactaaatttgcaatgtcacagagccgcctcttctttctgcttactcttctcagtagagaggagggagaataaataaagatactctttatataactgcccatggtttgttagtgatacatatctttaatggtcttctgataataacctgaatttacccagggttgatgttggaagggcttctgtcctcttgctgttggtcctctctctaaactagctccctgtaggttcagttggcctagtggaaggtagatgaacctgagtggtatagactaccctctacagtctcaactttggggcctataggcacaggcatgaacttctttctaggcatgttgaaaaccatgaaccaggtgaggaagggagaaagttgtattgtcatgcctactgaaatggaacatttcaacaagccagcagggagaaaggtagtcccagaggtctgtatttaaaatgcgtcttcaaggtcttttgttcattgccctgtgggccctacttgtcaattccaggaaaacagaaatttcacttgacaccgacacctcctaccaccttaaattctgctttgtcgggtaataatattgcctctcggaatgattgaacctccaaggaccacatttagcaggtacagccccctctccaagtggattcaccagcatctgtcaaccagaaaagctggagagatctaaggttgttgctgtttcccttgctcttggctcctcactcttcccttgttattcggtggttacagaaaatgaagcatcactcctgttctcatctaccttcagcttccagtgtacttgcctcgtgtcactaccacccttattttgacagttgtatcactccagtgaggtgtaggtagtaggcggaagagaagttgagaacttgtgttctggctgtcatttccacagaattcctaaatagccaatttaaaacaaaggttttcagaggaaagcgtggggtgccatcactgccaccagcactgctgtgccagagccgagccctgcctccccttcttcctgacaccaccgctcatgtcctccagcctgttcctacaatctgttgaaacttggtagaatactatgaagttctaggcatgtagagacatgcccacctggctccccccgctccaaggttattaaagaggcatattggaaactggcaccaaagtggcatccagataaaaatcctgagaatagagaagaaacagaaaattccgacaagtagctgaagcatatgagatattatcagatgctaaaaaatgggacatctgtgacaaatatggcagagaaattaaatggtggaggaggagttggaagtcattttgacagttcgttttagtttggcgtcacattcctgtaacccagatgatgccttcagggacatttttggtggaagggacccatttttattcaacttctatgaaaactcatttgaggacttttttggggaatcaaaggggttcctgaagaagcagaagctgaggaacagtcatttttctccaccttgattggatttccatgttttggaagtggattttcttcttttgatacacaatttgcttcattcaatcatgaggtcatggaggcctcacttcattttcctccatgttatttggtggtagtgccatgggcagcttcaaatttgtatcaacttatacctaaaatagttgatggcagaaaatcactacaaagagaattgttgaaaagggtcaagaaagagtcgaagtgcttaccgataaatggtgaggagcagctgctacccttgcataacaagtaactcaacacactcatttgaacagaaatgttaaactataacaagcaccattgaggattaaggaacatttctttgaagatttcagatgaattcgactttctttttcattgtgcctaatctagagtatttataaacagctcattggagtccctatttgtcttaaacttttgaatttattgatgaggccacataataggaccttttttttaaacttcaaaatagtaaatctctgtatgcactttgctttcattattaaatatactcttagttgaaccttgactcttgagtagtggtaggacaagattgtacacttaacaccagcatggatctgcttttccattgtgtctgaaatgtgagccaggtgtagtgtcaagtgacgttaacattgccagcataaatcttccacagaaataattcctatttttttctgtcaagtgaagttaacattgccagcatggcagcatgaatcttccacagaaataatttctatttttttctctatttagtagtgcaagatattaatgcattcgtcgtaatacatttctagtttaatataaataaaggatgttttctagttgtggatgaatgctagcaacttagttttgacagtggtttaaattagtaatgttaagctgaaatttaaaaactaaagtttgagagggtcgaaaatttacctgctgcgtataatgcacactcattattcgagtgatgggtacactgacagtccagactccaccactgtgtcatacatgcatgtgagaaatctgaacttgtattccctaaatatataaaatattttttaaaatttaagtaaatctggtaaactgagtctttgtcatttgttttttaaaaaaagaaatgcaggctgggcgcggtggctcacgcctgtaatcccagcactttgggaggccgaggtgggcggatcacgaggtcaggagattgagaccatcctggctaacacggtgaaaccccatctctacgaaaaatacaaaaaattagccgggcgaggtggcgggcacctgtagtcccagctactcaaaaggctgaggcaggagaatggcgtgaacccgggaggcggagcctgcagtgagccgagatcgcgccactgcactccaacctgggcgacagcgagactccgtctcaaaaaaaaaaaaagaaatgcaaatgtgtttggtgcagtctttcctgagtgggaaaaaatagataaaagttttcattagttgaagatctatttaaaacataacatatttcatatataatttccttgaaatctcttgatttctaatattatgtctttataagacaggaactttaaatgaaagatctaaatgtttagagtagtaagtttgctgatatttagtatccctcatctgagcaacttaaatagtattaaaatatatagcttaaatatgtagtgttatttgtttttttcataattctagacttgtttcttagagtaaaaaagcataaacaagtattgttgagaatattgtttcattctcaaggtcagtgccctaagtttttaatacattttttgtaattttgtagaaattataaatacagaaaggaatgcaaataacagttatgccttgctatgaaaatttatgaagtgaacacaaattaagatattgaatgttttcagcagttcagaagcttccttcatgcttcctctgcatcattatcctccccttacaaacatacccactgttctgactgccatcatcaattatttgttttaccaatttctgaactttatataaataaaatcatttagtatgtattctttttttttttttttggagatggagtcttgctctgtcgcccatgctggagtgcaatggcacgatctcggctcactgcaacctccgcctcccaggttcaagctattctcatgtttcagcctcccgagtagctgggattacaggcgcctgccaccacacccggctaaatttttttgtatttttagtagagatgggatttcgccatgttggtcagatgatccccccacctcggcctcccaaagtgctgggattacaggtgtgagccactgcacccagccctatgtattcttttgaaactatcttcttttgttcagtaatacggttttttttttttggagggggggttggggacagagtgtgagacagggtctcactctgtcacccagactagagtacagtggtgcaatcatgtttcattgcaaccttgaactcccaggctcaagccatcctcttactttacccacctgagtagctgggactacaggcgtgcactaccaggcctggcttcttttttaaaaaaatgtttttttggagctagggttttgccgtgtcacccaggctcgaatagctgggactacaagcatgtaccaccacacccggctagtttttgtatttttttggtagagaaagggtttcaccatgttggccaggctagtcttgaacttctgacctaaagtgatccacccgcctcggcctcccaaagtgctggaattacaggcgtgagccactgcacttggccttgatggacattttcaacttgggctatgatgaacagttttatgaacatttgttatgtgtcttttgatgcacctattagtatacttttccttttttttatacaactagtagtggacttgctgagtcatatggtttctgtaaaatggcaaacattttccaaatttgaaaccatacattttttaaatgccaaaccttttatccaaatttgatgctaccagtttacattcccatcagcacagcagtgtttcagtgttcctttgccccctactgtcagatgctattttgtttgttttgtgtgccattctgcactgtatatgtgtagcagtatctcattggagttttgatttgcatttcccaataatattgaacacctttacatgtgcttattagctatttggatattctcttttgtaaatcctgtatagatcttttgtctattttttaattggattgtctttcttgttgatttgtagtagttatctcactctatggcttgcccttttaccttcttaatggtgtctttggtgaaaagattgactttgccaatcttttttcttaatggttgttgccttttgggcctttgtaagaaatatttacctagttctaggtcataaagttacactaaaaggtcgttttccagaagacttattgcttcactttttacctttgggtctataatctatatgaaacttattcttttaaggacaggatttacttttccatatggatatcatattgatctgtcaccaatacttgaaaacactctcatgttactgaaacactgcagtgaaacttttgttctgaatcaggtgattatatatagagagagatctgtttttggatttttaaactctgttccattgaccacctttttatctatgcttttgtctagctgtgtcttaattactttagctttatattaatctcgatattaagcagtatgcccttctctctctctctttttttttttttttttttgagacagtgtctcactcttgttgcccagcctggagtgcaatggcgcaacctcggctcactgcaacttccgcctcccaggtacaagtgattctcctgccccagcctcccgagtagctgggattacaggcacctgccagcacacccggctaattttttgtatttttagtagagtcgggtttcaccatgttggtcaggctggtctcaaactcctgacctcaggtgatccaccccccgcttcagcctcccaaagtgctgggattacaggcgtgagccaccgcacccgggctttcttcgagtcttctatactattcttggatctttccatttccatgtaaaacttataatcccttagtctttatggtgacatattcctcaaccagatttctgggagcgtagcctaatgcgtaaacacactgcttacaaagagccaaaataaaaccaagaactacaaatttaaatagttttaatcagcataatgcatgagtgctgtatgatttattttgtgtatcacagtctcacagagattgtttttcaacaaccagatatctgtttctcatacctcaaagttgtcgtcattattaaagaagttacagaattccattcaaggaaagtactgtctttgtttagggacatatcttaattggagtgtattgtgttatgaagatgagaccctcttcatatcacctggatggtcatggatgagacaaacatataggtcaaataattgatatgatgacttgagaaattttgagagttttgagcaaattcagtgggcagaggggagctggggactgatgcctggcaatatggtgagagactggacttggagatgacggtataacttaggagtaaagagcctgaggtctagagccagattgcctggctcagccacttactagccatatgaatttggtaagttacttattctttgtatgctttattttcgttatttgtaaagtatggataatattgcctaccttgtagggcagtttgatgattaaattagttaatataggtaaaatgcttaggaatagtacctggcatgtgcaattaactagactacagaccttactcagatttggttaatggtatacttaattgccatatatagctagctattattatagctaataaaagttataatctgccccagagagaacaaccaccaaaaattatgttttttatatatatatatacatatatgtgtgtgtttgtgtatatacagacacatacacatatgtgttttttgaagaaatgttctaagtgtgatgaaaactataaacccacagatacaagaagttcaatgaatcctaagcacaagaaacatgaagatttcactaagacacaatatgaaactgcttaaaactaatgataaaggaaaaactattaaaatcagtcagaaaaatcacagacagtggagaaacaaagatgacagcacacttctctttgaaaaaaaaattcaagacagaagacaagtggggcagcatccttttttaaattctttaattttcaaatttaggaatagcatctttaaattactgagacaaagacactatcaacctagaatggtataccctgaaaaatacatatttcaaaaatgaaagcaaagtgaaggttttctcaaacatataaaaaatggaagactttatcaccagttgacttgtactacaagaaatgtctaagaaatttcttcaggcaaaagaaaaatgataccacatggaaattcacagaactatacacaaaatgtacccaaaaaaccccaaccacaacaaatgagtgcaggcaaaatctgacaaaatcaggctggccagggtgacatgcacctgtattcccagcatgctgagggtgctgagggtgctgagtttgagaggaccacctgagctcagaggttccggaacagcctggacagcaaagctgagaccccatctcttaaaaaaaaaaaaaaaatctggctgggtgcagtggcgtagtcccagcactttgagaggcctaggtgggcagatcatgaggtcaagagatcaagaccatcctggccaacatggtgaaaccccatctctactaaaaatacaaaaaattagctgggcatggtggtgggcgcctgtagtcccagctactggggaggctgaggcaggagaattgcttaaacccaggaggcggaggttgcagtgagctgagccccactgtactccagcctggtgacagagtgagactctgtccaaaaaaaaaaaaaaaaactggcaaaatctgaataaggtttgtagtctagttaattgtattctcccagtgtcattttcccatataactcactgtggttatgtaaaatgttacctttgggaaaactgggtgatgggtacatggttctatctgtactgttatggggttttcatatttattaataacagctatactgaaatgtaattcacataccaaaaaatacatccttttaagatgtacacctcagtgatactttagtatatttacagacttgtgtaactatcaccactaattttagagcatttttatcacccccccccaaaaaaaaatgtcccgtgcccattcacagtcactccccacacaacccagtcctaggcaatggcttgtctactttttatttccacagatttgcctattccagacatttcatatgattggaatcacacaatatgtagtcttttgtgtctgattttcttagcacaatactttcagtgagtgttctttcattttatggcatgtatcagtatttctttttttttcatggccaaatgttccctaatgggaatatatgacattttatttatccattcaccatttgagggacagtggggttctatttttgactgttatgaataacactgctatgaccattcatgtacaagttgatgtgtgttttcagttcttttgggtatatgcctaggagtagatctgctgagtcacatggtaactctatgtgtaacatcttgaggaactgccaaactattttcaaagtgtctgcacaattttacattgctaccattattgtatgaaggttccaataaatttcactatttcttattgcttgtcttttttgttttacccatcctagtggatataacttgatatctccttgtggttttgatttgcatttcccttaatgactaattatgtcaaacatcctttcatgtacttattgaccatttgtataccctctttggtgaaatgtctattccagtattttgcctatgttctaattcatttatttgcctttttatggttgagtagtaggagttctttatgtagtctgggttcaagtcccttgaacacatgattcacatatattttctcccatttagtgggttgtcttttcactctcttgatggtatcctttgaagcatgacacttcttaatattgatgaagtctgatttatctgtttttccttttgtcacttgtgcttttagtgtcatatctaagaaatcattgcctaaccaaaggtcacaaagtttactaccatgttttcttctaagagttttatagttttagcttatacatttaggtccacaatacatttttagttaattttgatatatgaggtagggcttcatcttcatacctttgtttgtggttatccagttgtcccaacaccgttgaagagattattttttcccattgaattgtcattgcatccttgttaaaaatcatttggccaaggcaggaatggtgactcatgcctgtaattttagcactttgggagggtgaagtgggaggattgcttaagcccaggagttcaagaccagcctgggcaacataatgaggcaccatctctacaaaaaaatttttaaaaaaattatccaggcatggcagtgcatacctgtagccctagctactcaggaggctgaggcaagaggattgcttgagcccaggaggtcgaggctgcagtgagccatggttgtaccactgcattccagcctgggcaacagagcgagaccctgtcctagaaaagaaaaaaaaagatcaattgaccataatgtaagagtattatttctggactctttatttcattggtctattctgatgccagtaccatactgccttgattaatgttgcgttgtaataaattttgaaaataggaaatgtgagtcttccaactctgttcttctttttaaaggttgttttttaattttgggccccttatatttccatataatttttatgatcagctggtcaatttctgcaaaaataagggaagaaggaaaggaagcgagtaagcaagcagctggaattttgataaggattgcattaaattggtagattgatttggggagtattgatatcataacaaaattgtcttccaaaccatgaacatggaaaaccataatgcaccctcccccctgcaaaaaaagaagatttgatacacacaatatggatgaaactcattctaaaatacacattgcctccaaagaccagacaatctttaaagtatgtcaaagaattttcttaaatttttttaaatcactttctctgttcttaaaaattaagaacccaataaccctgataatttagcactgatttctctctcttaagctaccactatttccattaaatcctcccttttagtgatcttcaaatggccctattgttaattgtaatgagggggaaaaaggctatctttattccactggccagacttttttctcctggtaaattttcattttgcaggcagagaggttttatcgtagcagttacttgcaagtgggaagtagaaatgaaacaaaaagggaagaaaaatggtagtatttaaggaagaatgcagaatcaacgtacactaagtaggaaaaaaatgaaaatgcgtgacctggtgacattttaagcatattttaaatgaaatggtttggaggggaggacctggctttgtgtttcaacatacagtatttgaatacactattatgttggtgcaaaagtaattgtggtttttgccattacctttaatggtgccataatggcaaaaacctcaattacttttgcaccaaactaataaattcctgcaagtgagaagctgttcatctggtcctacagagcaacttcaaaatatatttcagatattcccaccttttaaaaaaatatattatttatttttcagacaggatcttgctctgttgcccaggctggagtgcagtgacatgatcatggctaactgctacctcggcctcctgggttcaagcagttctcctgcctcagtctcctaagtagctgggaccacaggcgcgcgccaccacacccagccaatttttgtattttttgcagagacggggtttcaccacgttgcccaggctggtcttgaactcctgggctcaagtgatcaacctgcctcggcatcccaaagtgctgggatttcaagcatgagccaccgcgcctggccccacccttgtttgttttcagaagtaactatttttaatttattttaaaataggaaatgaaagtggaatagggaagaggttactgacagttaagtctgtaatctagaaaccagaaaggaagtgcctctactgtttctactttattccaccagaaatcctggcatactttcaggaagaggagacagaggcagccgttgataatctaagacttaagatggagggattcgcaattaggtccctgtctgttatttgagaagcccccactaattcatctactaggcctttcataatgtgtaaaattttactcaagatcaacaaataagaaaagttcaaaacaaatgtaattgccaaagatagttttttcgtatcataacctggtatcggatttctttcgttatagagtgcacgacagataatatattaatgtcatcctcaaatgatattttgagacgaggtaagtaaataggaaagaaaaagtagatttagcaaggtttaaaaaataccagtcaaaccagatgaaaaggacctggtgtggtagcagtatctaatatagccactcacagaagaattcttgaacttctttctgcattagtacttggaagtactgaaagtagtaatgtagaaagggttgcagttatctgtctcttaagaacctccattcgattaccttacttagtgtttacaacatgctttgttaagattattgagattaacatgctatgagcaatatgcctattattacaagttatctcttattcagacattctcaccatttgtaatatttctttccagtgaggaagacactgtgttgtgctcattgggagcatagattctggagtcagggagctcaagttctaatcctggctctgccatttactggttttattactttgagcaaataatttaatgtatctgtgcctctattttctcatctgtaaaatgagggtaataatttctaccttagaaagtggaatctaaagttatgaaggttaagctaatatatgtaaagtgtttacactagtgacttgtacatcataagcattatgtaagtatatgctaaataaatatatactcttattttccatatagattataaacttttcaaagtcaatgactatatctccgtgttgtataaattctcgtatctgttgttaaccatgtacataggaaacacttattatcagagtaactttgtaggagacagtgaaatagagccccagaatatctagaggtctggaatctacaatgagaaaaatttgcaaaagattagttagtttaacctttaggagggaggaaagtgttactcattaatttgaagagaccagttttgccttttcattttatcaaggaataagaagctttcaattgttcttgagaaaaaaataagttatctaaatgtttataacataaaaataaccctactgattctcttatttctgttctgtggcaaagaaatctatttatgttgcctctgggaggataataggagaggaaaaatagagccttgtttttctaccttgacatacattcagtgagagttttgtagagatttttcacagatggaacttgagttcagtactaatacacaaaaatacacatataccctatctctgacccccagcttgtgactttattagagaagttgatataaatgttaaatggaataataacaatgcagatcttaccttcttagcatttggagtggtttactgtgtaatactgaatatcctaaataataggatatgattgtgttttgtgatgctgttgttttggcatcaaaccgtatgacacttcagttaatgcttgtaatgctaatggatatatctgaccccataaaaagatttttgtaaagtcctttaaaatctgtgctactgtggattgttacaaggtgagattaaatgctctgaatttagaacaaagcctgaataaatatggacggtaagtcaacctaacataaacagatactcattttaggtaaaattttttttctgcctcacatttataatcattttgagttccctggctcatttttatttgattcgtgtaaattttttacttggaagcgaatttatattgggagtgagtagtccaagaaaaacctcataactttgtaatttttgagttaaaatgtgaaaactaaagaaatgaccaaagtgaatgtacaaatagttgcagaactagaccattttattttgaaagattcatgttcttcaatgccttcttgttacaggtgatgctgaacaggagcttggcccccctccatctgtagatgaggcagcaaacacactcatgactcgtctgggtttcctccttggagagaaagtcacagaagttcagccaggtgaccaatacagcatggaagtacaggatgaaaatcaggtaagctgtttgctatcacctttgtgaaacatggtgtgaatcagcttattatgccagaaataatcccaattgttgaatgccttttgaggcctagaatacaacttaactttccataatcactattatttcttcagtttatgaataatcttttagctttagtcttagatttaacaacccaaaaagccacttttaggttttgattgatttaatgaatgaacgagcaagccaacaaataaaattgacacgtatataagcactgcaccccaaatttgcagaatatacattcttttcaagtgcatgtggattatttaccgaattggttatatgctgagccatagagcaggtcttgacaaatttccaaagattccagttactgtgaccacagtggaatttatcaattacaaaatgataatttagaaagtgggatctaaaagattacttggatcattagttcagattttctacttttctgaaatacacatttaaaactaatatttctttttaagcacatctttagctatatcctacaagtttttttatacttagtttttattccaatttaaaatattttctcatttttttgtgatttcctcttggactcaaaggctacttagaagtgtattactcaatatctaaatatttggggattttctaagtatccgtctcagaaagttaaaaaaatctacaatttaaaaaatattttatagttttctttctttttgctattttcatttttttcagtttaaatgtagcaaaaaaaagtactagagtcagattcatttgtatgatcttaatcttcagcgtgaatgtctgatagtgaagcattttattcaggagatgacaaattaattttaaattgcatattttattaataaatattagtgaagagtctatatcacatactacttttgttacaatgagatatacaaggattatttgaatatatttatatattgtgtggataagttcagatgttccagggtgctgtcctcaagcctcactccttaggttattggttttgctagctgcacattatttaaatactatcttaactcccaaattatctctagccctgccttttcccctttacttgaaatttgtatatttagcttcccacattatattttctacctaatgtttaaaatgtatctcaaacttaacatgtcagatttctccctagaacctgtgccttctgcagtgtttcccatatgagtaaatggtatcacctacttgcttaggacaaaagcattggagccatttgacttccatcagacccacgttcactctttcagcaaatcgtagaccctgtcttcaaaatatgtactcaatctgatcccttctcactattcccactgctatacccaagtccaagccactgtcatcttttgcctgtgctactgcaataggtactagaatgtaaggctggaaggctgggatttttgcctattctacccgttgccgtatcctctgcccctagaacattactgtcattactaggtgcacagtaggtatttattatatgaataaatggtctcctaataggtctctgtgtccactcttgcccccctgtagtctgttcacacagtaaccagagtgatccttgtaaaatatgaatccagttctgtcactttgcttgtaatcttctactgtattcccatcatacttaaaataaaatctaaaatctttactgtggcccagaaggctacacctgatctagccacttgctacctctcctacatcacttcctacccctctccctttcacgcacggctctccagctacattggcctccttgtcgttcgccagtcacatcagctatattcatttttactggaatgttcttcccccataactcacttcctcacttattcagtgttctgcctaaatgttacctcctcagagaggtcttacttaattcctcttctaataattgcacctgcccatccatatacccctatgcttctactttattttttcatagctcttaccattaactgatattacattacatgtttagttgtggggttgttttaccttatgacaagaatgtgtgtttcatgatgtcagatctgatgattttttaaatcaatttacattgtaactatgtcaatatgctgtgctgctctgtgaataaaaaatgggaacaatattgttgagggattttttaaaattgggagcaataaaacatctatttcacctttcatttcttgatattcatgtcaagttaaaatgtgactgttatagtaatgaccaggtaacttgatgtcatatcttataacccgaatatttttcaaggactctgtcatttctacacagctacatttccttggatgataaaatttgtacttgttgttcttgagattccgcatgtcacagtgatttctgcataaagtcacaagtctatggagtgcaccttacttgtacattactgaataacataatcttaagtaaatgagtagtatcattgatttaattaaagcaatatggtgtaatagaaaagccattgaaccaggagggagaaaatttgtgttctagttccaactctgccacctaccattttgtaaatttggatgtgtcacttaacctctctgagctttatatttttcataggtaataataactgacatttattaaatacctactgtgtaccaattattgtactaattgttttacttgcactgttttgtttaagcttcttcacaacccagtgtagtagagttcattcatattccaattttcaaataagatatggaaacacactgccagaaagtgatggaatggtattcatatccaggcagtctgcttttataatctatgctcttaacagccacaccatactgttccagtgtaatgtgaaataataacacctgacagggttgttgaaaggatcaagttaaatcatgaatatgaaagtactttgtaagctgtaaaatgtcatataaataaaaagtataaaataatatgcagtatagttagtatataaatatatgcaggaactgtgtgatttgggggaaattacatcatagctttcgtactttcattggtttcattttcacatttcttaagtgggggaaataacatacattatgcctctcataccaggttgataaggagtaaatgagataatatataaaaatatttttaaattgttaagctttatacaaatttaaaatattaataatgaagctaaatgatagccttcttgcagtataatatacactggaactatcttggaaccacacaagaaagtggctaaattgatcatttgaatttctggtctcaggaagattatgaagaagtaggaggtcatgttaatttggtgacttttttctgagctaaacagtgtattaacaaagataaactgctatgcttaggcagatcatgtagtgatgatattctcaaaatagtaatgacagaatctaatgcaagtcagcgtacatcatttttctgcaaaaaaaacaaagcatgaaagtgatattcacctgacccctttattctttcagtagtttccaaggtattcaaatggaccttatgaatttcctctttagcttcttatgttgtgtatttgtaggacctttaagagatccagattgggagctttcttaggatccttctggagaacattaagggcaatgggaaaaacactgaaaggtttaggaagtgcagtggcttaaatagacgtccattttagcctacagcatgaagaataaatagttgtctttctctagctcattaactagtctccttaagtaaatatgaggcctgccttttaagtcataagccatgaacaattttctgttttctaaatggcttgatatttaagctttgcgtttacagttaaagcttttaagatacacattctctgatatgtgctttattttgcacaaaataacttagagtaaaaataagtaagtgctgtttgggcttaacctccacattgtctatattatgcatataatatgattttctttcacaaagaacagaatgagaatcttagaacagaaatgagttgttataaaagtaatagattcctatcataataaaacttttcttcttttttttttctttttttttgagacagagtctcactctgttgcccaggcggtagtgcagtggcacgatcttggctcactgcaacctctacctcctgggttcaatgattctcatgcctcagcctcctgagtagctgggagtagaggcatgcaccaccacacccagctaatttttgtatttttaatagagatggcattttgccatgttggccaggctggtctcaaactcctggcctcaagcaatccgcctgcctcaagcctcccaaagtgctgggattacagacataggccaccatgctgggcctaaaacttttgcaatatggaatgactatagctatatctaatgtaaaagacctgagtacagttcatctactcacatgtgtctcagactgggagtgggaggttaaaaatcgtttgccacatttctaacctgaaggattccaattccaattcaataagtctggagtgggggctcagtatctgtcaattttgtaagagagcttgcatgtttgttttttccatgtcacaagtgatattactgtgtgcctagttaggaataattgctctgtaagggaaaaaagattttaaggttaaaaaaaaaaaaatcattgctctggtagaccagcatcatattataaaaatagagattttaaaaaattgaaactctcctcttctctggagagataacatatagtagaagagaaatttggatacgtttgagagcttactgtgttgttaagaaaaattagattctaatattattgatatgattgaaaagatttacttggttggagggtaatgagaatgtcacttgtttttggttgagtcaaatttatcttttgtaacctggttatagtatttaaattaaaatcaaaacctagattcaacagagatgattaaacacaagggactgcatctaggaatcatcttaggatgagtcgaagagccttaatattctcatagctagttatcaacacattctccagttattaaattttagcagaaagagtatgaatagagactctatttgtaaagaagttgaaaggcttcttttaaatttaacatttaaagatgttaaatttatcattagtgcgtcttcaagtaattttgctgctgatcacttaataattttaaaaacgataaaatgttggccgggtgtagtggctcacacctgtaatcccagcactttgggaggctgaggtgggaagtacacattcaggagttcaagaccagcttggccaagacagtgaaaccccgtctctactaaaactataaaaattagccaggcgtgatatttggcggctgtaatcccagctactcggaaggctgaggcaggagaatcacttgaacctgggcagcagaggttgcagtgagttgagattgtgccattgcactccagcctgaacgacacagtgaaactccatctcaaaaaaaaaaaaaaggataaaatgtttttagtgtttgaaaaaatatacttttattcactattgtagtaatttatttgtgtagaaagagttgaagaaaagtgaattgtcattaaattaggtaaatcagaatatattaccaccaacctttttagtaattattcattccttcacatcaaaacttaaaaagtaaatagcttcaagtgtaagaatcattcaggatacaaagtgatctcaggctgtaatgctgttacagagaagttatttaggtttgtattaaactaatattaattctgttttattagacaaacttttagaataaggcatttttctctgcattcatgtattgtctctggacagctgcctatgtatcgaaaagacacttccttgcattaagaactttatttcttcccagctgtagagattttttttttcccttccatctaaagaaaattattggctgggtccagtggctcatgcctgtaatcccagcactttgggaggttgaggcgggtggatcacctgaggtcaggagttcgagaccaccctggccaacatggtgaaaccccatctctactaaaaatacaaaactagccaggtgtgatggcgcatgcctataatcccagctatttgggaggctgaggcaggagaatcgcttgaacctgggaggtggaggttacagtgagccaagattgtgccattgcactccagcctgggcaacaagaatgaaactctgtctcaaaaaaaaaaaaaaaaaaaaagaaagaaagaaagaaaattattaacaaggcaaagttccaggtcttccaaaaagttttattgattgcaaggaaaacttgcaatagcagggagaacttgtgcttaataaaaaatttctctattctattaatgaatggcagtgatagggtacttgtcactggaaattttgtaggcagaaaaactggcaacagtctctgttaatgttaagttcatcaagtttcacattaatttgtagaccccaaagtccttatccgagaaagcaaaaacaaatagagcctaatagatgtaaaagctatgcatgtagttttttttttcatcaaagcatttattttatcttaaaatatactttaacagctgatcaggttatcttacttattcatgattccaatttttcagacctcagcaatcacccagcggataagtccttgttccactctgactagcagcactgcctctccaccagccagtagcccctgctctacactcccacccatcagtacaaatgcaactgccaaggactgcagctatggggctgttactagtccaacctctacccttgaaagcagagatagtggcatcattggtgagttggtttttatattgataattttgtgtcctttttttcctttttaaaataattacacaagcttaaggtttttaaaaattctgcttttgaattgttgagatgtatatataaaactttcctggtctttttaatgatgctggagagagaaacctaagggtaaacaaaatgaaaggtattcctccctacttaaccactccttatcaggatattccctgataagaaggagtggatttaaaaaaaaaacttctgtccacttcttcctgtaaatgcacgtacatcaactatctaccaacagaagtagttcagaaaaagttcattccttactggtatagtcgagagttttatgaaagaaaggtgagattagattaagtggcgaaagagttatgatttgagttgttctgggtctatttgtgcaaaccatatattagttatttaattagttttgggagcccctttagactttgtttttcttcttgtcaataagacagccctgttttttaccttctgcaaagtagaaaaatggtatttctttgcttatgatttgaaaccttatacgaatacatttttatggcaagcttgggcataaagagaacttgaaacttagaagtattcaagcaaagaaattttccatttaattttcccctcgtgaattttcttataccttttttttttttttttaccaaagatcctagttgactacttagtcctagaaatatttctaaataatcttcaacccaattagcagtttgcagcagaaactaaaaccactctgataaaggcaatgctgattgggacattatgtaatttattatctccggtagactctaggtaaacatttcatcagagccagacgtggactgttggagggctcattcatgttcaggagataggccatcatcatttatatgtattgttatgattcaacacctcttgctatgaaaatcataggatatttctagctcaggaaatctttcatcatattcaaaattttgagtgatctttcttgagtaatatttcctattaatgcattttgacaactagaaaatattaaagtattgtgattactctttgggacactgttctaatgctcttcttatagttaggtatggagataagaagagtaggggaagaacatagttctggagcttctcagtttttatggctatcaagttgtataatgattcagacattgaacattattctataccattgtcatttacaaaatgctaaaaaaattgcatttcctttaataatggagttaccaatagactccttttgacaaataagtctgtgtacattttctagtcagaaataagaatttaagaatagtataaaactatatatttatactctgtgagaagataaaatggaaattgggcttctgtccaaaacataaatggcatttctgggtattccttttctacctaacaaccagatgatgacagtgtcatagcctccagcagctttatgtagaataaagaagaggaaagaacataggtggtaataagaataattttaattaaaagttatttatggctaggtttctcttcagactcccaaaattatagtatatgccaaccccaattaagtatttaggagcagagcataaatggggaatgaatgtgttccatcatctatgatattgcacatgtgaatgtatgggcttatatttatacataggtagacaaaagtgattatgttttttcctctatcgctctgggccccaggtgcagagagctgaattaataatactcctcagtatatacagattggtctgtacaaagctcctctcagtttattacttttccctttatcctcaatcccatttcattgcagccatactattatatttatataagtccttgaatattaatgtgtccttgaatattatatgttgttttttgtgtgtgtttgtgattttaatttataaagtggcatgttaatacagatcttatattctgctttttaaaatctatatgaacaccaaatttcttgcttctgatgatgtaaatattcttcacattttacctgcgaacacttaggttgcttccaactcctctaccatttgtacaaaccttttctggagtttatacctaggactggaattaccgagtcatggggcatatgattatttaacttcatgaaatactcccagattattatccagaatagttacagtaattcacattctcatcagcagtatataaagcttcttttcccttttctcgttctttgttgacactagctagcccagttctaaaatctgaaaactcttaaaaccgtaagttttttaaaatataaatttacatcaaattcatttggctgtaaaatcttacctgagctaagatgaggctacttacagtctttatcctactaaatatgaatatctatacattttattgtagaaatgttaatatactcggttacaggatactattccctgtgccatatacagtatctgtgcctttttacttttttaaaatatgagacattctgtattttgaaacacatcttcagagtttcatatatgcgattatagacctgtgtcatctgactttctgattttagtaaatctgatggttataaaattgtctcattttaatatgcatttctttgattagtgtagaggttctgcagctcttcatatgctcactgcctattgtatacttgttaagggagtcattcaaatggaaataggtgaagttttgggaaaagaataatctaaagaaggcaaatccaaagagaagaaaacagaggactgagcacaaaatcttagagcacattcaaagagcagggaattggaagtgggagaagaatgagccagtggacaccaaaaaaaaagtagtcagataaataggagaaaacttagggcagtgcaatgccaccaaagccaagggagacacatgttccaaggaaggtgtgtggaaaggttgcttaacaaatgacgaaagttgagaagacaaaggaaaatgaggatgattaaagaataaaagtaaatatttttcccacatttggcttccttctgtagatataaaaaatacatatttatttgtttagaagttgtggcaaatgttaatgccgtgactgcaaagtgtatccctaacttacataaatgcacatcggtgtgtggattcattcattttaaataaatactgagtaaataaaaatatttttacagcaaagttgcaggatacaaaatcaacaccaaaacaagttgtatttgtatatcctaaagatgaaaaatccaaaaagaaaaataaggaaacagtttcattacagtggcatcacaaagaataaaataggaataaatttaaccaaggaggcaaaaaaaaaaaaattctacattgaaaactgcaaaacattgcagaagaaattttaagacttaaatggaaagatatactgtcttcatggattggaagacttgctattgttaagataacaatatttatcaaagccatctacagattcaaatcaatctctatcacaatcccaacagtagtctttgcagaaatagaaacatccagctgggaatagtggcgtgaacttgtagtcccagctccttgggaggctgaggcaggaggatcatttgagccaggagttcaagtccagcctggaaaacctagcgacactctgtttctaaaaaaaaaagaaagaaagaaagactcatcctaaagaagaaagaaagaaagactcatcctaaaagtcatatggaatcttaaaggactctaaatagccaaaacagtcttgaaaaagagcaaaattggacgactcacatttcctgatttcaaaacttattacaaagctacagtaatcaaagcagtataaagagaccagaaatagggggccaggtgcagtggctcatgcctgtaatcccagcactttgagaagccaaggcagacggatcagttgaggtcaggagtttgagaccagcctggccaacatggtgaaaccccatctccactagaaatacaaaaagtagccaggcgtggtagcaggagcctgtaattccagctactggggaggctgaggcaggagaatcacttgaacctgggaggcagaggttgcagtgagctgagatcaagccactgcactctagcctgggcaactgagcaagaccctgtctcaaaaataaataaataaatgaaaataaagagaccagaaataaactcttgcatatatggtcaaatggtttttgacaagcgtcctaagaccatgtggcatggacagtcttttcaacaattagcgttaggaaaattgaatattgacatgcaaaagaatgaagttggtcatttaccatctaccatatacaaaaattaaaatggattaaagacctaaacatagtagttaaaaactgtaaaactgctcaaaatttaaccaaggaggcaaaaaaaaaaaaaaaaaaaaaaaaaaaacctcatacaccgaaaactacaaaacattgcagaagacatttttaagacttaaatagaaagacatcctgtattcatggattggatataggagaggaacagagaacataggaggaaatctttggacattgcatttggtattgattccttggatatgaaccaaaagcacaggcaacagaagaaaataatacattggacttgacataaatttaaaacttttgtgcatcaaatgatactatcaagagagcaaaaaggccgggcactgtggctcacacctgtaactttgggacaggttacacaactttgggaagctgaggcaggtggatcacctgagctcaggagttcaagaccagcctggccaacatagcgagacccccatctctactaaagatataaaaattaggcatggtggcacaagcctgtaatcccacctactcaggaggcaggagaatcacttgaagccgggaagcagaggtggcagtgagctgagatcacaccactgcactccaacctgagtgacagagcaagacttcatctcaaaaagaaaaaaaagcaaaaagacaacccacagatattggaaataatgtatctgataagggattaatatccaaaatatataaagaacccctacaactcaacaacaacaaaccatttcaaaaatgggaaaaagacttacatagacgtttctccagagaagatatacaaatggccaatagacacatgaaaagatattcaacattactagtcattagggaaacgcaaaccaaaaccacaataaaacactactttatacccattaggatgacaattataaaaagaaagtggaacataacaagtgttggcaaggacgtggagaaattggaactctcatacattgctgctgggaatgtaaatgatgcagctgctgtggaaaagagtatggcagttctccaaaaagttcaacatagaattgccatatgatccggcaatttctcttctaagtatatacctgaaagtattgaaaggaaggatttggacagatacttgtatgctgatgttcatagtggcattttcacaacggccaaaaagtggaaataatacaaatgaatatggacagatgactggacaaacaaaatatgatatatacatgcaatgaaatattattcaccttaaaaagaaatgaaattctgatgtatgctacaacatggatgaactttgaaaatgttatgctgagttaagccagacacaaaaggattgtatgatatatatggttccactcatataaatggaataccagagtagctaaatcatagagacaaaaagtagaatagagagtactgagtggggctgcagcggcgtggggagttggtgggatgtggaaataggaagttattgtttaatggatacagaatttcagttggggatgatgaaaagttctagagatggataatgttgatgtttgtacaacattgtgaatatacttagtgcccctgaattatacacttaaaaatggctaaaataattttatgtcgtgtatattttaccacagtaaaacatttttaaaagaatatttattaatatgtatatggtatagacaataagaatatagcaaatacctgactacctctcttaccctataacaaaaatgacctgtcttatatgctaaagccttcttctgtatctcttcccatttctctattcataccctaccctgagaggtcatctgaattttgtgattatcattccagtactttctttcatgattttgccacatttgtatccctaaataatttattatttagatctcatgttttcaatttcatatacctgaaagcatatttatgcaaatttctttttttttccttttttttttttttttttttttgagacagagtctcgcactttcgcccaggctggagtgcggttgcgcagtctcggctcactgcaagctccacctcccgggttcatgccattctcctgcctcagcctcccgagtagctgggactacaggcacccgccaccacgcttggctaattttttgtatttttagtagagatggggtttcactgtgttagccaggatagtcttgatctcctgacctcgtgatccgcccgcctcagcctcccaaagtgctgggattacaggcatgagccaccacgctcagccacaaatttcttttgtgcttactgttatgtacctcagatacattcatgttgttgcattttagtctgcttgtttttattgccatatcatattctactgtatgaatatagcacatttgtttattcattctgttgatgaaaagttgagttgtttccagatttttgctcttgcaaatagtgctgctgtgattattcttgggcttgtgtcgttagtcatatgtatgattcggaatgttagaagtgaaattgtcagattattagaaatgtgtctctttcaactttataaaataatttcatcttttatgaaactataccagtttatactgccactagcaatatactataaaatgttccatttgctatagatctttcccatgtttgatattgtcaggcttcattttgccaatctggatgatatgaaagttatctaattgtgatattaatttgtgttttcttgattactgatgaggttaaacaatcttttcacatgtttattagccaattaggtttcctcttttgtgaaatacctgttcaagtttttgctcatttcctaatgtgatttttcttttccttacagatttgaaggaaatctttattttttaataggaagccttaattttaatgtagtcaagtttttttgttttttcctttgtattttatatttttgtgaaactttgctttgtcatttaagtccttaaaatcacctagaattggtacaagagtacaaatttatgtttttctatacaaataactagttccattaccatgttcgcatgcagtgtattgctgccaaaagcataaatgtctaggtctttttctgagcttttattctaggtctttttctgagcttttattcaatccattggtaaatcagtctctccttataacaatattgtactgtcttaattacaaccgctataagtcttgatacttggtaaacaaagtcccctaacttgatcatcatcttgaggattctcggctattctgtaccctttcttctcccaaataaacttaagaatcaatttgccaaattcatgaagaaccccttttgagatttttattagaattgcattgaaaccatagatcaatgagtgatgaatttacaactgtttccaatattaaatcttctaatccaggaatatattttttatctctttcatttagagcttctttagtatctttcaataaaatgttctaatttttcaatagggtctggtatatcctttcaaagatcttttttcctagatgctttatatttttatgcgtttgtcagtgttatgtctttttcattatacttcttacctattgcatagaaatatgtagagatttgtgtattgtattcagcactgcagcaaagtctcttattaaataatttatagtttttttgtggttttctacatatacaaccatattgtttgcaaataatgactttttatgttttccttacctatccttatatcatgtattatttattgattgattgatttcttcctaattttttttttcaatttttttgagacagagtctctctgtttcccaggctggagtgcagtgttgcaatcttagctcactgcaacctccacctcaaactcctgctgaagtgatcctccctcttcagtctcccaagcatctgggactacaggcgcatgccaccacacccagctaatttttgtatttttttttgtagagacaggattttaacatattgccgaggctggtcttgaactcctgggctcaagcagtccgcccgcctcagcctccaaaagtgctgggattacaggcatgagccactgcacccggccacactttttttttttccttgttgtaccagctaattctctggcacattgaattatagtgatggaagcagtcatctttatcttgtaactgatttttaaaggaatcctttttgtttgtttgtttgttttgtttgtttgttttgagatggagtctcacagtgtagcctgggctggagtgcagtggtgcaatctcagtttgctgcaacctccacctcccgagttcaagtgattctcctgcctcagcctcccgagtggctgggattacaggcacgcaccaccatgcctgtctaattttttgtttttttagtagagacagggtttccctatgttggccaggctggtctcgaactcctgacctcgtgatccacctgccttggcctcccaaagtgctgggattacaggcgtgagccactgctctcgggctaaaggaatgctttcagtatttcgctattaagtattatgttcctgtagatgtttgtagacatcattatcaggtttttaaaatgtttatttccagtttgttatgtatttttaaccataaacgaatattaatttttttcaaatacttttacaaatatcttttgaggtgatgaaatagtttttctcctttattctctcaatggtgtaaactacattaatttttcaaatgttaacctgattttgcattcctagaaccacgtgtagttatgatacatttttaaataaatcaacttattttctaacactttgtttaggatttttgaatctatatccatgagtgagatgtgcttgaaattctcctctctggttctgcaattgtcaggttttgctatcaaggattatgttagccttataaaataggttgagctcatccaaatataaatactccccaaggctgactctcagcctttctattgtcatctttctcagtctgctttccctgctgggatgactctctctgttccttgactcctatttcgtatttcgagctctgatttttggttccacaatttctctgtttattacattcttttcatcatggacacatgtccaggaataatcacacaaaccaaatcttactttcttcatgaagcagactctgattatccctcccttctctggatttccgcactatctacctccctcctctacacttatgagactcattgccaataaccagtatagttacttatagttatatatttattttctttatgtaagcttcttaatgtcaagatttatgtctcctactttttatttactctcgggatttagcataatatctaaattgtggtttatgtaagaagtctttatagggatataattattaaataactaaacattttgagtaaataacatagagcaacacaatgtgataaagagtaacctttttttctatcctctgaaatagtttgtggaagattggaattatctgtttcttgaatatttagtcagatttgctcttaaaataatcagggcactgtcttcatgcaataaatgcacatttcaattttaactactgtttctatgtattatgtttaatactatagaacattttaggttttctttttctttttgaatcagtttccttgtagtttttaatctttttaaaattttttagcataaaattatccaaaatatccttttataatggcatccctacctacccaggaacctaagacagatacctgagaggagcccttgcctcctccctctctttatatttctcatccctgtattttattttcatccttcatagcattgcttcaatggtcctcattatctcagacttagattaatacagatctttttgtctacttttcatcttgttctttctgttgtttttcactcagcaaccaaagtaaattaattgaaaatcaattactcatttgactcccggttacctaaaagataaagtgaacttcttgaaaacaaagtctgaccatatcactcttttggctctcatttgcctgtaagacttataggtaaatgaatttacattttgtagatcgataggcttcctttgacctaggccctcatgatctggtgatggccagtttccccagccttctctcccacttctttttgccttggatttattgttctagcggcaatagtttttttttcatttctgtgattttgttcataatgatcattcttactatgatatcctctctcctcccaacattagaggagataatagattatctcctctaatcttttatcgtaaatccagctgagaagtgttctgtcaccaccactactactcctcccacctttcctcagctctgcacttccaactgctattcaggacatattattactccactttcccagtaatacctgtgcctatctgtattattaaatttaacacatggtattatgcatagtttttgagtctacttttcccccattgactgttaatttcttgttagcagaaactgccatgttcattttttatctgtagcatttagtccagtgactggcacatggtagcatagtagatgctcaataaatgtataaaaagaaggaaagcttaatgatgggggaggagggaatgaaaggctcacctggcattttgttgtagttgttttgttttcttttattatactttaagttctagggtacatgtgcacaacatgcaggtctgttacataggtatacatgtgccgtgttggtttgctgcacccattaactcgtcatctacgttaggtatttctcctaatgctatccctcctccagccccccaccccacaacaggccccggtgtgtgatgttccccaccctgtgtccaagtgttctcattgttcagttcccacctatgagtgagaacatgcagtgtttggttttctgtccttgtgatagtttgctgagaacacctggcattttttaaattcattttttggcagtgcttagagtgactgttgggtacaagatgaaactttattggattttgaatgagattagaattctccattgactaactttgttctcttaagttctctatgattaattttggtaaaacgactttcataattcctgctgagcttcttcctgtgttcttttgatattattagattatctataattggatatcatctatattgccatacataaaaatagctatagaaatatgttcattcaagcagaaggaatggtgcttgaagaaatacctaggtggaaagacaagtgagccatgtaatgacagatatgtttggtttgtgcaaataatacaacaaaaatgcaaaataacatcagtgcttacattaggaaaatggaatgtcctcctgttctttgcttttattctgtttatttattattttatagaaacagggtctcactatattgcccaggctggtctttgaactcctggcctcaaacgatactcccacttcagcctctcaaagtgctgggattataggcatgagccaccgtgcccgaccctctttgcttttaaaagcccttcttactatgaaatgtagcacttaaataaggtccatagaccaaatgaataattgtgtctttgtgccacaaattaactcaaaactttctaccacctatcaggactactttcatcatttttattgatagatctcatgttttcaacaaatctgtcagcattactctattcattattcaatagttgctcatttttaatttatgagacatatatctgctaacacttatgttcaaaataaggtaactaatattgtcacccttgatataattctagctaagtttacagaggcttgatgttgtagttaactagtcaccaataaatatgtgattatttataaagtctatgaaatattgaaaatagtgaaacccattactaccctctcagacctttacaagtgtaatgtttcagtgtttggagcctaccgtatgtgctcatggtctgtcagagaaaagggctatgtttctggcatatataccagggttagaatacacagagacaagtacatcttagccaactgtgacatggtacctaaagacagaagcatctgctaggacacacaaagaaaacaccacaaaaggcaaggaattaaataacagacactttacacttagacaagtcctctgggaagcaggagcttgcattctctagctttcggtgtacaacccgtgtagccatgtaactccaagcttccaactaagaattacagagccagctgaccaaatgaaattatatttcagtcagattttagtgaatgaaaaagacttaagtatattttaataagacaacttccagaaatcaggataagtatacatttatttaaacaatacagacacataatataaatatatacaactatatactatcaatgaatacatttagaaataattataaaacatgctgtggaattcatacaaatctcattggggaaggtgcaacattgtatttggtggcaaaaagtttaagaaccattgggctattactgaaagactgaatatgtgaaatgaagttttcattaaaatgaatagttttggcaacatgctgaaataatatgataacttaataatgacttgaacatttaaattagctttaagaatatctagcccctggttcccaacattttcagcaccaggactgccttagcatatatttcttagaaaacagagcctgagacaaaagtttatatgttaagacctttttaacagagtacaagccagggaagcaagcgtgaaggaaagggggagtgagacaggaaaggaaagagaaaaaatgtaagggaagatactacagagctggcagaggtgagagaccacatgtctctgaaccatggaaaggagactccaaagaggatttttctgctaactcccttcctgtattggtcacagcctggtgagtattatctcccttattctccctattgcacaaaaccagtagccctactatatcttatgtctcagtgacaatagagaagtccagggacagaggagacagactgtatagcatgcacatgaggtaaggtattgattgacttgtgcccaggatcaacacaaatgactcggagcagcccttgtagccaatccctcagtctgaagccagaggcattagtaacacagacctaactccaacccatgagaattgttcaaatcgttgtgaaggccactttggccaaacaactggcaggtgactatatctaggattctgctttagtccattcaaatggctataacaaattattttagcttgggtaatttacaagcaattgacatttattactcacagttctggaggctgggaagtccaagatcaaggcaccagcagatttgatatctggtgagggctcatcccttgtagctgaagcctttgctgtggcttcacatggctgaagaggcagacatgcttcctcaggcctgttttatacaggtactaatcccatttgtgaggacctaatcaacccccaaaggccagaacctttaatactatcacattggagattgtaagtttcaacacatgaatttgctgggggacacaaacattcagagaatagcagatgccaaacccagtacagtccaacccttgtaccacattgatccagtagtatcctctgagtatctggtctcaccctgggaagatgatgcaatgatgctctcaattctttcctgagagggtaggttctaaatccagtccttcaagttggtagtcagttgtaacctcccaaaaagccttagaaagggttagtaaacaaagatttaggtccttgctgctccatgtagtcctagagaccataatgcatgctcattatttccctctacccatttcagaacaaaaaatgtcaaaatagatttaagaacaggaatgatctacaattgaaagtcgtttcataatgatgaatggatcagtttatcaagaggaaataacctaaatgtttatgcaactaacagaacttcaaaatgagagaaatccataatcagatttcagcattcatctctcagtagctgatagaacaagtagagaaccaattaacatatagaggatctaaaccattccatcaaccaacttgacctaatcgtcttttattgaacaatgtgataataaaaaatatgtctatttggtctttgtccctggttcctgacacagggttcctaaatacctttgaattttccgagtcataggagcatcttggcaggcccctagatagcttcaggatagggaatggtcaccagaaagaccagggaatgactacggttacacttttagccccactccagacttcagggaggggagagaggctagagattgagttaatcaacagtgaccaattatttaatcatgcctaagtagtgaaacctccattttaaaaacaccctaaatgatggggtacagagagcctctggattaatgaacacaccaaggtactggaaaaggcatgccaggaaaagggatggaggtgccacacttttattttattttattttgttttgttttgttttgttttatttttattttattattattttttttttctgagacggagtctcactctgttgcccaggctggagttcagtggtgtggtatcagctcactgcaagctccacctcctgggttcacgccattctcctgcctcagcctcccgagtagctgggactacaggcgtccgccaccacgcccagctaattttttgtattttgttagtagagatggggtttcaccgtgttagccaggatggtctcaatctcctgacctcatgatctgcctgccttggcctcccaaagtgctgggattatgggcatgagccaccgctcctggcctattttattttattttgagacacggtcttgctctgttgcccaagctggagtgcaatggtgcgatctcggctcactgcagcctccacctgctgggtttaagtgattctcatgcctcagcctctggagtagctgggatcacaggcacgtgccataacacccagctaatttttgtatttttagtagagacggggtttcaccatgttggccaggctggtctggaactcctgacctcaagtgatccacccatctcggcctcccaaagtgctgggattacaggcctgagccaccatgcccggccagctccacacactttcatacctgccctctgcccctcttccatttggttattcctgagttgtaccctttataataaaacagtaatagtaagtaaagtgcattcctgagtcctgtgaaccattccagcaaattattgaactcgaggaggttgtgtgaatccccactctatagccaattggtcagaaatacagatgacaacctgggacttgcagctggcatgcaaagtgaggacagccttgtggaagtaagcccttaacctgtggagtctgtgctaactctgggtagttagtgttagaattcatatgaatcgtagggcaccagttggtgtccagataattggcaaattgattgttgggtggcagcaaaaactcacacatatggtatcagaagtgttgtgagtaaaaatatttcagtggtccacccaaaaacagcagagtacagattcctttttagaaggttcaccaagacataccatattctggtctgtaagacaagtctcaataaacttaagtggactcaaactaaacaatgttctctgaccacagcatgattaaactagaaatcagtaatagaaaaatatcaggaaatttcacaaatctttggaaattaaataacacatttctaaataatgctccagtcaaaagaaggtggaaatttaacaatattttaaattaaatatcagtgaaaacaaaacatatcaaaatttgtggaatatacctaaagaagagcttaggaggaaatttatagcattaagagctttttttagaaagcaagtttttaaatcaatgaactgaatttccagttaaactagaaaaataagaagttcaaccgaatgtaagcagaaggtaggaaatcatacagagcagagatcagttaaatagaaaacagtggagaaaaacaatgaattaaaagctggtgctttgagaaaatcagtaaaatcaataaacctctacctgtactgactaggacaaaaaaagaagatacaaattaccgctattaagggtgaggtagggacattattacaggccccactgacattaaaagaatactaaaggaatgtcacaaacaattttattttttaaatttatttttctttttctctacactgggaagaaacttaaatgaacaattttaatgtcagtaaatttgacaatttagattaaatggacaagttcattgaaataaataaactatcagagcttacttgataagaaagaacctgaatagctgtattgaatttgttgtttaaaactttgccataaggaaaacttttggtccagattcattgacaggtaaattcaaccaaacatttaaagaagagtgataccatttctacacagactcctccaggaagttaaagaggaacaactaggaggccaatattgttaccctaagaacaaaccagacaaagacatgacatgaacaggagagtacagaccaattatctctcatgaatgcagagttcttaacaaaattctaacaaactgaatctaataatatataaaaaggataatgtctcattactaatgggttttataccaggaattgaggttgtttctacattcacgaatcaatcagtgtagttaatcattaataacagactaaaaaagaaaaactgtatgatcatctgataaatacaaaaaaaaaacagcattggttaggcacggtggctcacgccgtaataccagcactttgggaggtcgaggtaggaggatcacttgaggccagaagttcgagagttgcctgggcaacatagtgagatcctgtctctacaaaagtttttagaaattagccaggtgtgatggtacacacttgtagtcttagttacccaggaggcttgatcccaggagttcgaggctgcagtgagctgtgatcatgccactgcactccagcctgggtaacacagcaagaccccatagagaggagggaaaaaaaaaatcgacaaaaagttaaaagtaggaatggatgaaaaatttttaaatttgataaagggtaactgaaaaacctacatctaattcatacttaatggtaaaaacctggatgctttcccttgaaaatcatgaacaagacagatttctacacctatcacttttattcaatattatgttggcagtctcaatcagtgaaataagatgaataaagtaagtaaataaaaggcatctagattagaaaggaaaaagtagaactgtcactatttccagacatgatactctgtgtataaagtttaagaaatctaccaaaaataactattagaaactagtgagttagctggacacggtggctcacccctgtaatcccagtactttgggaggctgaggcaggtggatagcctgaagtcaggagttcgagaccagcctggccaacatggcgaaacctcctttctactaaaaatgcaaaaattagctgggtatggtggtagacacctgtaatgctagctaagggaggctgagacaggagaatcgctagaacccaggagacagaggtttcagtgagctgagatcacgccacttcactgcagcctgggcaacaagagcgagactccatctcaaaaaagaaaaaaaaatagtaagtttagcaaagtctcaaggtgtaggatcaatatgcaaaaaagtattgtatttctctgtaccagcaacaaaaaaaatggaaattgaaataaaagggtcatttacaaagcactaaattgtggaataattagagataaattaaaaaatacatgacctgcacagtgaaaagtgcaaaacatgctgagcaaaattaacaaagatatgtgggaaaatataccatgttcaaagatcacagtactccatactgttaagatgtcaattctttctaaattgatctattccaggggttggtaaaccatggcaggcaggccaaatctggctacccacgtgtttgtctcctgaaagctaagaatgatttctatatttttaaatggtcacattttaaattattatataaataataatatgtaacaaattattgtaacatccagatatgtaacatttgtaacatccagatatgtaacaatctggatgttgcctactggcccacaaagcccaaaacatttactatatagctccctaagaaaaagtttttcaattcctcgtctatacattcagtgcaatcccaaacaaaatccctccacctcccaggttcaaacagttctcctgtctcagcctcccgagtagctgggactacaggcacatgccaccatgcccggctaattttttgtatttttagtagagacggggtttccccatattggtcggttgttcttgaactcctgaccttaggtgatccacccacctcagcctcccaaagtgctgggattacaggcatgagccatcacacccagcccaccatggtttttagtataaattaacaagctagcactgtatacctatgtaacaaacctgcatgttctgcacatatatccatttttttagaagaaataaaagcaaaaattaaaaaaaaagaaattaacgacctgatattatcatttgtatggagttagattagccagaacaaattttgaaaaagaacaaagttggaggatttatactacctgatttgaggtttactataaaactgcagaattcaaaacagtgtgttactgctgtaaaggtggacaatggaaccacataaagagtccaaaaataggctgagcacagtggctcacacctgtagtcccaacactgtgggaggtcgaggtgggtggatcaccggaggtcaggcattcgagaccagcctggccaacatggtgaaacctctcctctactaaaaatacaaaaattagtggggcatggtgtcacgtgcctgtaatcccagctactcaggaggctgaggcaggagaatcgcttgaacccaggaggcagaggttgcagggagccaagatcgtgccattgcactccaacctgggtgacagagcaagactccgtctcataaaaaaaaaaaaagtccaaaaatagacccacacatacactagcaactcatttttgacaaaggaatcaaggcattttagtgagaaaaggctatttttttcagcaaatattaatattacagaataggctgggcacggtggctcatgtctgtaatctcagcactttgggaggctgaggtgggcagatcacttgaggtcaggagttcgagaccagcctggccagcatggtgaaaccccgtctctactaaaaatacaaaaaaattagccaggtgtggtagcgcgtgtctctagtcccagctacctgggaggctgtggcaggcgaattgcttcaacccgtgaggcggaggttgcagtgagctgagatcgcgccactgcactccagcctgggcaacagagcaagaatcagtctcaaaaaaaaaaaaaaaaatatatatatatatatatgtatatatatatgtgtatatacgtgtatgtgtatatatacatgtatgtgtatatatgtatatatacgtgtatatgtatatatacgtgtatatgtatatatgtgtgtatatacgtatatacgtatatatgtacgtatacatcagaatatttgcatatccatacacaaaagaaaaaacagtttgtctttaccctaccccacatacaaaaattcaacgtggatcatagacttaaacctaagagctaaaattataaaactgcaagaagaaataatagatttaacataagcctaagtaaccttgtgttaggcaaaaatttttaaaattgaacacaatcattaaccctaaaagaaaaataactgatgtttgactgccaaaatttaaaatatttactcctcaaaagttattaagaaaatgaaaaaggcctggcacggtggctcaagcctgtaatcttggcactttgggaggccgaggcaggcaggaggtcaggagttcaagaccagcctggccaacatggcaaaaccctgtctctactaaaaaaaataaaaaaattagccaggcgtggtggtggtggtggtgtgtgcctgtaatcccagctacttgggaggctgagactggagaattgcttgaacctgggaggcagaggttgcagtgagccaagatcatgccactgcactctagcctgggcaacagagtgagactccatctcaaaaaaaaaaaaaaaaaagaaagaaaatgaaaagggaaattatagatgaagagaaaatttttcaaacacttatctcataaaagagttctattcagaataagtgaagaatcctcacagcttaatataaaggcatacaacttgaatttcaataaaatgagcaagcgatttgaacagatacttcacagatgaaagcatatgaataacaagagatagatgttcaatatcaataatcattaggaaaatgtaaattaaaaccataattggatatcactgtatacctagtacaatgtctaaaactcaataccaaagattggcaaaaatgtgggagcagttggaattttcagacactgctggtgtgagtgtaaaatggtacagccactttgaaaactccttaggcattcttttataaagttcaacaaaaatctgccatttgacctagccatgctattcctaggtatgtacaagagagcaagaaaatcatatgtctacgcaaagaccagtagttgaatattcagagcagctttattcatgatggctgaggtcttagtccatttgggctgataaaacaaaattccataaactggatagcttataaacaatagaaatatatttctcacagttctgaagaatgggaagtcctggatcaaggcagattcagtgtctggtgaaggccaacttcctgtttcgtagacagcatcatcctcacatgatggaaagggtgaggaagcttttttggtacacttatattggtggatcaaccccactcaggaccaaatcacttcccaaaggccctacctcctaataccatcaccttgggggttagaatttcaatgtatgagttttaggagacacaagcatacagaccatagcagctgaaaacttgaaacaactcagatgccatcaaactagcaaatgtataaatactgtgatatatcaatttttaaaaaatggaatgaactactaatacaacatcatggataaatgttaaaagcattttgctacataaaacaagcttgaaacaaaagactgcatactgtatgattctatttgtgtgaaattctacaaaaggcaaaactataatgatagcaaatcagcagttgccaaggtgtagagtggtgggtaaaggtgtaggattgaccgcaaaatgttaggaggcaactgtatgggatgatggaaagttgattacagcataactggatacatttgtcaaaactgcatttttttacttaaagtatgaatcttattgtatgtaaattataccttaataaaactgattaaacacacacacacacacacacacacacacatacacactagcatgacacagctattttactcctaggcataggcccaaatgaattgaaaacaggtagtcaaacagatactacatgaatgttcccagcagcagtattcacagtagccaaaaggtggcaacaatccaaatgcccacccacagatgaatggataaacacatgtggcatatacacaatggaaacttactcagtgatgaaaaggtatgacacactgatacatgctactgcaacattggcgaatctcagaaacatgctaagtgaaagaagccagacacaaaaggccaaatattatgtattcccttcttagtagatatttagaatatgtaaatttatagagacaaaatgcagactagtggttgatttgagggggtgggcatgatagtaactgcttaatgggtatgaagttttcttttggagctgaatagaggtgatggttgcacaacattgggaatgtactagatgccattgaatttgttcactttgatgcaggtgcaccccaaaattagagcttagcccaagaaggttcttggcttctctcaagaaagagttcaagagtgagccgacagtgaaagaaagcaggtttattagagcaatagtatatagcaaaatggttgctccatagagagagcagggctatcccataggcagaggagcccagaggagcagagtacagcaaagtggctgctccacaggcagagcagcccggaggagcacagcagcagtgtatggcaacagtagcagtccgaagcaggagcaacagcagacacagctgcagtgtacattgctggttagctatatctgtacccactcttaattattttatatatagtgtatatatatatatatatttaagggacagagtgttaagacttttctagaaaaggggcaaggagttcctgaaaccatagaaggtaactttcaggtcattgccctagtgcgttgccatggcatttgtaaactgtcatggcggcagtggagtgtctttaataacgagcagtgagggcaagcagaggtcatcttcgtcaccctcttctgatttgggccattttctttactgcatcctgtgtttaatcatcaggttcattacaggtgggtgctgatctcctacctcaactttaaagtgggtagctttatgttatgtgtattttacctcaagcacacatacatagttaacctaacacatagccacaattttctttgggtgagaatcagaggaatattttactacagtggcattgcaaagcccttgcccaaagagctccaacttccttttcaatcctagaccagtgaattctggtctgtgaactaatttagatctgaaacctaagggactgccattttccactatgcctgatgttagcctctttttaaaaaataaagtaagcagcatcctaatctgttcaaccatcttgccactagaaacattgtcatctgttaaccatcaccactgatgcttttagtcaaagcaccctggttgctctcccagacttgctgatttttttttttttttttttgagacggggtctccctgtgtcgcccaggctggggtgcagtggtgtgatcttggctcactgcagcctccgcctcccagattcaagcagttcttccacctccgtctcccaagtagctggaattacaggggcgcaccaccacgcccagctaatttttgcatttttaggagagacgaggtttcaccgtgttggccacggtggtctcaaactcctgacttcaggtgatccacccaaagtgctgggattacaggcgtgagccaccacacccgtcccagccttgctgatctttacaataatatatcctccttgcatctgagaaatacgtgctgccaactggcctctgtatcctcactgatattagagaccccagttctatgataacatctccctattaactgcacttagagaggatggtcaccttcaggcttttcaaagatgtcagtgttccccaccactgccaccagtacatttctcattgccttagtgaaaggagtgtccattaggcctccagggagtggagagaggtcatggtattattggtcttatgtggtagtcccttctaatctccaccaccatgaatcttctgactcatttgtcagtactatgcccaggaagttctagctgatcatctcaggctgatttcctataggccatcatcatatccaggtttgaaggaaccatcctcatatagatctcctttgtctcctatatctttttttctgcctattttattccattttaattaggatttaaacatgatcaagtctttttgcatcttctatctccctctacccttcacagacccattgaaagaattgttctcaccttttcttaatttcatctccctctcactttggaaccattgacattccagtttctgcctatactactcacccaaggtattatctagatcacctccatatagatcgagccaataatgattgttagttcttattacagttaatgttttctgacgcatgtttactttttgaaactctctcttgcctgacttgcccacagtctccttgttttcctcttctttctggttgttctttcttagactcctttgcaggctcttcttgctttgcctaattgtgtttcaacgggtgtcattttaggccttcctctcccctcactctacaaacttcttaagagacaatagtcagctcctaaggttaataactttgacatctgactctctattctcctgagcttcagtttaattatctcactgtctactgtacatctttatttgaatgccccatagacacttcaaattctacatattcctgagctaaatttatgttcctcttaatcctgcttctcttcctgtattccctaagtagatggtaccaccatctagccatttgccccagccagaaaccaggatattattcatgactgcatttttacctcattctttacatctaatcaaattatcaagtccattcattatttttcatctcctttgtcatttcttaatacaggtcaatatttctaactcggattgctataaaacctaacttttctgtttgccttcaatcaggtaatcctctgacacaggagatcatgaatttggattgtaaaaaaagattacgttttcattttttgatttctaattgaaatttagaacttctattttgaatgtaggtaacaaaccacagaagcactagaagtttttgtgactttgtcaccaataaatacctcagatattttcatgttacttgtaggtatcataaaatatcacacttgtcaccaccttgaaaatatagtagacttgcactagatcttatcacttaatgttaatgaaactcacaaattactgtgtcacaaatctattttttattattttgattactgtttttcaaaataattgatttctcctgtttttgcattttatttcatgcatttagaaatattatggaaagagtctttttaggcatcaccagacaccatagggggtctgtggcaacaccttactgtaatgtattctactcactagaaccaaagtaatctttccaaaatgtaagtttaattatgtccctcaaaagcctttaatcatgtgcctcggttgcccttaggagaaaccgggataaaatctaatccctttaatatggcttacgagttctagtctgatctggactctgtctcctctctgtcattctagccagtggtgtgctgtggccagctagcacctgcaagattcagtttttaagattttggtaattttgtgagccagttaagtcataggtagcttgagtgtacatttataccacggagatcagcaaacactgcaaatcagaattttgttttgtttttgtcttttattttttaatttaattttttaaaaatttccaggatacacatgcaggatgtgcaggttttttacgtagggaaatgtgtggtagcaatttgctccacctatcaacccgtcacctaggtattaagccctgcatgcattagctatttatcctgattctcttcctcccctcaccttccctgacaggccccagtggtggtgttcccctccttgtgtccatatgttctcattgttccactcccacttataagtgagaacatgcaatgtttggttttctattcctgtgttagtttgcttaggataatggctttgagctgcatccatgtccctacaaatgacatgatgtcattcctttttatggctgcatagtattccatggtgtatatgtaccacattttctttatctagtctatcatttatgggtgtttgggtttattccatatctttgctattgtgaatagtgctgcaatgaacatatgtgtgtatgtatctttataatataataatttatattcctttgggtatatacccagtaataggattgctgggccaaatagtatttccagttctaggtctttgaggaattgccacactgtcttccacaatggttgaactaatttacattcccaccaatagtgtaaaagtattcctgtttctgcacagccttgccagtgtctgttgtttcttgactttttaataatcaccattcagactggcatgagatggtatctcattgtggttttgatttgcatttctctaatgatcaatgatgttgagcttttttcatacgttggctgcataaatgtcttcttttgagaagtgtctgtttatgtcctttgcccagtttttaataggattgtttgtttttgttttattttttgtaaatttgcttaagttccttgtagattctggacattagatcttttttcagatggatagattacaaaaactttctcccattctataggttgtcagttcactctgatgatagtttctttcgctgtgcaaaagctctttagtttaattagatgccatttgttaattttggcttttattgcaattgcttttgatgttttcatcatgaaatctttacccatgcctatgtcttgaatggtattgcctagattttattctagggtttttattgttttgggttttacatttaagtctttaattcatcttgttaatttttgtataaggtataaggaaggggtccagttttagttttctgcatatggctagccaattctcccagcaccatttatttatttatttttcatttatttattttttttgagacagagttttgttctgtcacccaggccggagtgcagtgctgcaatctcggctcacggcaacctccgcctcctggattcaagcgatgctcctgcctcagccttccaggtagctgggattacaagtgtgcaccaccatgcccagctaatttttgtatttttagtagagacgggtttcactgtgttggccaggctggtctcaaactcctgacctcaagtgatcctcctgcctcagcctcccaaagtgctaggattacaggtgtgagccaccatgcccagccccagcaccatttattaagtaggaaagcctttccccattacttgtttttgttaggtttgtcaaaaatcagatgattgtagatgtgtggtcttcatttgtgagatctctattctgttccatggtctatgtgtctgtttttgtactagtaccatgctgttttggttactgtagccgtctactatagtttgaagtcaggtagcatgatgcctccagctttgttccttttgcttaggattgccttggctatacgggctctttgttggttccatatgaattttaaagtagttttttctaattctttgaagaatgtcagtgatagtttaatgggaatgggtttgaatctataaattactttgggcagtatggctattttcacaatgttgattcttcctatccatgagcatggaatgtttttccatttgtttgtgtcttctctcatttccttgagcagtggtttgtagttctccttgaagaggtccttcactcctcttgttagcggtgttcctaggtattttattctctttgtagcaattttgaatgggagtttattcatgatttggctctctgcttgtctgttgttagtgtgtaggactgcttgtgatttttgcacattgattttatatcctgagaccttgctgaagttgtttatcagcttaagaagctttggggctgagataatgggattttctagatataggatcatgtcatttgcacacagacagtttgacttcctctcttcctatttgaatatgctttatttctttctcttgcctgattgccctggccagagcttccaatactatgttgaataggagtagtgagagagggcatccttgtcttgtgccggttttcaaggaaaatgcttccagctcttccccattcattatgatattggccatgggtttgcataaatggttcttactattttgagatatgttccatcaatagctagtttatcgagagttttctacatgaagggatgttgaattttatggaaggccttttctacgtctattgaaatgatcatgtggtttttgtctttccttctctttgtgtgatgaattacgtttatggatttgtgtatgttgaaccagccttgcaccccagggatgaagccaacttgatcgtagctaagttttttgatgtgctgctggattggtttgccagtattttttgaggatttttccgtcaatatgcatcagggatattgggctgaagttttcttttttgttgtatccctgccaggttgtggtatcagaatgatgctggcctcataaaatgagttagggaggagtcccttcttttcagttgtttggaatagtttcagaacaaacagtaccagcaactctttatacctctgatagaattcagctataaatccgtctggtcctgggttttttttttttttttggttggtaggctatttattactataggctatttattactgcctcaatttcagaacttgttattggtctattcagggattcaacatcttcctggttcagtcttgggagggtgtatgtgtccaggaatttatccattttttctagattttctagtttatttgcatagaggtctttatagtattctctaatgattgtttgtatttttttttttttttttgagaaagaatctcactctgttgcccaggctggagtgtattggtgtgatctcagctcactacaacctctgccctctgggttgaagtgattttcatgtctcagcctcaagcgattttcatgcctcagcctcctgagtagctgggattacaggtgtgtcccaccatgcccagctaatttttttgtatttttagcagagactggattttgccatgttggccagcctggtctcaaactcctgaccttaagtgatcctttcacctcaacctcccaaagtgatgggattactggtgtgagccaccgtacctggcccagttgtttgtatttctgtggggtcagtggtgatatcccttttatcattttttattgtgtctatttgattcttctctcttctttattagtccagttagcagtccatccattttattaatttttttcaaaaaaacagctcctggatttgttgattttttttgaagggttttttgtgtctctgtctccctcagttctgctgtaatcttggttatttcttgtcttctggtagctttggggtttctttgctcttggttctctagttcttttagttgtgatgttagggtatcgatttgagatctttctagctttcgatgtgggcatttagtgctgtaaatttccctccaaacactgctttagctgtgtcccagagattctggtacattgcctgtttgttatcattggtttcaaatagcttcttgatttctgtcttaatttctttatttacccaggagtcattcaggagcaggttgttcaatttccatgtagttgtgtggtttggagtgagtttcttaatcttgagttctaatttggttgtgctgtttgttatgatttcagctcttttgcatttcctgaggagtgtttgacttccatttatgtgatcaattttacagtaagtgccaggtggtgccaagaagaatgtatattctgttgtttttgggtggagagttctgtagctatctatcagatccactttatccagagctgagttccagtcttgaatatctgttaattttctgtcttgattatctgtctaatattgacattgggtgttaaagtctcccactattattgtgtaggagtctaagtctctttgtaggtctctaagaacttgttttatgaatctgggtgctcctgtattgggtgcatatatatttagtatagttagctcttactgttgaattgtcccctttactattatgtaatgcccttctttgtctttttttaaatctttgttggtttaaagtctgttttgtcagagactaggattgcaacccctgcttttttctgctttccatttgcttggtaagtttccctccatccctttattttgagcctatgtgtgtctttgcatttgagatgggtctcttgaatacagcataccaaggggtctttacccagcttgccactctgtcttttaattgggccatttagtccatttacatttaaggttaatattgctgtgtgtgaatttgatcctgtcatcatgatgctagctggttattttgcaggcttgttgatgtagttgcttcatggtactattagtctttgtacttcagtgtgtttttatagtgactggtaacatttttttccttcccatatttagtgcttccttcaggagctcttgcaaggcaggcctggtggtgacaaattcctgcagcatttgcttgtctgaaaaggattttatttctccttcgcttatgaagcttagtttggccacatatgaacttctggattggaaattcttttctttaagaatgttgaatattggtcccgaatctcttttggtttgtaggatttctgctgagaagtccacggttagtctgatgggtttccctttataggtggcctggcctttctctctggctgcccttaatgtattttacttcattttgaccttggggaatctgattattatgtgtctttgggttgatcttctcatggagtatcttactgtggttctctgtatttactgaatttgaatgttagcttgtcttgttaggttggggaagttctcctggatgatatcctgaagtatgttttccaacttggttccattctccctgtctcaggtaccctagtcagtcataggtttggtctttttacataatcccatagttcctggagattttgttcattccttttcatcttcttttctctaatcttttctgcctgtcttatttcagcaagttagtcttcaggctctgaaattctttcctccactttgtctacttggttgttgatacttgtagttacattgtgaagttcttgttttgtgcttttcagctctatcaggtcatttatggtcctgtctcaactggttattctggttaacagctcctgtaatgttttatcatggttctcagcttctttgcattgggttagaacatgctccttcagctctgtgaagttattacccaccttctgaagtctacttctgtcaattcatccatctcagcctctgcccaattctgtgccctttgctggagaggtgttgcaatcatttgaaggagaagagcactctggctttttcagttttcagaattttttcattgattctttctcatcttcgtgagttcgtctagcttcaatctttgaggctgctgacctttggatggggtttttgtggggacattttttgctaatgctgttgttgttgctttctgttatttgtttttcttttaacagtctccttccatagggctgctgcagtttgctgggggtccatcccatcctgttcacctgggtccctcctacaactggaggtgtcaccagtggaggctgcagaacagcaaagatggctgcctgcttcttcctctaggagctccatcccagaggggcactgacccgatgtcagcgggaaccctcctgtataaggtgtctggcgacccctgttgggggttctcacccagtcaggaggcaggggatcagggacctggttaacaaagcactctggctgccccttgggcagagggggtgcactgcactggggggaatcccacttgtctggactacccggattcctcagagccagcagcgggaaagactaagtccgctgatcaaccgagactgcggctgcaactgcggctgcctctccttctggggagatcagagttctgttcgtaaacctctggctggagttactgaaattcccacaggggagccccagccagtgaggagggatgggtcagggtctggtctaaaaaggcagtctggccacaatctgccacagttgctgtgctgcactgtggggaattcttcctgggtctaaaccgcccagtctccctggcaccagtaggggaaaaacagcagactggagctgcagtgatggctgctgcccctcttcccaggagctcagtcatcttaggtaggaggcagccacagtcatgatggccacccctccccctgggaactcggtagtcttaggcagtttccagccaagaggccgccgtagtcttaggcagtttccagccaagaggccgccgagaatctgcacagctctgtgcttgggacccaaaccctggtggtgtgtgtgggcccacgagggggatctcctgatctgtgggttgcacagatccatggaaaaaccgtggatcgtggattcttgggcagggtaacacaatcactcactaccacctcccttggctgggggtgggagctccccttgccctgtgtggctcctgagtgggccatggctccaccctgctttttccttgctctccatggctcacgccaactgcctagtcagtcccaataagagaacctggatacctcagttgccagtgcaggattcactcaccattttcattcttctgtgtgagagcctccaaacgcatatatttctcgtcagccatcttggcccctccggcctgttgttgttttttagagagccaagatgttaaacttgtaccagcacaccactggccccaacccacctccaaagttttagtctattgaatttacttaattcttacgaactttgctgtgcccttgtgaatgtttttgtctttggataaaccattgttttttcgtctttacctgaccaactcaacttggtcgacaagagtattctctagccctcaagtctgggttagatttctgtctcctttctcataaagcaaacctctttttccaacaggtaaagtaaaataaagtaaattaagtaaagataaaagaccaaatttaggtgaatgtgaagttgttatctggaatgactgggagttgggtaggtattgcaaggacttttattgaagtccttgaccattattgaagatgcagtcttctcaagagctaatagttcagtacctatttaattgtttcacagtatcctaaaatattatagaaagcctgattgatctcttgcacctattcccctaccacaaatataaagccttttccacattaagagtacagtactatattcctagcagacataaacacttcaccaatactgaatccattcttcagagcttagcttatgtgtctttaaatactatgtcctctcattacattttttccctaaaagtaggcagtttcttggcttaaataatttcccagataacatatacactcatatcattggtaacaatatttttaatgtaagtagtagtaaaaaatgccctgaagaatgaggccgattattttcgttctgatatttcattgttaatgtctgcagtgtccttctgtgctgagggtctcctgaatgttcactgcatgctattttcctatgacttttgtagagaacagcagggctttagcctctgtgctttcctttgttttatctctcctatcatcatgtgggcattacagagctgggtgctaaaagttttttttttaatttaaatatgaaaaaacccttaaaatatagtttctactctccagaaatgtacagtgtagtaaaggaggcaaggtacatctacaaaagagttaaggaacaacataagatagtaaatgattaagattccaagtaattagttgcctgtgagactacttgttagctatataagtgggcaagatgcctaatctgcacattggtttggtttcctcatctgcataatgaagatagtaatatcagtcccgcttagagtgttctgttgataattgaatgagttactgtatctcatggtacaatttaaaggttataaggtgataagtatgaatttattatgattactagtattaaagcttatgatctaatacagaagaaagaatatcttgcttaaaatgtatatgagctttttctgaggtgattttttttttaccagttatcaaaaaaatcactttggcctttgagttgttaggcccctggagttacttttcaattctttatttgttttccatgttcttcctttggaaagattttctgagtttcagaaactgttttccagatttgctaccacatactatccttggttttttgtccccaaagaccagccaaaatgtaggaatataattttctctgctttctttttgttagctgtctttccaaaatgagcataggttgtctattttttaagattttacaactaatcactaaaggggaaatagagtataataaatacgggaacttatcttccaaaatctcataaggtttccaaagggttctgtgatatttctgatttcctttctcaggtggagcccaaaagcacataccctcatctctcttttaattcttaagtttataaaattttccctcttcccacttctctacctttttctagtttacttagatttcttcttccttagccttttactttttgtgacaacaaagtcagattttctttcttagagagaaatttaggtcatcctttataattcatcttcttcccgtgttattagaaaatccagaactccatttaaatttgcagagagagaacctcactaaaaacgattgtggaaattacctcatgagcttaggtctcttcttttggcaataggtacattcaaaatataagaagagaaaatgaactaacatataaaaactcctctgggatgatatcttttattcttgttttataattattgctaaaaaattataatctagatgttaatgtttttaatcctttcatttctagcattaattaaaatttttctatttgtgtataattagtagtaagactatataaaattcaagagacctttcagtttattttattaaggtacttaaatccataaagttagagctacagagatctgtacaagtagggcctgttattgcttacttatttgggcaggttctgtctcttctattagttcctgcttagggactgcttattttattctaattctttgttacatattagaagcaaggaaataaatttaaatgaggaaaagaacagaataaaaagaatatagagatcttttagggaccgctgaggctctccagcagtccttgaagattatataaattcccttttgatgaaattctgaaaattttaccactaatagacctgagctgtagtttctctaggactgatacatgaatttttttagtttatttaaatagagttgttgaaatatgtgagagatgactgtattttggtttcagttatgtaaacttcatgaaagaagtgaaatgatcatcagtaacttttaaaaataatgttactaaatattcttattatctaatcatgaatttacgtaatcataaacagattaatctctactttagattttcttttaaattcactgtttaaattttataaatcaatgaagtacaaggcagttttgttacatgcataaattgcgtagtggtgaagtctgagttttttaggatattcatcacccaaataatgtacattgaacccactaagtaatttctcatcatccacctttcccccaccttgtaacccttcagaggctccattgtccgtcattccattttctacttcaatatgtgcacattttttttagcacccacctgtgagtgagaacatggaatatttgtgtttctgcgtctaacttgttttgtttaagatttctagttccatccatgttgctgcaaaagacatttcattctctttatggctgaataatattccattgtgtgtatataccacatttctttatccattcatctgttgatggacatttaggttgattccatatctttgctattgtaaatagtgctgtggtaaacatgcaagtgcagatatctttttgacatatggatttcttttcctttgggtagttacccagtggtggaattgctggattgaatggtagttctatttttagttctttgagaaatctctgtattttccttaatggttgttgtaatttatattcccgttaacggtgtatatgagcattctctgcatcctcaccgtctgttattttttgattttttaatagtagccattctgactggtataagacggtggttttaagttgcatttctctgatgattactaatattgagatttttttcatgtacatggccatttgtatgtctccttttggaaaatttctgtttatgtcctttgcttactttttaatgggattatttgtgaagtttttgttgagttgtttgagttccttgtatattcttaatgttagtcctgtcagatgtatagtttgcatatattttctcccattctgcaggttcttttcactctgctgattatttctttggctgtgcagaagctttttagttttagttgcatttgcctgtttttgtttttgttgcctgtgcttttgaagtcttagtcataatttctttacctaaaccaatgtccagaaaagttttctgtaggttttcttgtagtatttttagtttctagtcttaggattaagtctttagtgtatcttgagttgatttttgcatatggtgagagataggggtccagtttcattcccctgcatatggcaatccagtttttctagcaccattttttgaaaatggtgtcctttccccaatgtgtgtttttatcaactttgtcaaagattaataactgtatgtatgtggctttattaaattcattttactctttttttttcagctacattaacaagctattctgaaaatgtggaacgcacaaaatatgctggggaaagcagtaaagaattaggatctggaggaaacataaaaccttggcagtctcaaaaatccagcatggactcctgtttgtatcgagtagatgaaaacatgactgcttccacctatagtctgaataagatcccagagagaaatttggaaacagtgttatctcaatcagtacagtctattcctttgtatctcatgccacggccaaattcagtagcaggtaagtttttgttgttgttgttgttgttgctgttgttaaataatcattttactccagtatatattgaaatgaaaataaatcctgctctgacagtatttaaattttccattcatcttttctgactaagctgttcttttgtgtttgggtaatatacatgtatatattatttgaatctgggagaaggttcatcttcctcgagtgattgcttagttctgctcccaaaatgtacaaaaacacatagaaattcagaaacagcctataaaatatatcatcaaacaactaaaagtcttttctctcaatgagaagtctttgaaagaattttagtttgaggttttagttcttttcttaaaatcttagttttaaaaaacattactaaaattggcatatctcagtgtaatttgtattatcagaaatcatcatccatagtttgtaaaagtggaaggcagacaagaattcagcttttcctcatcccgtgagtttcagtattttcacaatatcctggctatcatttcatggaagaatcaccaggtggctacatttctaaagaataattctgcaacaccactagcaaactcggttaaaaaaaattgtattagtccgttttcacactgctataaagatactacctgagactggataatttataaacaaaagaggtttaattggctcacagttccacacagctggggaagccttgggaaacttataatcatggcagaaggcaaaggaggaacaagtacctgcttcacaaggcagcaggagagagagcaagcacacaggggaactaccagttttaaaccatcggatctaatgagaactacctcactatcacgagaatagcatgagagaaccacccccatgatccaatcacctcccaccaggtccctgacacttggggattacaattcgagataagatttgggtggggacacagagccaaaccatatcagaaatgatatagcatggtggctcatgcctgtagttgcagcaatttgggatgctgaggcaggaggattccttgaggccaagagtttaagaccagcctgcgcaacatagtgagaccttgtctctaaaaaaaaaaaaaaaagaaagaaatgatactgagggttaagtggttgaaatacggagtcatcattccttagcacctactctcctcaaaattgatgtcaaggggtatttttactacagctaaattgctgtttaataattcaaacctgggacttttgaagaatagttgaatgttctgacttttcaaaatatgtcatcatctggactttgtccagactataaaatcaaagttatgtttgcttctcttactttcctcatgaagacctggatagattatctcactgataattactccttatgtagctgatagtgtaatgcttcttgccattcccagttccctttcctacgtgttctttgttctctgggagaccatcagcatctgtcatcaggtgtgattataggggaaatggctcatctgaaagataagtaactatggaagattttaatattaattgttaaagattattcacttttatatagtgacaggaaattttttatcctaggaccttctaactatgtcaatccccaactaccatgtcatattagaatcctagaatgctgttgttttagtctattcttatactgctataaagaaatacctgaaactaagtaatttataaagaaaagaggttgaattggctcatggttctgcaggctgtacaggaagcatagcagcttctgcttggcttctgaggaggcctcagagagcattcaatcatggcaaaaggcacagggggaacaagcacctcacatgaccaaagcaggaggaagagcaggaggaggaggaggttgcacacacttttaaatgacccattctctggagaactctcatattacaagaacagcaagggggaagtctgccccatgatccagtcaccttcaacaatggggattacaattcagcatgagatttgggcagggacacagatccaaaccatatcaactgtacattatgaaaagttccaggcaagcctgagtcttttccgaaaagaagcatgtaaatccttgctcgtatataaatagaggaatgtaactaccaaccataatagtatgtcccaacttacttcctaactaagctacaatgatttctaagaaaattctggttctattatttgagaaaggcactgaacacttagtagaagacaaagaagctttgtctcaatgagtggaactatgtagtcagtctgaatgaacaatgttaattcagggctatgagtcttggtcactacttaacatcaacattgtgtattactgtcttcttcctacttactccccattatattttatgtgtatcccttagaaccttttttcactgtgttaatcaaggaccttctcatttgtttaaaagcgactcagctcttcctcaggcttcccttagccccaagtgtatcccagaactgttgtacttccctattagccaagtgctccctctctagttgtatcctgtaccttcagagcagtgccagaactgaacagactatgggaagagagaatggaacaagcaagctggttaatttaatgttttgctgttggtctcagaaagccatcaggaccacatgaaactaaccaccagacagtaataagctttgaggcaactaccaaactatctccatctaattcctagccaccttcccaggctgaactcaaatacttcctccttcatgaaactttctccagtcatctcccagccacaagtaattgcttcttcttctagaaagcattctctttttgtgttggcaacagtctactttgtgttatgtgcagctattgtgtatatgtgttggtctgactgtcacaatctaaactttttgacattagcaactgagaagactccagtagaggttccatagtgagtgaactaatgaatgaatatatgcatgaaccaaccaatctgtgatatcagctttaaacaaaaataacaatgtagttagtaaatctaatgataattttcttcatcttactatagaatatagtcttctcataggagagattacccagaaaaaggtggggtgggggcttatttacagaaagtaagctctatatgagatggtagtatgagccagttacaaaacagttttggacttactagtatctcacaatttcttttcttccaaaattataaactgtagttctctttaataatggaatgtataaacagcatttatcactatttgctaacaactggcaatatatatttttcagtggttaatcagaagcccttattcaattagcagtgtaatggtattggggaaaaaaatggagattttaagagatttctgtttctctaagagagcagtcagcaaaccagggcccatgggccaagtttggcacactctatttttgtaaataaagtttcatagcagcaaaaccacactcatttatttatttatggctactttgctctaccacaacagagttcagttgttggaacagagatcataagctatacagttaacattgtagtggcctacaaagcctgtataaaaagggcaatcccaacgttcattctaaaatcttaccctggcgttggattcaagtcacccctcggcgatgcatctcggctatacaggtcatatacagtgttagctgtgcatagggacagaaactgttttagactttatgaaagtttcatgatgtgtttcacatgacttcatgaattacatagagcatcagaaatgtgtaaaaattccgtgagaggacattgttactcagctatactgatacaagatagcaaagacactaaacggatttgaaagagacaaaaaagctgaaattgacccttaagttttaagtttttgtaatatgcatttagctagactcatcatcagtgtggtgcatagacagtgcctaatagtaaattggtcacctgcttgagtctagagccctcatttccaaacttaggaattttcattttggtggtggagaagtctcttaatatattcgttctcattttctcttgacttctttttagtttattgaaaagaatgtagaattactttgctcttcttaaacagacatatctcttgagattcattattttacccaaaaaaatgctaactgtgagcttatgagatgtctaagactcctgtactcctataaaagcccgataagcttttcctctcagtgtctgtgaggctaatactattgtaaacaaaaaatacagaaggaaaagtaaaagccactctcctctctacacctaatatctctctccaaaggttaatatttctgattctttaaaatatatctatatatataaaacattataatatctgtatgtgatatataatcatatatacctatacatgatcctctgtatctgtggttccatatccatggatatggatggccaactaaaagggacttgagcatttgcagattgcggtatcctattgcagatagctccaggggttctggagctaattccctgcagataccaagggatgattgcatttaattataatatatgtaagagagatatgaggtcaaaaatgagtgggattcattcaaaagaaatgaaagcatatgttcttaaaaatatatacataatcatcacagttttatttgtagtagccagtaactgagcatcccagatgcccatcaacaggtgaatggataaacaattgtgtatccatacagtgaaattctactcagctacagagggaaatgaattatggataccacagcaacatacatgaatctcaaaataattattctatttgaaagaagccagattaaaaaaatatatgctatatgattccatttgtataaaatcctagaaaatgcaaactaatctgtaggcatagattgcctctgttatactgcgaccatctacaagtacaggtgccctgtgggaattagggctcaggaaagtggcacaatgttgatcctctggctactgctattgctctgagtaaaaaactgtctttgatctccgacccaaagtttcatatctttttccagcatccaagcttgttagtttacagattcttcacaattcttgacagtgagatatcgctatacccaaacccacaaaattaaaagaaatggcaatggcaagcaacacaaggaaatgctgcaattgaaattatacattgatggtgggagtatgttaataagttggtactccattttgtaaagttgtttgacaagatgtattaaaggtatataaagctatatatgcatgttatctaaaacctcacaattccatttctgaatagaatgtccatgagaaatgagtgcttttgtttatgagaagacagataaaataaagttttatcagttttattcataatatctaaaaactgaaaaccattcacatgtccatcaacagtggaactgataaattgtatgcagcaatgaaaaagaacacactactgttacaacatcgtgaatatatttcacagatgtgatattgaacaaaagaagactcaaaagagtgccttctgtataaagtatgtacattgatataaagttcatagaaacaaaatgatcacacttctataattatagaactaaagtaatggttacctttggtaggattattgactaagggagctttctgtatcttggtctggatggtagttacatggatttatactcatgagaagacttcaaaaagtccatggaaaacatacttaaaagatacaaataaaaaatataaactttatttctcaacataagttccatcaagttcaagacacctttgtaagtgatgataccagccatttagttcatccctaaagaactgagtgtcctgggaatttaaccatgtcaattaagtcttttttacattataaactgaagaaaaatgcatgccttttacagattttaatattaagaaacaaaaaagtcagagccaaatcaagactgtaagatggatttcccatctaaacttgcaaaattgcctttgtttgatgagaggaatgagcaggagtatcattgtggtggaaaaggattctctggtggagctttcctaggtgtttttctgctcaagctttggcttgctcaaaacactttcatagtaagcaggcgggtcatttttggtcctccagaaagtcaacaagcaaaatgtcttgatcaccccagaaaactgttgccatgatgcttgctcttgactagtccacttttgctgtgactggactatttccacctcttggtagcccttgctttggttgtgctttgtcttcaggattgtactggtaaagccatgtttcatcccattaccattcttcaaagaaatgctccaggatccgaatcctactcattttgttttaaattttcattgaaagcatttctcttttctgcagctgatctggggacaatggttttggcacccatttagtggaaagtttgcccccattttaatttttcagtcataattgtgaaagcagaacccattgagacatctgtcatgttggctcttgtttgtgctgttatcatttgtccttttcaattgggatacaaacaagatgaatttttgtggatggtctgccactgcaggcttcaacactgtctcatcccttcttaaaacaagttatccatttgtaaaccgccgatttctttagcgtattgtctctgatatgatttggctgtgtccccacccaaaactcattttgaatcatagctcccacaattcccaagtgttgtgggagggacccagtgggaggtaattgaatcatggaggcaggtctttcctgtgctgttctcatgatagcgaataaatctcttgatttctcatggttttataaaggggagtatgtcatgtaagaggtgacttgctcctccttgccttctgccatgattgtgaggcccccagccatgtggaactgtgagtacattaaacctcttctcctgtgtaaattacccagtctagggtacgtctttattagcagtgtgaaaatggactaataacagtctccataaatgttttgtaaaaatcagtgattttactattcttccacccaggcttcaccataactttgctgtttatccttgcttcaattttagcagaattcatgttgctctgatgagggcttttttcacactaatgtcttgttcttaatgcctcaaactatatcctgttcagacatcttataataagttagtatgaatttattttgatgcaaaaaatttttgaaattcatccatagttttttcataagatgcatttcaatgaactttttgaagactctcacatgtataaaaataattaagctatacaccaaagatttatatactctatatatgtaaatcataccagtttttaaaatatataaaatgtggcagggcacagtggcttacacctgtaatctcagcactttgggaggacaaggtgggtggatcacttgaggtcaggagttcgagaccagcctgaacaacatggtgaaaccccgtctctactaaaaatacaaaaattggccaggtgcagtggctgacacctgtaatcccagcacgttgagaggctgaggcagacgaatcacgaggtcaggagttcaagaccagcctggccaacatggtgaaactccgtctctactaaaaatacaaaaacttagctgggcgtggtggcaggggcctgtaatcccagctactcgggaggctgaggcacagagaatcccttgaacccgggaggtggaggttgcagtgagctgagatcgtgccactgcactccagcctgggcaacaaggcgggactccttatcaaaaaaaaaaaaaaaaaattacctgtgcatggtagcgtgcacctgtaatcccagctgctcaggagactgaggcacatgaattgcttgaacctgggaggcggaggttgcagtgagccaagattgcaccagtgcactccagcctgggatacagagtgagacgctgtctcaaaaaaaaaaaaaaaattatatgtatgtaggcctgttgtctctgcagaaggattttctcttttctttggtatagaaatagcagtcctaggaaacataacaagatctttgtctgaattatctattttagtgttgcttaataaaacctaataactacaacaaatagataatttatttaaaatgtttcattttattgagtatataaacctaagatgagtacccaaactggccagaacttttttttttgtttttttttctaaagcagcagtctgtgtgtggatttttaaaaaaatttttttaaaaacaagtatattgagtcttattttatatattataaaattcacccatttcaagtgtacaattcagtaatgtttagtaaatgtagcaagttgtgtaaccctcaccatgaatcagctttaggacattttcattacctcagaaagatttctgcatctatttaacattaatcccattccctctcccagttcccaggcaaccactaattgacagagtctatatatttgtattttctggaaatgtcacataaatggagtcatatggtatgtcgtctcttgtatctggcttctttcactcagcataatgtttttgaggtttatgacgtatatatatcagtagtttcttcctttttatttcaagtaggattccactgtatgactgtaccatattatgtctattcatttaccatttgatagacattgtttccaattttggtctattgtgaatagtgctgctgtgaacatttgtttgcaagtgtttgggtagacatatgttttcatttctcttggatagatagatacctaggagtagaattgctgaatcttatggtaagcttatatttaactttttaagaaatgcaaaaatgtttttctaaaagtagctgtactgttttgcattcccaccggcagtgtacaaggattcctgtttctctacatctcctttgttactgtcttacctttagctggtgtgaaatgatatctcatgaggttttaatttgcattttcctaatgactgctaatgttgagcttattttgtgtattgttatctattcatttattctttagtgaaatatctattcaaactttagcacattttcatattgggttattttctttggatttgtacgaacttgttgtatattctggatacaagtcacatcagacatgtatttgcaaatacttcagtctgttgcttgtctttttgttttcttactggtatattaggaaatataaaaatgtcaaattttggtgaggtcaatttgtcaattttttttctgatagaccatgtttttcatgtcactttcctctttatctttttaatagaaaacatactgtttatatcatgtattataaaactgatttctttacgacattggggtttgttttaactcaagtattggaaaatacttcctgaaatacttaatattttttccctcttgtccctcctcttcccctactcatgttaaaaaaaaaatagaaacaattacatcatcctaaattgttacatctgtagactagaccttaattgttacatctgtagactagaccttaattgtgaatgatttttttatttaccacaattgtcttcccataatgttagtctttctggctagcagagtgctttagattcttaagcagtacttatcactcatccttaaaggaagggtaaaaggtaaatataccatcagagatcagatagctctgtcctggagaacaagattatatgctactggagtagtacatattgactgtgttgaacaaaatacttcatcagaaaattatttcttgtcagtgttgaacataatacaaacagacctactttggcctacagggcaagtcatatgtcagggaatagtttgtattaggttgttttttgtatctggaaaccatggtttcaggatgctcagaaagaggcagaaaaggaagctataaaccaaatgactcagttattttcaacacttagtagattgtagattgaaaatttttccagaacgtagagaaataaaattactttcacagggaattgccctgctaaatgtataatgtatgtaaatatttgataaaaccacaacctctggtagcttaaatgattacgtatctaaaccatttttaaattaaattttctcgtctcaggagggtctgctcttttcatttagctctagatacacatactttcctttcctttctaatgggtacatagaagtggttccctaaactggggagactccgatgctaaatctctggtgaacaggaataattgaggatttcaaatatgaagtgagcttgaaataggaaaaaaaagtatattcacacttattaaattgttctaagcatctgaacgtcaagggcaggatggggatgggaatgatgaatgccagtaataaaaagccttattcagatccaacttttaaacttctcatcttttttaaacttaatttctgtgtgactaatataattatttattttagagaccaaatgatgttgaataataatgtgaaaaatatcatttgagtaacttttaaaaacctgggttaataattgtttaaatggtccttgccatgatacagatttctccccaatttgggaagaggatcaccttctattgcctaagctccttagcatctttttaggaccacatcttctggcatgaccaggaaatttttaggggattatttaaaatccttgaggctgctactggattgaactgtaatgaataaaactatatatattgttccataatgccaagattcttgattttaaaaagaacagaaatgacttgtggcttttgtgacacttttgtggggagaatggagtcagcatgtatgcaaatatttatggtgaattatttttaaaaatatttttctaagcttttaacttacatatgacataaatggaagaaatatatatagtgaaaatttttaaaatcgtgtattttatttacagtattaaaatagaagtttgactaatacgttggtcaaatagattcagctgcatacttttaaaaacataaagactccaactagtgaagttcatagttaaaatagataaaacaattaacactccatgttccacatatgaggatagtactgtttgctgaaaacatgaaaacttttaactcaaatgataaagtgattaaagttgagttttggcagtctgcaatattaaggctcggaattttctggagtagctcagttttctgaatataaacttagctgttcatacacctttaaattaaaattctaaaatattaaaaagatttaacaatgtgttttgttttcaaaatgtaaattgctattgcatatttgtttttaagcctgtgtgttggaaggaagtagaagactcttgtggacttgtggttgcatggcagaaattatcagagtaggcagtctacggtcatccttgatgtccaaaaatgagattggcagtgaattagagggatgtgggaagcaggaaatgtttgcttgcaacagctgtcgtcagtgctttgtgtgagaatgagaggtctatcaaggaaacatacaaacaacagaagtcagctaaaatataaactctggccatctacatgttaatgcttggagcttcatgttttcctaagaaaaggatcttaagaatcaggtaaatacagaacgggaatctagggggatttaagcaaacccaatcagaaacttttaatagagattttgcaaaaatcaaaaatgggcttttcagcagtcagaacgttggctttatgtatcaagggtataaggacagcagaatggcttcttgcccaggcaggagcaaacatacagtgtcattccaggttccttgctcaagtcagctagagtgacaattttactactataatctgtttgcattagtggcaactgatataagaagaaacaattcaaactgtcttccaaactcagtatagagttatctctaaaatgttgtataccaaatgtctgttagatttcttctgcccacttgtagtgtatttaaattattttaacttcaaaaatgcatgtcagttaaatgctgagttgtcctcagctgttacaacctgatgaaatctaaaaaaaagctgttctttttttcttttccctgttccttctcaaaacaagtcttttaaatgacaaactttgtggatttactttttaaagctttttctctttacataaaaattttgttatagatttgtttttctgctttctccattcatctgaactcacctgattatgtcttatacttgtatctggaaagtgttagttaaatattatagtatttatttatttatttatttatttatgaatgaatgaatgaggcagggtctcacagtgttgcccagattggtctcgatccctgggctcaagcaatcctccaacctaatatcttcccaatataatgttaatttaatctgacagaactatctcaaaaatttttgcagtacaattgcgtagtaagactagcgctataaggtaggaacgtatgtgtccctatagagccgtcattggtgtttgtatgagatgatgatgtacaaggcattgttgctatagccaactccttcaaaataacccagtaagacaaaagttaagttgttgtttgctcattgttaaatgtagctgaaacatgaaatgtgcatataataatggttattcgttcattagacaagtatttattgagcaggtactatatgccaggcactgttcaaagcacttaagtatcatcattaataaacaaaacaaagattcccattctcatgtagtttacattattgctgggaaaagtaatgttagtaagtaatgttacccaggctggtaatttataagtaatttatatactatgctagaaggtggtgtatgctatggaaaaaaggaaaagggggatcatgaatatctgaaggaagataatagaaacgttgttgaagctaagcatattattttagtgatatctgttaagcattaagaaagcaaaacagtgaggaggaggaggatcgtgccaaacggattatgaaatctaagtaggaccagtctggaatttagttctacattgagtatcatgtgcagggcactctgatttactctgaagtggtagagtaatgaaagatgaattgggcatttctttcttgttctcaagaacctactacaatcagtgaaggaaggcagacatgtaaacacctacctgaataacacaaattctaaacagcagtatatatttatgtggttgctgagaaggagaaccaattaattctgactgggagattgattaggaaagcaaggaaagtgcagcctaagcaaagttttggcaaagggaaagataagtttgacgcagtttgaccaagcctttttatcagaaaatgatatacaaatggaaaagatccaaatgactgtgaggaagagtacaactaggtacaactagaagaacaaagggaaacacctaacagaagtttgtgtctcctggctgatctttccaatatttgtctcatatgcctttaaataatctatttgaaaggagaagaattttgaaaatgatgaagcaaagagaaactaaaagaggactagggacaatgattaataagaaaaaaaggcagtggaaaatgatagattcagataacaccaaccataattttattgtagtcccagattaaagccatagttccccatttactgattggaaagctgtctaagcccaacatcaggaccccagagctattgcatttgatattgaatatcgctgcttttttttaaggtcattgtacttctatttggatttttgaaggaatgaactattcactcagttcagtgatggcaatatttgtctttttcttctagtgtcatttgtctgaaattgagaaatgtgctcatgccaaagcatatttactatatttcttggttttgtgaaataaatcaaggcgatagaatagtgatgttcatcttcctaggtatttcaatagtaaagattagcttaacttgttaaaaccacactaaacattgatattttacaaaccaccagcttttatttaaatataagaagttaaacgtgagaaactaaacctgtggctaaaagtacttgccagaagattttttgatacaaaaattaaaatgaattacatgactattatttaattggaatatgtactccacagtataagatctctcatagtttaatctttaaaatattagatgagtataattttttaaaaatatatctgtattaggcttctttctttttaatttttatgggtcatagtatatgtatatatttatagggtgggtgagatattttgatacaggcatacaatatgtaataatcacatcagagtaaatggcataaccatcacctcaagcattgattatttttgttgcaaacgttccaactattctcttttagttatttttaaatgtacaatattgtacattttgttgtacaaaattattgttgactatagcccaccctgttttgctgtcaaatactagatcttattcattctgtcaaactatatttttgtaccttttgaccatccccactacccccaccccagcgacccttcccagcctctggtaaccatcattctactctctgtctccatgagttcagttattttaatttttagctctcacatatgactgagaacatacaaagtttgtctttctgtgcctggcttatttcacttaacataatgacctctggttctatccatgttgctggcaatgacaggatcttactcttttttatgtctgaatagtacttcattgtgtgtatgtaccacatttttttttacctagtcgtctgttttttgttttgttgtgttttggtttttttggaaggagtctcgctctgttgcccaggctggagtgcagtggtgcaattacccagtcttctgttgatggacacttaggtttcttccaaatcttggctatcctgaatagtgctgcaacaaacatggaactgcagatactaattttccttctttggggtatatacctagcagtggatcatatagtagtactattttcaattttttgagtaacctctgtaccattttccatagtggctgacctaatttacattcctactgacagtgaacaagggttcccttttctccacatctttgccagcattcattattgcttgtctcttggataaaagccatttgataatatctcgctgaagttttgatttgcatttctctgatgtcagtgatgtttagcaccttttcatatgcctgtttgccatttgtatgtcttgtgagaaatgtctatttttgcccattttaaaattgtgttactagatttttttcctatagagttatttgagctccttatacattctgcttattaatcccttgacagatggatagtttgcacatattttctcccattctgtgggttgtctcttcactttgttgattgtttcctcccttgtacaaagctttttaacttgatatgatcctatttgttcatttttgtttgggctgcctgcccttttagggtattaccgaagaaacctttgcccagaccagggttctgaaaaatttcttcagtgttttactttaacagtttcatagtttggggtcttaaacttaagtttttaatccatttttatttgatttttggttttgggtttttttgacataggatctcgctctgtcacccaggctggaatgcagtggcacaattatggctcactgcagctttgacctccctggacctcaacttcaagtgattctcccacctcagacctcgagtagctggaactataggtgtgtgccacccacacccaactaatttttggtttgagggtttttgttgttgttgttgttgtttttggtagagacaggttttcaccatgttatgcaggctggtctcaaactcctgggctcaagcagtcagcctgcctcggtctcccaaagtgctgggattacaagcatgagcactgtgcctgctgcttgggatggctttggctatttggggtcttttgtggtttcatataaattttaggattagtttttctatttctataaagaatgtgattattattttgataggattgctttgaatctgtagattgcttttggtagtatggacattttaataatattgattgattccagtcaatgaacatgaaatgtctttcccttcctttgtgtcctctttaatttcttacattattgttttttagttgtagagatctttcactattctacttaaatgtattcctagttattttatttgtggctatcataaatgagattactttcttgatttctttttcatcttggtggctgttggcacatagaaatgctactgtgttttgaatgttgattttgtatcctgctactttactgaatttgtttattagttctgtttttttgtaaaatctttgggttttttaaaatataagatcatatcatctgcaaacaaaaataatttgacttcttcctttccagtttggatgccctatatttctttctcttgtctgattgctctagctgggacttccagaactatgttgaataacagttgtgaaagtgggcatccttgtcttgttctagttcttggaggaaaggcttttagtttttccccattcagtatgatactagctatgagtctgtcgtatatgtcttttattgtgtttaggtatgttccttctgtacccagtttttttaggatttttatcatgaagggatgttgaactttagcaaatgctttttcagcatgaattgaaatgattgtattatttttgtccttcattctattgatatggtgtagcacattgattgatttgtgtgtgttgaaccatccttgcatccctgggttaaatcccacttggtcatggtgaatgatctttttaatgtgttgttgaatttgttttgctagtattttgttgaggatttttgcatcagtgttcatcaggaatattggcctgtggttttcttgttttcatgggtcttcatttggttttagaatcagtgtaatctagaatcatagaatgagtttggaaatactctcctcctctacttttttgaatagtttgagtaggattgggaatagttattttttatttatttatttatttatttatttatttatttatttatttatttttatttatttatttttgagacgaagtctcactctgtcccccaggctggagtgcagtggcactatctcggctcactgcaagctccacctcccgggttcacaccattctcctgcctcagcctcccgagcagctaggactacaggcgcccggctaattttttgtatttttagtagagacgaggtttcaccatgttaggatggtcttgatctcctgaccttgtttgtgatccgcctgcctcggcctcccaaagtgctgggattacaggcgtgagccaccgcgcccggccggcagtagttcttttttaaatgtttggtagaatccagcggtgatgccattggatcctgggcttttctttgctgggagactttttattatggttttgatctcattactttgtctattcaagttttgcatttcttcatagttcagtcttggtaagttgtgtatgttgaggaatttatccatttcttcaaggttttccaattgattggtatatagttgctcatagtagtctctaatgatcctttgaatttctgtggtatcagttgtaatgtcgttttcatctctgatttcaatttatttgggtcttctctctttttttcttagtctggctaaaagtttgtcaattttatcttctccaaaaaaaacttttcatttcattgatcttttgtattttttgtttcaatttcatttatttctgctctaatctttatttctttccttctactaagtttgggtttagtttactgtttactttgttctttaagaagcatcattaagttgtttatttgacttttcttttttttttttttttttttttgagacagtctcactctgttgccctggctggagtgcagtggtgtgatcccagctcattgcaacctctttcccccaggttcaagcgattctcctgccttagcctccggagtagctgggattacaaatgcccaccaccacgcctggctaatttttgtatttttagtagaggcagggtttcaccatgttggccaggctggtctcataaactcctgacctcaagtgatccacctgcctcggcctcccaaagtgctaggattacaggcatgagccactgctcctggcctctaccttttttatgtaggcacttattgctgtaaattttcctcttaatactgctttcactgtatcctataggtgttccatactagttctgtttccattttaatttgtttcaagaaatctgttaatttccttcttaacttcttcattgacccactgatcatgaggagcatattgtttaatttccatgtgtttgtatagtatccagagttcctcttgttactcatgtctagttttattccattgtggtcatagaagttaattcatatgattttttttaattctttagtacttggtctgtgacctaacatatggtctgcccttgagaatgatccatgtgctgaaaagaagaatgtctattctgcagccattggatgaaatgttctgtaaatatctattagatccatttggtctataatgcagattaagtcgaatgtttcttttgattttctgtctggatgatctgtccaatgctgacagtggggtgttgaggtctccagctattattgtattcaaatctgtctatctctttagctctaataataattgggtgctccagtgttaggtgcatatgtatttgggtgctccagtgttgggtgcatatatatttacagttgttatatcctcttgctgaattgagccctttatcattatgtagtgactttctttgtctctttttataatttttgtcttgaaatctattttgtctgatataactatagctactcctattctttttttatttccatttacatggaatatcttttttatcccattattttcagtctgtatatgtctttgtaggttaagtgtgtttcttgtaggccacagataattgggtcttgttttttgtttggttggttggttggtattttttttttttttttggtccattcagccacgctgtgtcttttgattgcagagtttattccatttacgttcaaggttgttattgatgaggaaagacttactcctgccattttgttattttttttctcattgttttgtgttcttctttatttccttcctgccctccttgttgtgaacgtgatttttttctggcagtatgttttaatttcttgctttttattttttgtgtatctgttgttggctttttggtttgagattaccgtgaagcttgcatataacatctggtttcggtttttgtttttgagatagggtctcactttgttacccagggtggagtgcagtggcgtgttcttagctcactgcaacccccacctcctgggctcaagtgatcctcccacctcagcctctctagtaactgagataacaggtgcacaccaccatgctcagctaattttttgtagtgttttgtagagatggggttttgccatgttgcccaggctggtcttgagctcctaagctcaagcagtccacctgccctggcctcccaaagtgctgggattacaggtgtgagccaccgcacccagccacaggtaacatcttataacccatttatttcaaactgataacaacttaacactgatggcaaaaacaaaccaactaataagcaaagagaaaactaataaaaactctctacactttaacttcatctcccctgctttttaactttgtattgtttctatttatatcttatactatctatgtcttgaaaagtagttattatatttgataggttcaacttttaggctttctactcaagatatgagtagtttataaatcacaattacagtggtctgtgaactatactgttacagtgagttttgtacctaagataatttcttattgctcattaatgtccgtttctttcagattgaagaactctggttagcatttcttgtagcacaggtctgatgttaattaaatctcttagcttttgtttgtctgggagagcctttgtttctccttcatgtttgaaggatgttttccctggatacgctattctaccatagaattttttttctcatcagcactttaaatatgtcatgccattctttactggcctgtaaggtttccactgagaagtctgttgccagatgtagtggagctcctttgtatgttgtttcttttcttttgttccttttaggatcctttctttatccttcacctttgggaaaaagtaccttgagatagtcttatttgggttaaatctgcttggtgttctattagcttcttttacttgaatgttaatatatttctcttagttctctgttattctccctttgaataaacattctaccccagtctctgtctcctctttaatgcccaaggcagatccagaaatgctgtccaggagccagggcctggagtcaggaaccttgaaatctacttggtgttccatactagtgcagtggagcgggcaccaaagccacaagataaagtccttcccactcttcctcaccttccatcgtgtagaaggagtctcaacaccccaggcccatggcaagtactgcctggctactgctaatgttcactcaaggcccaagagctcttcattcagcttgtggtgaatgctgctaggcctgggtctctcctttcagggtaggtggctcccctatggtccaaggcaggtccagaaatgccatccaggagccaaggcctggaattggggaacccagaagccctcttggtgctttacccccatggccaagctggtaccctatctataatacaaagcccccttcactcctgcctctcttttcctcaagcaggagtcctccctcaaaaagggaatacacagagtcacacctaaggtcagcatggccctgggtctcatccaaggcctgtggcaagtgctgtgtgagtactgctgatgttgattcaaggctcaagggctctataatcaacaaataatgaatcctgccagtactgggtccttcctttcaaggtagcaggttcccttctggcacggggtatgtctagaaaagtcttctgggagctagggcccgaaataggggccccagaactcttcctgcggccctattctactgtggctaagctggtatccaagttccaagacaaagtcctctttactgtctcctctcttctcctcaggtggaaggaaggcatctcccagagctgtgagctgcactgcttggggttagtggaggggtgacgttagcactcccttggccaccccagctggtgtctcactaggtcaccagcacccaaagttttaatatgatgttaaaaccaggtactaggattgctcacctgatttttgggtcttatgaaggtgctttcttatgtgaatagttgttcagtttggtgttcctgcagggggacagggaaacaatcgttggagggtattatttgactatcttgttccaccttccctcgtaggcttttttcccttaatacagcattttgctgcactccattttatacatttctattatcatttttactcactattaatgaaaaatacattctcttttaattaaaacatgtcaaaccattttaatgtgagccattttaataaacgaactctcctagaaccttgctttgaaattatatactgtgccattaatattgccataatggtaaccagaaatttctgtcgctcacccagctgttaagattttatttgaattttgctttaatgtaaatagaagatacttatttccattaatcttcttttcaaattactcttcagtttatcagcttaaaaagtaccctataattatttttattttcttatgaaaaatagtgttttgggggcttttgtttgttttttcattttgtttcttactgcagaaaatatttcaagcgcagagagctgtgatttattagtatatgatatacagggtacattactttgcattagcaaggtcactattactactctttgaagccataaaacagaattaaaagaaagtggcgaagatgaataaggaataaaaaataagcttttaaaaagagatttaaatctgtttagctttaaagtgggaaggaaggaggcactcattgtactgagagtcaggatacctggcttcatgggctgctgtactgccagtgactgaatcactttagacaagtcactccactgtttcctaatcataaaatgagaggatctgaatagatcaggattcagcaacttttttattaaaaggcagctagtaagtattttaggctttgcaggccacatggcctatatcactacttagctctgatataaatgatactgtatttacatgaataagcagggttctgttcaagtaaaactttattaacaaaaacaggtagcaggccatatttggtccacagattatcatttgctggtgtttatactaggtgatcttttaagatttctcatctgggtgcgatggcccacgcctgtagtcccagcactttgggagaccaaggtgggctgattgctttgagctcaagagttcaagaccagcctgggcaacacagcgaaaccctgtctctacaaaaaattagccaggagtggtggtgcacgcctactcggaaggctaaggtagaatcgcttgaacctgggaagcagaggttgcagtgagccaaaatcacaccactgcactctagcctgggtgacaaaatgagaccctgtctcaaaaaaaaaaaaaaatttcttttgcatctacattctgtgatattgctttattatcaacatcatgtatatgaaagggactggtgttcaattcttttctatcctgtatcatttaggggccagtcaggagacataaaagcatacttattttaacagaataagggttgaatttgataatataaataattgttggctggtcacggtggcttatgcctgtaatcccagcactttgggaggccaagttacaaggatcatttgaggccaggggttcaagactagcctgggcaatgtggcaaggccctatctctacaaaagaaattgtttttaaatattagccaggtacagtggtgtgcgcctgccttagcctcccagctacttcggaggctgaggcaggagtatggcttgagcccaggagattgagactgcagtgggctgtgattgtgccactgtactccagcctgggtggcagagtgactagtttatctcaaaaaagaaaaaaaaaatcattaactaggtttaaagaactgaaaaggtagtaagaaaaccttgaggtatcatggatttaacaactgcaggaagtagttaccacctgtggacctgaggaaacaaaaagaggcaagaattattaaactatacaagattggaagaaaggcctcacaaagctgacacttacatctccatgaaggggatcctgctcagctgaggctaatacaagggctccaagaagggttctgtggagattagacccagaccactaagaacaaggcactggtcacccagtgccagtatctgaagacgtgagatgaggttagtcccgcctcccttggaaaaactgcaaactagattcaactgctgctcctggaatgaactgccaatgcttggctgaacaagtaagactagggtaatgctgataggaacaggaaggggcaaattatttctccagtaaccttaacaattaacaaagtccacctttttggctaaccagcatccatactcacccttctatatttatttgagcttccaaactatacatgtttgaaactccaaacattttcagcacaacaaactctgtattttaacctaacaagatggaagtatctttcatgtaattgaagacatatttacctctccaaaatgaggctagttccaacagtcactttaactatgtttagatgatataacactatccatctctggctatgttaattattcctcaaactctgacacagtcctatctgaatggtttgttatctaaaaactaaattggaaacttaatttacatcaaaacttgtatttataaaataagggaaaggaggcgagaaaaagaataaattagtataacacacacacacatatataacaaaagcaaggaacaaaatatgcatagctgctatagtcgtcatttctgtagctagttatgaaactgagattgattttttttctttaagagacaagagtctcactctgtcgcccaggctggagttcagtggtgctcactgcagcctcaaactcctgggctcaagcaattctctcacctcagcctcccaagtagctagcactacggacatgcgcactatacccaatcagtttttttgtttgtttgtttaattttcagagatgaggtcttgctttgatgccccggctggtcttaaaagtcctgacctcaagagatcctcccacctcagccttcttagtagctgggattacaggcgcaagccaccgcacccagctgatatttgtaacttttttcatctactgcctatcccatgtgtcctttgccctaagccaggaccacatctagtcagggttctttccctggtaggatgtcctaagtcttcattcttgatgggtctgaatccctagtagtcctctttttttttttttggtagctacatagatatcgataaagaatcaaacaaaagaaaatagacttcagttaaagcaggaggcattggattaaacataagaaacaactatgggccagggccaccccctgcatcttggcctaaactcctctcaacccccaaaaaagaaagaaagaattcatggaaacattagaacagcaatagggatggttttgtcgttgtccctaatgttttaaaataagacattagatacctcttctgggtagttttaacttcagaatgctgagataaagattttttttaatacttttgctactcttttactctctctgatgtaaaatgtggcatctaacttccctttcttagtttaagttccctaaactagctttcaaatacttatttctttatagaaattatatctacaatttggataaattcctttagctgggtttccagtagacctagataactaagacgggaaacataaagcgtgtgtattgttaagcacattttaatcggctcttatcatagttgagcacagagaagaacattaacgttattaaatgtaaaactctatatattaatagtgatgagctgactctgaattttcagcctgccaagaaatcttttaaaaagagcttttactgcaaatcttgcttatttaagatagaaaagtaggataattatatattataactaaatgaagatcaaataaaagcagagatctagagcagacaggacacatcctggcaatctttatgataactggtccaaagtgtcagtaaaataattgggcatttcagagttatattataaaagttggttcaaacacttaattataaaaatgtcttttgaagcttaaagtaccataaaatgtgccaattatatttcacagaatatcactttgatttctctgtaaatcaaatctgagttgtttattttttgttgtatttattcttgaaattagctgattctaccttttaaaccaaagaaagctagtgtaatctaccatgttatagaacaggaaagaattttcctctgcctttgtagatgcagtacaaaagaaagtcagcaagcctgttcttgaaaccatactttacccaaacagcccttggtcccctttcaacaaattaatttaataagcatttttgagcacctattttatgccaggcataatgcatttattgagaatagaatgtaaataagacatagtccctgctcgtgtagagctattagaattctacagcctaagccatactcagatgttgaaagatcgacaggtatatcactctgctattggtacaataatgctgtgtaacaaactatacggaaatataacagctcaacataatcatttatttgtacccactcatctcaggttaactatggattgattggtctaggcagtttggttaggtttggctccaagctggagactggctccagatctaccttattctatcctccttggaccagtgggctaactggacatattctttcataatgttggcagaaccaaaaaagacaagcccagttctacaaacacattttaaatccttccttgtatcacatctactaatataccattagttaaagcaagtcaaatgatcaaacccaaagtcaagggcagggaagtgtactcaacctctgatgggaattactgcaaaatgggattcagggtctggtggtgagaactgcaaagacagatgagaaagagcatgtatataggaaaggctgaagaactgggggcagtatttcagtttgctccaggcatgttttggggagcagcaaatgcagagataaccagtagctcccttccactgccttttttggactattatgaccaagcaaaatgccagtatcaccagagtgtttcacctcgcctttgcaaggagaaactgggttatcattgtgtcttgaatgttgagaacttggattgaaagcttcattgtaatattaaacttatttaattgagtaatttggggagatggtataaagttaaaagatttctcaactttttgtgttgagaaactacctatttttatagtagtgtatatggaaagtaaactgctaatagtgtgtgtggcttgctggcattggagaggcacaggaaaagagcaaagaagtcattaccagcctgggcaacaaagagagaccctgtctctacaaatagtaattttaaaaaattagctgagcgtggtgatgcatgcctgtagttccagctacttgggagtctgaagtgggaggagaccctgagcctgggaggtcaaggctgcagtgagccatgactgcaccactgcactctaatctgggcgacagagtgagacttcgtctcaaaaaaaaggaactcattaccttctcctgttgccaacatcactcccaaatatatttaccatactctaaatgtcatgatatcaagagtttactctgttagaatagtcgcaacagtttctgagctctgtgtagtccttgggcagaggaagatttttggtgaaagcttctgcttagaatcagttacaggttgagtattcctaatctgaaatgctccagattcataagtttttgagtgctgacctgatgctcaaaggaaatgctcattggagcatttcatatttcagatttttggattatgaatgctgaaccagtaagtataatgtaaacatttcagaatctcccacaaaattcaaaatttaaaacacttctagtcccaggtatttcagggaagggatactcaacctatatcagtcttcttaatcaactgacttgtctccctgggccaatggtatggcctctgtttgggattaatgacccattttcagagctgctgtggaatacatatgaattggaatctatatctgtgaaaagtaggatatcctaatacaaaggactcatataatgactaatgttttgtaactacttagtaagtgttttaggtaatatttatgttcaaaatatccaggaaaggaagggagatgatgcttgtagtagtagttttagtaaaattaggggaatagttgtgctcagactctcctaatattattatcttcatatgggagaggccaaaaattacccatagggattcttagcaaagacatagaaatcttccaagcatctctccaggcaagaagcccatgcatttctcttaagagactagacagaatgtcttcattgttacactttctgttttttttttgtttccctttaaaataaaagccataattcaagaaaagcatgttgcacactacccagcacattacaggtgtttaataaatacatgttcattccttttagttcttttcaccttagtaataaacttttaaaaagattattccttcttctttttgatataagcagaagaatcatctgtaccatcaagagaaagagagggtaagaggtagagaaatagaaccatattgctaataacaagagttatgcaaagttgaaatatggtgtatcaagagatagtgacatgttcaggcataagctatacaactacattgaaaaagataacagagttgagcattgcacaggtgttggatgggatagcccttaaggtccattccattcctgtaattgtaataaaatattaataaaattttaataaatttttaataaaatattcttttgactgctatctgctacattctttagtaaaatgtttccttgctcatcttttttctttcctatacactgattagaaactatggtaaaagtattgttacggcacagtgctgacatttttttactaacaattttgttatatttgttaaatgaatgaacagattaacaaatgaatatcagtacccaatgtcaatcatcataaacaacttatatatgaggttggagatgtaagtttacttactgtcataattcttgtttccttatgctgagggaattctgagctgtctccccttccttttttgcttcttagtttatattgaagagcttatttataatcagctatttggtaaggtagtatatatcattggtggcaaaattggatttcttgattaaaattttggattataaagtttttgaggcaaatgaccatgtaatctcaacacatcatacaatacagaaatatactccccaagtatttggtggcaaaacatttgaggcccagcagccataaaaagataatcttaggggttttttttccctctcaccaactcaaaccagttgttagtaataagttggtagctaatattttcttcctttttttgtggtgttattgttgttgttgtttgaaacagggtctctctgttgccaagtctgtagtgcaatggcatgatcatggctggctgcagccttgacctcccagcctcaatcaatcctcccatctgagcctcctgagtagctgggactacaggcgcacaccaccacgcctggctaatttttttgtgcattttttgtggagacagggttttgccatgttgcccaggctggtcttgaactcctgggctcaagcgatccactctcctcagcctcccaaagtcctgggattactagcatgaaccactggtagctaatattttcaaacaataaaatggatactctagtatttcttataatttgaaacatttttgtaaaatgaattttttctttcactcagtttttagtaaaaacccatttactatttcttttgataacaaagaaacttcctttttgttactgtctctgcagctttcatgatccagacattcagaggcaagatggcattttaagcttttggactagcattttgtttttcattttaaatctcaaatctaccattatctatttcttttatgaagtaagggtttatgtttatttgcttagtttgttttgctttttgaataggaaatatttaatccctctgtttaaggttatagaacctcttagcaagcacaggtttattatgtactgtcttaaagtagcaagtgaaatgaagggttaatattttttacaaaccacttatttggatttttaaaggcataaaatacatgtattttatatatattacatattttgcatatatattttttggctggagtaagccctgattccaaagttccggagatacagactagctgaaagacattttctgaacttaaatattctaactaaacttttctttcttgtcagccaccagctctgcccacttggaagaccttgcttacctggatgagcagagacatacacctttgagaacttctctacgaatgccaagacagagcatgggtggtgctcgcacacagcaggatttaagaggttagaaccacagaagggctttaagggtgcccgggaacagatggaaatgggcaaaagccaaaaagttgctttgtctcctattcccatacttacttaaacctccctaagaagtgaaatgatccattttagcatgtgaccagttcatttctgctgagtctagagaaagataaacacaaatacattgtactcctcatagacaggcattgtgtaattatcaacatttggaagcattagttcctcgaaattctgaaagaaaacagatgtaaaggggctgtggtaatgggggaaataacctttctaagatcttggatttcagaagtgactgcggaccagattcagccctagccatattgcaggtgaactgtgctgatcataatgtacaggttgagcatccctaatctgaaaatccaaaatgcaaaatgcttcgaaatccaaaactttctgagtgccaacatgacaccacaagtggaaaattccacacctagcttcatgtgatgggttgcagtgaaaactttgtttcacaaaatgttgagtaaaattaccttcaagctatgtgtataaggtgtgtatgaaacatatgaatttcttgtttagacccaagtcctatcaccaagatctttcattatatatatgcaaatattccaaagtccaaaaaaatctgaaattcaaaacacttctgatcccaagcattttaaataagggatactcaggctgtattttgctagggaatttttttcatttttgttttagtggccatttctagtaacatgcaatattttattatcttggtcttttagaaagtgcctataatcctggcctagcaagagctacacaacctatccttttctcactcaggtacctgttgccttaccttctttgtggcatgctacatgcttctccaagctggcaccagatctttttaaagactgtcattttgttacagtgatggtctagttgaggagcctcttattggtatttctatgcctctcgtttgctcaaaatgaaccaaactgtctctgatagcttttaacagatagtctcctttctctggtatgttagcaatctctatctctaccacaagtgtgtttttaattttatcttacggatgattttcatctttctttagctctcctcttcaccccttgtcctattccctactctaagcagtatagtgccacgtgcacaattcccatgggaaggaatttatacatgtctgctgtccactctagacatcattatgctaacagtttttcagtgatggctaagcaaacaggattttaaaataattgattgtattgcaacaattaccatacctcccatcaacagcagttagttgatagcctcagtcatacttttagttcccagtccttttgtccatcctgcttgccagttcttcagtttgtcatataccagttgcatggcatatgcaactgtgtgtttacagtccagaaaatggaaatatatcaagcactattttagactaattacatctaaagtctgaataaagttgatcaagagaccaaataattgatttgcgccccgaccagaatgcacagccgtaataaagaagattggacagaactactgatctatatggaccttcagatttgattgaaaatctgccacattggcatcatcttccatcttattactaaaaaacatactgacattgttgactttattttctgctttactaatcattgaataatagatgttatactacatagaaaacaaaattatttgacagatttcagcagtgaaatttttgggaaacctttatattgagttctgttgatatgtggtagtacctatctgcttgtagtatctgaagatttaataaggtctttaacagatacattctggtgagcttgatgtttacaaataccagttttatctggaatgcaacaaagatcttttccattgcattgatcttcagccgaagcattcagtgaaacaacaaaagcacattcaaagattttcccaaagctcacctaaatctttaggaagggctctgactgaatattgaatttctaaaaatactaatttcatattccttgcaaatagtgtcttaacttattgtttacattaatacttaggctggagtttgtccattgatgaagatgctatgatgttagtatttcagttccttgaagtcatctttatttttcaagagctttccttttagcagtctaaacggttagaacatgccatccagctgggtacattgatccataaaaagcaaggtgtttacttagcagtgtaaagtatactaaaactagtaataactttaattcagaattttcagaatttagagtccctgaacaataatcctctctcaaaaagtaacatgttatcttaattattgtttacagatgaattgtatggcttaggatacgacttaaaacacattatcaagaaaggaaagcaaacttgggcagataaactttccttatgtttcttcagacctgcttggcaagcctttataatatgtgattattatatccacaatgttgtactttatttcagaaaaaatcagatttgttttcctggaataatttttaaaaacatgtcacatcatgctttctaattttatttaaaggaatgtacaaattacagtcatatttcagtttgacatatttttcttctgattatgattaaaatgaaactacccccaaaaaagtaatgaaatgattgaaaatcttttttagtctgcattaaggtatatctttccactttagaatagaggtgtatctttcatacattttaaaggagtactctgacaagttctgtgaaataggttttttttaacttttaagtttaggggtacatgtgcaggtttgttatataggtatgagtcatgggggtttcttgtacagattatttcatcacccaagtattaagcctagtatccattcattatttttcccaatcttttccctcctcctacctcctcccaccagtaggccccagtgtttgtcattcccttttatgtgtccatgcgttctcatcatttagctcccacttacaagtgagaacatgcggcatttggttttctgttcctgcattagttcaccaaggataacagcctccagcctcatccatgttcctgcaaaggacatgatctcgttcttttttacggcttcatggtattccatggtgtgtatgtaccacattttgtttatccagtctaccatcaatggacattgaagttgattccatgtctttgctgttgtgaacagtgctgcagtcaacatatgtgtgcatgtgtctttatgataacaatttatattccttcgaatatacccagtgatttcactggattgaatggccgttctatttttagatctttgaggaattgccacactgttttccacagtggttgaactgattgtggaaaacactcccaccaactgtgtataagtgttcctttttctccacagcttcgccaacatctgttatattttggcattttattaacagcctttcagactgttatgagacggtatctcactgtgcttttgatttgcatttctctaaagatcaatgacactgagctctttttctttttttttttttttaattttgctttaagttctgggatacatgtgcagaacatgcaggtttgttacataggtatacatgtgccatggtggtttgctgcacctatctacccgtcatctaggttttaagccccgcatggattaggtatttatcctaatgctgttcccacccttgccccccccatcccccaacaggccccagtatgtgatgttcccctccctgtgtctgtgtgttctgccattgagctcttcttcataagctggttggctgcatgtttgtcttcttttgaaaagtgactgctcatgtcctttgtccattttttttaatagggttatctgttttttcttaacaaattaatttaaatttaattaattaaatttcttaacttaaagttccttgtagatgctgggtattagacttttgtcagagacatcgtttgcaaaattttctcccattctgtaggttgtctgttgactctgttgatagtgtcttttgctgtgcagaagctctttagtttaattggatcctgtttgtcaatttttgcttttgttggaattgcttttggtggcttcatcatgaaatctttaaatctttgcctatttctttatccagaatggtattgcctgggttgtcttccaggtttttatagtttggggttttacatttaagtctttaattcatcttgagtgaattttcttatgtggtgtaaggaagggatccagtttcagtctttgcatatggctagccagttatcccagcaccacttattaaatagggagtcctttccctattgcttgtttttgtcagttttattgaagaccaggtagttgtaggtttgcagtcttatttcctggttctctattatgttcggttggtctatgcgtctgtttgtaccagtaccatgctgttttggttattgcagtcctgtagtatagtttgaaatcaggtagtgtggtgcttccagcattgttctttttgcttaggattaccttggctatttgggctctctttttggttccatatgaattttaaaataattttttctggttttgtaaagagtgtcattggcagtttgataagaataacattgaatcttaccaattacttttggcagtatggccattttaacgacattgattcttcctattcatgagcatgaaattttttttatttgtttgtgtcatctctgatttctttgagcagtgttttgaagttctcctgatagagataattcacctacctggttaactgtattcctaggtattttattctgaaatagttttttaatcacaattctggttttaaatgatcctagagatggtagttaatgcttatatacactgtagtatacccagtagataactaagtttattgactgactgatttcaagtgtagagagtgtctgaaataatatcctctggatgtatgtccaaagaacatttgaggtgacaagccatgcattgattgggaacttcatataggcagaatcttgtactattctgttaagagcagtgtttctcaaactttttggtcccgggagccttttatactcataaaaaaattacacaggcggctatggctgtccctgtaatcccagcaccttagaaggccaaggtgggaggcttacttgagccagaagttcaagaccagcctaggcaacataggcaacatagcctaggcaacaaccctgtctctacaaaaaaatttaaaaattagccatgcatggtggtagtcctagctactcaggaggcagaggtgggaggatcacttgagcctgtgaggccaaagctacagtgagccatgagccattattgctccactgcactccagtctgggtgatagaaggagaccctgtctcatttttaaaaaattattgagcttatatttatatgggataaattgatattatcatattagaaattaaaaataatatgttaaatatactttgtttaaaataatgttttaaaataataatagggattgttgaaataactcatttattcatttttttataaataatagacccattacatgttaaagttatgtaagctgtggaaaattccactgtacacttgtgaaagaatgagagtggaaaaaggcaaataacctcttagtactgtaaatatagttttgactttgcaaactccaagaacatatctcaagaatctagggatccccagatgacgcttttattttattttaggatcacaatgtttaaaaacaagttttgttggctctacacctccaaagagctcccaaatccaactacttttcacctccttcaatactgcctctcactgagactattgcagtaggcgagcttagtggctctcacagtgtggtcctgggaccagcaggagtggcattatctaggaagttttcagaaatgcagattctttagccccattccacacctactgaatcagaaattctgagaatggggctggcaagccgtgtcttaaaccttgcaggtgattttgcagatcacacttttaaaaccactagtttagaggatgtcattgtaattgaagataagctttatgcctcaaggtccatcagtctatttacaaaagtgcaaaaatgcgtagtttgagagctggttacatgttattcatgaacatgatttaacaatacaggcataattaatttaacaggtgccttaatagtaactgcagttgtttgatgataatggtagtcttttgactgctgaagcagaagttgggataacatctccaagtgggatattaacatcaacattgcttcattagttaaaaagtcctttttttttttcactcttcaagacagctgttttgaacaactgttctacaaaaattgatatttccagaaacccggcccaacgggggagaggtcatgtgagtcaactgtccaaagcaacttaacagattcctagctgtcaaccatccaagagcttgaatactaatgataaaagtcatagaagattgtgtactagtacagagtatatagctagctaacctactacaagcgccttttctagtcccaaagcctaatgtctttgatagatattaatttgaattaatttaactaataaagtttttaacttaaaattttaaaattaggctaggcatggtggctcacacctgtaatcccagcactttgggaggccaaggtggagggatcacctgaggtcaggagttcgagaccaccctgggcaacatggtaaaaccccatctctactttaaaaaaatacaaaaattagccaggcatggtggcgtgggcccatagtcccagctactcaggaggctgagacttaagaatcacttgaacctgggaggtggaggttgcagtgagccaagatcgtgccactacactccagcctgggcaacagtctcaaaaaaattgttttaattatttttggcttcatgtttttaaatttaatcaccattaggttaatgtggagttatgctaaaaattatccacctgaaaatgtccactctttctgatcatcttaatgaaagctctctcattccgcagagaaagatagaaactaagtttgctgcctattacaaggaaggaagaaatagtttatttttatggataaatgtaataaatcttatgatggattatataaagggaaccaggaggagttaaaatatacaaggcaaattgtagcatagtgactttgaatggtagctacgtgggttaaattaacaacaaattattaatattgagaccctaacctgcctggtcttaagttacaaccacactcttctacttgaagaaattatatattgctaattaaaacttcatttctcaatatatggtggtttccttagaacttttactaaatctcattacataaaaagccattcagaggctttgtgtttagttattagctactttaatagacactaggttggagggcatatgtacaaatgatagtctgattcattggcagaatttatgtgaaattggccctgccacagttaacttggttttatcaaagcaataaatttaatttttatcaaatctgtgcttcacaccatttatgagtcccgtactgttctgaaacaatgaatcctttatgatgatgactaagatgcatgtcatgaagctaaatgctcttacattagcctactgagtcacacatccctgaggttgcttagtcatcttgatcattgcctggctggctctcacatttacaagggaatatttccatcagtcttttctacctcattgttcattatttcatccctacaagtaagattaaattttcttaagtagattcaaaacccaaggataaggttgcatgcacataacttcctatagtaaatattatatgggtagattgtaagttttagttgtatgaggttgttcccctcacccccaaccagctcttctgcagagaagactgtgaagtaacatgaacaaaactctcatcatgacatctaactctgcaagatatctcactggaaatactttaaaatgccttgagtgcagtaaagaaaaataacacactcttaacctattttgatgttttgatctaaattaaagaataaacttcccaattaatcttattattttcctcaaaagtgactaggtctattaaagtaaccataatgccaataaatttacttagataagactttgcaaaaaaattttgtaattcagtaaaatgatctaagttttttaatcttgtagtatataaaaggtttgttgtgaaataacttccccagatgctcataaaattacagaactagatgatttcattttaaggccacaaacgaaaggctatttcatcaatgagagttcactttaaaatgttttatcttaaatttcaacgaattaaaatacccagtttttatattcccaaaaataaatgttgtatatcaccttaaaagccaacactctaagagcacaatacttaaaacaactgtattgccatagttataaatattttatcaaatatttcctattttaaaacctttactgttttatgttttctctacattttcaggtattaaatgtgaggaagcatataaaaaagcagcaacctttgggagaattgggttttccctttcttttttttttttttttaactgttctccaaagatctttgttctctttctgaaaattccactcagcagtgactgcagatttttctcaacaaatgttttcccataagaccaatgtcagaaagctgaaatttaatatggaagttattcaaagattcaaagtaagatttttttcagagtaaaataagccttcccccttttttatccccacattaatagaaggcaatggactttttaaaacactaagacaaatgttaacagtgagacactcttcaaaaggtgtaaaagtgatagcatacatttattggagttcttactctttgtgggcacagtgcttagagctttaaacatattcttatttaatcctcacaactctttaagtagtggtaataaggaaactatgtcatagacaacttaatataaaaagcaatcggtaatacagtaatagcagtacattggcttatggtagatactctgtactctgcggtattggagatggcaaagactgttgaatatttcagcaggagctgtggtcagagaggatacttgattcattcacccaaaccagcttcgactcctctcttcctaaatagtacttcagttttcctctcacttgagctttaaatcttggagtcagcattgaagcaccatctacattatctcctatatgcagtcaggaccagaccctgagggttcagctctcacagagtttctcacattctttccatattctccattctcaatattgctaattagcttgcctccctcctctggtctttccatcttcttctttttttttttttttaacttttattttaggttccggggtgcgtgtgaaggttcattacataagtaaacttgtgtcacgggggtttgttgtacagattatttcgtcaccccggtattaagccgaagacccatcagttatcttttctgcttctctggtctttctgtcatctaatcagtataatgcctggctgccaaagtaatctttctaaaatgcagctcagaatcatgtcatttctctgtcttaagttatcattgccagcatccttgttcagttagtgtgcaggaatagaaattagcaacatttaaaagcagttttgaagaaaacaagttacagtttattacctttaaaattaactcattgatacttaagaaaagctaaaaaaaaaaaatttaaagaatagacactgccagatggacaatgaaatggaacatgtaatggaaaagaactaaaggaacagagatagtaagataatgtataagaacatgccaacacaatgcttaatgaattttattaattcagcaaaaaaaaaaacaaagactaaaattatttctatgccagatgagtcatcagtatttggcatcagtatttttagtacttaaaaagaggtaacaggccgggtacagtggatcgtgcctgtattcccatcattttgggaggctgaggcaggaggatcacttgaggctaggaattcgagaccagcctgggcaacatagtgagacctgtctttacaaaaactttaaaaattagccatgcacggtggtacacgcctgtagtcccaactactcaggaggatcacttgagtccaaggctgcagcttcagtgagctatgattgtgtcaccacactccagcatggctgacagaatgaggacctgtcttaaggagaaggataaggagaagcaacagagtaacaaggcaatctatggaataggagaaaatattttcaaaccatgtatctgataggagttaatatccagaatatataagaaactcctacaactcagtagcaacaaaacaatgtttaaaaatggacaaaggacttacatagacatttcttcaaagaagacatacaaatagccaataggtatatgaaaaaatgctcaatatcacttattgtcagggaaatgcaaatcaaaaccataatgagatagtacctcacacctgttaacatggccattatttaaaaaaaaaagaaagaataacaagtgttggtgaggatgtagagaaattggaaccccatacactgttggtgggaatgtaaaatggtgcagttgctatggaaaacagtatggaggttcatcagatatttaaaatagaactgccatatgatccagcaatcccacttctgggtatttttccaaaagaactgaaatcagggtctcagagatattttcactcctatgtttattgcagcattattcacaattgccaagagacagaaactacctaaatgttaaaggatgaatggatcaagaaaatgtggtctatatatcaatggaaaagagatcctgtaatatgctacaatatgaatgaaacttgagaacattctgctaaatgaagtaagccagtcacaaaaggacaaatatgacatgattccacttacatgaggcatctaaagtaaccatcagaatagaaagtagaatagtggttgccaggagctgggggaaagaggaaatggggagttcctgttcaatgggtataaagtatcaatcatgaaagatgaaaaagttctagaggtctgctgtacaacattgtgcttatagttagccatgctgtactattcacttaaaaatttaagagggtagctttgtgctttaattagcctctccccctatggaagaacaaacatcaggagtaggcaacagatggcactgaaacgtgaaggtgaggggaagtccatgatgctgccaagactcctgaaagtgattgagaaatgtgtaaagtgaaaagacttgagcagagttcgtcatcaagaatgggaagacaggatgaaagcatgaccatcactagcatttactgagcatttactatgtaccaggtttcatgctaataactacattatcatgacagccccatgaggtatatgtatccccttttacagagtaagaaatcaagatggagagaggagttaagtaatttgcaaaaggtcacagagttgttatgtctgagcatataacctaccctgatataatacctgtggttaaatgatcttaggggctataaattagaaacagaggattgtgacccaaaggagaggtaaattaagatatatagagagtgtagctgatctagtaaaaggaaaaagctctaagccttgctaggaaatactaaactcctgaaaccccatgcttttatatagcacctgtcatatcacataatgttttcaaaggactgaaagtcttagactaggtgcagcaatcctcactggtgagcactgtacagaaaggacacctcaacaaggaacatagtgttttcaaaaataaactgattgttcccaaggagtcccccccacccatttttaacttttattcccctatgtcttatgagtgagataaaagttttagatcaaattctagaaaggtcttagattgagaatcatcagctctagagagttcttttcagagacatgcctgacttcattgaccctgttttttacgaaagattatggggaagtggggagaaatgaagtggcaaagggattctgtgaaggaacaagggaaataacatttgagtcatggttagttcatagtcagtatcactcaattctcatatgtttaaaatctgattcacgtaaagctttttttagcactaagaaagaatcttaaagatttcatccaagtcctttgtttcacatttaatgaaactgcctccaaaagcagttaattccacttgcccagggtaatagaataataaaccatgaactagaatccagatctaacttagttcatttctctcttaccctctccacgattctgttacactctcgaatttcacagatttgccaaatctcaggatgaaatgtacttttcagtctaaatagttaaaactaaaccccagatatgttttttaattgttgggtaaaaaagtaaaacctagtttttttttaattcagtttaggtattgacctactctctatatagaatagactgtaggctgccaagtaaatatcatatcttcttaattattgaggatgtctgctaatagtgaaggttgatcctttccctcctctttttaaaagagttgcttttttaagagtccttcccaccatcctttgtagtaattaattactaagatatgatgaaaatatctgtctcctagcttagtcacttttgttcttgctttctcccttttttctttccactaaaaatgacttgtttaaatacatctgttacttctttgtctgattctgtttattagcagaaatctgatagggttagaaaaattgctaggtagattttatgtaatactgatctatagggacaggttgctctgctgaatgcttctggaacttcagtaggtcttttttactttggctaacacctacctataaataggtagctatactggctgtactgtaagaactacttgctgagaatttttaagctaaaaatattcctctcagagttaatgaggtaaaatcatcatctggcacctctggcctgacaaatgaatgcgcactttgctaaagcattttaaagccataataaaaacatgtctgaattccagcttttgttagtggaagaattgcctttttggactaagccttccatggataacaattaagaattatgaacaaaatacaaaaaataactatttgaaggcactggagagtggcagaaagcagatggaagtgggaagtgagtttacatttgaaatatagggaccaaaacttatatttggaatataaggacaaacttgtattttcaagtttgtagcattttgcttaaggactctttccaatctgtggatggcttcaggtggcagaaagccacagctttacttacttgaagtatcaaaggacagaatcccaaagctggcagaatactggaaagttagcaaggaatttctaaaagaaagggagctgcagaggcggtaggtcccaaaatgtgtgtgtaagccttgccccagatccttggctgactactgaaccatatatgtatagaagaaatcctaataagctctgcaaataaagaaacacccagaagctgaaagaacttttcagctgcttattataaccgaagagaatttgaatccggctaagttaacttgaacaaaaatcagcatacttgaacaaaaatcagcatacttgagaggaacataacagaatccagaggttctaaaatgtatctgttaaacccagtgtaattgaataatgtatcccaaaaattcaggtccacccagaatctaagaacgtgacctttttggaactaagaccttgcaggtgtaattaaattaaaatgagatcacgctaaattagggtgagccctaaatccaatgacggtattttttaaaaagaagagaagtcacacagaagtacacaaggaagggggccatgtgaatttggaggcagaagttggagtgatagagctgtataagccaaagaacaccatggatttataggagctaccgaaaactaggaagagggaaaaactttcttgagcctcagagggagcatggccctagggacaccttgattttggacttctagcctccagaactgtgagaaaataaaatttggttgttttaagccacaaagttagtggtaacttgttatggcagccctaagaaattaatacacccaatgtagtaaaaaggaaggaaatattataataaagataagagcagaaatcagtggagtaagaaatagacaaacattagcaataatgaacaaagccagaattcgttatttgaaaaaataaaatttatgaaccccataaataaaatttatgaatcttaatattgcttaagaaaaatgggagaaaacacaaattactaatatcaggaatgaaagaggagatatcactacacattctacagacatagaaaggataataagaaaatataaagagatattatatatgccagtaactgcaacaacttagatgaaaataacaaatttcttgaaaagcacaacttaccaaaactaacacaaggtgaaataaaatatctcagggtctctatttcctttgagaaattgaacctgctatcagaaaccatccaccaaataaaacttcatgatcaagtggtttcaccattgaattctatcaaatatttaagagtaggtggctagatcatctgacaggtatatgtttaactttttaagaaactgcaaaatgatattcaaagtggttgtatcattttcgttctcactatccatgtatgagagtttcagttcctccccattcttgttggtacacagcgtggtcaatcttttaaacttttgatattctactactatgtagtgatgtctcactgcgcctttaatttggatttactagtaactgatattgaaaatcttcctgtgcgcctatttgctatctgaacatcctctttaagttgtgaaactttttttatctagtttggatgcacgtcctttaacagatacttgatttacaaatattttttcctcgtttatgacttctcttttcattctcttaacagtgtcttttgaagacagaagtttttagatgtccaacttgtgaatttatgtcttagaggactggccttttagtgtcgtgtttaagatttctctgacaaatgaaaggacacaaatattttctcctagaaattttgtagttttatgttttacatttaggtatctgattgattttgagtaaatttttgtatatgatgcaagatatgtgtcaacattctttttcttttcggtttcttctttttggaggggaagatacggatacctagttgttcccgcaccatttgttgtaaagactattcatctactggattccttttgtacctttgttaaaaattattcatccatagatatatagttctatttctggacttctgtttcacttatctaataatattctgtattgatactaataacatactttattactgtagctttatagtaaatcttgaaatcatgtcaacactccagtcttcttttttagagttatttcagctattctagattctttgcatttccgtgtgaagccttataaatttctacaaaaaaaaaaactgctagagtttttatggagattgcattggatggatggatggatggatggacagacgtacagacagatcaatttgaggggggaagatagataatttgggagaaaattgacttatcagtattgaatcttccaacctatatagtatatctctgcagtcatgtagaccttccttaatttctatcagctgtattttctagctttcaatgtataaatgttgaaaatcttttatacttatccttcagtatttcatatttcttatgctattgtaaatgatattgcttttagcttaatttctaattgttcattgccaatatatagaagtacaattgatttttaccatgttgctcttgtatcctaaaaccttgctaaactcacttatgagttctaatgactttttttaatagattcagtaagattttctgcatagatgatcatgttgtctgtaaataaagataatcttagttcttcctttttctttttcttgccttattactctgactagaactagtacaatgttgagtagaaacaaagagagcggaaattcttgctttttcttggtcttaggtggaaagcattcagtctttcaccattagctatgtcaatatgttctccatagatgttccatatcagattaaggaagttctttgctgttgttagtttgttgatacttttttttcaatcaggaatttatattggattttgtcagaattcctcaacatcaatagaagttatatttttcttttttagttaaacattgcaaatcacattgattgatatttgaatctaacttcgcattcctaagagaaaagctacttggtcatgactttttaatatattgatggattcaatttgctgcaattttgtatttactgttctgtatttatgttcatgagagatactggtttctagggttttttgatgtctttgtctggttttagtatcatggtaatgggaaagtattacctcctctttacttttttttaaagcatttcatttgcgttccattcaaaatactttcaaatttgtcttttgactttttctttgatttacatgtatttatttctggggaacttccagatatatttctgctatcgattccaagtgtaatttcactgttatcaaagaacatgctttgtatgacatgatttcttttaaatttatacagaattttttacggcccaaaatatagtctgtcttcataaatgtttcatatgcaattgaaaagaatttgctattttacagtagacacttctataaatatcaaataggtcaaattgtttttttcaagtcttctatatccttgctgattttctacttgttcgcttaattattagaagagagacattgaaatctttagctgcaaaaatggattttgtggatttctgtattattccttgtagtttttgctctttgtgtttggagctttgttattagagcgtgtatttaggactgttatgtattcttgatgcactgacccagtgatcattagggaatgacctttttttaatccttgatgatactctttgctctgaaatcactttgtctaataataaaaaccactccacctttctattatttgtgttagcatatattagttatctttgtccatacctttaattttagcctatttgtttatttatatttacagtgagcttcttattagcatcatagtgatgggtcttgcttttttatccaatctgtctttggcttctaattgaaatatttagatcatttacttttttttaattaggggaggtttaaatttatcttcttgctatttgtttttcatttatcctatctattccttgttctcatcctgcttttctctattttgctatcacattttgattatttgtatatttttatctccttagttaattagctgtactctttgttattgtttgttcactgtatcatgtatactatgtaggtttaacttattacagtgtacccttaagtgatattacaccatttcatgtatagtataagagcattacaatagttatgtcaggagtgcccctcagttcacggattccctgggaagactcacaggactcaacatatagtcattcccacagctatgctttattataatgaaaggatacaaaggaaaatcagcaaagggaaaagccacatggtgcaagtctggaggaaattagacacaagcttccaagtaccctccccagttaagtcacacaacatacactcaattcctccagcaattagttgtgacaacatgtgtgaaatattgtataccgggaaaacgcattagtgattcatgacccaagatttttattggcgtgtggtcatacagacccccaccttgcctaacacataccaaaattccaggcagccagaaggggagcaggtaaaccacattgtttatacaaactgtttaggtacaatgagccgttcttaccagttctgggaatggtaagaaccctcctgaaatccaagttcccagactcctgccaagagtcaaccttgtaagcaagctttctgaggggagcagcctcagacctgttatattaattatttctgcaccatgtatatttccatttgtcccctcccaacttctatgttgttgttgtcagacattttacttatataaatgttatataccccacaatacagcagttagttatcttttaaagagttttaaccaataagataaaaatcttatgtatttatccatgcgttaccatttctggtgctcttcatttctttgtgttaatccatatttgcatctgctgtctttccttctgcctgaaggacttcctttaacatttcttgcattgtggatctgctagtgattaatttattcagcctctatatgtctgtaaaggtctttattttaatatgatttttgaaatatttgaaagatgttttcactgggtaaagaattctaagttgacagattttttttcctttccataatttaaaactacagatccactgccttctcacttgcattatttgtgacagggaatctgctgtcattctttcctttgttcctctgtacttaatgtcatttcttctctagctgcttttaagattttctctttatcactgttttgatcagtttgatgtgccttagtgtcattttattcatgtttcttaaacttgaggtttattgaacttcttggatcagtgggcttatagttttcttcaaatttggaaattttgtagccatagtttctttaaatgtatcttctttcccccaccttcagagactgcaattacaactatatttgtccacttggagttatctcacagttcactgatgcatttttattttggagggtccctctgtgtttttaattttgtatagtttctattcctttgtcttgaaggtcattcatcttttcctctgtaacgtcaaatgtgtcactaattctatctagtgtatttttcacttcagctgggtgtgtgtgtgtttgtttgtttgttagttttgagatggagtctctctctgtactctttgttatacacccagcctggagtacagtggcgcaatcttggcccactgcaacctctgcctcccgggttcaaatgattctcttgcttcagcctcccgagtagctgcattacacccagccgccaccacacttggctaatttttctatttttagtagagacagggttttgctatgttggccaggctggtctcaaactcctgacctcaggtgatctgcctacctcagcatcccaaagtgttggaattacaggtgtgagtcactgcacccgccctcatttcagatgttctaattttatatctagaagttcaatttgagtcttatagcttccttgttcataccttttgagcatatttaatacagtaataatctgttttaagatatttctctactaattctaacatctgtcttatttgtcagtttcaattgattgattttgtttctcctaaatatgaatcatattttcttgcttctttgcatacctgataatctctttttggttatctgatgttgtgaattttagcttgttgggtgttagaaatttttgtattcttatacatattcttaagcttttttctgaaatgttatttgcagacaatatgatcagttttctgtcttgccttaatcatttgttaagcaggaccacagcagcatgtattccaggtctaattgtttggtacttctgagataagacccttctgagtattctactgaatgtcctgtatatattttttttttttttgaggagtctctgtcacccaagctagagtgcagtggcatgatctcagctcactgcagtctccatctcctagtctcagcaattctcctgcctcagcctcctgagtagctgggactacaggtgagcaccaccatgcctggctaagtttttgtatttttagtagagacggggtttcaccatgttggccaggctgggtctcgatctcctgacctcaggtgatctgcctgcctcggctccccaaagtgctgggattacaggcgtgagccactgtgcctggccgaatgtcctgtaaatttttccattctggctggtaggaacaggtactatttctggccctatgtaagaagcagatacttttttttctaatcttggatagatcttttctcagccttggatagtttcctcacatacacatgccagtgagtactccattgatttctcaagggttaatttccacagatctccagaattatttctgcacagctttcttcttcccagaactctgtcccttgaattctcactgccttggtctcctgggattctcagctccacctcctcaagtaagggaatgtgtcagattctgactgggttctctctctttgcattgtttaatctctgtgtattttggaattttccagctatctttctgttattggtttctaataattccattgtgatctgagagcagatattatatgctttctattttaaattcattaagatctgttttatggttcagaatgtggtctggtttggtaaatactccgtgtgaacttgaaaagaatgtgcattctgcccttgttgggtaaagtcatctatggatgtcagttatattcaggtatttgatggtatcgttgagttcaactgtgtccttactgatttttctgcctgttggatctgtccatttctgttaaaaggatgttgaaatctatatatgagatctataaggatcttcatatgtttttggagaatttacccctttatcattatgtaatacccctccctgttcctaattgttatctgttagatcaattcagaataaaaaaaaaataaaagtttgtatcttaccttcacttattccttctttagtgcttttccttcctttatgtagattttagtttctgacctatattattttcccactctaaagaacttttcttaacatttcttgcaaggcaagtctggcaacaaatttcctcaatttttatttgtccaggaaagtctttatttctcctttacttctgaaggataatttctcagggtacagaattctaggttggtggggttttctctcaacattttaagtatcttactcccctctcttcttgcttgcttggtttctgagaagtcacatgtaattcttatctttgttcctctatagatgaggcattttaaaaatctggcttctttcatgatttgttctttatcgtagtttcaaaatgatacgcctaagtatagcttagggggcatttattatggttgatgttctccgaccatcttgtggtttgctgtctgatattaatttggggaaaattctcagtcattattgtttcaaatatttattctgttcctttttctcttttttctccttctggtattccccattatgcatatttacaccttttgtaattgttccacagtcattggatattttattctgggtttttttcagtcttcgttctcttcgtttttcagttttgaaagtttctgttgatacatcctcaaaatcagagattctttactctgatttttatctattaatagaccacatacagtccattaatagtcccattaaaggcattcttcacctcttttgcagtgttttttaatctctagcatttctttttggttcttccttaggatttccatctctttgcttacattacccactattgttgcatgctgtctactttatccattagcgcctttaacgtgttaatcatagttgttttaaattccctgtctgtgtgttacatctctgccatgtctggttctgatgctcaccctgtctcttcacattgtgttctttgccttttagtattccttgtgcttttttcttgatagctggatatgatctactgttttaaaggaactgctgtaagtgggcctttattattaatcatgtggtagtgagctgtggggatgaggaagcgttctgtagttcagtaagtaggtctcagttttttagtgagcttgtgcctctgaactgtaagcttcataagtgttcctcaggtattgttttccttcccccccttcagtgggagaggaggactagagtgggagacagttgggtatttcccttctcccacaaggaatgcttcccttcagttaggcactgataatactccagcaggttgggctctggtgaactaggttcccctgagggcaggccttgttaagagcattgtgctttggcatgtttcaaaatggttacttttccccttcttctgctagaagcttgaggggatttttcttcagtatttactgtgagaacctggttgggctcctagaggtaagtcacacaaaatggtggcggcccccatctctgagtgcccctggagttgttaactctcagacttgtccacatggagcctccagcaatttgtcagtagcaagtcaggttttcctaccctggctctggttcccactgcattttccactctggtaagctgtgactccctgactgtactcagtgatttgccctgtgccctcacctcttatggatcctggaattgttgaatttttagtctgttcaggtttttacttgttgttaggatgaagtggtgacttccaagctccttacatgtgaaactggaaactggaagtctcccttcttacattgtggcctggaaatgctttcaaggcaataagtgggcagtcacaggatttgcctcatttgttttccatctgaggaaccactgtttttcattgccttatgtctgctgtcttaaaacctattgtttcatatattttgtgtaaaggtttgtttattgctttaggtgggagggttaatctagtgccgcttactccatcttggccagaagtggaaattcatgtcaaatttttaagaagaatgttatagatggagtagaccagaacataaaccagtgtctcattagaaggtaaccgtcttggtagttagaattaggttctccataagctacaatgcatattgtacttacaataatgaagagttaaatgagtcattgtttacataacaataaacttaacatgtaacattagcaagactttagttactaaatggatggatgtggatccagccttctcaataacttttctaaatgaaagtgagtcttaaaaaaaaaaattcatactgtcctctctaaatactaactctgaggcattttcccccttcccccagcttcctataggaaatactattcaccgattataagtgccttggctagtatccaagtcttacctgtgacatgcacagagcttggaaaatggtttttcttccctctcgttatttaatagtcttcttgtttatgacagtagcctttaaacagggaatgtgttcctgaaagatggcaaacaaatgatttcattttcttttattatatagtacagagcagtgattttcaaaggctgggtttgcatccttaactgtcttcccctagccttcctgttctaccaaaaccaagtctatacacatttctctgcagttgagagtggaaatcatattagctttattcacaaatccgtttactaaacattatggaatgtacataccctctgacaagaactggaatgtacataccctctgacaagaactgtagtaacactaggttggatgattatggtggggtgagttaatgagatgcaagggtagcagtgtagggatggacatcatcatgtcagatacaaatatttggtggctttatacaaaagaaatgtgagagatgcaagattatccattaaaataaaagcaaaacatcttgagaacctaaattatatggctatcattcattgagaacttcctaggttctgattaaggacttaacatacatttcctcgtttaaccttatcaggtagatgctcttattatcctcattttacagatgacaaaacaggcttagagtgaaccagcaacccctccaagattacagcactataaacaacagtggaatgggaaaagaggaaagggattatatctaagagatattcctcaagaataattgataagacctgtgacaaattagttgtaatgattaaggaggaagaaattatgggtaagtcccaagtttctatcttggaagaccagacagatggtgatatttcattaactgtggtaacaaatggaaaagaacgaatagattaaggtaagcgagataaatttagctttaaacattttaagtttgagatttctattggatatccaagcagataactcttctaagttgttggaaatgctgtacaggaatgaggtctagaatagaataaacttgggcaccatcaccacttagattgtgtgaaagacactagtgtcttcctttgagattgataagaaaaaaacaataaaatatagaacctaggattggcagtattttaaagatgggcagaaagcaggagtcattaaagatatatcaggaggagaagacaagaaaagaactggaagaaagtgtcgtcacgttaagcccaagaaaggaggctatttcaaaaagtggggatgggtaaacagtgtgaaatactaaaaagtgattaagaagcataaagactgaaaataaataatttgatttaacagaaagtctttagtgactttaactaaaacaattagagcagaatattttgggtggaagccaggctataaattattgctatgaaagtgaaaattgcaaacatggttctttccaaactttgggtggtaaaaggaagaatggagatgaagaagcagcatcaaagggaagatggctcaaaaagggccaatatgttttggtatcctttttgtttagttttgttttaaataagtgtgtgtgggatggggtgattatgattacactggatgtctctgttggcttgatgatatggatggtgataacagctaacacagttaacagccagacactgtcctaagcacatcacatgtattaactcattttatctccatggtatcattaaccctattttaaacatgaggaaactgaaatatcaataacataagcagctagcctaagcttgcacagagatacgatgcaaactgaggcagcctgactccaagtccacagtttaccctccctgctatatgcttccctgctcacccaaaaaagcgattctgctttatttattctaattttctttacagaatgtatctagagtgaacatttttcagaccattatctttagagtgtgttttaggacctgattcaaattgctttccgttcttcaaaaacttatttcctgggataggaatagctgcccactctagtcctattcctgagcaccaagaataaacagacttgactcttgtaaatggaagaatgagtttcttctagaaactcagtagaaaaatgagctcctactatggccttaagtattaagaaaaaataagtgtgtgttttgccttttgtttggtgctaatgtgataccaggttttgtatgaagcacatgtgttttccctgttttatgtagagaatagcatgcatggaatgaaccccaaaaataagccccaaattatcttttgctcaaaggaacagaggtacttcgaggctagactttatagtcattatagaagaatgtgaggaaatacaactctgcttttatttgcaccagactttggctgtgttacactttcttctgccagtcctgtgactgacttctctttaaatgattcatggttgttttccatgaataaatatgcattagtcaagatccagttagagcccccacttccccttcccctcttttccctagctgcagctgtttatatttgcatttgactggacagatctgttagccttaatgtgtttttctttgtttattaaaggtttacactttgccttagttgaagaaaggtaaggattttttttgtttttgttttttttcccgtgggtgcccgccacccacccacccagagtgcagtaccataatcacagctcactgcagcctcaacctcttggactcaagctatcctcccacctcaggctcggactacagccacatgccaccacacccagctaatttttgtaatttttgtagagatgaggttttgccatgttatccaggctcatcttaaactcctgggctcaagcagtcttcccaccttagcctcctagagtgctgggatgataggcatgagccactgcacccagcccctacattttctttataagcctagatatataattacaattattgatgatctcacagaaactttcctagaaggaattcatttgtctgccataagcctaatttacattgaagagatagacacagtgattaaagactggaggagttcttaaatccttaaagaaactactaggccaggcgtgttggctcatggctgtaatcccagcactttgggaggccagagctggcagattgcttcagttcaggagttcgacaccagcgtggtaaatggtgaaaccctgtctctacaaagaaatacaaaaattagcccggcatggtggcatgtgcctgtgtcccagctacaggaggctgaaatgggaagattgcttgagcctgggaggttgagactgcagtgggctgtgatcacaccaccgcactccatccagcctaggcgacagaatgagaccctgtcttgaaaaaaaaacaaaaagaaactgccttcccaagtttatcttttttgtatgccctattagaatgcttttcctttttatgtttttccccattttattagaaaaatttccagatatacaaaatggaagaattttacaacaaacactcatatgcccaccaacttgatttcatcataaacattttactgtcttattttatcacatctgttcatctacctatctctttatgcacctatcattttttatgcatttcaaagtaaattgcaggtattagtatactttactggaatgcttttagaagggtggagtggtcttcctgctctgttgctgccttggctgtaccattttctgggtgctgcggataagaaagtcacattctgttgctaaatgatatggattagttcatcttttttccttagctcagctatagttgggatgataacttgtcactgaattccttcagtggtttctgccttagaaaatctcttggaaaccagcagatattcaaaataaagaaacatttatttaggcatgtgaaccccacagagaatattcattacattcatccccgtaatgcaggccaacagtgctttcttgttcatatgttctaaatttatagtcgagtacatagaaagtagggctttcttttatcatattgatctgataaaagccctaggttttgaggtacagaaaccatccatttctgggctgtacagacaccatttttggtgtctacagttgttttgccatatggtactgggctaattttgtctgtgttcctctcttgaggcttttgtgaattaattacgtttttagaaaattttttaaataactttttaaaatgtcaaagctttctcagtagaataaaatatgatgaggcattatgtcaacatgagaacaagttatcttaatagactatttctcagaaactgaggcctttgagtctgtacttattccatgttataaattagcattagtcatattcatgaaagcctcctttgaaacaacatgtaaagtaatcttggacctgaagagataagtctatttagaaagcaacgaagtctctgaatagttctccactctggaaaggtcatctctggccaagcatgaaaattcctaaagggaagtacaaagagagataaggggaaagaagctggcttagccagtcatataagcctaatcaattctggtcgtcagtgggataactcatgccacattcagatgtaataatcaaatcctttagaacaaatacaacataatataatagaaaaggcctggattttagagtgagaactaggttttgggtctagttcttaaactaactacatggccttacatccctataagactaattagacttgtccataaaaatactataagaattttatgaggggcccataattccgtttgtcaggagagcccacaactgaggcagtcctgggtgaggtttatctccctctttttacctccccaagtcatggagccagctgatctttctatttcctgtttcctgcctaagactactcagctagagctcagtgcatctgtctgaatgtctgcttttccatcaagggctctcagatgcccaagaaaccccctgagtggttagctacttcctgctatcaaatggcatcacagaaaagcagagtaagaagctctaagaatcagtccttgccctgaagcaaccattaagctggcaaaaaatgacaaaatcatctttttcagaattctggaatctaatcaaaacttaaagctacaagaggagtgcctaatgaagaaagaggttactcaatttcagcatttaatgaaatctgtcagatcactggctgaccactgagataatagaagagagacttcagtgactacacacaataaggagtagagtcattgcaaaaattgtttggaaaagtcactaaagggacaacagtagggccaaaataagcaataacagcaagccctgtgaaggaggcagaatctgatatccagacttaccacattataatattcagaaggcacagtttttgatacaaaatgacaaggcatacacagaaataggaaagtttggcctattcactggaaaaaataaattgacagaagccatccctgaggcagctgagacattggacttatcaaacaaagactttaaatcagctgtattaaatagggtcaaagagctaaaggaaaccatggatgaaaggataccaggagaacaatttatgagcaaatagagtatatcaacagagacagaaattataaaaaggaaacaaatagaaattctggagttgaaaagtacaatagataaaatttaaaattgaccagagaagttcaacagatttgagtaggcagaagcagaagaaatagtgaactcgaagataaacagttggaattattcagtctaaagaagagaaagaaaaaagaatatggaaaaatgaacaagcctacaagatctgtggaacatcatcaagtttgtaaatgtgcacttgagagtctcaggagaagagaaagtgaaagggtcagaaaaaaaaatctacaaaaagcaaacaaacaaacttgagctaataacatgaattcagcaaagttgctggatacaatatcagctcacaaaaagcagttatgcttcttctatatactgtattaatgtttaatgttgttaagatattggtactacccaaaggagtctacaaatacaacacaatccctagcaaaattccaacagcctgttgggcaggaatggaaaaggaaattctcaaattcacatggacttgcaaggggccctgaatagccaaaatgatattgaaaaagaacaaagttggaagtgtcaaacgtcccaatttcaaaacttgtcataaagctgtattaatcaaaacactgtgatactggcataggaatacacataaaagaccaatgtaatacagttgaaagtccagaaataaaccccatacatctatagccaattgcttttcaacaagggtgctaagtctaggaaagaatagtctcttcagcaaatggtactgagacaactggatatctacctgcaaaagaatgaagttggaccctacctcacaccatacagaaaactcaaaatgaatcaacaacctaacctacagataagagctccaactgtaagactcttagaaaaagagtacaggaaaaatcctcatgaccttagattgggcaaaagattcttagctatgacaccaaaagcatgaggaacagcagtaaccaaaaaataagatattttgaacttcattaaaattaattttgtgcatcaaaggacactgtgaaaaaaatgaaaagacagcccacaaaatgggagataatatttgcaaatcatgtatctgataagggtctagtatccagaatatattaaaaaaactcctacaagtcaacaacaaaaagacaacccaatttaaaaatgaataaatgacttgaatagacatttttcaaagaagatgtacagatgtctagcttatgaaaagatgttcaacatcatcagtcattagggaatgcaaattaaaatcacagtgagatactattttacaccccctaggatggctgtaataaaaacaaaaaaaactaacaagtgttaatgaggatttggaaaaataggaactcttgtacattgctggtgggaatgtaaaatagtacagccactgtggaaaacagtttagtggttcctcatatagttaaacatagaattgctatatgatccagtaatttcatttttaagtatctaccacaaagaattgaaaacaggtgctcaaatacatacacacgaatatacacagcaccactatttgtagtagccaaaggtagaaacaatccaaatattcatcagtggatgaatggataagcatcatggtatatatgtacaatgtatattattcagccatcaaaaggaatgaagtactgatacaagctacaacatgaatgaaccttgaattatgctaagtgagagaagacagacacaaaatgtcacatctcgtttgtgagatatccaaataaggaaatccacagacacagaaagcgaattgtttgccagagacgtgggaagggagcaatggagaataactctttagtaatatagggttttattttggagcaacaaaaatgttttggaactagatagaagtggtggttgtgcaatattgtgaatgtactagatgccattgaattgtacactttaaagtggttaattttatattaatttcaccttgattttaaaaaacttatgtgaagaatatatgtaaaaacctacaatcatgagatttccttttttatttatttattttatattattttaagttccaggatacaagtgcagaacttgtagggttgttacataggtatacatgtgccatggtggtttgctgcacctatcaacccatcatctaggttttaagccccacatgcattagttatttgtcctaatgctcttcctccccttgcccccacatcccccgactggccctggtgtgtgttgtttccctccctgtgtccttgttattctcagtgttcaactcccacttatgagtgagaacatgcagtgtttggttttctgttcctgtgttagtttactgaggatgatgtcttccagcttcatctgtgtccctgtaaaggacatgatctcattcttttttatggctgcatagtactccatgttgtatatgtaccacattttatttatcaagtctatcattgatgggcatttgggttggttccatgtctttgctattgtaaatagtgctgcaataaacatatgtgtgcatgtgtctttatagtaaaatgatttctattcctttaggtatatacccagtaatgggattgctgggttaaatggtatttttgggtctagatccttgaggaatcgccacactgacttccacaattttttaactaatttatattcccaccaacagtgtaaaagcgttcctttttctccacagcctcaccagcatctattgtttattgactttttaataattgccattccgactggcatgagatggtatctcattgtggttttgatttgcatttctctaatggtcagtgatgttaagctttttttttttttttttgtatgcttgttggctgcataaatgtcttcttttgcgaagtgtctgttcatatcctttgcccactttttggtggggttgtttgtttttttcttgtaaatttgtttaagttccttgtagattctgggtattagacttttgtcagatggatcgattgcaaatagtttctcccattctgtagattgcctgttcactctgatgatggtttcttttgctgtgcagaagttctttagtttacttagatcccacttgtcaattttggcttttatggcaattatttttggcatttttgtcatgaagtctttgcccatgcctatgtcctgaatggtattgcctaaattttcttctggggtttttatggtttagggttttacatttaggtctttaatccatcttgagttaatttttgtataaggtgtaaggaaggggtccagtttcagttttctgcatatggctagccagttttcccagcaccatttattaaataaggagtcctttccctattgtttatttttgtcaggtttgtcaaagatcagatggttgtagatgtgtggtggtatttctgaggtctctgttctgttccattggtctgtatgtatgttttggtaccagtaccatgctgttgtggttactacagccttgtagtatagtttgaagtcaggtagcatgatgcctccagctttgttctttttgcttaggattgtcttggctatacaggctctttttcagttccatatgaattttaaagtagtttttaccaattctgtgaagaatctcaatggtagtttgatgggaataacattgaatctataaattactttgagcagtatggccattttcatgatattgattcttcctatccatgagcatggaatgtttttccattcatgtcctttcttacttgagcagtggtttgtagttctccttgaagaggtccttcacatcccttgttagctatattcctaggtattttattctctctctttgtagtgattgtgaatgggagttcatccatgatttggctctctgcttgtctaatgttggcgtataggaatgcttgtgggttttgcacattgattttgtatcctgagactttgttgaagttgcttatcagcttaaggagtttttgggctgagatgatggagttttctaaatatagaatcacgtcttctgcaaacagacaatttggcttcccctcttcctatgtgaatacactttatttctttctcttgcctgattgccctggccaaaacttccaatactgtgttgaataggagtagtgagagagggcatccttgtcttgtgccggttttcaaagggaatgcttccagcttttgcccattcagtatgatatcagctgtgggtttgtcataaatagctcttattattttgagatatgttccatcaatacctactttattgagagattgtaatgtgaagggatattgaattttatcaaagaccttttcttcatctgttgagatgatcatgtggtttttgtcattggttctgtttatgtgatagattatgtttattgatttgcatatgctgaaccagccttgcatcccagggatgaagcccacttgattgtggtgggtaagctttttgatgtgctgctggatttggtttgccagtattttattgaggattttcgcattgatgttcatcaggggtattggcctaaagttttctttttttgttgtgtctctgccaggttttggtataaggatgatgctggcctcataaaatgagtaaaggaggagtccctccttttcagttgtttggaatagtttgagaaggaatggtaccagctcctctttgtacctctggtagaattcggctgtgaatccatctggtcctggacttttttcagttggtagactcttaattattacctcaatttcagaacttgttactggtctattcagggattcaacttcttcctggttcagccttgggagggtgtatgtgtccaggaatttatccatttcttctagattttgtagtttatttgcatagaggtgtttatactattctctggtgatagtttatatttctgtggggttagtggtgatatcccttttatcattttttattgtgtctatttgattcttctctcttttcttctttattagtcttgctagcagtctatctattttgttaattttttcaaaaaccagctcctggattcattgattgtttcaagggtttttcttgtctctatactcttcagttctgctctgatcttagttatttcttatcttctgctagcttttggatttgtttgctcttgcttctctagctcttttaattgtgatgttagggtgtcaatttgagatctttctggctttctgatgtgggcatttagtgctataaatttccctcttaacactgcttttgctgtgtcctagagattctggtaagttgtgtctttgttctcattggtttcagagaacttcttgatttctgccttaatttcattatttacccaggagtcattcaggagcaagttgttcaatttcctgtagttgtttggttttgagtgagtttcttaatcctgagttctaatttgattgcactgtggtctgagaaactgttttttattatttcagttattttgcatttgctgaggagtgttttacttccaattatgtggctgattttagaataagtgccatgtggcactgagaagaatgtctattctgttgatttggggtggagagttctgtagatgtctatcacgtccacttgatccagagctgagttccaagtgctgaatatccttgttaattttctgtctcgttggtctgtctaatattgacaatggggtgttaaagtctcccactattattgtgtgggaatctaagtctctgtaggcctctaagaatttgttttatgaatctggatgctcctgtattgggtgcacatatatttaggatagctcttattgttgaactgatccctttaccattatgtaatgccccctttgtcttttttgatctttgttggtttaaagtctgttttgtcaaagactaggattgcaacccctgcttttttttttttttttttttttttttttgctttccatttgcttggtaaattttcctccatccctttattttgagcctatgtgtgtctttgcacgggagatgggtctcctgaatacagcacacagatgggtcttgactctttatccgatttgccagtctgtgtcaggttttttgttttgttttgagatggagtcttgctctgttgcccagggtggagtgcagtgacatgatctcagctcactgcaacctctaactcccaggttcaagggatcctcctgcctcagcccccctagtagctaggattacaggcatgcgccaccatgcctggctaatttttgtatttttagtagagacagtttcgccatgttggccaggctggtctcaaactcctgacctcaggtgatccacctgcctcagcctcctaaagtgctgggattataggcatgagccactgtgcccggtcatctgtgtcttttaattggggcatttagtccatttacatttaaggttaatactgttatgtgtgaatttgatcctatcatcatgatgctatcttgttatctcacacactagttgatgcaatttcttcatggtgtcattggtctttatattttggtgtgtttttgcagtagctggtactggtttttcctttccatatttagtgcttccttcaggagctcttgcaaggcaggcctggtggtgacaaaatccctcagcatttgcttatctggaaaggattttatttctcctttgtttatgaagcttagtttggctggatatgaaatcctgggttgaaaattctttaagaatgttgaatattggcccccactgtcttctggcttgtagggtttctgctgagaggtctgctgttagtctcatgggcttccctttgtaggtgacctggcctttctctctgcctgcccttaacatttcttccttcatttcaaccttggagaatctgatgattatgtgtcttggggttgatcgtctcgtggagtatcttactggggttctctgtatttcttgaatttgaatgttggcctgtcttgctaggttgtggagattctcctggataatatcctgaagtgtgttttccaacttggttccattttcctcctttctttcaggtactccagtcaatcacaggtttggtctttttacatagtcccatatttcttggaggtttttttgttccttttcattcttttttctctaatcttgtctgcgtgccttatttcaacaagatggtctggatatcctttcttctgcttggtcgattcagttattgattcttgtgtatgcttcacgaagttctcgtgctgtgtttttcagctccatcaggtcatttatgttcctctctaaactggttattctagttagcagctcctataacctttatcaaggttcttagcttctttgcattgggttagaacatgctactttagctcagcggagtttattacccaccttctgaagcccacttctgtctattcgtccatctcatccttcatccagttctgcgcccttgcaggagaggcgttgcgatcatttggaggagaagaggcactctggccttttgagttttcagcatttatcattgattctttctcctcttcatgagtctgtctagtattgatctttgaggcttctgacccttagatggggtttttgtgggtatcttgttgttgatgctgttattgctttctgtttgtttttcttgcaatggtcaggtccctcttctgtagggctgctgcagtttgctgggggttcacttcaggccctattcatctggttcactcctgtgcctggaattctcactcgaggaggctggagagcagcaaagatgggtgcttgctccttcctctgggatctctgacctcaaggggcactgacctgatgccagtaggaacgcttctgtatagggtgtctgacaacccctgttggagattctcaaccagttgggtggcacggggagcaggacctgtttattaacaaagcactttgactgtcccttggtggacgggggtgctttgctgggtagggggccttgtctgggctccctggattcctcagaactatgcaggagcaaagactaagtctgctggtccatggagactgcggccacccttccacctagggactcaggcccagggagattagagttctatccctgagtccctggctggagttgttggagttcctgcagggaggccccgtgcaatgaggagggatgggtcaggcctgaagaggcactctgtccgcggtctgccacagccagtgtgttcagctgtgaaggacacctcttgggactaagccatccatcctcccttgctccggcaggggaaagcgcagcctggagctatagagatggctgccgcccatcccctgcccagggagcttagtgtgttaggcagctatcagtcctattgttcgctgttgccccttccccaaggagctcagatggcttagacagcaggcagctgcagccgtggtgctggtcaccacccccgctacccccaggagcttggtaggcttaagcacattctagccgagtggctattgagaatctgtgcggctccatggttgggaccctaggccctgttggtgtgggctcacgagtaggatcttccgatccatgggttacacagttccgtggaaaaaacatgttttcccaggctgggtagcgtactcactcactgcctaccttggctgggggtgactcctctgccccgtgtggctctcaggtgggccgccttaccacactgctcttccttcctctctgcgggtcacaccagccacatagtcagttctgatgatggaacctgggtacctcggttgccggtgcaggattcacacagtgttatggttcttttcaatgggagcctctgatcgcgtctgcttctagtcagccatcttggccccacccgctatgatttcccttttttcttctgtctttcacatgtagtctgtatttaaaactgctagacattatcctttctctaagagtttgcaatctggttggaaaaacagtatttaaaatgttaataagtagtgtaagtcagtgtataattaagcactaaattatatggagtaaacttagtttgggaagaggaaaataaatgaggactagattgattaaggaagatactatgaagaagatgaaaattaaccttgactgtaatatatggacatggtatgaagagaagaagaggggcatttcaggtcaaagggacaacctgccctaaggcacaggaactggattggagcagtttgtcagggtactctgtgaagactgccttgtctgcctcagatagcacatggtggcagggtgtgaggcgtggacaggacagaattgagccatgttacagaaagccgtcagaacctggggaggagcttagcttagatttgatacagcagaaaactgcacctttggacgcgctagaagggaatgacgtaatgtggtcattgtaataaagaattggtctggcataatatccaaaacggagtgactgaggcaggaagtaagggaagccaggcaggaagcaaggagagtaaatgtagcaaaagtctgagctaggtgggagcagttggaaacgaacagaggtaactgatacaagagatctttctaaggaaaaattcataagacttgaagacagactgggattgcttggttaagtttacttcttaaatagcaggaactttcattttaattatactcaggatgtttgtgatataatgacaccctgatataataacaaaatacttcactcatctcctctactaatacataaaaattattttaataaaactctcttgattcccttcttcaatattcattcattcaacaaatatttactgagcctttactatgtaccccagactatgtactgatacagtgatggttcctgccttcatagagcttgcattctagttaagaagacaggaataagcaagaaaacaaaagaataaatattgttagattgtaatacgtgataagaacataaaataattagtatttatgataaattctccaagagaaacaaataagccctctggctaaaagaaaattatgggggccgggcatggtggctcacgcatgtaatcccagcactttgggaggccaaggtaagatcacttgaggccaggagttcaaaaccagcctaggcaacatagcaagaccccatttctacacaaagttttttaaaaatagtcacgtatggtgggacatgcctatagtcccagctacttgggaggctaaggcaggaggattgcttgagcccaggaatttgaggctgcagtgagctatgattgcctctccagcctgtgcaacagaacaagaccatgtctcttaaaaaaaaatgatgagcagtagggaaaccaacttgaaaagcttatcaggggaagccccgctaacatagtagcatttacgctgaaacaagaaactggaaggccagaagagctggggcatagactgagggggaagtgatgtgagatgcctgcaggggtaggtaggcagggtccaaatcatctagagccttgagcactatgggagggagttttgattttattctaaatgcaataaagaaccactggagggttttgcgtaggggagtgatatggtccttttatcatcagacaggcccagttccagcactggtcattccagcctcagtccgggtagcaataggagtagtcgataagaaggaccctttcttttctagaaaactaccattactttgttaattcttattttatgagctccttactcttctcaccctgctgccctttcctatgttagcaggtgcttatatcaattcatgtaagtttccttcccccgatgtaatctaaaaataattatcagctaacttgtctaagatattcagaccttcatcctacacatattcctcatttcagtggcctacataaaataaaggccttaaataaaataaagaggatttctgctacatttttatattctatagaattcaaactcaagagtttcagggcttgtatgagtatagaactgtcacataatcacagaagaatattggtgtggttctttgattttctatagagattaattcagtgaacaattttgtttaatgcatttgaaatttaaatttgggcatactctaatgtatccagagtttgttgttgctgttgttgttgttgttttgttgtttttgagacagagtctcgctctgttgcccaggcaggagtgcagtggcgcgatctcagctcactgcaatctctgcctcccaggttcacaccattctcctgcctcagcctcccgaatagctgggactacaggcgcccgctgccatgcccagctaattttttgtatttttagtagagacggggtttcaccatgttagccagattggtctcaatctcctgaccttgtgatctgcccgcctcggcctcccaaagtgctgggattacaggggtgagccacggtgcccagcctgtatccagagttttaatcctttcctcccagatgttgaggaaattatatctctaattcatatttagtgggggaaggcctttacataacagaaagaaagcaggaaagctatttctatcccatagtaaatttcttcttatattttaattttggtgctcttcagctccataatcccttagacttgaaactggaaaaatctttggcttcttccgctccctatccctctacatctagttttttgacaggtcctacatatttcttcactctttgctgtttcattggtgtctcccttgttcaggccttcatcacattttctgggactattatagtgagtagtagtcttcagggtatctccagtctgtcttccctctccagtgagccaagcctagtattaggtccacttcagtgggtcatcactgcctgtcactcaaaggaaatataaaccaagtactcagcctgacattcagactgtcctggcagaaatagccaattttatatatttatatattttttgatttttaaaatcattctgtaatagctacaacagttaaaatttgtaactacatatactttgttttcattttctaaaaatgtatacacagtaaaagtgggagagagatagccaggacatatatgcttgtgtgtttcaattgatgtagtttaattagttgttggatttggcagtagttatattcacccatgcatgacagaataatttgtgattgtgataaaatatttgcttattttgtctttgggtaaaataacaaccaattcattttgcagctttttaaaaaatagctaatattcctattgaaaaatttttttaaaaaaattataattaaagatataattaatcctatcataccttcactatttttgttttggagtattgttagcttccatctgcatatactgtaaattgtaatcataatatatattgttttttattctactgttttactaaattttatttcataaatacttccacatttccatgattctggaaagtattcctttctattttaatgtctgtgtaatttttggtagatacaccatagtttactaaatcacctttactaacaccatacatgctgcaaaaaatgtgagtgtgtgtatgtatgtatgtgttagtgtgtgtgtgtttgcacttttcttatgaatcatttccttagaataagttcccagaacaggattttaaggtcaaattggcatttgcaaaatgtcggttctctaaaagttggacacatttacagtgctaccagtaactgaagaaactaatattttttcaaaagatggttttgaatatgattacatgccaaaaaaccgtatttttttctaatggtagatatagtttgctttaatttgtatttatttggttatgtcaaagataaacatttttaaatgtttgctttctaaattgttttgtgaattatctgggtttttaaaatatgacattaaaactaaatcattgttttcaaatgtgtaatatatatctgctaagatgaaataattatctgtctttggtttaagaagatgttttatggttatttcaagaaatccatttaatgaaacttaaatggagcattttctgattaactgtcagaactgaatgaataaaattgaaaagatttcttatggtaaatttcaaactaattccggaaattatttttgaaactatgtatttttcaaaatctattgaaaaaataagaataatgatgggagactcacaattaactagtacataataacaactaaatcagcgtaacactgatgcagtagtagacttacagataagtggaacaaactagataacttaaaaacaaacccaatatgaataagataaagtaagcattacaaattggtgataatttaaattgtcactggtaaaatttgttaaccctttgggggaaaaaaaaaagttagatccctactctataccagactcaaaaaagcactagaaaaaaaatgttaatgtttttatactcttggattaagagggaactttcaaagaacaacactaaaggcagaacccataaagaaaaagactgacaagtttggcgacataaactgtttcaactttcacaaattaaaatagaaggaagaggccaggtttggtggctcacacagtaatcccagcactttgggaggccaaggcaggtggatcacttaaggtcaggagttcgagaccagcctggccaacatggtgaaaccctatctctactaaaaatacaaaaattagcctggtgtcgttgcacacgcctgtagtcccagctactcaggaggctgaggcaggagaatcacttgaacctgggaggcagagattgcagtgagccaagattgcgccactgcactccagccaggggcgacaaagcaggattccatctcaaaaaaagaaaaatattatttctaaaaggaagaaagaaaaattttaaaggcaaagaactgagaaaattatttgcaaaaagtaactatgaaaggcaaaagattaatgtcctcagggttaaaaatgttctcacaaattcagtaagacaaacgcaggcattccaatagaaatgtgagtaaaagccatgaacaggcaattcacaaaagaattcagatagccaatacacatgtttttaaaaaatcacctttcacacacataaattacttttcatactcaaaatatacattaaacacaatgagatgccattcttaactagattaacaaagataaagaataataatactaccccgtgatgatgagactgagagggatatggtcattttcacgcaaccaggataatctttctggagagcaatttggtaaggtgtatcaaaaacacaacccattgacccagaaatttcacttctagcattttgtttcaagaaaaataaggcaggtgtgccaaggtgaatatacagtgatgtgtattgtaccactgcttgtagtaccgcttttcgtgagaggaactagagcatagtagataagattcagattggtaaaagaccttaggcaaataacttaatctctttttgcctctgttttatctataaaatgaaagtagtaataactatcatcagactgttgtgccagttagcatgcttagaaatagtttctggcatatagtaaaggctatttcattgttagctgtgattataacagtggaaaaccaaaataatctaaacatacaacaataagatattggttaaataacttatgatttagttatataatggaagagtctacacatattaaaaatgataatatagatttatgttttatcatgtagagagatgttcacattacattgctaggtgaaaaaagtaaatgatgaaacagtatatatagtatgatcccatttttgtttttaaaataagtatatatggtacaggcaaaactcagaatacatgctaatagcatttctctctagctaatggaaacacagttactattttatctactatccctcagttttctatagtgaaaatatattgaataagaatatagtaaaagccaaatagaggaaacagttgggcagtttctcagaaaagtgaacctaagagtttccatatgaatcagacatttcactcctagatatatagccaagaggattgaaaacatatgttcacataaaagttgtacatgaatgttcatagcagcattaatcagccaaaaagtggaagcagcccaaatgtttattaactgataaacaaaatatggtatatccatacaatggaatattattcagcaataaagtaatgaataatattaagccaagtaaaagaagtcagaagtaaaaggccacatactctatgattctgtttatatgaaatgtccagaataggcaaacctttacaggcaaagtagattactgattgccagggactgggaggagtgaggattgggaatgacagctaatagatacaggatttctttgggggtgatgaaggtattcgggaatagatagcggtgatggttgcagaacttagtgaatatactaaaaaccactgaattgtatattttaaaagagtgaattttatggtttgtgaattacatcagtaaaatagtgtttaagtaaaatagaatctattagctatgagacactagattttaaaaggatttttggcaaactaaagtttatttttcatcaaattctaataattataggtatggattttaaaagagtagtttttttgttctaccaaaaagacatatgcatgcgtatgttcattaaaatactagtgacagtaacaaagacatggaatctccctaggtgcccatcagtggtggataggataaagaaaatgtggtgcatatgcaccatggaatactatatagccataaaaaagaatggaatcatgtcctttgcaggatcatggatgcagctaaaggtcattatcctaagtgaattaacacaggaaggaacaaaaaaccaaattctacatgtcctcacttataagtgggagctaaacaatgagtactcatggctcattgacgtaaagatggtaacagtagacactggggactgctagaagggggaagaagatggggcaagggtcaaaaaactattaggtactatgcttagtacctgagggacagaatcattcataccccaaacctcagcatcacacactatacccagataacaaatctgtacgtgtgccctcttgaatctaaaataaaagttgaaattattaataaatacaagagtaaattttgttacagaaatgtgaatcagggaattataagtgaccctgtagctttatctccacagcttcccctaaccccccacaaccccactttagttaatgaaaactttgggcattttgtttctgttgtcagaatttggctttatattttaaattatttgcactacttttggaaattttagccttttttaaatgctcagttattctagtggctttcaggcagttttaaatgagagtgcacacatgtatgtgtgcgtgtgtctgtgttttctcaagtaagccaccatctctgtatcccaccttgtggtgtgtaagtggttcaagtatgttctagagtaacgtatgaagtataaattatctcattttcccctttgtgatttctctttctcctctttccatctctttcccactcctggcctttcttgtgctccaaaatatttgaaaaatggagttagagtgtaataccttatttttaattaattctttccttaagcattttttgagcacctagtatatatcaaggcactgtgctaaggttaaagaaacaaaaatgaaatacctggtttcagacagataaagtgatacgtcttagagctgctctgggaacagttcaggaagccgtttaacccagatatggaccatcaggcaggacttccttttaccatcaatataattagtagatcttcttttaaagcacgtcacatcaattctgcatttttagaaaactgttgacagtatagtttattcttggcccttagcacaccccataattatataagcacagaaaaaaatcttgagaaaaactgtgtggatctatccccaagagagatgtataagccaaaaattattttttaattggcatcaatagtaagcagtacaggcacagagacactgggtgaaggcctgctttctgctcgactgcttagaatgtttaagatcttttaaaccatcagagcttttaatggccttgcttcccctaataataatacctactagattttaaaaaatactagcatgaacttaaaggaattactattctcattggtgtttttaaagaaacaaacaagcctctctatactgctttcttcaggactgattttcaactgatacgtactggtatagccatattggttgtgaaatattgaaatatgttactggttagtaaagagctgctacggtaagctgtctagatgccccgccacagcctggcctttccaacaggaacttcactcctgcacctctccacaatccaacaattaaaaggttatcccgtggcgtagcaggaggcctttaggtcccttcttcactaggcttgcatccgtagtgattgctggtgcttgggccatcccttccctgtaataattttgaatatcatcccgactttcggactgatcaagtaaatcattaatgttttatcagtgtttgtgttctgcaatttacagtatcaattagctctagctcgcctgtgttgcttatctgtatagaatcaacattcgcagttgcattatttctgaataagcctaggatgccatcatatgataactcaagtccctaaaccacactgcattttttctctctttgtttctctcaatgttgacagtttgacctaagttctgcattctcttgttcctttcagttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacgtacgtattcctttttaaagaactccctgtttcattggcgctgaagtttttctgacatatttatattaggtcgtatatccttttattttctcatctgcaaaacctgacttccacgtgaggactattcatttaggttgagagaaagattgtaatactctatttacatctaacccacatacccagtagtcacctaagcgtgactgaagaaaaacctttctcgtggaataagtttatgactcctccgtgccggctgtgtggttggactgtcctctagataacgaccgcagcaattgcccgtagagcaatttgcattcatcactgttggattttgctcagtctgtgcccagttcttcttcttatttgccagcacagtctgtttgcatccttcatctctttgctgttggcgtcagtgttgcactgcttggacttgagcttcgttgtgtccttgaaggggttctctcctgcttccttgtgaaaaggtgctgagctctcatatgtattcaggcttctttcatcacaaccagggggcagcccagtaatcactaccaggatcttactgatttatttttaaaacactcatatggtacttactatgtgccagatactctcttaacttttttacaaatattaattcatcacatcctgttaccagctcaatgaggttgtcttcatttcacaggtaagtaatctgaggcccagagaggttaagtaagttctgctaggttttacagccaataaatgggagaactaagcagtctggtttcagaggccattctcctatccattttactatgctgcctctccttactggtgaaactcacttgagtaaagaaaataaatagaaatgtatcagtattcttcttatacatactacatgtatagaaccagtttacctggtttctgttagttagaagagaacaaaaaaagaaactattgctttgttagtccaaatcaataatctagcccaccacagactttcagactgcaaccactagaaatggtttgtgtgagataatagtagttacagggtctagcacagtgctggaaacttaacaggaactcagtgaagaccctccaaacttattgacttcctattgaagctagttagcagccttgtatcattaaggaggcagatggcctctgataaacttatggatgtctaacgtggaagaactggtgtcttggaagaaaactgaatcaaaatacctctttaccagggtatggtaagaattggtatggaagaattcttttcttcagaggaatataatgcttagtttctaaatgaagctcttctgaggtagattgccatagtactgtgggagtcaggagcccagggtttgtgccccaacactcaaattgactagactttgtgaacttgagaattttacttgaattttttagagctcagttttcttatttgtaaaatgaagaagtgtgactaattgatctttcagaattgtctctgctaaaattttgattctgagaacacatcttcatggttaaaagtaactttccacactattccagtgttttcctttgagtgtttaagtatttatcactccaaactgctgtttatctgagtagttcaagtggcttgcaatttgagtgtgtcagaaaggaagccagaaagctcaagctctctgtgactcctctgtatatcagagttgcagataacagagtggtagaatcatgcatgacagaaaataaatcccaaggacgagaagagttgctttcacagaaagcagaggtacctggggatctctctatgagcctgggggagcaaaagtttatagaaaacagcccatgtactccccaaagcagagattctttaaaggtagttcactaagttattctctaacatccattgccttcaggagaatctccagaaacaccaagacactccccattcatgagataaacatccgttgttgagactgtagatttggtctgacagttaactttccgaatttgaaaggagttaagagagctaaatatgcggttctatatatcagaattactcagaaccaatgttaccttatacaaaataatttttgttacaatttattgatggccaaactatattctaccagtgccatcttaaccaatagaagggtcaagaataagtgactgatataatgcaagctattttttggcacaaatctgttacctatatgaactggtgttgaatatgttactggcaggagcagcagttttttcactaatagtaagaatgatgtctgtatatggagggttggcttaattttttacagaatataagttattaatataagttattatattaaacttaatataagttattatatataaacttaatatgagttatcatattaagcttggatgggtcatttggaacctcactggctttcttaatccttgggtgatgatactaattaatagttgtagtgataataaaaaaacatgggaaatcactggagttcccaacttctttctctgcatcatctgtcattctttcttctgcccctgtcttctttctgtttggtgttcagagaatagtagaaataaaagctgagcaccactgctgtggaagataggagcagtttagcctgcagtactgccttgcttggctgtccttcccccacagaaactcagccccccagcccgcccccctccttgtcatttccctggaaaggtatagaaaagctgtcaaggcaggcactagcctgtcatcctgctttccacctactctcccaaacctgacacccccatcagtctccaccaccaccaccaccattatccacacccccaacacacacacacacaaagaacaaaaatattttgtgaaaacagacctgttgtataattcaggattattacattaactacaggtattctcagtatagtagttggggaagctctaatacaagactgtatgtttctatcactaaaagtctcaatgtagttattatttggatttgacatttgccaacagctgccaagcccccaaacagctgttaagtaaataaatcctacgttcctactctgttcatttcagaagtctcttttgccagtgtgctatgcacattgactattgcctacctattaacttttatttctactattgtctgaataccaaacagaaagtaaggtgtttagacaaaaaggagggcatttccaaaaggaaatagctagaaagacagagggcatttggacagtaattacccacaaaatcaaataccagataaaggggaatagagtaggggaaggaagtgaacagcagaaataatgcagaaataatacagtaacatacaatcactgaacttcacctcaacccaaatgtcacacagtccttgaggcttctttcactgccatcctccatgcccacccccctgcagttatccagaactgtatccagtgaccaagaaatttactgcaccagttaaatgaaagaagtctaaattcactcctactggtaaggagttaaatgaggactactttttcctattcttccttcttttcaatcactattggccatcaaataacaacttctaatatttactttggtatctatttttaaagtatgatcttattcataaatatagcctataatttctactagtaacaataaatgttctaaataagaacaaattgaatttttaaaaaaatcttaaaacagttttattgagctgtaactcacatactatgtaattcacccatttaaagcgttcaactcagtatttttagtataattcacagagttgtatagcaatcaccataatgtaactttaggccattttcatccccttaaaagaagctcatgcctgttagcagtcaatccccattctcctcttaaccctctatttccagccctaggtaaccactaatttactttctgtctctacagatgtttctgttctgggcatttcacataaatagaatcatacaatatatggtccttttttttactgacctcttggatttagcataacattttcaagggtttatccccgttctagcatgtatcggtatctcatttctttttattgttagtagtctattgaatggatattttgtatttcatctattcatcagttggtgggcatttaggttgtttccacttttggctattatgaatcgttcttctgtgaacacttgtgtacaagtttttgggtggacatgtgtttttatttctcttaagtatatacttaggagcagaattgttagatcatagaacaaatggaatttagccatttttccttaaagtttttatgattatctgatgcaaacatctaaatctttttaatccagatgtggatgccaacagagagctgccactcacacagccaccttcagcccactcatctatcaccagtggaagctgcccaggaactccggaaatgcgcaggcggcaggaggaggctatgcgaagactagcctcgcaggtacaatatgattcccacgttggggatatggtagttccattttaatatcaaggaagcaaagatagggagacctttggcaaagtgaacaaaaatacgtaaagctataccatgagaacgtggaggaaagtttctctttctttgatattcctagaaaaatactttattgtgatgggatcagaaccttagagttggaaagacccttagaaaaaacgtcttctagtgaataaataaagaagttgagaccgaagtgggttagttggttggtttgttttgagacggagtttctctcggtttcctgggctagagtgcagtggtgcaatctcagctcactgcagcctccacttcccaggttcaagtgattcttgttcctcagcttcctgagtagctgtagctgggactacaggtgcgtgccaccacaccagactaatttttgtatttttagtagagacggggttttgccatgttggccgggcttctctcaaaccccttatctcaggtgatccacccgcctcagcctcccagagtgctgggattacaggcgtgagccactgcacccaaccggaagtggtatgttttacccaacatcagggtataagtaatcaacagttttaaattttcattcctagcttaaaactcttcgtgctatactaccctgtccataatattttttatacatttgagtttgaaatttctatttttttcaaaataacataaacacatagaaaatcaaagaatgctcaaaaccagcagtgctcttcctctaccccacccatcttctctccacaggcagccacttttacctcttaaggaagtttctctgattttcacctccatatttctaaatactattcgtatactgctaaaatttttattagtttacaaattatctattgcttcttattatggatgatgggaattatagttgtttcaccttccttcttcctaccaccatcccaatacaattattgcatgatttttggctgaatccatattatatatagtattttcagtattaatactgtgcaaatacatcactctggcgccaaggataacatttccttcttgaacgattttgtttttcctaggggtttatgaaatgcctcattttaaaatttgcttatttttcttcaaatctttggctaagtcatttcataacccttaatgtagttttgtaaaatttctgtcagtacagttttccacacttacaagttacattttttaccctggaggcctccgtcctagagccctccatcgagctcagtctggacctaggacactctgaaggcttaccaccttgttctcctgggagttcctgtccctcctcttttgtgtttcatctcatgtcatattctttctcgattttattcttcattttggtggagcatatcttccagtagcttcctaacaaaaaatgcataggacataaattttttgatacttactgtttctaaaagcatcattattctatgcttatacttgcttatttgtttgacacagtatatcattctagggtaaaaattattttttctcaattttgaaggcattgctccattgtcttgagcttccaatattgctactaaatactctgatactattcttattcctaatcctttatatataccttgttttctctccaaatgcttttagaatcctttttatcaccattgttcttgagtctttttcatttattctgttggtacctagcaagccctggaaatattctttaattctgagtaatgcttttgtattatgtatgatgatttcctcaccaccatttcctctattttctctttctacaactcgtattaataaaaaattagatttctggctgggcgcagtggctcatgcctataatcccagcactttgggaagccaaggtgggtggatcatctgaggtcaggagtttgagaccagcctgaccaacatggcaaagccccatctccaaaaaaatacaaaaattagccaggtgtggtagcatgtgcctgtagtcccagctactcaggaagctgaggtaggagaatcccttgaacccaggaggtggaggttgcagctagccaagattgcgccactgcactttagcctgggcaacagagtgagactccatctcaaaaaaaaaaaaattaaatttcctatactggtatgatactctcattttcttaacttttctgttttctatacttttgttttttggttttttaatccacctttgagagatttcttcaacattactttccaatccttttacaaaaaatttatttttgctctcatagttttaatgtgtaacagttcttccttttctccagctgtctccttctttttatagcatcctgttcttgttttatggacgcaatgtattctttacttaggcactgaaaaaactgattagaagcttgtgtgtgtagagagcttgaccatagaacattaagatgatccgccctttttttgaaatgcccaaaagtcagtattcctaagtttttttcctgggctgttcaaattctctagcaaagaatcctccagtcttctgactggagagtatatgtcttgggtgccagcattttggagctgggcaggaaaagagggctggagcttcactgttcactatcagacatttatttaagccccttgttttcagtcctgcacctgatctctaccttgctcaatgtgtggtgtccctaagtctagattctctcttgtttaatttctctagttctctttcctgtgggtgttggggaaggtagtcacctggctgggcagggcagggatgggaatctggggatctaacttcttacataaacttcatataaattctgtgttttcaggtcccttcacccttctcttccacagtacctggtgtttctaattcctatgctttgtggaagttttacagatggtctgtaatattgtaaggttcaaatttttcatagaaatacactccagctccaagccagaaacagcatgttttcccagatacattattaattattcctactcagtagtacatcctcatctataaatgggcttctgcaaaatctgagatttccgtcaattcattgcgaagtcattgtagctttaaaagacatctctgtttttttctaaatatctcctgtgtaaacggtctctatcctcttctttagaacagttagaatccctgtaatcccagcactttgggaggccgaggcgggcggaccacaaggtcaggagatcgagaccatcctggctaacatggtgaagccccgtctctactaaaaatacaaaaaattagccgggcgtggtggcgggcgcctgtagtcccagctactcgggaggctgaggcaggagaatggcgtgaacctgggaggtggagcttgcagtgagctgagatcgcaccactgcactccagcctgggcgacagagcaagactacgtctcaaaaaaaaagaacagactaatatctatcttagaaatacacagatgttaaagtgcttccagcacttcagttattcagtcattcagttattcagtttagatatacatttgaaggacctatagtccaggactgaagataaatcagtgaacaaaacagacacaattcctgctgttatacagtccacattctcatgagagaaagacaataaacaaatacatatatagtatgtcagaagatgataagtgctaagatcacagagaattaattctcctcactttcttacatcttattctttctctcatcaagagaagtcccaagatgttcatgttcaatatttggaaaacattacatgtcataagtaggaaattagtggctactgtttatacttatttgaggcatgattacatgttaaatttcatgattgtgtcttccttaagcaaaatataaattaatctagttgcacctagacatggaatcctgttcagcttataacattgtatcagaagtagccacttagcttaaaactgaatgttatcccagttattgtgctacgtgttacagttcagctacacaaaagtgttctgtagacgcatagagcagaagcctgcaatcttgctgctcacctatagcaaaccagtaagcagaaattatcttttaaataggattttcaaattagttaatgttttgatgaggtagactaacatgaaaatttaaagtgttcttgaaaaatctctcaatttgacatattcttggtgtcatttctttgtatgtcagtaattatcattggtatttcataacattcttgctctttcttgtgcatctagttaactgagaacactggagagtttttgtcacaactttagaactatttcatttattgaagaaatactttccatttgaagcaaagattttgataggttggcatctctcgagcgtgtctccacttaacattacatatttcttctaaagcataatcacagtagagggacagggagatctcattcagggcctttcctggatatgtgaatttaactccaacagagatttctctaggttttgaatctgttgtgcccctgtggtaatacacacaaaattcacgagacaaggagaagttggcctccctttatggaaggcttaatgtgtgttatgggcttagtgctatttaccttatatttgctatatcatttcttcatttttaccttaaccctatgaggtacatcattatctcattttacagatgaagaaacagtgacttcagtgattaattttttcaaagtcatactgttaataaataacgaagtgaggattcagagtcagtatcctcccctgtaatgtgaatactatggttatccccattttacaaatgaggaaatagaggctctgaggttaaataacttgcttgagaccataagctagtacatgactgagtcaagatttaaactgaggcaggcaaagtctatactcttaaccactgcacgaagctgcttctctagtgtgacaggaaggaatttagtttagtgttatttcgaaaaatccatccatcatttaaggtggcttcacagcaagaaaattataatgaagatgtactttcagtcattttgctgacctaaaattcttcttcaaaaaaggtttttatgcaactagaatctcccaacacattaagcaagttgtcactgacagtccttagattaagaagctaacatatctgaaatgagttcattagagaaaacagctaattttaggaagtgtcacagagatacaaaaagcaaaggttttttttcccaaggaaatctatgtaagaaaaaaagtaaatgtcatccttgccaagagacaagttctgtactataccagggggtgtcaaatgatcatggttcctgaaattgttgcagtcactattaaagctgtcagccaaagaagtagtcatttcagtaatcctttaatattgagcattttgaacataatatggaaatgtaagccagaaacatgcacacacacacacatacatacacagaaaatgaaaaacaataatgaagaataagattttatttgtgttgtagtgattatttttaaaaatattttcatttagtagaaatgagatccaaactaaacaacacataccccatagatgatgttttataaaatttgtctagggcttttcttctctaaaaattaacactgacgttttactgtcagacccagatttcatctacatttggaacactgaatatgggaaaacagccttgttgtttattgttaatttctatgttgtttttattttctacctcttccactagaatgggtcagtgtttaaatgttcaccaccatatccccagctcctacacaatgcatggcacataaatatttgaatgaagaaattctagtcaattctctgtactgagtaatctttctaaaacatttgttttttgctacttaaagccatcaaatagctcctccttgcccttgaatgaaatccaaactcccttcttaaaatatcataaaaattgtaatgaaaggacctctgcttttcccaggaccggttattttagactacataattctttgtgtggggtggggggcggggggcgggcaggggcaaggcggatgttgtcctgtctactataggatatttagaagaagtgaccttgacctctgtgctaccagtagcactccctcaacctctaattaagacaaccagaaacgtctccagaaattgccaaatgtttcctggggagcaaaaccactgccagtggaaaacctcgccatgccctatcttccaccattccccactcacttatatgctagccacactaaaattgatttcagttccttgaaagtaaaaagctatgtcttgccttagggcctttgcatacttttttcccctgcctggaaaactaccacaccttggttcaccccttgtccttcttcatgtctcagcttaaatattgcttcttctaaaaaagctttctctggctctcctaaattaccttaaggtgccccagctgtgtgttgccctagcaccctatgtttcctctcttctatcacactattattattacttgtttaattgcctctgtttcctgctaaactgtggagggcagacaggggtcatagctatattactcattattatagctttaaaacctagcacagtgcctgatatacaatggaagttcaattaatatttgtgaatgaatgaaaatgttagtgttttctattaggaaatcttggagtattcagctgggtacttatacatgatagtggttcccaaccaatttataaggtcaattcagaatcagattcatgtgttccgggaatgaatcttgtttgagaatctggaattccaccaatcctctaagacaaagtttcataaactgtagattgaatgtacttagactgtttatgtgtgccagatcagcatctctaggaattccagatgaactaaataaattagccgcttttctttaaaatttgtatttgttatcggccctaacctcctttggctcaagtaatcagtaatgtataattgaatagtagcaatatacaggatacagctgtttagatctagaattataacaaagataaacattatcctgatctcagctacagctaattaaacaacagggctctgactacgagccattgaggcatactgtaaagcctaaatcaaaacggtgtgtttctagtatgtgaatagacaagtggaatagaataaaaagttcagaattagacccaaggacatgtggacacttagtgtatgatgaaggcagtatttcagatcattgggataaaggtggactttttaattaaatgggctgagacaactaaataaccatatagataactcatatctcacaccatgcacaagaataagcaaatggattaaggatctaaatatttaaaaatgaaaccatgcaactaatggaagaaaacttagtaactttctctttaaccttggtgaagagaaaggctttctaggatctaaagctagaggaatagaagaaaagattgacaaatttggccacgtgaaaaaattttaccagcctgggcaacatagtgagaccctgtttctatgaagaaaaaaaaaattagctgagcgtaatgacaagtgcttatagtcccagctactcagggtgctgaggtggaaggattgcttgagcccaagaggtatgggctgcagtgagccacaatcatgccactgcactccagcctgggtgatagagtgagactgtcaaaaacaacaacaacaacaacaaaaaaaaaacttctaatgttgcatgaccaaaaaataccagaaacaaagtcaaaagacaactgataaactgagagaaaatattgacaaaagagctcaaaagtacaggcaacaaaaggaaaaatagacaaatggaatgacatgtaaactaaaaaccttttgcacagcaaaggaaacagttaacaaagtgaggagacaattcacagaaggggagaaaatctttgaaaaccatacatctgataaggagttaatatctaaaatataaaaggaactcagacaattcaatggcaaaaaacaacctgattaaaaaaatgggcaaaggacctgaacagacatttctcaaaagaaggcatacatgtggccagcaggtacatgaaaaaatgctcagcataactaatcattaaggaaatgcaaattaaaaccacattgagatatcatctcacaccaattagaatggcttttgccaaaaagacgaaagataagtgttggcaaggatgtggagaaaagggcactctttacgttgttggtgggaatgtaaattagtacagccattatggaaaacagcatggaggttcctcaaaaaactaaaaatagagctatcatatgatccagtaatcctgcttccaagtatatatgcaaagaaactgaaatcaatgtcaaagggatagccacacgcccatgttcattgcagcatcatttgcagtagccaagatatggaaccaagctgaatggattctttaagtgtgttatttttttaaaaaagcagtttggaaatttctcaaagaacttaaaacagagttactgttgaacccaacaatcccattactgggtatatacccaaagaaatataaattgttctatatataaatataaagacatgtgtccatgtgttcatcgcagcacttttcacaatagcaaagccatggaatcaacctagatgcctatcagtggtggcctggataaagaaaatgtggtacatatacaccatggaatactgtgcagccattaaaaaaaaagaatgaaatcattcatggttttttttattatactttaagttttagggtacatgtgcacaatgtgcaggttagttacatatgtatacatgtgccatgctggtgtgctgcacccattaactcatcatttagcattaggtataactgctaatgctatccctccccactccccccacctcacaacagtctccagagtgtgatgttccccttcctgtgtccatgtgttctcattgttcaattcccacctatgagtgagaacatgcggtgtttggtttttacagcaacatggatgcagccggaggccatcatgcttagcaaattgatacaggaacagaataccaaatactgcatgttcttgctaataaatgggagctaaacattgagtacacatggacacaagaaagagaataacagacactggggctcacttgagggtggaaagtaggaggaaggtgaggatactacctgtcgggtactatgctcactgtgggtgacagtcatctgtacaccaaaccccaagcaatttacccattaacaaacctgcccatgtactttctgaacctaaaataaaagttggaagaaaaacagaattttaaaacatggtatgtgtatgtgtatatgtgtgtgtgtgtgtgtgtgtgtgtgtgtgtattcattgtgtgtgtgtgtttgtataatagaatactacttagcctttaaaaagaaggaaatcctgtcttttgcaagaatagggataaaactgaaggacattatgctaagttaaataagccagaaacagaaagacaaatactgcatgatctttcttatatgtggaatctaaaaaagttaaactcatagaagtaaacagtagaaagatagttaccagagactgggagtgtgaagaaggaaggaatgggagaagttgttgatcacaggtgatcaacaacttctcccttgtacaaattttcagatagataggaagaataagttttaagatctgttacaaagcagggcaactacaataatatatttcaaaataactaacttttaagtgtttcaccataaaaaatgatacaatagggaggtgatacatgtcaattagcttggtttcatcattccacattatatacatatatcaaaacatcacattgtaccccataaatgtatgcaattatgattagtcaatcaaacataataatttaaaaatctaccacttgtcaacttttagcatagtatcaaagaaaaacatccaccttcccttctccaacatatgactggcatttcgtcttgtacttgaatccaaaacagtttcttggagcatactgaatgcagaggcagatttgggagtctattgcaaaaatttacacagtgccactttctgaaatgtttgctttgaaaaatagttattttcataaaacatattcttagatgtcagcatgatagatttattatttttttaatgaatcaataaaaattttaagaaaaattatagcatatactacagataaagagttaatatctcttatatttaaagaactctttaaaattgaggaaaagaccaaaacatgatgaaaaaatgggaaaaaaataaacagacaactcacaaaaaagattaaaatggccttgaaacattttgaaacatgttcaaactcataactaaagaaatgcaaactaaatcaatactgagataccagttttttacctatcaactagcaaaaattttaaaacatgacaatttaaaaactattctgttgtcaaggctgtgggaaaacagacactctcatactggagcacgcctgtcaacaccatttttctgagagcatgtgtttgcttcatgtctccatgtcacatttggtaatgcttgcaatatttcaaactttttaattattactatatttgttatggtaatctgcgatcagtagtctttgatgttaccattgtaattggtttcagataccatgaagacagcaaatttaataaatgttttatgtgttccgatgactctactgaccagccattcccccatctctgtctccttgggcctccctattctctgagacacaatattgaaattaggccaatgaataacatcataatggcctccaagtgttcaagtaaaaagaagaactgcacatctctcacattaaatcaaaagctagaaacaattaaatttagtgaggaaggcatgtcaaaaacccaaaataggctgaaagctaggcctcttgcaccaagcaagtaatcaagttttgagtataagggaaaagttcttgaaggaaattaaaagtgctgctttagtgaacacatgaacagtaagaaagcaaaacaagctttttgctgatacagagaaaattttagtggtctagttagaaaatcaaaccagccacaaaattttctataagccaaagcctaatccagagtaaggccctaactctcttcaattctatgaaggctgagagaggtgaggaagcttcagaaaaagagtttgaaggtaacagaggttgattcatgaggtttaaggaaagaagccatctccataacataaaagtgcaaggtgaagcagtacgtgctgatacacgagctgtagcaagttatccagaagatccagctaagataattgatgaaagtggctacacttaaaccatagattttccttttttttcattgttttactttacatctttattacatattttctgagactttattttaaaaaaaaaatttattcaggatcataatttgcatgacaataaacaatggtttcgtgggttccaaattcttaaaggtgaccataccaatttaaaatacaagtcatctttttgatttgcagcacctgacttaaaatataattcatctaatgcattcattaaaagtgtccgttcttttataagaaagatatgttttaattgctgttttccagactgttaaacatgggtatatattatttttaattggttagcagaattttactcacataatttatagccacaacaagagcctctagcctctctgaatggacttccactgagaacaatgatgataataaatatctaaaatgtaggcggagcgcggtggctcctgcctgtaatcctagcactttgagaggccgaggtgggtggataacctgaggtcaggagttcgagaccagcctggtcaacatggtgaaaccccatctctactaaaaatacaaaaattagccaggcatgatggcgcatgcctgtaatcccagctacttgggaggctgaggcaggagaattgcttgaacccgggaggcagaggttgcagtgagccgagatgacaccattgcactccagcctgggcaacaagagtgaaactccatcccaaaaaataataatgtatctggggtgtgcccctacttgacattgccaagtgtgtttccaaatattcttagaaaatatggtttttaaacacatgcataatattctaccacatgatgcattatcacttctttaaccatttatttcctaattgtttatattatttgcaactttttgatatataaataacattgtgatccataccttcattcataagttttatgcaagactgattatttctttagaatgatgtcaaagaagtggcttactagtataaacagtgcaaatggtctaaaggcttttagtgtactttaccaaataatttccagaatagcttgaacaaatcccaccaacagtatgttattgtgcccacgaagtggacttgataacagtgaagcaaattcaaccacaaatctattagattctcatccatctctaaactgtcatgtcaaagaagcaaggtattcttcttcgtattactggtgaggaagccaaattggaatgctttttaaaaatcactcagcattagatcagtaaaataatcaacagaaatgcttcccacaaaaagatctgggtttttcaaaaagaattaagaagagagggaaaagtcagtagcaaatgaccagaattttttgtctaaattctatttcatacgtagacaatctctcctatttatttgactttggcaataaaaaaccaaacaaccttgtacagaacagtgaaaacgccaagaatgaagcctacagttttactgtaagataagagtgtgtgtgtgtgtgtgtgtctgtgtgtgtgtgtgtgtgtgtgtgtgtgtgtgtgtatttatttatatttaaaagacttctctccatttggcggtatcaactctcagttccagccgttaaatacagacgtattttcaaaactacatatttacttcttcaagatcttcgatgctgtcatcatccacctctggctgttttttctgaatgatatcaattatgccatctgtagagtcttcctgaataatttcatcctcccctgttaccgaggtaccacaggagaatttttgagcagaaaaatctttgtgcttctttaagatcaacttcaaaagttgcaaagccacacactgtttttacatatttcttctttgctctgggaattttggctataataaccttttatggtacagtctccttttttggttttatttgaccccttccacctctcttctgttttttcttctccccttcccctgctattccttgacccttactaattccacttcttgattgggtgaattttctacagtaagtttttcaaattcatttcatttagcaacaacaggcatatattcacagtaccctgttggtaatgaacagactctgcaataaaggactcaaagtgagtaatcagcatctaacttggcactgttccttgggcctcctttgcaatcagccccactggatttagaaatgccagcagccatttcacaaacccaggtggtcacacaggccccgctgcctctacttctaccactatggccagttgaagtgacatacagcttgtcttccctggccagggccacccgagagcaatgatagattcttaatgtagacagaatagccttctgtgggtagctggtgccacctaggactttcatagctagagagaagtcaatgcctgccttgagagcctcaaaagacaggctgacactcttgttagggactaatgtagctggtgactttcagttaaagccaatgttcatttaccattccaaaaattctagggcccttaagaatgatgctaaatctactctacctgtgctctgtaaatgaagcaacaaaacctggatgatagcacatctgtttacagcatggtttactgattattttaagcccactattgagatctacacagaaaaaaagataactttcaaaatactactcctcatggacaatacatctagtcacctaagagctctgatggtgacatacaaggagattattattgttgtcatgtctgctaacacaacattctttaggccttggatcaaggagtaattttgacttttaagtcttgtaacttaagaaatacttttcatgaggctagaactcccatagataatgattgttctgatggatctgggcaaagtaaattgaaaaggattttcaagattttcatctggaaaagattcaccattctagatgccattaagaacatctatgattcataggaggtcaatattaacattactaggagtttggaagaaattaattttaaccataatggatgaccttgagagaggttcaagacttcagtggaggaagtaactgcagatatggcagaaataataagaggactagaattgtaagtggagcctgaagatgtgactgaattgctatcatctcttgataaaacttgaatggatgtggggttgcttcctatggaagagcaaagaaaatggtttcttaagatggaatctgtacttggtaaagatgctgtgagcattgtaaaaataacaataagggatttagaatattacatatacttcgttgataaagtagtgccagggtttgagaggattaactccagctttgaaagaagttctcctatgggtaaaatcctatcaaagagtatcacatactacagagaaatctttcatgaaaggaagagccaattaatgcagcaaactttattgtcttattttaagcagttgccacagtcacccatccttcagcaatcaccaccctaatcagtcagcagccatcaacatcgagggaagacccccctacacaagcaaaaagaggattcactggaggctcatgtgatcattagcatttttaacaataaagtatttttaaattagggtatgtacatgtttttagacataatgctattgcacacttaatagattatagtgtaaacataacttttatatgcacagggaaatcaaaaaaattgagtgactcaccttattgctctgtttgttttattttggtgacctggaacaaaacccacagtatctccaaggtatgcctttatacgtacttgtatttcttagctctgttcagtgagaacccaaaaacaatgacacatcaatacaataatcacaactggtgtccacatcttttttcttaatatcattctccaataaaaagaacagaggctttttagagaagtagatgatcccagaggcagggaaaatacaaaataagtctagaacatcttttggtgccaaaaagcaagaacttgctcaaaaaaagatagaggcttcttgaaataacacagcagtcaacctgaaggaaatcctagtgactaaagctggaacaaattgagcaacaaaattaatatagtattgaattataaccaataggataaaataagcccatacttattaaatcaataataaataaataaatgggagataagggagaactctttcttccaataggattctaattaataaatgtagaaagaaacaaagaggggaatagaaaatcactattaggcaaacactcaggaaatactgctgcagacaagatccactgatagatactaaaattaatgggcaaaagtttaaggagaaacaggatttgcatagcctcaaacatctcccttaagatatttattaactacaaagggaaagatgatagtagaagaacctagcagaaccttaacaaagtgatcaagggcaacattaccagttgtgttaggccattcttgcattgctataaagaaatgagactgggtaatttctaaagaaaagaggtttgattgaatagtcctgcaggctgtatgagcatggcatgtgtccagcttctgaggaggccttggggagctttcattcatggtggaaggtgagatgctagcaggcacatcacatggccagagcagagcaggaggtgggttggggaggtgctacacacttttaaatgaccagatcttgtgagaactcactcactgtggtgaggacagcaccaagccttgagggatctgcccccatgacccaaacacctccctccaggctgcatctccaacattgggaattacatttcagtctgagatttgggcagggacaaatatccaaactctaccaccagtagaaaaacatcactatcatgaaccctgtgatatgatccacaaagagggataaaacactctttttctggtattcttgacaaaaattctcagttacatcatgagaaaacatcagacaaacccaaaatgagagtcattcaacaaaataactgatcagtacccttcaaaagtgtcaagatggccgggcacggtggctcatgcctgtaatcccaacactttgggaggccgaggtgggcagatcacaaggtcaggagttcgagaccagcctggccaatatagtgaaaccccacctctactaaaaatacagaaaaattagccgggcatggtggtgtgcacctgtaatcccagctactcaggaggttgagacaggagaatcacgtgaacctgggaggcggaggttgcagtgagccgagatcgcaccattgcactctagcccaggcaacagtgcgagactctttctcaaaaaaaaaaaaaaagtgtcaaggaaatagaagacaaagactaaggatctcttacagactccagaagactaaagaaaaataactaaatacagtatggggtcctggatagaatccaggaacaggaaaagacatagtggaaaaactgtaaaatttgaataatgtctataggtaatagtattgccaatgttaatttcctggttttgataattttgctatggttatgtaagatgttaataataagggaagctggatgagggataaatagaaagtctgtgtactacttttgcaacatttctgtaagtctaaagttagttcaaagtaaaaaattaaaaaataaataaaagtcctactgccaaaaaaaaaaatggtagggctccaagctggaaaattactgaggcagaactctagcctgggatctattcttagcatctagtcccagcatgaggattagaatcagaattgagggactaagagaaaaggaagagagagttgttatttatggtgagccaccaagtcccaaaaatattaaaaatcaaactttagagttggaagggttttgctgattaggaaatcaatcgggtggtagtgaggaagaagacattcacagaaggagtaatgaaaaggaacatggagagtaagcgtgtgacagctgcaatattagtttaagtgatacaaatgccagtcagtatggaaattagaattttatttccaaacaaatttcagatattcaaagctgccttcactttatgtgagattagcttaattctgtcactgatccttcatttgaagtagaaaatggtctatggagagtgaaggcctgtgactcaacgcaagcgtgacatttttgctgccactcagtccctttgatgaagtttatgactagttttatcattttttatatacagcattaaatcaagagattttatacacaaggctgtattgacttctagtcttttctttctgtatatagcccacaggcctgcccttttctttcttccctcacaagagtaacctaaaacttacttgctatcttcctccaaagaaataatgcaactctgctcatatcagatatgctgtggatgaaattgttttaagaaaaagtttaggaatttaacagaaggaaaagttgaaatgaaaaaaataatgtaagaaagacatagctaaaaaatgaaatttaaacaagttactttgaaagacaagaattcgccaaggagaaaggttttacctgctgatttattatgagtagactaatcctgaaccattcccaaggagctgtaatagtagtgactatgtatgatgactttctcaaaggtgtagggagtgatctaatatctcttaccaagcgcgctggtactaatgagaaactgaagggaaaaaaatctacattttcaggcttgttttctatttttatacagagggaaagttatacgtaatattaatagaaaatttggaggaagtaacagatgtttttgacagattgtatgtgcatatacctactacgtaactactttaaaagtctagtaaataatctattttgagccacagtgcaaatctaatgaagatgttgcctgaattctgcagatgcatcaagactttatatttggaatgccaaagaaatatctaaaaattaaaagagaggcagccacagaaggtgcaactttatttatttatttttaatattcttagttaaattttctgcctcatacctttgtggatatcatattttttactataattctaagtagttattgctggagtcaaaaatgttattaatttttacaagaaaatcttgtaccaaaaatcttgaactctattaattctaatagcttgtttttctctatatagataactatatattttaataataaaaactatcttttccatttaagtctctgctcttcctatttcttttctttttctttatagtgctacccacaatcactcgtattatattggatagtaatggtgaaagtgggcatctttggcttctttccaatcttttttttttttttaaattttattttaaggtcagaggcacacgtgcacatttattatataggtaaactcatgtcacaggaatttgttatacagagtatttcatcacccgggcattaagcctagtacccattagctatttttactgatcctctccctcctcccactctccgccctccggtaggccccagttgttgtttccctctacatgcctatgtgttctcatcttttagctctcacttataagtgagaacatgcagtatttggttttctgttcttgcattagtttgctaaagatagtggcctccagttccatccgtgttcctgaggaggacatgatctcattctgttgtacagctgcatagtattccatggtgtatatgtaccacattgtttttatgcagtctgccattgatgggcgttaaggttgattccatgtctttgctattgtgaatagtgctgcagtgaacatacgtgtgcatgtgtctttatgatagaatgatttgtatttctttggatttatacccagtaatgggattgctgagttgaacggtagttctgttttaggtctttgaggaatcgctacacttttcaacaatgattgaactaatttacactcccaccaacagtgtataagcattcctttttctccacaacctcaccagcacagaaggtgcaacttcagcattgtcttttagatgaaacattcagccaagagcacagatgggttttttttaataaaatcagtaaaataatgctttttctaaatatcacaatttttatctttaaaatggtatcttcttactttaggatgttgcagctgattttctcagctgtgcttagcctcaacatgtggaatcaattgaagtgaaatatgatgaaagtttatattgatgtagaggtttgctgtttgctttttatcaagtggagatttgtacccatgtagacctaaccactggcattcactgttcattgagaggacagatcaattgctgacagcctttctctttaggttccttacattctgtttaagatagataaaatacagtaggtaaaataatcaccagtctatctgaagaaaagtggagatttttaaaatacaacctctgatttccactttccatattgtgctcagacttcattgcttcactcacaggcaattcctatcttcagttttgtatatgtagtaacatttcctgtattgtttggggtttttttatgtttaatgagaaggatttcaggtgtttaaaaaatatcgacatttccaacatgtgttagaagaactaggatgaccataccagtagatgaggagtcttttcaaagcagagctctttagtagatgactggcagatgcctgatgagttagaggtggtgttctcgaagagaggcctgaagagctggagttcatatgtctatgagtgcccctaggacagatttcagttgccggtatataggcacaaagctaagtagctgaaaaagacagtatacagatccttaagaatgatggcagtgaggaggataaagatggtgatgataaatggcagcatcagctgacattgctgtgattagtaggtgctgagcaccatgctgagtgctttctctacattcaagctgaatctcccccttccagtttggtattttctacacagtccaatcccttttctgggtagtaatgagccagaaaagtggtccagattaaaatcccctttgtacttgccgtggaggcaaagagaacagccagaagacctggggtgagtgctgtgcagattctaacaaacaaaaaacagaccctagaactccaggtcctagccaggcagcccagaccctggatggtattaatgcttataaattttccatgttctttgattttaagacctacatctaacaaaaatctcactcctttccttcttccttttatctaattctgatactctttttctgtctctgcctgggtgctcagaaaacatttaatgctaattttaaaatctgaattactttatttttataagacttagtttataacacacctgtaatccaaaaattgatagaagtatatgtgtttgttgagactaacatgatttttcttggattattttattcctcatgctttgtttaaagattagactatttcctatactgctccatgctgaataaatgttagtgatatcaatgtaagtctttattttcagacttgcttcctatttcttgtaatccagaggaaaactccatttttatttacaaattttattctgggttatgatatcatatgcatacaatagaagtatcaaatttctgatcttacataaatcagacgttttctgagttagtagcttttatatttacttggaaaagttgaggaatgaagagacaaaaaagtattatgtaatactgagatactaagtgatttctagtataatcactcaatagctgataatcatagctattgctcttactactgataagcctgtttgcattctcatctttcttttgcaggtggttgcctatcactattgtcaagcagataatgcctacacttgcttggtgccagaatttgtccacaatgttgctgccttgctctgccgctcacctcagctgacagcctatcgggagcagcttcttcgggaacctcacctgcagagcatgctgagccttcgttcctgtgttcaagaccccatggcctccttccggaggggagttctggagccactagaaaatctccataaaggtacagataaggcccaaaggaggggaaagatggaggtttagagcccaagttcacccgggtcatactataaaaatgattgattttatcacattgccaaaactaaatgttccatagctggatatcctgtaggatacagttaacagacaagagattttacttgcaaaaaaaaaaatccagcagtaactactccttcctcttttctttataaaaattcttattcttatttccaaatagaatgccttttccttgtcctgaagatagtagagctttcagtcctttctgtgaagtttaaataagtcagtaaatttgtggctccaacgcagtgttgtgaagtttctatggttagaaatcccccctgtaatatgtaatattaataaaaaacatattttattaccccatcagttcatgtgaagtggaatggcctccatggttacacaatgctctgtataaaccagaaatcatttaactgtacactttaaaatctacttaaggggcataagggtattttacggtgcataaattgtattataggagagctgttattttttaaaagtgaaaaaaattaaatgagatccatctcccattcatgctcatgcctttcctccctttttcctctgcagttctagtgttagcagtggcctaagtgcaaccatttccttgaaaatggtacctgccttcttaagtcttcctgccccatactcttaacaatgttttgttagtgccagaagccaaagaaaaggatgtgggtatgcataaaattcctgagcaatcctgtttattcctgagagacttagacacctttctcaagggctttggaggcactaataaggaaagatggtttataatttctcctggccatcatcttcagttatttcagcttccatgctggttacttggatatcagaatttctctttctcctctactctgatgacctctgtcactacctttgctacctgttacctttttaaacattgccgtttctccacaagtatttttaagcctatttcctggacattcagtcaatctctaaaacctgttaattctgccttcgtcatgtttctcacacccacttggctcaattgtttctagcatcattaccacaaggactgttcatctgcccatagcatcatatctataattacctcatcctggtctttcctggttctcgagtttagtgctctttccacatcatgacacacttacaaaataataaaactttgtatagcatactgggataaaaatttataactcctcattgctggacatgactggccctgaggagacagctctgccaagcctcagatgtcctgagggctgaattttaagtacacttctaaaccattcatggcacacctggaggggaagttcttccccagtctctccagtcttctagactttatgtgtttcttccagataaagttttataaaacacttctctgatcacataattcctcaattcataatccgctgattgcctattgccttctgaattaactttcaattccttgttctgacattcaagatgcttgatggccagtatccaacctacttttcagccttattattcactgttatccttaggaaccctgtgtttatgtgtaaactaaaatattcactagtcctcaaatacttccctagattttcccacctccatatatttactcattattttccttcttgatataccttcttcttaaatctctgcctgtcagaattccacccatctatcaaggaccagcttaaatgctacctcattcatgaaatacctactgatctacctgcccccctccagtcagaaatgatgtccttccaaataacattagatcctttttcaaaatatatatatgtatttatggtacataacacataatgtataacaagaatttaaaattattattattaatatttattaaatatttaccatatgccagatacactttgcagtttataagaattacttttgtacttatccctttgagtaaattgtatgttattgaaattaggaactttgtaaaattcagcttttatccttcatagtggttacctcaccttgaacatagtaggcattttaggaaatatgttttgaacagataagtgaatatagaaactgctcacatgtaggagtaccttgaaagaaacacagtgatacaaggatctacaccttacagccaattcaagaagactatccatcccagcactttgggaggccgaggcaggtggatcacgaggtcaggagatcaagaccatcctggctaacacagtgaatccccatctctactaaaaatacaaaaaattagccgggcatggtggcgggcacctgtagtcccagctactcgggaggctgaggcaggagaatggcgtgaacccgggaggcggagcttgcagtgagccaagatagtgccactgcactccagcctgggcgacagagtgagactccgtctcaaaaaaaaaagaaaagaaggctatccaaatgcttgcagtcagctctggcataattcatatgttttatagttttgctacaagatatatctgcctctcatttaggtctccataaccagctttagtgatctctattataaatactgttctaagtggatttaattacttcattttatttccatgtttttaactcacccttaaatcaccattgtgagcaatagctggaaacacaattttccagctggaaatactaaaatttattagagtgacccaaaagaactcaagaaataaagaagaatattttttttagagatagaacaagcaaaatggtagatgtataagcaataatatcaacaattacattacatgtaaatgggctaagcacttatattaaaaggtagaaactgtcagactggataaaaagcaagactcaaccatatgcagttttttaaatataaagacacagattgaaagtaaaaggatagagactgtataaacatggagcataagaaagctggagtgactatagtaatctcagacagagtagacttcaagacaagaagtatttctaaagaggcatttgataaacataaaagggccaactcatcaggaacatgtattagatgtatgcacctaataacagaggttccaaattcatgaatcaaaaatagaccaaattagagaagtagctatagtcccaactgctctggaggctgaggcagaacagtgtaattaatgactatctagttatttaatgtttagcatatttttatcccgctaaactataaaagctgcataaccattgaagacatagcagctagtatggtaactggaacataaaaggaatttaggctaggcttggtggcttatgcctgtaatcccagtgctttgggaggccagggcaggaggatcacttgagcctagaattcaaaaccagcctgggcaacatagcaagtacccatctcaacaacaacaccagcaggcatggtggtgcacagctgtagtcccagctactcaggaggctgaggcaggaggatcacttgaacccaggaggtcaaggctgcagtgaaccaagatcatgccactgcactccagcttgggtaacagaatgagacctggtctcaaaaagaaaaaagaaagttaatcagtgtaattcatcatattaacaaaataaaggagaacatccacataatcgtttcaataaatgtacaaaagcatttgacaaaatactacatcaggggtccccaatccctgggccaaggatggatataggtccgtggcctgttaggaaccaggccacacagcaggaggtgagcgacggctaccgcctgagctccgccttctgtcagatcagctgcagcattagattctcataggagcacgaactctattgtgaactatgcgtgcaagggatctaggttgcgcacttcatctaatgcctgataatctgaggtggaacagtttcatccctaaaccatcctctccaccctccaccccagaaaaattctcttccatgaaaccagtccctccgaagtacaccaattagtgataaaaactacacaaactaggagtagaaggaagtttagtctgataaaggacaactccaaaaatacatgtagtgaaatgttgaatgcttttttcccctaaggtcaagagcaagacaagagtgttccctcactctcaccacttatattcatcattccactggtggtccaggctagtacaataagaaaataaacaagcatgcaaatagtataaatattggaaaggaagaagtaaaactgtctttatttgcagacaacataattgtttaccttagcaaactctaaggaatctacccagaaaaaagaaatctgactagaactagtaagcacaaagctttaggctataaagtcaatgtacaaatatttctatactaacaacaaaatactgaaaatgaaattttaaaactacgtggcagttttaaaacatggctacaaattctttgacattacttccactaatagttcaacctgggtcccctcccttcataactgggcaggcttgcaactgcttcagccaacaaaatgatgctatgtgacaactgagggaggtcataaatagccatgcagcttccatcttgttcaccaaaccacttgctttgggaggcatgtattgccatatatgaaacctgactaccctgagttcaccatgctgcaaagcacaaaccacagggagagtctagttgactgtcccagtgctcattcctgctctgccaccaaacatatgcttgaataagcttccaaatgattccaacttccaacccccagccccagacattcaggtaaccccttgctattcaatatagcaacaaataagtagaataaatacgattttcagtggcaccaaaaaatatataatacttaaaaataaatgtatgaaagatgtgtaagacttagtgaaagcacagcaaaaatattgcagagtgaaattaaagaacttagtaagtggaagagatatgtcataaatgaggattggaagatgtcagttttttcttaaactattctatagattaaacataatcctggctggttgcagtggctcacgcctgtaatcccaacactttgggaggccaacgcaggtggatcacctgaggtcgggagtttgagaccagcctgaccaacatggagaaaccctgtctctactaaaaatacaaagttagccgggcgtggtggcacatgcctgtaatcccagctactcgggaggctgaggcaggagaatcacttgaacccgggaggtggaggttgcagtgagctgagatcatgccattgcactccagcctgggcaacaagagcaaaattctgtctcaaaaaaaaaaaaaaaaaaaacacataatcccagcagaatttttctgtaaaaatggacaacttttagaaatgcaaagtaccaaaaatagccaaaacattcttgaagaagaaagttggaagataggatctggtttcaagacgtacagaattacagattactataatagtcatgacagtgatatgctagtaaatgtttaacatccagctcagggatggggggctgatttgatgcttaaaagtttagcaatcagctctcatgagccagcttgagtcaggtccaaaattccacagacaggattgtattcatacaaggatagaaaatagatcaatggaacagaatagagaatccagaaatagacccacatatgcagtcaattgatcttctctaagatgccaaggcaattagagaattcttgtcatcagatggtactggaacaactagataaatgtttggggaaggggaaataatctcaatccttacttcacactatacaccaaaattaatatgagatggatcacagacctaaatagaaaagttgtatctctaaagctaatagaaaaaacatagaatatcttcacaaacttggaataggtaaagatttcttaaggacacaaagtatcactaattatataaaaatgatgacaaattagacttcatcaaacttaaaaatatttgctcaacaaaaaataccactaagaaaaaggaaaagcaagtcaccaaagaggaggaaatattcactatgtttctgtgtgtgagagacaaagcacttgtatctacgatacatgtagaatgcaaacagttcagtttttaaatggacaagcgatttagacactttacaaaagaagatacgtcaacagcctacaagcacatgaagaagtgtttaacatgagtaatcagggagatgcaaattaaaattacaatgagaataccacttcacacccattagaataccacttcacacccattagaatggttaaaatttaaaagaatgaacatccagtgttggtaaggatgagaaacaactggaactctaatacattgctggtgggactatacaatagcgctactactttggaaaactatttgtcagtttcttttttttgagacaaggtctctcactctgtagccaagctgaagtgctgtggcatgagcacagctcactacagcctcgaccccctcggctcaagcaatcctcccacctcagccttctgagtaaccgggggctacaggcatacaccaccatacctggctaattttttttttttttcagagatgggggtcttgccatgttgcccaggctggtctcatactcctgggcccaagcagttttcccgcctcagcctctcagagtgctgggattataggcatgagccaccacacccagccaacagtttcttacaaagttaaatgtacatctactttatgaccaagcaactctattgctacgtatttacccaagagaaatgaaaacatatgtctacaaaacacttgtacaagaatgtttctagcagctttattcatagtcgtcaaaaactggaaacagcccaagtgtccatcaacagaatagataaattgtagtacattcattcaattgaatacttcttagtattaaaaaggaacaaaataatagtacaatcagtgtagaagagtctcagaaacgtgttaggcaaaagaacaagtgtctgcagtgatagaaataagaacagtggtttcctattgaggactgactggaggagaacctaacaaatttctggaaagatagaaatgttctaaatttgatcacagtattgcttacatgagtacatatagctgtcaaaacttatcaaagtgtatagttaagatctttgtaattcactatatataaattttgttgcaataatttttaatatagaattattttttaaaggtagctggagttttttcaatggaaaacactttcaatttagagtcagaagctagatttcaaattatgtattttctttgaaaaatgagtcagtatttttcacagtactttaaagttccacaagtacagtgattaaaatacatacacgcacacccacatgctcatataaaacaaatgaaaaagttttgaagtttctcagtacacttttgctttagctaccaatatgaaatgaaaggagacacaaattgttttgttttgtttcgttttgttgggacagggtctcactttgtcacccaggctggagtacagtggcaagatcatagctcactgcagccttgacctcttgagcccaagctatcctcctgcctcagtaactaggactacagaagcgcaccatcatacttggctaatttttttctattttttgtaaagatagtgtctcacgatgttgcccaggctggtctggaactcctggactcaagcagtcctcccacctcagcctcccaaagtgttgggattacagatgtgagccaccaggctcagctgagacactaatttgttaccacactgaaggaaagataactcagatattatgtgaagcttttcagaacaaagatattgtctgatatgagtcttctttttcaatttcaacaattcctatatataccagtaaaagaatctcatgtgccgagattcagttctgacttcagtactagctactatctcttctcttgcagtctctgtaattcttatttctctcaggcacctaggtagagtcttacaatggaactactaaggaagaaagttcacgtatttgttaggaatacatgtaagtggaggcagtggggaatccctggtgaacgtgtatttacaagggattaaaaataaggattttaaagggcttgggaaacctttttagtgacttgtcacctagagcagtggctcctaagcaccagtccatttaaagtttttagttagtccatgacaaaataagaaaatagcaacagctcagaatttgtatggatgtagatataatgtagttttccatatatatgtatgtaaagattagataatgtccctcctacttttttaatgttaaaatcctttttattctatgaaatatggtgatcgtggatggtaattatattttacatgttcttacatggcaaaatacgaagcagcaatcctttgttagtccccaatttatttttatttgtaaattttttttaagctactgatttaaagtactactctaaatatctacagaaatttgaatgagtgaacatactgaagcattcttgtaggctggttgcatttcaaagtgaaaatctaaagaacattagtatctcacctcttaaatttataattgagaaaccttatcatttagcaaaggaaaatgaattatttcaggaacagttctcattgttttacagcattagtagcattaggaaattatttgcatttatcgttctgaatcctaaaaattatgatatccttagataaatatgccctccttacttcctaagtgatgacattttttttgatacctacattagtaggtgacttgtaagtaattccttcaaaacaggaaatctcaaaaaaaaataataatcagaatttagaagaataaaattagctttattaagggggaaggcaagtacccccttttaaaaataaaaaataatatatcatctactttactcatgggcttaatctactaagaatttatgcaaatgaaaatgtaattttattagcaaatgaattattcattcattaaaatgtctggaccataatttactacacattactgatctccatgcttgagaatgtgtttgcaatgatatcccaaagaaaatcccaacagatgcattatcatcagctgttttgtctactggaaaatcatgactttcttatgaaggaacctggttgaagttattaaaggagatataattgaagggcggggacagtggtgtgctggtaaatttttaacagccacctgggagaggagggctgatttgtaatatttgccaatttttattgtgtaaatattcccaccatacacaattccaagctaccagctgtttaacagtcagagcttgaaaatattgcagtggcctctcctgaaccagtacagggatagatagctccagcacagtgagtgatactagctgatggtgcttagccaggcagaatgcaactagaaaattcctctatggaaattaaaggcatggttaagcttaagggagccagagccttcaaaatcaagaacataacacccacccccctcgttgtttgggtaaatcccagttagttccaagcaactcctctttcttccttaatactttgcactccctgaaggaatttcatgttttcttagtgcttcgtcatctagaataccactccattagtagtgattgttaatagagctggaatccatagttcatttcactccctaaaaacttggcagatgaaagtaattgttaaaattcttcataatttgagaactgatttggatattgaaattaaatctcttttataaagtttatgctttaggagaaaaacaataagggcttattaatcattgcaaaagatctgtatattttcaaatatggaaacaaaatagtatgttcagtttcaattggtcttgactttcaaaggcaaaaatagccaattttgtatgcaagtccacagacattttcttctgtcctcggcttcttctttttcctcctcagataaaacctgtttctcactccaggtatctgatgactgcttgccctcttccctctgctttccccctttcagagcctgtgagatcctgctaacaaataacttttatttgttattcacaattcacttagactaaaatgttctttcagtgtggaaatttttgaatctctaattgttgaaccaagaatcaataagcatttatcaagtgcagaagcctgaaattttcccaagctgcttcgtcagcatagccctaaagttaaattgattttgtcaatgccggatcatgtggagtccaagagagaactggacacaaacacagcagatgtttgtcttttccacttgactcctccacttttgggaagatcatgcaagggactggtctcattgcggctgctttaggtatagtctaggaagctgctacggtgttgggatctagccacctggttcaactctgtctaatgcctgggattccttttctctgttactctgtctcttccttcccactacacattcacattcacatgcagtcctatatactgttttagactttagactttacataaacctttttggggacattcccaaaagaacatatgatactattctctttaatgctgtcagatagggaaaaaaaaaaaaaaaaaacagaacatgttctactcagctttttcatgtgtaagagaaaaattacttcccatgtgcaaattttcttaactccaatactcaggctgtctcacaactattaatatggagatttctgaaaatgatgatatatatactcatatgtgacaaaagccttcatacctgattaaaagcaaaatgaatttactaagttaatttttccatgcccttagaataaattatgtaccctgagcattcactaaacacatgacaagccttttctaatattttgttccaaagaaatatgtgatcaaagatccagtaagaactcatttatccacttggtaattattaagtaatgtgtttctttctatctcagagagaaaaatcccagatgaagatttcatcattttaattgatggattaaatgaagcagaatttcacaaaccggattatggggatacaattgtatcgtttctgagtaaaatgatcggaaagtttccttcttggctcaaactaattgtaacagttaggaccagtttacaggtatgtgtttgtttgcttttaaaccataaatgattcctcttggaaagagcttagactgaaaaagttctaggtcctagtttcataaacttctactatgtcctagagcattatgaagaataattcccgaagaattaatctaatattttgagagatatgatctagaaagacattctttatacgtgactctcagattcccatttctgttgctctggatgaggtttaataaaatgttcctcaaaatagcatgaaaagaaagtcaatttttctagactgttctgaggacagcagtgtaaagatgatctctaacactttgactttcgtttaacattttttgatcatttaatgctatgcaaaattcagttcaatctacatcctagaatgagattttctggttcctccctctgcttctacttaaacaactcttctatagcatgaatatggactttcctctatatctgtcctcctttaacaaaaattggcaatattagggctttagattaaatttactacaactgagagagaaggtttttgttgttgttgttgttttttctaattactttcccttctcactcactggtcacttaatggcctggaataaggaccaggaatgtgagactgagcctgtaaaaatatatgggctaaagataaatgactctgctttccccagccttctcattgtagctgagttggtgtcccattctttacatattcacacttggtttggaacaatgtttctcattctttttataaaaattatttcctcctatgatgaatattaaaatctcaaacattatatgcttatctcactatttggatgcagcccccttgtcataagtgctgatgtacagaaaatagtctgtacatttaagtccctcctttccccctctgccaggcacttagcattatttccatatattgaccagttagcattactgtcttccatgatgagaaactatatttctaatcctggccaccaccttacagatgtttattattaatctcaaagtagtttgagctaaaggatatggataaatcaatataaatccatctttacaactaaaaattatataacctatcattattagtagcttgattgttaaaaatgaaagatgaatgaaagaaacctccaggaatgtaatctctgactgctttaccaaatggatgctttggagatgttatcctcatacatattctcacataatatcatgtgcagtctcaaaagaaattgtgtttccggatagagtaggtgactttaatttttcagctgtgccaacagaaaaagtacttcaactaagaatttttaaaaattatttcatttccgacagtgaaagaatttataggttttagaaaatgagccttcatttatatttgatcatcattatttccacaaacatttcttaagagtatttcagggactgttctaggggctggagattcaaaatgaacaagacaggcaatattcccatcctcctaaagcttatattttagtaaggaacacaaaaaacaaatgagcaaaaagttaaacatatactaaaattacaggtagtgttgagtgctatgaagaaaaacaaaatagggtggagggataactggatagtagttgttttagataggatatataggaaaggcctctcgtttaaaagtgatgagatctgatctgtcttttttaaagatttctgtcaactggccgtctacataataaaatgtaagggataaagagttgaagcagaagtataggtgaaaggtaatggtggcttagactagagtgataatgatggggaccatgtgaaatggtcatatttcgttggactgtattttgaaggagagtaaaaggacttgatgatgggctgaatgtgggtgtcagcaagagagaagactcaagaatgaatcctgggtatgttgtgagcaaatgggtgaatgatgatttgaggacaatagaaagatcacagatatcttctagaatttggtggtagagtcagtggtaatgccatttattgacatggggtgagttttgtggcgggggacaaaattaagtactgatttggtcacattgtctatgaaatatccaaatgtaaatgttgagtagacagatataagatgggactcaggggagatgactaagctagaaacataaagttaggcatgagccacatatagataatatttagcaccatgggactaaagaatctattgatgggagtgagaatggctagagaagaggaaagaacagagcccagagccctgggtgagctgggaaataaaaaaaagagccagcaaaaaagggaaggttaaaagtggccagtgtgctaagagagaaaagaggggaacgttctctgggagcaagctgcagaaagtgactccaaaaaaagtgcattgaggtgagatgcgttgtgtcaaatattgccgagaggttgaggaagatgagaactggaactttattatcggatttggcaaagtgaaagttactgatgcccttgacaagaaccatttcagtgaggtggtgagggtgcagcctgattggaacaaatggaggagagaatgggaaggaaagaattatagatagcgaatacagaaaacttttgtgaaaaatgggaacagagatacagggtagtagctggaaggaagaatatggagtttatgtatgtgtgacccagctgagaagaaacagatgcaggagagggaatgggtactcacaggagcaaagtccgtgggtaggtaagaaaggatggaatccagtgcataggagtagccacaaagccatatcaccttcccccagtagaatttccaacagattctattggaatctgttaccaaggtgccaagcttcctactgttagaagtgtacctttcggctaaggtatctccagaaggcccgcatttaaatgtagtcattttatacatctgtgttgtgtgggaaatttttttttaaatagtcattttattaggagagttagaaagccaactttttctaagccagtctttgaatctttgtacatttctcttactgacttgtacttggcattatgccctggtttacactgagaaaaattacagcaaaagagttatacagtgctccgttttctatttatttcaggagtgttgtttagaatgacgatcatgaaatcactccaaaagcactctttacaaagacccatttaaaaatatatcttaagtctcaatgttaggagaagttgtgtcccttctatgcaactaatttgttttactttttggatactaatacttgatcatgtttccctgtttggccacttcgaagttcagaatacatttgtgaacctcatagtttatcacaagagttaggggaaactgaaggtctttctgtctctttctctctctccatctttttaggaaattaccaagctgctgcctttccataggatttttttggatcgactagaagagaatgaagccatagaccaggacctgcaggcttacatcctgcaccggatacacagcagctcagagatccagaataacatttcacttaatggcaaaatggacaatactacatttggcaaactcagttctcatctcaagaccctcagtcaagggtcctatctatatctgaaacttacatttgacctcatagagaaaggctatctagtgttaaagagctctagctacaaagtagttcctgtttcgctctcagaggtttatttactccagtgcaatatgaagttcccaacccagtcttcctttgaccgggtgatgcctctcctgaatgtggcagtggcctctctccacccactgactgatgagcatatcttccaggccatcaatgctgggagcattgaaggcacactagaatgggaggattttcagcagagaatggagaacctctccatgttcctaatcaagcgcagagacatgactcgtatgtttgtacatccttcttttcgagaatggcttatctggagagaagaaggagagaaaaccaaatttctctgtgatccgaggtaagacatatatctgtgataaacaattctgagtctgttttctgtttattgcatggagtgtgagtattgaaagtagaagtgttcttcattgaacatttcacatagaagagacatcatctgtgtttcttctcaaggcaaggctataatgaggttaactaatttattgttttacaatgttatttccttaagactcaacatctgcatagatatttagaatgctatcctacgttcctgtgttcttctaaataattttcactgaccccacagggttcacaggctataattaagttaaccatttaatggacttcctcagtattattattctgatatgaagaaagaattgatatattgtaaatctctttgatttagggcagaatcatttcaaagtttttattgcccttttataaaaccttatcatttttaaagtttccagtgactaaatccattaaagtccagccaatgctaagctttatactagaaaatacaatcttaaacctcctagctgaaaaagatttgaagagatcagctggtctatccatgctgcctttagatacgtaaggtgtcattatctccattttgctataaaggccttaagatgctggatcaacttgcacaaagtcataaggttaatacatgggagaagggaggggcacacaccagaatagggatcacaagtgcatgatatatcccaccactccccaccccacacgcacaacaggatcactgatttaccccagcactctttcccaatgagcttgaacctgacttgagaatctttctcaactcaaaccagactagatatgaaactgtttccctttttattgcatgaaacctagttctctggcatcctggtcggggtgtgcttttactccgtcatactaacatttttaaagacgtattcctttaataaagttggtgttttcaaaagccgggtacattactgacttcatggaaacaaagaagacaccaacaacatagctggcaaatgcagagcttattttggctcaaaaagaagaggccagatttgactatgcctcacatgtgactcatcagaaagaataaaactctgtgttcatgctggggttttattgcccttcaccgtgtccttcaccaggccttattagagacaactgtactgtgggcatgctgctcagcctactccatgctgattcatcagaaaattagttccagattatgatgaagatattaagccaggcaatagactttgtagcattttctctgagagggaagcttttttaaagaaacatgctgtagtggaaagaacataaactcttgagtcaaattacctgcatataaatcctgcctcttctaggaactttgacctttggaaaaagttacatagtgtttctaagacttagttttcttatctacataagagcaataataatgccttttttctagagttgttgagaagttaagtgaggtcatatagtatgatgcctagaatagtacagagtaaaagaaacacttggggtatgttctttttcctcccctcaccctgcagtaatagacccttctggtgtatcttagttaaatcctgtggctaatcggatagcgacagccatcttctgctgttatcattttggagcacaagattttaaaaagaaacaataaaaacaatccaagtcccttctgtgaattgtatgatgttcccaaaaggattttactataaatcctactagagctgttgtcaatatttaatacaaagaactggcaactatgtatataggaaaaagaaactaatgtagaattgcctaataaacgctttgagatcagttcccagagaaactttgctagctgatctgggaccttagatcctgggacatctcagaggattgaaagctgaggtccaaggcaaccagactaccactgaattaatagtatccttacaacagatgaaatcctcaggggctctcagaggagaaaatacggcttttatacagccatatcatgactatacaggctttgccttctcaacatcgcattttaactaggagttttgcagcaaccgactgatgcactgggacaagaggagcaggtacttccaacttcaaatcctgtataatccgttccctgatgattgaatagcatggctgctgagagatcatcttatttcacttaatggcagagagtaaaattgtaaacaggaccaggagttatcaaaaaaagctttcttagatttcatttcagttggaactcagccccctccccagcaatggctggcaccaaccttgttactaaagtactgaagtattgatctcagtgcttaaggctccctaggtcaatgagatggaaattcactaagaatttaatgctattggcaaagcccaagctggtctttcaaagcagctggctgcacttgttttccatttcaggcaggtctgattagcaggactctctccaggcatggtttgtctttgtggccttcagcctccacttcttgcacattgtttctccttctgttctccactttctctccttctctctaaagcatctttcagtagatcaaagaagaccaattcagtgcctctgaaatcacaccaggtaagccagtgcctgacatgtacatctctgtggtgtaaggagagcttccagaggcaacacaacattcttaccctttttagtccattttcctgggctttcagcactcaattgccaaaaagtagttgatcttctccagaaataggctacccaaggaggttgcttctgcctgagctgaaaagagtcagtaatctgagaatggtgctggaagcaggaaatagcagagccagaggttaatgctacagctgagattgagttttcattattttgaataccagactgcttattgtctcagaatctgggcaaggacttgacctaccagagagaatgacctaacgttacatagatgtatcgttgtctcattgtcatagaaataaatgagtaacaaggtgagtagagtgagagagagagagagagagagagagtatgtgtgtgtgtgtgtgtgtgtgtgtgtgtgtgtatgtgtgtgtgtatcaaactgtaagcagagtatcactgaagaatcttttagatttgcagtttaggtaaaatatgccccttgaagcaatcacaaaccttagaccataccacctcattctgctctctgtttcccactgttcatcactgtcagccttctgacataccctgaacttaatctgtcctatgttttattctcttgggcacggagatatcagattaactcactaatttaataagcgaattcctgctattatgctaatagtaaagagatggaaaacctatttgaggcaacttgtgcatttaaaataagacatttgagagaagtagtcatcggcctttgttaggcaaccttttagtgactctcatagtagaaatttaaggctgatagagtagacagtcggagctaccagccttgtggtgcagtccagttactgcttaatatttctatatcgctttaggctcgccctgaataaatctccactctgttctgtttctattcctcattttctcaattttcatgatatctaactttcccttccataggaacggctctcagattaatatttgtgtgtgtgtgtgtgtgtgtgtgtgtgtgtaagattttgccagagattaaaagactactgcgttattatgtgtgtatttttgtggggtttgtttttatttttttaatacagtatctcactctgtcactcaggctggagtgcagtggcacagtcacggctcactgaagtctcaacctcctgggctctggcaatcctcctaccttagcttcctgtgtaactgtgaccacaggcacatgccaccatgcctaattttttttgtttgtagagaaagagtcttactgtgttcctggtctcaaactcaggttcaagccatccacccaccttgtcctcccaaagtgctgggattacagggatgagctactgcaccagcatttttttttttttttcgagacagagtgtcctgtcacccaggctagagtgcagtgatgcgatttcacatcactgcaacctctgcctcctgagttcaagcaattctcctgcctcagcctcccaagtagctgggatattacaggtacctgctaccttgcccggctaacttttttgtatttttagtagagacggagtttcaccaatttggccaggctggtctcgtactcctgacctcaggtggtctgcccacctcagcctcccaaagtgctaggattacaggcataagccaccgtgcccagcctagccagccttatttttaaatgtttgaataagatacaagaagcttgttgtgaacttcatgtaatgagtgttgagttgatacaacctaatgagattgtgatgtgggagcctaaggttgtgatgtgggagcctaatttggtttgacctgatttcctcaaattaaagacagcaaatcctgtgatgaatggaaagggaaaaggcgacacaaatcctacctataccatgggatagttgagtacttacttgattctttatgaccagaattgattgcttataataagtggtttgtcgaggtttttcctaatttatttgaccatattagtaagtgaattacacgttggagacctgatgctccaaaatccattgccacaaagcagggtgtcagagaacaagcagtttgtctaaggaaaaagagagggtgtcctccccaaagtgaaaaataactgtgccagaggtctgtataacagggcttcttatagaatagatggggttgaaatgactacaaaataaatggtgagttgaagtttgtgttgattttgttttttaaatctaaatatgagcctccaggcaagatgacaattaaccttaccctcactgaagcacaaacttgaggtcactgctcctgatagccattgcaggctcccagagcagacccttaaactggaggatgggttctgctttctcaaagcattaggagagaattcagcaaaatgatgaagcatgggaaggaaaaagggcctcttagaactaaatcaacccttaggaggcttggaagagttaaagcagagaaaagagaatgtaccagacatcttttattcacactttcaatttttttttaatttttaatttttgtgggtacatggtatatacatacatacatatatatatatatggttacatgagatattttgatataggcatgcagtgtgtaataatcacatcagggtaaaatatccatcacctcaagcagttatcctttgtgtttcacacaatccaattatactcttttagttatttttaaatgtttgattaaattattttttactctagtcaccttgttgtgccagcaaattctaggtcttatttattctttctatgttttgtacccattagccatgccccccctttccaccaacccctccccagtcctgactacccttcctagctggtaaccttcccctactctctatctccatgagttcaattattttaatttttagctctgacagataagtgagaacacgcaatgtctgtctttcagtgcctggcttatttcacttaacgtaatgacctccagttccatccatgttgttgtaaatgacagggcctcattcttttttatggctgaataatactccgttgtgtatatgcaccacattttgtttatccatttgtctgttggtggacacttaagttacttccaaatcttggctgttgtgagtagtgctgtaacaaacatgaaactgcagatatctcttcaatatactgatttcctttcttttgggtatatacataggactgggattgctggatcgtatggtagtgtcacaggatctttggggtgttgctttgccagccagaaacctctgtggctgacagagccttctgcctgagtattgctcacaccctttgggatcgttctgcctactcagctcagcaggctgcactcagctcgtgctactggcccagatcccacacctcccaagggtgagccaggcacagaacagtgagcagtgtgtggacaagagagcatggggtccagccactgcacaaccaggcacgctggctgctgcagcagggcaggcaactccaggcaccagcacaggtgccagctgcatgtgaggctgcggttgtaccaaacatattgcacgcagcttccactgcaggcaaccacgtctggacaaggggaatgcggtggcacctggaagcttggagacaccaggaactgctgagcccaaagagggtgtcacagccatagctcagggagtccctaggtctgggctcctcaaagaactgcagctcttctctccttctcatcgtccacaatgtggcgagcagtggggcatgtttcagctctttcagtcccgccattcagcaggtcctgaggtcttgtcctgcatccaggaagaatgatgttcatggacaactggagagtgagcaatgcagagaggagcttcattgagcaacagaacagctctcaagagatccaaagtgggaagctcctttccacaagcaggtcatccctgcaagtgtccagttctcaccagagaggagacctggattgagtagctcctatgcacaggcaggttgtcccgacaagtgtacaaccctcagcagagaggagacctggaatgggtagcttctatctacaggcagtttgtcccatcaagtgtgcagccctcagcagagaggagacctggagtggatagctcctatgtacaggcaggatgtcccaacaagtgtgcaaccctcagcagagaggagacctggaatgggtagctcctatctacaggcaggttgtcccatcgagtgttcagctctcaggggagaggagacatggagtgggtagctcctatctgcaggcaggttgtctcatctctgtgagtttggctgagtccagggtttttatgggcttcagaagggaggacatgcatgctaattggttcatgggcaggcctggaaaaagcaccataagttctcactcagggccatggactccacccagaactgacagcccagcccccatgcttcaggccgtttctggcctgaaggtggggcttcactggggacccactcctttccacccaggagcctgtctgcctcctgccaccatcaatcatgtcatccatggcacccaggctgttcatgccgagaggcacctgcaggccgagaggcacctgcaggcctgcaccaagccaccctcagcctaccctcagcctccctcccatgctcgtcagcacccaaagtccagaggggactgaggcagcatggggctggcgtgtcaacactgccctgaacagacatacacctggccgggtcacaacagtgcccagcttcagcctcagctttgctccgaaatcagagtgggcactgggaacagggagaggccaagtagagctggcacttctgagcctgtgggggtatggggatcttcccgggcccccaagagcacatggatgcccaggtctgcagccatggctgggcagggctcccaccctgacaactcaggagggggcagggctcccgtctgtttacagctcaccctagactctatttatagttttttttaggaacctccaaactgttctccatattgattgcactaatttacattcccaccaacagcatacaagtgttcccttttctccacatccttctcagcatttgttaattgcctgtcttttggataaaagccattttaactgggatgagatgatatctcgtggtagttttcatttgaatttctgtgatgatcagtgatcatatacctgtttgccatttgtgtgtcttcttttgagaaatgtctattcagatcttttgcccatttttaaatcatattattagattttttcctatagagttgtttgagctctttatatattctggttattaatcccttgtcaaatgggtagtttgcaagtattttcttccattctatgggttgtctcttcactttgttgtttccttcctttgctgtgcagaagctttgtaacttgctgaggtcccatttgtccatttttgctttgcttgtctgtgcttttggggtattgctccagaagtctctatccagaccaatgtcttgaaaagtttccctaatattttcttttaatagtttcatagtttccggttttagatttaagtttgcaatccattttgatttgatttttgtatatggtgagagatagggatctagtttcattcttctgcctatggatatccagttttcccagcaccatttattgaagagactgtcctttccccaaagtatgttcttggaaccttttttaaaaatgagttcactgtagatgtatgaatttatttctaggctctctattctgttccactggtctacatgtctgtttttataccagtaccatgccgtttgggtctatagtataatttgaagtcaggcaatatgattcctccagttttgttcttgcttaggatagctttggctattctgggtctttcactaacacttgactattagtagatgagcttacctccctgggaccattagtgcttcatctcttttcagagtctagacattcttcacttctaattcttctctatcttccactgagtggtaatcagtcttctgatgtcatagtttagttgtgtgatttccaagaagatatttcattgacctgtaatattattggggatttatctaatttgccaatgaatattttttcctattatccactttctaaccccctattggcatcaagagtaaatctgagactcatatctgaagtaatgacccaatgtcatggttttgtgatatgacaaacgggaggaattacatgaactctaatatatattttgaaatatgttcaatttgccaacacattgaatgtcttttagctttacaagtttgttttgtctcagcataaatcataggatcgacatctattagtcaaataggcaaactgttcccatctttcaccctgtcagaccattagaagatgggccacagcaacattttttttttcgttttccaaatccaaaatgaaatttggaaaaagctgctaattagaattcttctccaaacccagttaaaactgagaactacttattctgtcataaaaacttatgagagatttcctaagtctatatacatacagagatatagttctgcttgtgataagttggaaagagtgcatcgttttatgagttggcaagaatatacttgatcttagccaaaaggcccagaagtgatgacttggcaagaataaatgcttagcgtttacttattcatgaagcatttacaggccaggcaaggtggcttatgcctgtaatcccagggctttggaaagccaaggtgggagaatcacttgaggccaggagttcaaggttacagtgaggtatgtcatgccactgcactctagcctgggtgacagagtgagaccctgactcttaaaaaaaaaaaaaattacagaacagccaactaatgaaaacacagaggagacttacatctatattgtttgtaaaaggtaataactgctttatgtgtttaaaaatacatatagagcttttttaaggtggatatgttcggtatagtgaatactggttacagcaacttaatctaaaatgaggtggaagtagggcaggcgattaagggaaatttcttgtactgaaagtagcacaggaattagaggctaattattctattaatgagtctccgaagcaatactggctggatcaaaagataagaaccccacaagttttcctaggttgtcaaaccaagattaatggcacagcagtcaggaggagctattgccagtgtagtgcaacatgacagcatattctcttttttgcaagtaaagcaattcactcggccatctctagagactttcaaaagcgggtagatctccacattttcaacactaatagcgttccatcctgtcaaccataagaagccacagctgtgagacatgaatttactgtagccgtccacatatccagttggttctaccacccaaattttacttgcaagtatctgtttgtttccatctctcatgatcataatgaccacatcctgggatctcacatggattactttcacctcttggtctcccttcttgccctcttcgagtccattctccaccagcagccagagcaatcttataaaaacacaaatcagaccatgtaacctcttcctgaaaatcctccagtggctttctatgattagagtaaaatcaaagccagattgttcaaagccctgtatttatagatatagcttctgcctccctccctgaattaagttcattctttctccctcttattcacaattttctgccagtttttagaacttgcactttcccacctctgggcctttgcacttaacagttccctccatctggagctcactttcccaggcatctcatcacatagaaagatctctcactcctccttcagatctcagcttaaatgccacctcctcagaaagacttctgcttgtcacgttatctaagtaagtgcctcctggtttatctcttaatcataacatcctttttacctcctttctaacacttatcacaatttattattaattgtaggtgaatactcgtttttgtccacttttctgtctaaaatgagctcgatgaggacaagaaccttctctgtattgctcactgtgtcttcctaatgattagtagagtgcctggaacacagtaagcgcacggtaaatttttttttgatgacgaactaatgagccaacaaaggaatgataagtggtactaattttaagctagcaacttcaaatatttgagaaactcttcccacaactcaacagatagtatcttttgttcactttgttacctcctgccatgcctcgggagttaagtgaagacatgcatttcagcaagtattcagtgaatatttattaagtaatatatttaaggctctgtcttaagcactgctgggaatacaaatacaagtaagatctgtctaccaagacttacaggttagtgtttttaacagacacatttataactagctataattcaaggcagagtgctgtgctagaggtataaacaaagagctgaggggcatggaggaggaagagagaagtgatcaattttcctatgactaccgttggtgtttcaaactgacatttcagtggagtcatagctcttctgcctcatgaagccctgccagctacctaaagacttcttgttggaacagagaaaagatgaccattttcctagagctcgagatgcattaacagaacagaaaggcagtaggaagatgtgaggcaaagtgggagaaagcagcaaattcctattcagattctatatttacaagaaaataatgcttttccactcatttctataaaggtaccttttggtcatacttacagtttactttcacaagggtcatacatttccatattgactataaaacagcacaagggaaccagaaatatattttgaattcagcttccatgagaaagccatgaaaaaatatgccgaagcagttactgactgttaagtgaaaaatggaagaaataattttcgccaagaagcatgagtatcatttgctgagaatggatagccacaagcagactataagacagcaacaactaaagtttaactgttggcagaatttttaagaagagaagtggaaaagatcaggattgttaacctattcttaatacttgagtcatatgcacactcatttcacagtcttaacagcgacagcagaaatatctgcaaattcaaagtcaaattgagtactgaattggaaagtgaatctggaagtccttgcattgctcttccttgtacccacttgcttggttttattcattcatgaaacacaaaacacttagtgagcttcttctcctctacaccaaggactgtgctaaccactagagaaacttaggtggcttaagacacccctgacactaaagccattatactctaaagcaagcttgtccaacccacggcccatgggccacatgtgtccccgggaggctttgaatgtggcccaacataaattcgtacactttctcaaaacatgatgagatttttttgcaatttttttagctcatctggtatctgtagtgttagtatattttatgtgtggctcaaaacaattcttcttcttccagtgtggccccaggaagccaaaagattggatacccctgctctaaaggaaagtcagacacagcaaccaacaatagtgccatagtacaaagtattataggaacctagacaaagaggaaatacttttcagaagaggtaacattaaagttcagcctggaagtatgggttgaattctgttaagcagcaagggaatgcaggagcactgtaggcagaaaggaaaaggtaatggcagtaacagaaacaaggaggagtgagaacatatgaaatgcctttggggaactgtgagcagctatgatgagagaataagatgcgtgatcaggaagagaggatgataggaggtgtcactgggaaaaccttaaatgccatatttaagactttataattctgtagataacagggagcctctgtagccttttgagaaggaagaaacaaagatctgataactctggtgatgtgaaagatagctctgacaagtgatgtatggaagatgagtcgaaatgaagggaagagactgcaagttgggctacttattaagaggtttatagcaacagtctaggtgaggaatggtaagacctataacaggagaatagagagcagagtgtatgtgggagagatattttggtgatactgaaaagcacttggtctttttttatatggtatgtgaaaggtcaggacagagggatcaaaagtgacgagatttatcttgaatgatggataatagtgatggtactaaccaacatagaactttctgaatggaggaggggctctaacatgagcaaaggcaggaggaagaacaggcttatggggagaaagtgagtcctattttggacatgttcataatgaattgcctctgaggaaagatgcacagaatatatttaggaatgtgcctttagaaaatagacagagagaatgctcaaggcatgcagctataactttgtgcattaccagcaaataactgacagtagaagccatagtactaaacgagatcacccaagaatataaagtagaaagtttagaagcatgaaacagaatagttatatttaaatgctaaaagaagatgatgagccaaatagtaatttagagaggaattagagaaacaaaaggaagtaaggtcatggaagtcaaaggagaaggcagtttcaaggaggggatgctcaccagcaccttgtactgcaataaggcaaagggtaagaggccatatatggcttttgctagaatactttgcatagaatgattggtagcagaagtccaattcccataagttaaaaactacatgtgaaatgaaaaagtagagaccactaccatagactcaacttcccaaaattttagcaatgaaggaagggaaaagtttgaccatgttggttgacactggaaaacgggaagataaaaagtaagagactaaacatagaagagaggcaaaggatgatgagttctagaaacctggctatcaaaagggcaacttaaagtcctttttgaacaaacctttttgaacttttggaaacccatatctttttagttgccacactcgtgttcctagtagggctcaggagctacagaacattaagaacctggccagaagacacctttgtccaactggcagaaagggagatggaggcacggggatccttgctagaaggactaaattccccatgtcctaaacaatgattatctgatggtatcatctgaatttctcagaggaattaatcttactgaaaataccactttatcaggtcatcctacaagttacttttttgcaaacacaaagacccctggtaacacaagagaaacatccatttaaaggaacttccctctttcacctttcgctctttatggtgggctctggtagggaatctatcgatgataccatagtttgaatactttcagctagctgtgagtttgaaaaattacttcatgttggctaggaatgagtggtttggaatagacaggcttttatactggaaggctgctggggatagaaagtgactcattactgtcacgggacacaaggactcctcttccttttttcttctcatggagtgtgctttgacaatcttgtggaaaggaataataatttcagcttttttttttttttttttgagacggggtctcactctgttgcccatgccagagtgcagtggcatgatctcagctcatggcagcccctgcctcccaggttcaagtggttctcctgcctcagcttcctgagtagctgggattataggcatgtaccaccatgccaggctaatttttgtgagtagctgggattacaggcatgccccaccatgccgggctaatttttgtatttttagtagagacggggttttatcatggtagccaggctggtctcgaacttctggcctcaagtgatctgctcgcctcagcctcccaaagtgctgggattacaggtgtgagccacctcgcctggcctaattgcagtttttaatccctccatccttaccttccctacacaaaaaaaagaccaagcgcttttgagtatcaccaaaatgtctctcccacatacaccctgctctctcttctcatttaataggtcttagcatttctcacctagccttttgctataaacctcataactgatgtcccaactagtatcccaaatatctaatttatgaggatattatgtttgtttctgcccattttcactgatattgagataaacagttccttagtcctcctttctttttttttcttttttttttttttgagacagagtctctctctgtcacccaggctggaatgcagtggtgcaatctcggctcactgcaacttccgcctcccggggtcacgccattctcctgcctcagccttccgagtagctgagactacaggcatccgccaccactcccggctaattttttgtatttttagtagagacagagtttcaccatgttagccaggatggtttcgatctcctgacctcgtgatccgcccgcctcggccttccacagtgctgggattacaggcgtgagccaccacgcccggcctccttagtcctcctttctactctttcttcatccttctatccatcctctgttagcaatccctcataaactaattttcttgttttatttaaggtaatgctaactactgaaataagtaaaccccaaaacctaagtgatttatcacaatagaaatttatttttcactcacatgaagtccaaaggcaccacatgttttggaagaggtctgccctgtaccatttttcagagacgcaggccaatgggggctctgccatctttcacacactgcttcccagcgtaattgttgttttcatcaactggcagatgggggaagacaaaaaacagtggaagagtggaagattcttctgggccaggtctgaagtgaatattatttctgtctgcatttcgttaaccagaactgagtcacataaccccacttgaatgcgaggtccctggcaaggaagccacttgccaacaagaactcttgacttggaaggcgagcacaatctttggaggccgccagccatctctgcctcataattctcgtctcactaggtctctttaaataacccacattagcctccgtaatataaagacacttcacagcagcacatattatttcctccaaaattataagataggctttagattataagaattttcttgccagctagctgtaactataccactttgtcacatctgaccctcacacagaatatcaaagcacctggccaggtacggtggctcacgcctgtaatcccagcactttgggaggccgaggcaggtggatcacctgaggtcaggagttcaagaccagcctggctaacatggtgaaaccccatttctactaaaaatacaaaaaatgagccaggcgtggtggcgtgcacctgtaatcccagctactcaggaggctgaggcaggagaatcgcttgaaccagggaggcagaggttgcagtgagctgagatcacaccattgcactccagcttgggcaacaagagcaaaattccgtctcaaaaaaaaaaaaaaaatcaaagcacctaagtgttgtttctctgaagcattagaaggttgtatattaagtttgtcatcataatgaaatctgtgtgactccatattagtaactctgactagaacagtgagaaactgtccatgctagaaatatccagatttatttgttagcatgttttggtactacaaagagaaactttaagactagctatctcctggggtgctaagtgaaaacctattagaaaaacaaacataatgccattgtatattttgtgtgaaacaactgttatccaacttccataatgttaaatgaggatagaggggagtgattcttgctttagaaagggtttttctctaaaagactccatagctctgaactcttgaggtacaggatcatcaagtgacagtagttcctcactgccttgtaacccgtagttatccagaagtgagtgtcatttgtctccagtatcaagggactactcatgcctacaaatgagagtgcaagtagaatttgctctctgctatcctggataccaccttctctgacttttgtcaaaacacgcatacttatccagcaaaggggaggagggagagtgctgggggaaggatcctcaactgtgacctgtgatcaactttctcctaaaatatctaaaatcaaatataccttgaatataagatttactatcctcctgaaaacctctggtctacatgagaaatttatattcttcctgttagcgtaatttttaccttgtttcttagggatcagttagctctgtccttaccctcccctctgcctgaagttacaattccaagttgcatttgctagcagtgaacggcatctgtaccccagtaatttttccctgatctgtggacttctcttctggctgcaaaggtagtagggtacagtgtggaagggtaaggatcagggttaaggacagggtatcacatttcaccctgctacacacattaaagactaaagttccatttgaacacacaatcatcttcctatatgtttaaagtcatttgtggttactggtcattcctttagtttagcgttacactagttactctgaagaatataaaagaaatataaaataaaatgcattcgcttaatatgtctcacttaattcttaccacagtcctgagaggtagatgttactatccctgtctcacaaagaggttcagtatcttgtcctaggttataaagtgtgtaagtggcagaactaggatttaaaagtaggtctgtttgacttttagggatgaagaggcagcactgtgaatgccagtaaggaaatttgtaaagtaactttgaatcataaggtgatattatataagctatgtgaaaataattctcttctgtcttcacttccctaccccatggcctttatgaccatatctgaacccatgttaaagttgattatgattaccatcttttttttttttttttttttgagatagggtcttgctcgtcacccaggctgaagtgcagtagcacgatcacaatttgctgcagcctcaacctcccaggctcaagtgatcctcccacctcagcctcccaagtagctaggagcacaggcacatgccaccacacccgcctaattttttaaattttttgtggagatggggtctcgctatggtatccaggctggtctcaaactcctggacccaagcaatcctcctgcctcagcctcccaaagtgccgagactacaggtgagagccactgtgccttggcctcatcatctttaattataaagggaaagcatagttgtgctctgtcatgctttaaaacataccacgcttcctagagctgtctctaccttatttcttacctactctttctcaaaatgccaatcaaaaagtgtcaaaatcatggttgctgattttaattatgttaaaattaaagaattcagagtttatactatacaaatgagtatattgttctttacagtggtggattttttttcacacaagtgtgttctgaaacaaagaccaagttgctaatcttagtgtggtaattgaactagatttcagtggaactaggtttcagtagaactagatttcaaaaacactgaagttctcattctagctcttttacttcctaggcatgcgagctgggtctgtccctcaatcttgcttagtctctgtcaatcctctaccataatattgggagtagtatttactgctatacctatggtataatgattttttgagaatctaaaaattattaaagtatttttctgggtgcagtgactcaggcctgtaatcccaacagtttgggaggccaagccgggcagataacctgaggtcaggagttcaaggccagcctggccaacatggtaaaaccccatctctactaaaaatacaaaaattagccgggcatggtggtgcacgcccataatcccagctacttgggaggctgaggcaggagaattgcttgaacccaggaggcggaggttgcaatgaaccaagatcatgccactgtactctggcccaggcaatggcgtgagactctgtctcaaaaaataattattattattattaagtattttgatttttcagttgttgttggttttttttttttttttttttttgagtcagggcctcgctgtgttgcccaggctggagtgcaacggtgtaatcatagcacactgcagcctcgacgtcctgggcttaggcaatttttctgcttcagcctcccaagtaactggaactacaggcacacgccagcacaactggctaactttttaacttttttgtagagacaggatcctgctttgttacccaggctagtcttggactcctggactcgagcgaccctcccaccttggcctcccaaagtgctgggattacaggtgtgagccatcatgcctgggtattttgaaaaccttaagatacacaggtataagatgttattatttactcatccattctgcaaatatatacccctattacctagactctgttgaggatagaggccgtgctttttcccacgtgtggagtagagcaacatagaagagtgccctgcagtgggtgctgtaatggagatgtgtaccaggtacaacaggaacctaaggaaggaacccctgagtttatcggggggcaccagggaaggcttcacagaggagatgatgtgagttgccatttgaagaatgagaaattgtttttctgatgaactaaacaggaaagagaattccaggcagagggaaagcatgtttgaaaccctacagataatttactctgtttagaattgaaaggataaggtaaaaaggtaaagacagacaaataggcaagggacaaattatagaaagcccttggataccatgctaaggaatttaaattttatatcagagggaaaataaaactagcaaataattttgagcagaattttgatcaggtttttgcaatgtagattattgggatggccagggagtgagcagtcaagaataaaatgaagagaatgagatacttgtgacttttcaggagagaaaatataggagaggggggaaatagctactacgttttatgcctgagtaactggcaatatttaaaaaaaagagagagagatggttttgagggaaagctccaacttcaaaaagtgagtttgatagtgatggaggtggagagatccagcagaccgagaagcagaattaaatctcagtgctcaagatgtcaccatgggagctaatatagaatgtacattgctgtttccccttatgtcctacataccacaaactttgagtccagtgtactgatcagaaccatccttttagtaataatgtagcatgcttgtattcaaaaagaaatgaactatagttgccaccttcatcttatccttgacctgtattgcttgctgtttctcctcagtgcctgatgcaaaagcaagcagttatctctagccagctgaaatgaagactagagaaatgcagacatctcaccagcatttcttagttatggtggtaaaatgaaaacactagggtaaagtcaattctatgtctaactgaaagttcatttccttgtcaagcacaagcttttttacattaatcccaataggcatgaattctcattaacagcctaaagcatagatagtggatcagagacttatattcagaagttctagtcacagtggaacagccatggatgagtaacttaaagtaataattcttataccagggaggctacaataattttactgttaagagctggacagaattttgagatcttgagagtaagatacttcataaatgctttgtattgttgtctaacttccatatggtctgttaaaataacttactcaaaaaataacttaattcaaaaagaacaatctctattgaaaaaactaaaataggctgggtgcagtggctcatgcttgtaatcccagcattttgggaggctgaggtggccagatcatgagatcaggagttcaagtccagcctggccagcatggtgaaaccccatctctactaaaaatacaaaaaattagctgggcatggtggcacatgcctgtaatcccagctatttgggaggctgagaggagaattgcttgaacgtgggaagtggaggttgcagtgagccgagatcacaccactgcactccagcctgggtgacagagcgagacttcatctcaaaaagaaaaaaataaaataacctatcacctaaactgagttttcatgggataaataagagttcagggccgggtgcggtggctcacacctgtaatcccagcactttgggaggccaaggcgggtggatcatgaagtcaggagattgagaccatccaggctaacacagtgaaaccccatctctactaaaaaatacaaaaaaaaaaaaaaattagccgggcatggtggcaggcgcctgtagtccccatatgttgtgggagggacctggtgggaggtaattgaatcataggggcagtttcccccatgctgttctcgtgatagctgatagttttataagtgtctggcatttcctctgctggcactcattatctctcctgccaccctgtgaagaggtgccttctgctgtgactgtagagtttttaagtgtcagtaaagaacctggaacacaggggatgggacagctcccatcatacataggaatcatcaaatggatttcattccagtaagagtttaaaaagggactttaatttttgcctttacagaatttctaaattgtagtggataccaggtcaccttgtttgattggatgaattaaccataatagaaaggaagttatttaattgggagaatgtctcagacaagtgtagcttgcatggaatcatcagtatcatctgaaggtgtgagtccagggttctttcgaactcataaaatctggaaattgccactgtactcttttttttttttttttttttttagatggagtctcactctgttgcccaggctggagtgcagtggcacaatctcagctcactgcaagctccgcctcccaggttcatgccattctcctgcctcagtctcccaagtagctgggactacaggtgcccaccaccatgcccagctaattttttgtatttttacaaaatgaggcttggggcttgcaccctctgaagcaacgacctgagctgtatattggtcccttttagccacagctggaacgcaagatacaaagtctggagattgcacaaagcagcaaggccctgggcccagcccactaagccactttttcctcctaggcctccaggcctgtgatgggaggggctgccatgaaaaccttcaacgtgccctggagacattttccccattggcttggtgattcaacatttgactcctcattgagtatgcagatttctgcagctggcttagatttctccctagaaaatgggtttttattttctattgcattgtcaggctgcaaatttttcaaacttttatgctctgttacctcttgaatgttttgctacttagaaatttcttccactagataccctaaatcatctctctcaagttcaaagtccacagatctctggggcaagggcaaaatgccaccagtctctgctaaagcatagcaagagtcacctttactcctgttcccaacaagttccttatctctatctgagaccacctcatcctggacttcattgtccatgtcaccatcagcattttggtcaaagccattcaacaagtctctaggaagttccaaactttcccacattttcctgtcttcttctgagccctccaaactgttccaacctctgcctgttacccagttccaaagttgcttccacatttttgggcagcaccctactctctgcagtaccaacttactgtattagtccattctcacactgctgtaaagaaatacctgaaactgggtgatttataaagaaaagagatttcgttgactcacatggctggggaggcttcaggaaacttatcatggcagaaggcacctcttcacaaggcagcaggagagagaatgagtgccagccagggaaatgccagacacttagaaaaccatcagatctcttgagaactcactatcatgagaacagcatggggtaaaccgcccccatgattcagttacctcccaccaagtccctcccatgacacgtggggattatgggggttacaattcaaggtgagatttgggtggggacacagagtcaaagcatatcagccatagagagacggttctaagtgtcagcagttcttagaggccataacaaatggggtaagaaaacacatctcaaaggtgatctagtgtcctttaatgccagattttttcttctaaaagttttattgagcatttttatatgcagtagactatgttaggcactatggaagatataagtaattcagatttctttcgtgaatgtaaatagaaatacaaccctaaatatacatacatgtcacacatacatacacacacacattaacacttaaaataagtgtatcattaggatgctttgagctggaaaaaaaaaacaaaattccaattcaaatagattaaacagaacagaaatctattacctcatataacaagttcagaattagggcagctaatagggctcaaactttatttttctgcaattcttttagcctagccctcctgttgactttgtcctcaagccagctgaccacatgatttgcaagaaaactaaggcagttctggacatcatgggcagataagacaatatccagaggcagataaaagagctttctctttcataaacaggtttgggatctgttagcaaggagataatggggaacagatgctatcaggaacctcaatctagtggaggagagagtatgtgacagtatggcaaacactgtgctagaggatatacagtctacactggtagccatagaaagaaagccctccattctcagctggagggaaagggtaggggcttggtagaggctgatcagagaagacgtcacttggggaagaggttgtaagtccagtttgggtcgtgttgagtgtgaggtactgagacctccaaatggggaagtacaatagacagttggatatatactggcctaaggctgagaagaaaagtctaaataaagaaaaagatacagaatataggtggtggtgaaggctttgaggatggatgagctaatctagagcgaggaaagaataggaccaagaatgagattctgaggaacactgacatttaagcatgggtggaatgagagttgctgacagagacagaaaataaaaatgaaaatcttgtaatgccatctgtgtgtgggatgggtgtaagccaactataactgacattttgtggtatttatacatgtgatttggataaggaactgcctaggaacctttcagtacccattctttgcccaggagcaggtgcccttccccaaaaaaccagttgaatgatatagttttgttggaggtatgactggacctgaagagtcccccaaccaaagcagaattggggcattaacatttctattaaaatgaatcagactggacgcagcagctcatgcctttggaggccaaggcaggtggattacctgaggtcaggagttcgagaccagcctggccaacatggcgaaaccccatctctactaaaatagaaaaattagccagacatggtggcaggcgcctgtaatcctagctactcaggaggctgagggaggagaatcacttaaacccaagaggtggaggctgcagtgagccgagattgcgccaccgcactctagtctgggcaacagagtgagactccatctcaataaataaataaattaattaattaaaatgaatttctctttttttgcaggagtggtcacacgttacttgccttctggttttcccgccaagagggaaaactaaaccgacagcagactattgaactgggacatcacatcctcaaagcacacatttttaaggtaattaaagcagttggaaccatttttccgccatctctagcagactttcatatgctttatgtaagagactatttcagtgtagtccctgccttctgaagttcttttgctgcaaacttggttcatctcccaacacgtatggcctgttcctccctaggcctttagaactacattgtacatctcccagtgtaactaactgataggcttttcaggaaatgtatatgtataatcattgacaaggtgcatatacacctatagatgtgtgctccatacatgacctatcatctcctgaggacagtcatattgtagcaattagttgcaggttttcatgatgtctaaaaaatcactgagggcaattactctttccattttttaaaattgttttagtgacaataataacattcctggtgctatgactttcaaaccaacactaaccttccttggagctacttcccccaaatctctcttcaaattatatcccagtttttctcccattagtttgaaaacctttaagaactctataacatcagcttctctctcagccttcagaaggctgaaatggaggaccaaaaagaggacacataatttgtttgtgcatgtatgcattcatttgtttattcatcacttactgaggcattaaactgggtactagagatacaaaaacaaaaaagatacaatccctaatcttaaggaatttgtagttcagataacagttttgggttaacccacaaaagtggagaaggaagttactgtgctaatttttctgtcccacagtctgagagttccaatccctacagccttttcagaattcttttcctgcctcaggatggagaatatgggtatcttaaacagttctctgggtcaggcttcccccacaggatattgttaaaaaatgaaaccattgtcttcagagagaaagatggcattaaggataacttcaagagcctagcaaattcttcccaatatataagcacagagccagagcagcctggtcatcagatggacagaagtgaaacccacagtgacaaatcttgtatttgaatcttacttgtcttgtctaacaaatcactgtaccaaaaatgaccttacttagtaggagcagagtggagctaaaataactggcaaggtatggcattccagtttcaagcagactaaaaagtagctaataattccataaactctaagagcattgtcctgctgttagatagtaactgaaagacagtaacttaagcattaaccttttagcatcactatctgcctagaatcagatgcaaaaatgaagctaatccctgcctttgctgccccataaaataaataccacattcacagagaagtagcatgaagcttcatttgaccaagcttcatttgacgaagtattttatcccatacatggaaacgtacatttaaacatgccctcctgtcattagcacagttttatcttatactgatgcagacagcatggttgcctgagataagactggctccatgtgtgattcaagccataaatactctagtgtacagcatatggtggtgacgtgactgcaagctgaagaatgaagacttggactatggttttcctggtgctgcagtttacaggatcctttaaatgcagtgttccctgttgagaggctttaacttctcccaaactgctagaattctcaatctgcaccagctgtgggtcaaagacaaatatagactttatggttagaaatagttccacttgaaacttctattcagcagtgacacacaatccaatgggtacttttttccaattaattttacatttctctggttttatattcataaaggtgatgtttgtaaataacccgctttaaagaagctcattggataagcccccaaggttagtttttgccatgatcttcagatacctgagccacagctaaagatccctaagatgagattgctcttgtttcttcatgctttccctgttttcttaagtattcaaaaatcttgagcaagcttatcactggctgctaaacagttttgtaaatttagattctaaggaagggactccattaccatttattgccgacaaaaagatcccttacctgagcaatagttacagatactgaagaggcactttttcaagctattcgaacataaaattctctttaagaaaccatgagcttagaatttaattatgcattatttttggctacatcctggctggtaatgggatcacacttctctgcctgtcatctttgttgaattgaaccaaactgacgctcttttctcccgtacttcacaggaacaaagggtcaactccactaaccagaagaaatcaaaagtccatagtacaagtaaagctagtattccaaatccaaagctatgtatttcaggcgtatttcttatgtatctagtccagcctcagtgcggttctcagtgctgctttgtggtccatttactggaccatttagttgacattcatttaccaaggtccattcttactcagctccttttcccatttctttttcctctagctcttaataaagccaactaatgaaacaaacagcctaacttgtgagtcactgaaaaagatcaaagctaccaagtgtgacttcctttaactattttcctcccctcaccagcaaatcaatctatatcattatcaattcttacctctttttttcttgttttagaagaaaagatgttcctattcctctttaattgcattatgaaatatagaaaagtacagataattgcatgtaatcaaatattatctaccagatttaacaaatgttaacatttttccatgtttgcttcaaatatttttctttatttttaagaaatgaatgtaacaaatataatagataacgcttttgtatttctcttttaccccatttctctgtctcccttagagataactcctattctaaatgtgttgggatttagcacatgctaacacccctaacatgttcttctcatctatattttacacttttccaatgtaggttcctgttcataaacaatatatacaactattttgggttttttaatgctataagattctataacttttttctctttttcactcagcattctgtctttgagatttctctatagatgtaggtcagtgattttcaactctggctatacattagattctcttgcagagtttttttaaaaatacacacacattcctgagccttactcccagagattatgagtcattgttctggagtagaacctaggcttcatttttaaaatagactttatttcttagaccaattttaggcttatataaaagttgaacagaaagtacagagttcccacatactcccccaaccacaattttccctattattaacatcttgtactgatgtggtacatttgttacaattgaggaaccaatagtgatacattattattagctgcagtccatcctttatgttagggtccactctgtgttgtacagctctgtcgattttgccaaatgcataatgtcatgtatccaccattaagtatctcagcatagtttcattgcactaaaattcctttatccgccacctattcattcctctccccttaccctcctcaacccctggcaaccactgatctttttactgtttctgtagttttgcttttcccagaatgtcatatagttggaatcacacaacatgtagaatgttcagactggctcctttcacttagcaatatgcatttaagatttctacatgtcttttttggcttgatagttcatttctttttattgctgaataatatttcactataaggatttactacattttatttagccattcatctattaaaggacatcttggttgcttccaattttggcaattatgaataaagcttctataaacactaagaggcaggtttttatgtgaacataattttcagctcatttgagtaaatgccttagtagtgcaattaccagattgtatggtaagactatgtttagcttgcaagacattgccagactagtttccaaagtggctgtgccattttgcattcccaccggcagcgactgatcagtagtatttttgaaaagcttcccaggtaattctaatgtgcaccccagctagttgagaaaccactattcttttcttttcctgtttgaaaaaaatcactattccacatcattaatttaaagatggcagtatagcaagcatggtaattaagagatcagactctaaaaacagactgagttcaaaccctgtctctcttaattcctgactgtatgactttaagcaagttgtttaacttttttttttatatttttggagacaaggtcttactcttcaccccggctggagtatagtggcacaatcacagcttactgcagccttgaactcctgggctcaagcagtcttcccacctcagcctcccaagtagctaggactacaggcaaacagtactacacctggctaattatttttattttttgtagagatgggggtctcaccatgttgcccaggctggtcttgaactgctagtctcaagccgtcctccctccttggcctcccaaagtgctgggattaccaccactaatcttactaatctttaaaatggcaataatattagcccttactaagtggttgtgaggatttaattcattaatatatataatcctcagaagaggggctaggatctctaaaggctacacacatatatatatttggggttaagagtcaccaaaatataggtgactcttacctacatttaatagttatatatataaatgttatatatgtaacaattatagtagaagcccctttatatctttcccttaccccattctcctccctccccagtgataacccttatcctaaagttagcatacatatgtcaacagaaaggtaactgttacaggtcttagacacaattttactttaatttaatagttgggaaaaaagcatataatgcttagttgaattcataagtgtgatgtcttaggagtagaagaaattgtctgggattaaaaaggacaattttggagaagagggccaaggatggaaaatggtttggaattaaaggtaaagggagaaagcagcaatcagctgttttgtctgttttagtctattatagttgctactttttcagctaagatcagagaagtgaggtcctgaatcaggtgccaattacttttcctttttttagttggtataatggaaggaacatgaactttagagtaaaaacagatttggcctctaattctagctccaggagttgtgttccctcctaaataaaaatagtgataaattctacctcctagggctgttgtgaagattagattacattagagaagctaaatctggaaaggccctagcacagaacctgacacattgtagatctgaataaatgtcagatttcctgcctttttttccttcaaccatcatatgtaagacatgtcttccattgctaaaagcttcctctgttagactatggatatttcttaatgctgatttttctctctgaattcgttaatatagtttatcattcctcaaaaggtcttgaggcccacacatattataaattaggagattgaggcccaagtggggagtcacagctaagcttcctggtcttccaggatctacagtgcaggtgtgctcaagaacctaacttgtctggactccaaccctgagtaacatttagaattcttcctaaaagatctggaactattctatttcatatgccaaaataacaatcagaactacttagtgatgtatttgcttcagttttgtttgcatgtaaactgcatggccaaatgagagtttgtaattgatgtccctgttacttgcacaaattaaaagagcttctgaagtaataatgagcaatcagaagctgcccttacccacctttcctactgttttctgtttacccagctctgggtgcctacatgggtactatagtagacagattcagaacagagcccagcctcctcaaggccagagagaatatggactatgtagaaattaggtagccatttttaaataatcgaggaggatgaaaagggaaataatcttgtggtgtgaggggttaaaactggattctgtttcagcctcccagcataggattgtgtttctgggcacccaaaggtctactctgctaggatttgacccagccttttggctcatgctcttaggatagaatggaacgagaggatacgtagaaataattagcaccatccttcctcattttatcaagctgtggattttttgttgagaatgtataaacacttgcagccactttgataaagccatgtcaaaatgtcgcaaaatatatcaacttcttgaggcatattctatagatatatatgcataggtgtataaagatacatgtacatggatgattattaaaagctataatagtgagggagaacaaagcctagaactacctagtaatatgaaagtgttttaaagccagtaacagtgtatggaccttatgtgaatcccaattcaaaccaaaaaaattttagttcctttttttagctaatcaagggaatttgaacactgttgggatatttcatattatagaatccttcttagttttaggtatgttttaaagagttcatatctgttgagagacactgactaaaataattaaatattaactgataaaatatctgggatttttcaaaataatcccatcaagggaaggggatatgagcaggaatgtaaataatacaaggttggccatgagttgaaaattactgaagtgaggtgatgggtacatgagagctttactatactattcctctctacttttgtaaatacattttaaattttccttaatcaaaaatgtttaataaagtaaattttacgttgtttatatgcacttgtatgtatgtattttgcgtatatatagaaaatgtgttaaataataaacactaatgtgttaataggagtcacctcttaggattgagatgggaggtttatttttaataccatattattttatttgatttttataacaaatttgtattatttttataatttcaaaaactgaaatgtagaagtcttttttccttctgttttttggtggttgttgttttttggtttttttgagacaaagcctcacggtgttgcccaggctggagtgcagtagcacgatcactgctcaccacagcctcaaactcccgggctcaagcgatcctcccacctcagcctcccaagtagctgggaccacaggcatgcaccagcatgcctggctaatattttaatttttttgtaaagatgtagtctccctacatttccctggtctcaagctcctgggcccaagcaatcctcccaccaccacctcccaaagtgctgggattacagacatgtaccactgcacctggctgaaaataaaatttttaataggaaagttcaatgatttaatttttggttgcatcagaatatccccacagggagaaaaaaaaaggtgcctgtgtcggaaaagcctttaaaacgttcgtgtatctagccttcccacagcattattcacctttcagcctttcctctagtgtgagaattccctctacaggaagttttttcctaacccactttagagaccctgaactctctatgggaagaccttgaccaccatgactagaggtcttgttagatgaatttataactcataagttactgacacattcctcctttgtagatgccccttccctagtatgccgcataaacacaccttcctgattttgggtatatgtaggtattctaggcaagaacattctatatttcagggacaaagaaagcagaagtagcttaagtttttaaaagaagtacctccctatatctcttattacaacccaaatttcattgttaatatcttcctgccctcaggatttccttctttaactgatttgatccagatattgacagaagagtaagatgattgtcagagagtgtctaacaatcaggagatctgaagaacaaattattctaacttccttctggggaagcccatgtgaaaaggacaaatattagtacatgtcgtgggacctgtgccagtgatactaggagaaaatttgttgcggatggaaatcaagcctgtattgctgtttttttcctgaggataagcatatgtaatcattttgggatatattagttaaggtgaagaacactagctgctattgacaaacctgcaaaatctcaatgacttaacaaagatttatttctccttacatcacagtacagtgcagatgtctgggcaggctccttccgtgtagtagttctaaaatcaccttgggcctcagaattctccattggatcttctacatctggcctgtaatcaaaaggaacaatagaaagtgtagagaaatatgcaggaagttttggagccaagcctggacatgacatattatttatgccctaattttattcaccagaattcagtcacatggcctacctaactgtaaaggagcctgggaaatagagtttttccaaatgttcaggaagaaaatgaaatggaaatccgtgatcacattgcattatttctgccacagtgtgtaatttagtaacttgaatttaagagatttattgaagaaggctaataaaaaagatatggaaaaataaattatatccagatagaaaagagaggtgttgagtagacgtgttgctaagggctgcagagatggagactgtttcagttagcttgttcctgcaggactggtctttgtccccccacctaggctttgcttggcatgaacattgttagggtgagactccgctctcattcattagtaccaaaaacaaagaggccactaattcaccactgatgctacttttttttgctgggctactaatttaattgtctgtatttcttattcagggtttgagtaaaaaagttggtgtatcatcctccatcctccaaggtctctggatctcttatagcacagaaggtctttccatggcactggcgtctttacgaaatctctacactccaaatataaaggtaaatttataaagaaattataaatatgataaggaattaactatgaaaaaataaaactagaaggacattaagtagctatttagttgatctttgacttgtctttcttattagccttttattgataatttaatatattttaaattgttaaattttattctataaattagagactagctccattgtcctcttaacttctataagctgactctgacatatgggatcaggtcctgctggttccaaagagtaaattgatctcaggtagcctttgtcttggtaggagcttttctgaccaagagctcacttcgtagagactatgttcagcactacagtataggaggcaattgctctagttactatgccatttatgtaaaggagatattttacattatctaccaaaggaaaagaaaaaggagcaaatgagattataaaataaagcaattactaaatgctactagacactgttgtagaatgttagatggtttaataaaagatgactaaaaggatgtgactcctgtttgtctaattattagttctgtttgtttatttctaggtcagccgactgctgattttgggaggtgccaatattaattaccggacagaggttttaaataatgctccaattctatgtgttcagtcccatcttggttacacagaaatggtagccctgctgctggagttcggggccaacgtggatgcctcttctgaaagtggcctgactcccctgggatatgctgcagcagcagggtacctgagcattgtggtgctgctgtgcaagaaacgggccaaggtactggctgcccagctctgctgcttttcttccctttttctttattttcgatgcatactctttcttatctccagtgttacttcatgagtctgggtagagtatatcaaaccatgatggagaggagatcagagagagtgctggttctgcatatgtgcagggccactgccatccatcctgcaggagcacacagttctaaaccctttgagaggtgcttgggaaactgcatttatccgtaaccacaaaaagtttctacataacaacccagaaatgatctattgagctcagaagaagcctctttttaacaaagagaggaaggagaagtgaggaagccaggagactgcagtggcaggtctggaccaaatgacacctgcaggctctaagcctttcatgtgtagagaagaaaacttagccatggagatgagaacaggaccagacaccttcatcctgtccttgaagaccaccactctagagataaggggagaagatgattctccctatttatactcagactgaccaagggcacctcgaagtgcttctgttagtactgatcagttctctgaaaatatttccaaaatatgtttgctttatgtataaaaactcgatttcacaatattggtgaaaagaaaaatgctggtctcacaaatgtgggcctctgggaaaaaaaagtctggcctcatagtattttgtttcagtcctgaaaacaaactgaggactttagtggtttcatagtgaaatacaagtcatagtatgacttcattctgcggtattcagtgctgttacgaggggagaaagtgggactcctccactcctttgggaactgagacgtaggcctctcaatgacatctcagagccttagaagtttactgtagcacagtgattgtgcacctgtgacatcccattcatttgaatggacacctctaggaacaatgataactgggcctcgttactattttcgttttctttttagagacaaagtcttgttctgttgcctaggccagagtgcagtggcatgattgtagctcactgcagtcttcagcctccccagtagccaggagtataggtatgtgccaccacactcagctttatttttttcctattttgtagaggcagggtcttgctatattgctcggaggtttgctaaaactcgttggatcaagagatcctcccactgtggcctcccaaagcgctaggattacaagcatgagccacggcagccagcccttcttactattgctgtcacttcatattctgatcttagctgggtctttcctgctgttcagcccttacactgccaagccatccttttcttcatctttcattgttttccccagagcagaaatgtaactcatatgtacttctttcaagatcctatcacgcctcttctgcccttcatcactgtgatcgagctcatctcaaggtgcctgtatctcaaaactcttatcagttcttacgtacgctcacctctactttgccttagagaaggaagtacttaccttcctttccagagcaattgtctcctcctctacactcttaacccacggtgttgctcattctctcacgttatttcattctttttctaaattcacactaccttttttctcagtttctacaaacctatgaatgtagaaacctacctaacctaaaaaagaaatgttcctctcccttgctaaccagaagcaacatcccatctcttccctttcacctctgccaaacctgtcctaagagtcctctatactggctacattcacctctttattactccttaaccacttgcattctggcttccatgaatgagagaggaggcaactcattaaaatgataagctttaggatcagacacaactgggttaaatcctgtgtccatacttaatttatacaagggcttgaacaagtcacttaacctctctcaatcgcacttttcatctataaaaagggtgttaaaagagtcagtgtaagcattgaaagagataaagcctttttttaaaagaggtgttaaagtctcttttaatcttatatagtgcctaataaatagtatctgtaaaaaagaaaataacccaacctccctacattctaccaagctgctcttttaaaagtcactaatgactgccattcaccaaataaagcagctttgtcttattcctcacatctctgagcccctccatagtattagcaataataaacctttttttttttttttttttaaacagagcctggctctgttgcctaggctggagtgcagtggcaccattcttggctcactgcagcctctgcctcctgggttcaagcaattcccctgcctcagcctcccaagtagctgggactacaggcgcacaccaccacgcctggctaatttttgtatttttagtagagatggggtttcaccatgttggccaggctggtcttgaactcctgacctcaggtgatccacccaccttggcctcccaaagtgctgggattacaggcgtgagccaccgtgctcggccagtagtaaacttttaatgtcatttcccacttctctggctgcccctctcttcttcttctgatagaactgttcactgagatcctctggtcttccttccgtcctcatactcgccatggcttcagcattaaagtcataggctttggcgtcaaacccgactgggttctagttctcctacctacattttggtgactcttaaccccaaattgctaatttctgaaagtgtttttgagctgtagtttcacatttgtaactgcttccttggcaggcatgttcatatccctgactagttagttcctcagatccagctttctaaaatcactcagcatctttaccctcctctttctggattttcaaagtctgctaatgtagcctccgtttttctcagaactagggagtcattgacatctttccctcctttgcccttcctaattcatttagtggccagcacttttcaatgttatcctcaaaagagcttgagaagctactccttggtctctaccccaactgccactatccccctgaattattcttggagtcttcttgtgtaacaaacccgtttttcagattctcatctcatctattacacaccatccccttagcttttgtagagcttttattttgaagtaattttagactttcaaagatactgcaaaaatagtgcagagacccaacacaaagaaatgatacacgtttgaggtgatgggtatgctaattaccctaatttgatcattacacattgcatacatgtatcaaaatatcacactgtaccccataaatatgtacaattattgtgtcaatttaaaataataaaagtaaataaaataattctcttgtaggcaaaaaaaaatgcatagagtttctatatatcctccattcagcttctcctaatgttaacagcctaagtaattgtagtctcattatcaaaaccaggaaagtaatttggtgataatactattaactaatctacagaccttactgaaatttgtccaactgtcccactgatcatttttgcattagagaatccaggtcaggatctcacattacatttagtgttgtgcctccttagtctcctccaacctgtgagagtttctcagtctttgttgatcttttatgagcttgacagttttgaagaataccagccagttgttctgtagaatgtttttcaattttagtttatctaatgttttctcactgtgagattgagtgtatatatttttggcaagaataccacgtaagcaatgctgtacccttataaaaatgcagcactagaagtccctgctgttgataggtcttattacaggtggtgttaacctcagtcacttggctaccctagacctgctcaccaacacactgaccatatatcagtgatgatgcgacattgtccaagaaagtacataccaaggccaccgcacaatacctgtccaaaaaggcctccaatacggaataatgttcttcattatttcagaagtctttttcttcgctggattcttctgagcatttgatcactctagcttaatccctactccagaattaggaggacattgacccccaacaggcatctaaggtaatgtcttccaggtttctcagctctgaagttactgtttttccttttgtaattaagaaatatcttttagggttatgcttttgagactagaaagacagacatcctggttcttgtcatacttttgtccactaatattaggatccatcagtgattcttgctgcagtaagtattattattattattattattttttttttttgagaggagtttcactcttgtcgcccaggctggagtgcaatggcatgatctcagctcactgcaatctccgcctcccaggttcaagtgattctcctgcctcaccctccggagtagctgggattacaggcacccaccaccacacccagctaatttttgtattttttaatagagatggggtttcaccatgttggccaggctggtctcgaactcgtgacctcaggtgatccacccgcctcggcctcccaaagtgctgggattacaggcatgagccaccatgcccagccactgcaataattattgctttgatgtttgcctaacagtgattttctacttccatcattccctcaacatgtattaattgagatgttactgaaagggaaagcgatcccttctcccccatgtatttattcaagtatttattgatattgctatgaagtcatggatatttattttattccatagcctgaaatccattaccattattattcattttcattgttcaccttgccccagatttggccattgggaactccttcaaactgattcctgtgtcctttcaacttccctctattaatttttgagcattttcagactttctgacaccacaagatgttctagtctcatctcttaccccagtcctggaatcaaccatttctccaaggagccatggtttcttttatccattcgcttagtttttgaaaatacagttctgagcatgaaaacactcaatgacttcactgcctattggttacaattcagaccacttagcctggcattcagaaatatccatgctctgtcccaaaagaccttttccgccttagagtttaaacttccctttcatgtgccctactcttacaaaaagtagaatacattaatcattttccatctcagccagtcaagatagacctttctgtctgaatctgttcctgattctagccaggaattaatctttccttcctctgaaatgttatttcacttttacattcctttaaatttattgtatactcctttgttggacaggctcttgtcacattggtcacatctcccctaccttgttggagagtccttgagagcagaacctatatatttactgtcttattcacctaagtggtactttgccacatactctgtattcagtaaatattcactatgtggatggctggatggaactgaaatcagtaggaaagccagaaacagaacttatattttcaactgatctaactaccgcaggacaagtaccacctacctaccagaaaaggctactcatctaatgaaaggctactcatctgttgaaacgaaggcccttctggtaaatcaatcttgatcagggtcttctttcagcctaaacttgtaaccaacactgaaattatgaagactgctactggtgcactaagccagaagtgcctctagccatttggggcagatctttgagagtcctccctcctgctggaagagagaagcagactttgccaaagtttggtggtcaaatgattcatgatgtgagatgttttgcttctttggaaggccaaaaaattgtagcttcataatgtttttcttcccttttttgatttcaaagataattttttttatgccagcagagctaccagtttctcaaatcttggtctaaaatgaactatttgaggagacaaagaagaatttacctcaggaagacgaagctcaaactgagagttttggtttttgtttttcttggaatgcaaaaaaaaagtctgaccttttctgaggaaaagaagttcttcccagagggacatttagcatagttgtagctcagtaataatctaggctgagcagagtctcctgaatttgctcagagattggttccaggagtggaaaggatgattcttagtagcctaggcttgtgcagtggcggatgtgactagattgcgagctcagccacaagtctgtgttcacacatatctcctgtcctctcctcttaggtggatcatttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgaggtaagaagtaggcaataggattgttttttcaagctctgtattgaaggacccaggaaaccaggagaaaagattgcacgaagacaaaattgccaaccaaattaatgtgaattcgtgatcgctgctctgaataataaggagattaaactccatgaagcactttactcaaatgccaaagtccctcaaattataggtatagaaaggtgcgagttggaaaggaccgtggaaatgatataattattctccatgttttcctccctgtttaacagacagtggcaccaaggctcaaagagatgaattattgaggtgtagtcacatggttagataatgtggcacaggaacagcataacatttagaatctcagaaggaccagatttgagtcccagcctcgctattcattaactctagcccttgaacaatttacctatctcttagaagtttagtttcccatcagcaaagtgaagctaataaactcctttatacaaggctgttgtaagggatgcttggtaaactgttaaacattatacagtttatttattaatgataataacaataatagtggcaaatgtagggaattggtagtgtgctaggaaatgtttaacaaccaactgtgaagaggggtgtggggtggaacaggggtgtgtgtttgtgtgtgcatacgtttattataaattttactgatagaatgtgttgccgtggaatactacacagccgtaagaagaacaaaatcatgtcctttgcagcaacatagatgcaactgaaggccagtatcctaagtgaattaacacaggaacagaaaaccaaataccacatgttctcattgataagtgggagctaaacattgagtacctatggacataaagaggcaacagtagacactggggactactgggaggggaaaggaaggggaaagggttgaaaaaaactgttgttatcctcactaccaggtgatgggaacttttgtgtcccaaacctcggcatcatccagtacaccatgaaacaaacctgtacattcactgcccttgaatctacaataaaatttgaaataattaaaaaaaaaaaaaagaggctgggcgtggtggctcacgcctgtaatcccagcactttgggaggccaaggcgggtggatcacctgaggtcagaagttggagaccagcctggccaacgtggtgaaaccccatctgtactaaaaatacaaaaattagtcaggcgtggcagtaggcacctgtaatcccagctactcgggaggctgagacaggagaatcgcctgaacccgggaggtggaggttgcagtgagctgagatcatgccattgtactccagcctgggcagcaagagcgaactccatctcaaaaaaaaacaaacaaacaaaaagaatatgttgcacacaacttacaaataataatgaactatataatactcttaattgaaagcttttgttgatttttgccaaatttttagctaaactgtggttgtaacttataacgaaagtttgacaaatggagctgcatcccagtttgctcttttctcaataactgtattgccgttaaatctgatatgtgatctactgttaaactacttctcgtccacatacgaactatattcattgaactgaatcctctttcagctttagcactaaatgaagccctgatttataatgtttgccagtttcaagggtgtaaatactcccatcatggccaatttcaagctaccagtgtgacatcactgaaacaaagaggggaggagaagcatagtagcatgttgtgatgtaatattcccaccatgcagacaagacatgcacaatcaatataaataacctcaacagcatagataatagtaagatatagttaaataataggaagttgagagatttgagtattctttaacctttgtttttaatgttaatttatttaattgctatttgatttctaataaacaactggctttcagaatttctgagaatttaacagtcagctttcatgggccagtgcaagcatgggataatcagcaaaacagctaccatatcaattgagctgacatgtcaccaagggagtgttaagtaatattaaattttatcatctgtgggaggtttttgaaccgtgttcagtcaaattcccagaaacagaactgtcacttttcattgtgtttagagatttttctccctttactagttgcagaacagtccttatacatctgagaggaaaaaggaagataatcactttactctgaggaaacacagggccagatgcagtggctgacacctgtaatcccagcactttgggagaccaaagcaggagaatcacttgaggccaggagttcaagaccaccctggacaacatggcaagacccacatctctggggaagaaaaaaaaaacttttttaattagccaggtgtggtggtgcatgcctgtagtcccagctaatccggaggctgaagtgcaaagattgcttgagcctgggaggtcaagactgcagtgagtcatgaacacattactgcactccagtctaggtgacagaacgagaccctgtctcaaaaaaaaaaaaaagaaagaaaaacaggccctcagttttctcgtatttattttctatggcttttttatagggaggaggaaggattgcttctttaacttaaatatgaagaatatgtaatttttaaaaaatcacatgctatataagtgaattgcattctagagaaatgtgcaaaccatacctgataagacaaatgctcatcatggaagctgtgagtttctttattaggacggtcaattctgattccttttgtgtgcaagagatttagtgatacttggatcatccaagcatcttccaaacctcacaggctagtgtcagtagcatagttttccacctgaagtttgagctgacacaacttcttgtttcagattgtctcctacctacttgatcttccagaaaaagatgaagaggaagtagagcgagcacagatcaacagctttgacagtctctggggagagacaggtacctctcatggacgttgccctcaagaatgtgttgtgtttgtgtggactctcgaatctcacccccttattttttccctggcatacatttggcagtcttctgtctcaggcttttgtaatgcagactgattcagccaaactaaacagtcaagcagttttcctctttcaatcctctttgcctgtggattctccatactctttgcaccagagtcttctttcaaacaaaactttttccctctcttgtttccaaatatttttaaaagactgaaagttaccttacaatgtgccaaaccagagcagaaaattattgtggcctgtctcctttttatgtgatccttgtagtagttaggaataaatatttctcccatcaaaataactctttccccttgcatttgttaaccaggatgttaaattttcacccacacctctggcttaaccaaatgttactgtgatagcgtggtatctgacacaattaatctaatacattatgagtaaagttgctatctggatgcacaatgaatgcccagcctcatgcagttcctgttggtctgtagcaaatcagtttctgtatcgttcggtacaatgcaaacagaagcctcttccttgtggcctttgcaggaaatgattgttgtcttccctccaagtctaaactgcagcatctggagaaacattagtaaccttggatgtgtttttatgaaaccagggcaatgaaaactgtagagtaaccccagatatgtgtgatattttccaggagaagtagaccaatattgagatggccaatctagggagaatattttactaaacaagaagggtatgcatttgggttaggataagagtgttattaaaaataagaggttcttgaactcatttaaaatttataaagacctattgtggcatttcttctcgtgacaaagtcttagacacatttcctgacttctttaacatcatgtggaatggtccaaaactcaggaatttgcttctcgaataatccctccttttgtaagatccaaagggagcagatgcctggcagctgcagcttaagagtccatgacagattaaaggaaagtgtacagctggaaacagctgctgtctctggagccccaccctgagggaagccagaggacaggctgaggggaaggaactgggcaggacatcagccgctctggagtatgcatatgtgtgtgacccagagctgcaggagggacatgttggtgtgtttctatcagcacagccttctccaacagtgttgccacatctccagcagaccctttgttgccaagggcatggcggtgtaaccactgacagcagcaaaaagagtcgtgtccccatggtgataatgaatagaaattacaagactaatagtcatagcgatgaatatcaaacacattctaatggtgtacttgaaagaaatccttaaaaatattcaagaagggcgtgaattaaatggaggacttatttttattgacatgaatttcttattagaataaaattttatggcctcaggatttttaaaatattttattccttaaagtatacaataaatttttacagtgaatgttgtacatatgtaccatatttcaagattttaaaaaatcaaaacttcatgtgtttgcttgtaatcagaattgtgttgtgtttgacttatgcatatatacaatataattataatattataaacatgaagagctacttaaacatgagttaagatggaatttatttgtaatatgattttttttttctttttttttgagacggagtctcactctgtcccccaggctagagtgcagtgacacaatctcggctcactgcaacctctgcctcctgggttcaagtgattctcctgcctcagcctcccgagtagctgggattacaggcgtgcaccaccacacctgactaattttttttttttttgtatttttagtaaagatggggtttcaccatgttggccaggctggtctcaaacccctgacctcaggtgatctccccacctcagcctcccaaagtgctagggttacaggtgtgagccaccgtgcctggctgtaatacaatttctatatctatgaaaaattattttatttcagaaaaaattctggaaaataatgtttattatgtggcagtgaccctagaactcatcactagtatagaatggactttgatttactgttctatctactgtgatggttattaaacatacatgtgcctttctaacttatagcacatgatcatttaaattttataatgacctattgaattatgatgcttcctcccatgacaaaatcctatacatattttcacatacaaaagtggtctgtgacccaaagctagttggtgggggctcatatctgcaaccaggacctaagtgacaatttttaacctaaggaaaatacaatggtcgtgatgtttcctataatatgtatcacttactctatcaaatctaagacaccattaactttaagaaactatgtagccattattttatgtgccactacaaaaacaaacaacttctgccaactatactgacacaattctttattatcacattaactgtaagatgcattccaatttcagagatgttaaaatgtagagggagaaagtgaatcttagaatattaattgggatgtgatttttacatattagattttctgaaggcagatcactagagcatcctggttgctttcatcttccatttgcagcctctttatctttccagatgtcatcatcttacatccagctttcactatctgctgaccccctcccatcccgtagagttttcacagacttcttagggaacaccacagaagaaaagcaaacaaggtgacaagattgttcaccacaccctcctctcccttgtgttgtgggcacagaccaggaccagcgctgagagcttctagcaactctggaggccaaccctggaaatacatggccccaaaaagaaaccagagtttacgacataaacttactagattcctttaattcctgccctcatcatcatttgcctagattattgcagctacctcctaattgagcttctgcctctagcctcacccttttgtgatacatctctcagacttcagccaaagtggtctttttaagccatagtctgtttgtgtcactttcctgctttctgaccttcatttactacttgtaggattaagtcctttaatgtagcataaaaagaccagtaataacctccagtctcatatattgcctgtcttctccagtaattccaataacagtaaacatgttgttttcccctcattgcctttattcatgctctcccttggcccaccccacaccttccatgcctgtaaatctcctgttcatctttcagcatctaactcacattatcatctctacctggaggccatctcagaaacctcttcctctgtgccttccctcataccaaggacatatctccattgtgcatatcacactatattaacatattcgtctgtttccttactcaaccatgagttctttgagagcagtgtctgacatatagctcaataagtgttttattaatgtcattttgaatagcagtgatcagtttatttctccccagccacttccccctcctacccgaccccttgatcttacatgacctgtctgtgctggactcttccaaggttgaaagtagatgaaagagtcatgtgtatctctgcgttctctttagtgtcagcatcccatccaagcagactctggctgtttccccaactctgagctacatcctgtctgcctcttccaactccttagatgtttcccgttgaaaaaagaccatttctgtcagatcatctcgtcagatgctgacaagctaggaaacaaattctgttactgctcttttaggaagaaagttggttcctaactgctctgtttgcagtttggtgttttatagaattggctttaccttcatctcctttcttttagaaagttttaacagttttcgataaatctcatataaaatccagccatacaactccttgctcttggattttgaaaagcccagactccattttacatagttgtgttgttctgagatgaaattggccagctgtgttaaccatgtccagctatcagctgaaggttgctgccaaatgacatcataacctaaacaacagagatgatacaacaaagaaaaaggccaaatggaacattccctcacatgtaaatgtgttatccagtggggagaaatggggcagccagagccatagaattgtcagactggacagtatggctttccagatggtcactggttgtgaatattcagatgtgttctgtgaactggcatcattagtgagaggcttcattctgaaattctgtattttctctaggatgctgtaacttctttcgtgaaaaataatgtatttggcaccctcacatacagaggtttgctgcaaacttatcaacctagtaactactttaaacgagtttagaatgtgggttagaaattttccaaatggtttgttttatgcaccgagataattcttatggttcctagtaagtgtctatccagtcaaattattaaactactcttgtgttctgacccatatatagaactcacaatttgttttctaaccttttagaaatatgaacttgagaaagagggagcatcacttatatttaaaaaacaagagataaaacttctttgtccaggaaataattatagccattaacacctgagctcacccactcagggatggaaatgaccctcacctcagataggaccatgccactgccctcccgtaaggaactgaaaagaaatgccaatgtcaggagttccaactaaaattgaaaatacacataagacaagccatagatagaactggtttaagagtgcatgtatcttctaaaattaccacattttacttcataagtccttcttatccttgcagaaggaaggaaaatgttacttgaaggtttatacttgcggaaattacaggtagttttcattttgcatatgactcagtagtggataaatttggccaagtccagagacaaaatgccataatttgcacttaagtggaaatgaatgcaaatgtccatttgatgtaaattttacttgcttctctgaatacgttttaaagtttgcaaactgcagtatctgtgcctgccaaatattatcattttctggtttgttactggagtaggaggccataataaaagaagaacctgctgactactacatcaattttttaagtcaatttggaaaaaaaaatctttatcctcttcctttaaaatgaagtataactcctacatgttctaacagtgtttccatcctccatacccctcattttttaaaacaatagacttgtgcacctgagagcccatggttaaatgaaacaaatacatatttgttaaaagatagacttcatatctccaaactcctctttctactgttgaaacgacactctgaggacaaaataggcgttcgtaaaatctcctttgtatcagagatcatattgtcagtggacagtggcacaaaaagaagaatgtttctgtttttttcctaatgtgtctcttaaactcactgtagctatttttacctgtgacttcattattttatattcagaagaaaatagtctttgtcatacctcttctctcatctttaagactgctaccttgaatcattcaaatccttatataaaaaatgattgcaaatgtaccagaaacttctgtatcaactaatgaagaaaaagaatgaaaactggcccaagaccttggactgcaattcctaactttggttctctaggcttaagagcccaggggtagagcttggctggaggtagttcccagctaattctaaaacaaaacaaaaaaaaaaactttttatctctgcaaagactcttgtctttagattccacccacacgtagactaacagagtttgtagctaggaagaggtaccaaaggagaggtagaccaaagcagagaagacagtctggttaggaaaaatgaaaccaagtgagtttgattaaaggtgaattttcaatagatttattattattgtctccaaatattgtgaggcaatttaaatgtgtctttattcattatttttctttagaacttttctttatggaaaaggtggcaaaaatcattattcttagaagtaaagtagcaattacattaatgaaacacaaggatatgtcacgtttaacatggagcgctggagaggaccagaaccacctatcctcaatctttgttctctgcccttagccctaacagctgcagccggaaggggcaaactggaggtgtgccgtttgctcttggaacaaggggcggcagtggcccagccaaaccgccgaggagcagtgccactattcagcacagtgcgccagggccactggcaggtaagcagggcgaccacttccagtccctcaggcaggactgagttctaggtgaggacttctgatgcacagagcaaaatgatcacaagtaaagtttgggttacccagcagtgatcaggtttgaggacttggacctttgttatgagtattctggttaattgagaatacgacagttaacattcaaaaccatcacttgatacagattgtatagaaggactaactacttatgtcctggtgatagagtgacctccttctcacatttcacagcatccaaagactccttggaaggttcatttctcagcggacttctgctaatcacttacttgcagatgtctgagacttactaaaagaaaatacagtgaatgcaaattctaacaacacaatccttttagatgtttggattctggataaatgttaatttatacacttaggatggaaaggaaagcacactgataataatcttcagaagtatttcaatagaaaaaaggctgtagaagccaaacagccctaaagagttaccagagtcacttgattatgttcagttcagttgcaagtattaactacaggcagatttgcaaccactagagggcaataaaggagtgatttatgttggaacttccgctatgggattgtttaatcctacatcttggcctttgttaagttcttttttacttagtagctgagtcagacattgagagttgaatccttctcatttgactgtccctgagagagattaaatcacatggtactaggactatacaggtacttatgggggaagtggaaagatacatgggtgactcgtacagcagtaggaattcctacagagtaagagatagtgtgcacgtgtcttctcagcagctcttctttgggctaattggtccctgtttctctgcacttgcagattgttgatcttttactcacccatggagctgatgtcaacatggcagacaagcagggccgcactcccctgatgatggctgcttccgaaggccatctaggaaccgtggactttctgcttgcacaaggttagtcttggaatgctagagctggctggccagtttccataattacctggtgaactcatgatttccagcaatggatcccaggagatgctaagaacagatattaatccagttggttggaaaatgaaaggctatctcctcccctcttgtattcagtgtaatgtttttaactctgatactctctatttccttatgacttgagggatttaaatgaaattaacatattctaaattctcattcagatcagtagtctccaaactttgattttttaaaaatatatactcaataaatgttcatcttccggggattgtgttctgactttatcaattcttttgtaagcctgcacaactaatatttttcttgaattcaaaggaggcaaatgccagtgaagatccctgctgactctgggatgctatttgggggatcaagattattaccctgtagtaataaattccttttgacacttaccaacatccacaaattcctggtgaatgggaaataagttaaaggagatgatgatcacaccaccatcataaagtacgtcaggctcctgttggttgctgtgacctctatcacctgtgcataacagtggctgctgatgatggacctctgtagtagaaaaagctcatcactggtgactctgcagtgccatctagtggagcttgagcatttacttgaagcaagagacagaggcagtcattccagttagcctccactattagtaaactggacgcaaatgtcggtaattacatccacaagcacatgtactttccttcaagaaaaccaacctcctgaagaattatgcctaggccagagcagctgagggtagtttaattaggaagaaattaggtttcttctaagatttcaaactacagctcagtcagagacttactggatctttagctgtatcccttaagtaagatttttttccacagactcagactcaaggctgggtcagaatcagagagttgctcttacagggtgcgaagtggctcttgccttccccatataagctaccaaagaaatttggcttcatgctctctcccttcattctgctggggaagcaaggaggaggaaggttgggcctagattctcaagataagatgtgtccagagtaatattccagaacaaaccaagtccactgaaagaggcaggaactcttgagccactgataacctttagatagctgcaaagtacctgtcatgtgccagtagaggctccgtagccatagattccaggtatttgttctcccttaccagtgaagacattttcatctttggactgtttcatttttttccacacttagaggcttaatgaattcaacaaagatttatttaggctatgttattagcagaacactatactaggaactatgagtggttctgatttttttaattaatacactataacctgtgccctcaaagggtctataatgtggcagggaagagatgaaacaaagataaatgccttaaaaagcggagaatcctgagtgctctgatacaggcgtccgttgagttagactaggacagactttgaaattcgaagaggaaaaatgttttgtatttagggagaggaagtaacatagatgaaaggccaaagaggaatgacaggtttggagaaatatgcaagctgtctagtaaaatgtaaggggactacggaaaataaaattggaaaggtatgtggaaatggaaaaggaccaagttagaagaatctggacttaattctaaaggaatctggggaggctttaaaaattttaaataaggaattgatggcagagttatgctttaaaaacaatcactctggcagtatgtgaacagcagatttgacaaaggagccaggagatcagttaggaagccatcgtaatggaacatatgaggcataatgaggtcctaacccaagggcagtagctttcagcatagaacaaaaaagggctatgtgcaagaggtattttggatatgaagcctgattagatgtaggaaataaggatagaacagttaaagataactccagagttgtaagacggacatttgggagaattgtgatttcattaactgcatgagaaagaaaagagagaagaggaagattacaaattggattttggaagtatttaacatattatggatttgtttcatgtgtatctccttttaatttcttctctttccttatctttggaaaaatcagttcatctgtaatgtacatccaaaactttcttatcctactctttcctccactggatactttgtccaggaaatttatagatgttgcatctgagaaaacgccttggattctgttccgtatttaaacttattccatattagagtcagtgttttaattgcaaactataccattacataaatggctctcatcaggattaagggatggtcccttccagcttttcatcctcctgtgggaaaccatagactctaatgacctccagagatgcaaaggtgataggctagataactgctgagtaaaccctgagcctgctgtggcaggtgctaagcttgagctgacatccgaatcctgtccagctgagggggcagccaagtgtcctggtgcagtaagttgatctctgatgtagttaaatatgacatgcctactgtgtgaaaagcgttgtcttaggtactcttctagcaagtaaatgattcgcttcttaccattgaaggccttacagtctgggtcttaagaaccaaatgtatattggattttagactgattacaaaacagcatgtcaggtatgcttgatcctttcaagtgaaaatagaaatgttgaagggaaacagatccagaatatgaaagggtgggtggagaatttaaaagtggggatggagttattgaataaggctgagtagtttaaactctgaattttttgtttatttgtatttgttttttgtttttgtttttgtctttttttagaggcaaggtctcactccatcacccaggctggagtgcagtggcctgatcatagctcaccaaagcctggaacccctgggctcaagcgatcctcccatctcatcctcccatctcagccttcctagtagctaagactacaggctcacaccaccaccacacctggctaattttttagttttttgtagagacagtctcaccatgttgcccaggctggtctcagatttctggcctcaagcagtcctcccacctcggcctccaaaagtgctgggattataggtgtgagttactgcacccagccaaatatttatttttttaattgacaagtaaaaatggtatatgcagttatgtatcacttaacaaaggggagatgttcagagaaatgcattccaagaattgtgtccttaggtgattttgtcatttgtaaacatcatagagtgcacttacacaatcctagatggtatagcctactacacacctaggctgtatagtatagcctggtgctcctaggctacaaacctgtacagcgtattaactgcactgagttactgtaaacagttgtaacacagtggtatttgtgtagctaaacatatctaaccataaaaaggaacagtatttatggtgtacaacatgatgttttgatgcaggctgtatatcccttatctgaaatgcttagttatatatcgcttatctgaaacacttctgttgggattttattttttgcattttgaagtatttgcattatacttactggttgagcatttctaatccaaaaatgtgaaatccaaaatgctgcaatgagtatttcctttgagtgtcatgttggtgctcaaaaaggttcagattgtggagcatttctgaaatcagattttcagatgagggatactcaagctgtatatgtatacattgtggaatggctaaatcaagctacttaatgtgtgcattaccttacacacttttttcttctggtgaaaatgcttaaaatgtactttcacaacagttttcaagtatatattgttattaactatcactatgactatagttaactatagagtagatttagtgtactagttagtaactagtaccgtagatctcttgaacttatttcttctttctaagtgaattttgtgtctttgaccaacatctctccaatcccccccccccatctcctagtttctggtaaccaccattttattctttgattctatgaatttaactttattagattaaactctagatttctttcttgtcctgggctcagtgtcctctcgtgtttatttcccccacctggggagggagaaggggccctggcatcgtgatcaatgacaaacatgtcctgggctcctatttgatgagactgtctcaaggagttagcactattatcaatggaaggcttctgctcagctcagaaaacattcaccgaactctggtgcagtgagggccgaggcaggtggatcacttgaggtcaggagttcaagaccagcctggccaacatggtgaaccccatctctactaaaaatacaaaaattagccaggcatggtggtgcatgcctttaatcccagctacttaggaggctgaggcaggagaattgtctgaacccgggaggtggaggttgcagtgagccaagattgggccactgcactccagccagggcaacggagcaagactccatctcaaaaaaaaaaaaaaaaaaaaaaaaaaaaagaagcagaagaaaatgctcattgagaatttattacatgcaaatagtatacataaaaagaaataatggaataagttgacttatgttaagcatacttaagatgaggtagcagtgaactgtgagaagcttcttagaggcaggaggatggagatagttcctagagaatgagaagtgaggcaagtcatgggggaagaaaagctcttccacacatggagcagcatgaccaagagtgaggatgcaggaggatttacgggagatccgagaggcagagagtgaggatgcgggaggattgacgggagatccgagaggcagtgagcacatccatttggccaaagtggaggattctcacaggggaataataaaacaggtatagagagtaattaggaatagactgtggatgaccctgaatactcagtaaaacgactggaatctgttttattgaaagcttataggatgaacttttaacagttgagatacaactggcataccagcatcagtcttaaaatggaaatagtccagaaacgagcagtgttctttgcaggagcatgccccttcagcgtacttcccctcctgctgtgtgattccatgtctcctcagccctgtgctatcacttgcctttgcaggtgcctccattgctcttatggacaaagaaggattgacagccctcagctgggcttgtttgaagggccatctctcagtagtacgttctctggtggataacggagctgccacagaccatgctgacaagaatggccgtaccccactggatctggcagctttctatggcgatgctgaggtggtaagtacctttaaacaagcctcaagagagcagagagaggggctattctccatccatactacctggggttgaaagtggagtgatgtattgatgattcctgatacagagctctcagatctatacttgctagagagcaagaatattcaaaatgctgttaaagatcaaggatatagctaaggcctgaaatacatggcagcatagcctggggtaggccagcagttgaaaaagggcaggcagcagccagagccctcggtggaacagtgctgagccattacgcctgtcctaacttctctgcttgatccgtgtcctaggtccagttcctggtagatcatggggccatgatcgagcacgttgactacagtggaatgcgccctttggatagggcagtggggtgccggaacacttctgttgttgtcactcttctgaagaaaggagccaagataggtaggagaagggaagaggatgttggccatctgtgcccaggggccagactggtccagtggtctggctgccctgggtatttggtgtgagtgtatatagttccccctcctccctggcccaattattgtccaagtgaacagagaggctcttggcccagggaaagcgccatctgagccatggtctgcagtcccctgtgtccagaaccacgtggttctctaccatgtcccttgtagccttagccaggaggctgctctggccttaagcacctctcagcactgcctctgttccagccccactctatcagcatcctggatctctgcgctgccgtgagcctttgctttcccttgctctgaatgtgcttcagactcaagtccctgctgccgctgtcccagctgctccccaagcccacagacctatagacgagggttggctgatatgctggctttgtgctgcctgcctctcactgctgctttttccttctttttttttttttcaccttcatccatttttttttcctctcctacaactttttgttttctcctttctttgaaggttgtcagacgttaccgagtcgcccacgaggtatatttcaccgctgtcagcatcaggcgtggtctgatggcttggtcagctttgccttctcctctttggtttagcctgcatgagttccctacacctctaatcttttaatttacttcaccttaaaagaagattttttttaatgactgttgtagagaataacttgaacttttgataactaaccttgaaaagcatagtttgtaaataattcaggcatttgtaaactaatcaatttaaccttttctttctttttgtgggtaaagtcatcctcagtaatgttggtttgtttcacatctgattgacattcgaactgtgctcctgcttcaaagtgaatcccggggagtcctagttggtacttatcatttaagggaaactttagagttatcagtggtttcccttctgcaaagtacatattttaaagttaagaggctaaacatctgggggttttgagtcccaaatccaaaataaattaccctttttggacttttcaaatcctgtggtaatgtttaatataaatccttcctcccaattccttatttaaaataattccaaactgagccattgcttgcccacatgcagcacgcaggctttgctgccctcgcgtggggcaggctcacatggttcaagtattcttattttaaggtgaatacaaatccaatgcagcttcttggcagtgggagttactaaaatactcccaggtctaaaagatgaggtactaattgtggagcaagttgttctctcagcagaaattcccctagggtatttttttcacctagcttcctaccacccttacattgtatgagttttttacccatcatgcatcctgtacactacaggtccagccacatgggcgatggccacctccaagccagacatcatgatcatcctgttgagcaagctgatggaagagggggacatgttttataaggtgaggggagggagggacacagtttcttcagaacagccactgactgttttccatgtgtagaatcttacaaagtcttgataattctcatcctttgcgtagaggcaaagggaaactactgttcctcagtgatggcctcatatgttggggatcctggggttctgccttaccaagagagcaagagtagcctatagttgcctgcagctgatcaatctaaagccctggtttcacctggtcactcacccatggttttgtcgatttttacatggaatctgttaggtaggatctggaaactcatgagacaagtcaaagtaaaattatgtagtatagctatttccagtatgttgatcctagctttcatatgtcataatatatacatagattaaaaagtatatagtaacaatagcttatcagcatccttgaataagataaggaaaccaagacaaatagcaattataagatttgtttgaaatcattcactgaatgacaataacaaaaactgtggaggctttttgtactcacagtccaagctgaaggctccataccctgacacaaatgaattccttggtctattacatgtcaaagtcatcgcactggatcagctggattaccctgtcccgaagcttcatacaaatccaacccagtttttggcagcagtcatcactgacacttccccaagactaaaagataaggagaaatagttgtgaagcatattattctcacctgtgtcaggagtgtacaagttcctaggagcagaattctatcttctaagtaccctttgaatgagtcacggtaatctaggactcccaggctttcaggaagcttaagccctggcccaaccttgattttacgtgacttcatagaaggtcctcattaccctagatgtcatatttatggacttcacaatggcattactctcagattatgtcctggttatagcataacttctggtattctgaggcgaggagtcctcttaatgaaaatatgcagtgccattattgttcccctcagaattctaccttgaaagactccaaatctctccttagtgaatggtgctaagggaaaagtaaaagactgggatccctgtggagttgtaactatagagaaggaatagagtggataaagatcagctaaaggggtgggagatgccgcctgcatctttctggtctcagcttatagattttcagatacaaagtggaagaaaagttcaaggtcgctgtggccagatctctaaattggtcatagatttacttcctcttggataatccctcctgcaacatcagatggaatcacaaactctaaacttcacttttctactgccaccctactccatgcctttccaaaaatggggaacactgattggtattattttatgccatgagattagggaagcaactgctagactgctttagctcccacatccttcatgaggaagagagtgacttctagagggctggccaggtggagcgtcagaccaaaaaaacagttctccagacaagccagaaattaaggaggaagtaataactttggagtgcttggggttaggaagtcatatgtgttatagagagcaaaggaactttgaaatgagcatggtcagcctctttggaatccagttgggaagtcagggtccagggccttccatttgccaaggctttgcctccctggcttgtatcttgggtatcccctcaaccttgcctttcctgccaggtgagtttcctatagaaaagactagacccttctgccctcaccatcagggccagaactcctctctaggctggcgtttgggagggttagcccttagtaacagctgctgagaagaagaagggagtggggaccacacttcctcagctgttcagcagaccaactgtgtgtttcgccatcttgtgctcccattagaaaggtaaagtaaaggaagctgcccagcgctaccagtacgccctgaagaagttccctagagaagggtttggtgaggacttgaaaactttccgggaactaaaggtgtctctcctcctcaacctctctcggtgtcgcaggaaaatgaacgtaagtccctgtcaccccaactcctttctgcaatcctggtagctgatagcctgtgtcactcactagcttttaccaggcccctgaaatcctcctctgccccatttggaacttggttgtccttcacagagcactgacatttgcaatttgaaagaaatcaagtctaagtacaatctgtatctcaaactgtacagaaattaatgctgcgagtactttgcagctttctgaatgttcataatttaactgaaagtgatgagaataccatctttcccacccccataccaccaagtcagtgttctggtctttgggaaaatgtgagagcagtggtcactagaattccagttgcaattagatgtgaattgtagtcattactctcaggtatattcccttatcatttgaagaagggctaaggagagggcttggaccatggtcttgaaggtttaatttctgaggctatcgaacttttcgcctctttcctcatctttgtatcccagcatgctatgtcccttcttgtcctagggggaatctcagaactccccctggacctttatcgtctccctggtaagccacggtccttcctgcctaccttgcagacccatctcacatgtccccagacactgctccctcagccactgccctttaacgtgaagacactccaagccaagaaccctctctcaggttttggaaatagctaagattgtgtcaggagtctctgacatctacctgcctgaggtctcacagttcctcaggagataaaaataatccaagccaaacagatgtattgatcaattaaaaactcagctggacagaagcaagatttgaacctcatggccagggatcttccagaaagatttgtgtgtgtaacctttagatcatccattccagaccctaaaccctgacactggaaggaacctgagttaaacctgactgtctcagagaacatagccatgaccttcagaggcagagttaaacctgactgtctcagagaacacagccatgaccttcagaggcagagttaaacctatctcagagaacacagccatgaccttcagaggcagagttaaacctgactgtctcagagaacacggccatggccctcagaggcagagttgctccagggtgctgagggaagtggggatgtggaagaggccccccaaccccgggaagggagaaggtggcggtctcgggagacagattttcatgctcttggggtctcctgtgaaatgaaaggaacagcaccaaggcctcccctgcaccagccgatgaggatgaggcaaagctcagaagttgctgccaacccactgatctcttttccctaccaaataatagactttttaaaaatgccctcatatttttaggaataatgatggtcccaaaagaacaaataaaagggtaaggctggaagcagagcagggagagggtgacccataaaagctgaaattctttctagctccacatttgttcagaagcggttgttaatcacctcctgggccaatactgtgccaaacaccagacgtctgtcttcttaggtagaggatttcccatcaacttttaaaaaatttttttacctatgccccagggcctttgttctgcccaaggccttgttttctgccttaggactcatgaccataaccagaggctaccatgctatactgtggctttgacactaaaagaaggggaaagccttctcttttagcttagtatttaagggaatactgaaaaccataggctgcctagtcggcgttgttccccaccccaccccccagtctctgtttccaggggttctcaggaatgacatgcctgtgagcgtgttcctctagggagagcacagacctcagtcacagctggggtcttctcttgttttgttttatttttaattttaagtgtttcctaagtaaggaaccagttaaaaaaaggaacagatcagagaagcctctgtgaaatagaaagaaaacgataattaatgagcacctactatgtgccgggaactgtgcagggcttttaaatactgtatcacacttgatcctacccccggggtaggtatggatgagaaaatacactatacacttgggggttatgaagctggtcagagaattgaacccaggtctgtctgacaccccctctccctctagtctctgtagtcagtgcagtttcctttacagacgtcatcctcccggactttacaggacaccttctcacctgtcccttagaaagccacagtgtagtgcatgtagcaggaaggtgtggggctcagaccagggtccacgtgaaatgtggacatgtgtgcgtttgcctcctacatgcatggataacttcaggagcttcactggaaagggttggtgtttggcttccgggctgagaactttattagaaaggcaaaaagagggaaaattaaaactattttaatattctgggcagataaagtccagtgagcagtcgcagcgctacacaggacaaaggcagaaggaactttcagtccacaggccacgcggcttgagccatgtcaggcacgtctagcgtcccaggcgttccatccatgaatgtcaaaaaatgtacaaataatttgttttattcccaagttgtctattttttatatctcatcaatgactcatttgcacacctattgtaatgacaggattttggaatggcggaggaatttgctactaaggccctggagctgaaaccgaaatcttatgaagcttactatgcgagagcaagggcaaaacgcagcagcaggtgaggagagagagagagggtgaaagcaagaggtctcttttctgaaaatttggccaaggcagcgtcggccaccctggggcatatgtacccaaatacatctctgtccttgagaactgtcagggccaagctttggggatggctcccatagcacagccctcagctcaagatcagcaaatctgctgggctgtggaggccacgaatgtttcacttcgggagaaaaacactttttcactggagaatggcagcttcttccaagaagcctctgccgtatctcaggcatttttcaacccccagagcagctagcacaaagagacaacggcgacttaaagaaatcacttaagcagagcaccccacccccgctttagagggaaagtaggatggttcacttaacatcacaggttcctcttccttctcccataggcgtttgaggaatcccggattagttagtcttccctctggggctctcctcaagtctggtggcatcagacccccttccacctaaaccatcacccaccacacacacacagagtcaagaggtccttgctgccaggatggagaggaccctctaagagaacaccattccacattccttgtgcccatctgctttagtttggccactgggcagaaaagctcccagaataacctagaacctgccatcagtgatctttgtgtaacttgtcactgtctcttatgcctcctgccctcctcctccccagctgcatgggaaagaactgcttcaggttcactgctatggccaggggcacatggtcccgaaaatcacacccagcttgaggctagtgatggtggtggcagtgatcgcactcttacctagctggggcaacgaagtcctcacagaaatctgactgaaattctccttccctctgggtagttcctttttcacaaggtcagttgcccctgtcaggtgatattagtagagaagatgggaatgtctctgacagttcatttcttcatttgtaaattagagtctccttggagtcagctcagctccagccccgagtgacctagtcagcaagcctaatgcctgccccactttgatagagcaaatggagacacagcaattctgagagatgagggttagaaagggcagaggacagggttcttgcctagagtagaacaggcctgaaatttggagctaaaatattgagaatataaagaaaaatttctgctggatcagcaagatttttaaatatgtagttttttttgttcctaagctacttgacagtgaccctgtaaatgacaaccccacccaactctcatactgcctggtgtgtgtttgggcaccaaaacaacttcccgaagggcctggctggactgacaaaatggggcatttctccactattcccagagaggccagaaggaagatggaggccgaatgggttagggaatcattcggactcttccagaatgagtcttcctgtttccttccctataaatccaactaaaccgaaataccccagactcccacagacgccaccacagctctctgagatagtgaccatgttctcagctcttggtgatttctctggattcagaataactccagttcctgtgttcacattttgtcaagcagacagttcgcagcagccttagaggacctgaacgaggccatcaagctgtgtcccaacaaccgtgagatccagagacttctgctgagagtggaagaagagtgtagacagatgcagcagccacagcagccaccgccgccaccgcagcctcagcagcagttgccggaagaagcagaacctgagccacagcatgaagacatatactctgtacaggatatattcgaggaggagtacctggaacaggatgttgaaaatgtttccattggcctccagacagaggcccggcccagccaggggctcccggtcatccagagcccaccctcctctcccccgcatcgggactcagcctacatctccagctcacctcttggctctcatcaggtttttgacttccggtccagtagttctgtaggctctcccactagacagacctatcagtccacctcacctgccctttctccaactcatcagaactcacattacaggcctagcccaccacacacttccccggctcatcagggaggatcttaccgtttcagcccccctcctgtgggaggacagggcaaagaatacccaagccctcccccttcccctctccggagaggccctcagtatcgggccagccctccagctgaaagtatgagtgtctatagatcccagtctggttcacccgtgcgctatcagcaggaaacaagcgtcagtcagcttcctggcagacccaaatctccattatccaaaatggcccagcggccctaccagatgcctcagctccctgtggcagttccccagcaagggctcaggctacagcctgccaaggcccagattgtgagaagtaaccagcccagcccagccgtccattcaagcaccgtcatccccacaggagcctatggccaagtagcccattcaatggccagtaaataccagtcttcacaaggagacataggagtcagccagagccggttggtttatcaagggtcaattgggggaatcgtaggggatggaaggccggtgcagcatgtccaagccagcctgagtgcaggcgccatctgtcagcatggaggattgaccaaagaggatcttccacagcgaccttcctcagcataccgaggtggcgtgagatacagccagacaccacagatcggacgcagccagtcagcatcctattacccagtctgtcactcaaaactagatctggagcgctcctccagccaactaggttcccctgatgtgtcgcatttaatcagaagacctatcagtgtcaaccctaacgaaatcaaaccgcacccgccaactcccaggccgttgctgcattcccaaagtgtaggccttcgcttctctccatctagcaatagtatctcctccacctccaacctaactccgaccttccggccatcttcttccatccagcaaatggagatcccactgaaacctgcatatgagaggtcatgtgacgagctgtcgccagtgtctccaactcaaggaggttaccccagtgagcccacccgatccaggaccacaccattcatggggatcatagataaaacagcacggactcagcagtacccccacctccaccagcagaatcggacctgggcagtgtcatctgtggacaccgtcctcagtcccacgtctccaggcaacctgcctcagcctgagtccttcagtccaccatcatccatcagcaacattgccttttataacaaaaccaacaatgcacagaatggccatttgctggaggacgattattacagcccccatgggatgctggctaacgggtctcgtggagacctcttggagcgagtcagccaggcctcctcctatcccgacgtgaaggtagctcggactctacctgtggctcaggcataccaggacaacctgtacaggcagctgtcccgagactctcggcaagggcagacatcccctatcaaaccaaagagaccgttcgtggagtctaatgtttaaaagacgttttgttggagtgagacccatatgttttcactgcacattttcaggcttggtttccacattcgaggtagttctctggcttaatttctcatgtagtttctgtgtggtgttcagaggtggcagcccacatgctgaaatcctttgcatgcagccgactgggaagcggcctcccgggagccaggacttcagtttctcttgtctgtgcccagccacatgctctctccctctcttcagatgccaacgaggagattttcgtgctgtgtgctttaacccagggagatcagacacactggtcagctttttccaggagacaatcgctttcactgatgttcttgttgtgtaattgtctttttccttttttaaaaaataaggtgttcttgttcgttttcttctagaaactttagaaagagtgcgatgcccctttgcctttgcatccttagccagtgtcacccacacagccagccgcagcgcattctcatgctgtggcccctccccagaccgccagcgccctgcagccaccaggtctgcagtgtgcattaggattattgctggtcttcctagggggtaaaaggatcagagagagaagaattaagtgctaaattggaagaaaaccccaatataattatgtaaaatgtcactacattgattttccaagaggcattgtaggaacatgtcaaaaacagccagccctttaaatattgcagtcagccaaggaaattagatgagaattgtggctattaagagaattcactgagagttattctctagatttttagccgacaattaaccactaaaagctgctgcttttccagggtgggggagggaatgaatacatagaaaaacaaaaaagattgttctggattctcagtgaaaggctataggaagtctgttctggagacatctactttttagatcctgatacatcactgagtgtcatactccactaaaaggaaactctaaccgaaggctggctggtgtgacaatcccgttagttggatcttcacctacagccagattttgttctagtggccctcttcctgtaaacccagatggtgtcatacagaaattgtttctttcagaagcagattggaatctcttgggaccatgagactgagtcccaatatttccacccagggtcatgcccgttgttgtctacttccattttgagatctatagtttgattatctattattacaggaactgtttcttttctttttctaggagtgtttatgagagtgtgatattttaaagtcagacgcagcaaaaactgtttcagggtgaagaaagacccctttcagccctgttttgcagccctgggtgggggcatgagatagacagcaagcttctgatcttgaagcttgtctagaagacacatcttctaggtctcgtggtcatttggtaggctgacctttgagtgagcgaggccactattgagtggatagcaagaacattggaaccaaagcctcggcacaggcctggcactggctgtacatcagctcttacaactaaacaactcaactaagcaactgaaacgaaacaaaggagcattcgttctctgttgttaggaatcattctgctctgttagggaagggctgcaggaagggcagtttcctgaataaaaatctggctgcgaccagtcccatgtgtctggtaagtaagtaagtaagtaagtgccctttgaagggatcattaagacacagggagcatgaacctgagatcagaagcatttctttactaatttagattctgcgaaatagacggacctctccacccccaaacctaaaacaggccaggacttgtctctgtgctgaaagcaaatagcaagactaactcaagccccagcctctttccacactccctgatacctaaggactgctttctcagctagaccagggtgggcatcagcgacgccttctcagctagaccagggtaggcatcagcgtcctctctccatctctatacccctctctctcacatcaggaagatgaaatgtgtagctctagcggcaacctctagccaggagcccagtggcctctcagattgctttttggccaggtctcagcactgctggcatctttacatcttactccttaaaaccgcctctcgctgaggagccactgcattttgaagaatttctcagtgtctgtcaggaaagtgctcctgctcatttggaacgccacacaccacccgcactcacctgtccaggcgaatgagcaggtcctgtagctttacaaatatgccgctgatgccgcttctccccagggtctctcagttttccaggacaaaaagatttagggcctataccctatgggcaaaacacctaaaatgtcaacagtcaaaatgccattctttttggccatcataagagggagtaggtatcactgctgcatgccagttgtttttgactagaatatgccaaccagagcttgttggggcaggagacgtttttccttacaagcagactgcctgtgccctgtgccctgtttgctacttcactgccatggaatgatccgagtactgtatttcagagctgccccttccccagcagcaaacactcgctgagtccatgtctggcttcaggtgggaggaaatgtttcagatgaaacttactcaattcataccaccctgaaatggaggacagaggtgacaaacttcagtttaataggtttctcaccaagttgtatgttccattggcccaggattcttgcactaatgggtttctatcacatcatgtctataaatgggtgcactttactgtttgaatttgtaactgaagtactggatatttaagtgtgagtaatgtcttcattagaaaatagcagaaccgctcttgtcttttagtgtatttttcaagaaaaaaggaaaggaaagacatcaagcagtggatcacaacatttatagcacaagaaataacttgtatataagcatcaaaaagattaagaattttttaatatgaaaaatatttgcagtgattttaaagtgcttttccagcaatgttcttagggactcctgagacacggttactttatctactggatcagtaaggcacacaattaacaattaacaattaatgtttatttacaaagtaaagggaaaacctgtgtaacatgagaatttggcatgacaaaatggagaccattttgtatctgctgttgtatcttgtccgggttgcagacgtgcactattaaagtcccaagttaatagagcacaaacccttctcgctcctcccccatgtgcccctctttttagatgtgtataacttaaactcgatggctcaggaaaattccactaattagaatcatgtacagtaccccaggtcgttgtccagatatacaagtttgctaatgtagttaagcctggattattaaacacttttcctaaattattgtaaacagaacagcttagagaaaggtattctcagtccttaatattgtatagtagtttatgagcccctctctaaatattggtatttttatattccagagatgtacccaatagaaaaaattaaaaattaatcagtatctaatttaatatccataagtatttttccttagattttagtcacgtacagtgggctatgtggatgtcacttgtgcttcaccatagtttaccactaggtgtcactgtggctctgcactgcgcttgttttgtagcaaagaacagcggcatcccctcgggagagaggagctgcttccagggcaacaggcaagcgggctcagaggttcaggagaaggcaacagaggcctggaaggggtcttcgtgcatctgtgccagttgtgcaagacgaactctttgaacactacatgctttggacttcagccaggcagaggctggaagaaggttgaccagagctcccttgctctggtagagggatgggtacatggagaagccccttcttccccatgagcctccctcctgtcagttcctctcagcctccagcttttataactccagaagcgtcacagttgggtggtttgattcagagagagttatttttctactgcagaaatgccttggacaaaaccagtgctcactgaatctttgccacaaaatggaataggctatcccagggggcaagaggtgcccgcccctgtgcccagcctcctcttgatgctcccagtgcccagcagcctcgcacaccctgcctgtctgttcctgggctgcccatttctcaagaaaccgacctgcaaaggcagccggctgctgcctccacaccgagggctgtgcggtcctgctgctcgctcactgggaggtgcagctctttctcctcttcctctaggaattccagaccgaccatctaccatgactaacaacaatgaacaaagggcttaggggcaagagctacctgcaaagacgtgtcatggaacccttcaccatgcaatgccttgaactcagctctggctgctcccaagaaaaggtggctggctgggggcctggacacaagcacaatggggctggtggagccactgtgcagagctacttgaataatcactgggttttcatcaactccttttgtcatacagaccactcaagggctgaagtgttggtaaccttcatttcggtgtccaaagcctcacagcaggtgagccaccctgagatgcttgtggccacatggtggccacagtcagagctttgaaagtcagtaccaaatgaacgcataattggacaccaaaaatcaagtgttactttcatgtttcctcaccccatcatctcattgcctcctgctgactctgataccgacgctgagctgacttgccaggctgccgctggacgcgtagagatcaggccagcgccgcgctcatttttccaggtagacctactctgtggaacggaagtgccctagctgctttgtttttgtagcacttgctggctgaatttttcttttgctaatcgctaaccagaaagtctggttagagggggctcaactcaatccctttggtccccagcgccagacaagagttaattctggaaaattcagtacttgaatgtacctgccttattgcataccaatttactggggggaaaaaaaaagttaagagatgccggctccagatctccacttcattcacaggtgattttggaaatcctgtaagttacacttcctgttctggttttgttttgttttttgtttcctttggctgattcctgctgagtgaggccagttcctcatcaggctcagggcaggtgccttttcaggcgtggcctcctttccatctagcacagcatctttgtctctgttctgtctcctccaaatccaagatgattttaattagtacagacatgtacagtctacaattaaagagtgatttgtactaatatgattttgattcttcctcctctttgctgtcctttcaagacacttgctggaaaaagctttaatgcacttagttttcctttaggttttctatgactcagatgtaaaggactttctctgtacagtatattatccaatgcatgtttgttctctctcctgatatattgaacaccacacagttgtgaagccgtgcagtggggatgccccacaccccacagaggcatctacccctgtgtataaggaaagacattttcctttgctgtacttgcttgagcagttttattgtctgtacatgtgagctgtgtgagatagatgtgaaaagttcaaatgaatgcattttcctgccccatgtatacagattgtcatctgtacaaggaactgtatgtatgaaagcaaatgtacttatttataaatggctaacacttgg

SEQ ID NO: 684 - DNA, 47240 bp, Homo sapiens
agtgaccgccctttgccactccccctgcctcctctccgcctttaacttctcgggaagatgaggcagtttggcatctgtggccgagttgctgttgccgggtgatagttggagcggagactgtgagtgccggctgcctcgacagcacgtttgcgacgctcggagtgaccttcgagcgactggggaccgggggcgggagtcgtgcatgcagcgttgtgtgacgaggcgccgcccgccgcggtcctgtgggaaaggagagagccagctgtcgggcgaacggggctggcggccgagtcgagcccacggagcccacgaggccgtgctcgggggtgggattgggggatccggacctagacggtcgtgcgcggggcgggggtgggctctggccctgactcctgcgcccggtgtgggaaggtgggaggccttttctaaggcaggtgttcacaccggccggaccggggcgttacccccacccggcttttcccacgcagctccttcgcgcggtcatttcttgactctctggaagaatccgccttctttatggccactgttcctttccatgtacacaccaggattagaccgtgattgtttgtctttggtgtctttttcttgagaaaccacctatgctttcttaaacttatagtccttgaagtttctggtactttggctggaagcgttaatgccctcttgaagccttacctttctaaatgtcagcctcacattgtgatcttagaattttatttcctcactctgcatatccactcctactcacctagagcttcaggttgagaaacttagtaacttccttattgtgtgtgaatttggcttcgcctcactaaccctgttccctgatgtactttagagtcacatgcagtgacaaacttagtcacaattagtttcgtcttcaccaaagggaaattgagtagaaattgcaaccaagattttggctaatagatttcacttattttagtgaaatatcattcaaaagtcgtctctaactgtctgactagaacactcccaaaaaagaattacctaaaaacattttgccagcataatttatttcattggggagttgatgaatgtcactggtgtgtcatcagtttgcatgtctatcatccactttagttggtgcttttctaactttatctccctctagtagcataatggcagaacctgtttctccactgaagcactttgtgctggctaagaaggcgattactgcaatctttgaccagttactggagtttgttactgaaggatcacattttgttgaaggttagttcttcttaagtttttaaagtaattactgttgaaaatatataaaagtgcttattctttcaacgttagttattgaacacatgtatagggcattatactgtatactatgagaagtaccataatgaataaaacccctttctaacctccagaaggggaaaattaaatggtattaataacaactaagaactttagtatattaatagctcatttaattttcatcaccactaggtgatgagaaatagctatgttaatagttcatttaattttcatcaccaccatctgtcattttaaagatgaagagacgaagtcaaagaaaagttaaacagtttgcccaagatcacacagctaataagtgcccagacaaaaaatcaggcagtccacatttaaccattatacttgtctcctccccaatttagcagttaagccaagacctcagacatatctcattctctcaaatgaggctgaattgcagtggaaagggggaaaaaggagtttcataactgttaaaggtgatgaggaatgtcatgtcttactagggaatacttcttttttttttttttgagacagagtcttgtcttgttgcccaggctggagtgcagtggcatgttcttggctcactgcagcctccacttcctgggttcaagcgattcttctgcctcagcctcccaagtaaatgggactacagtgcacgtgccaccatgcctgactaatttttgtgtttttagtagagacagggtttcaccatattggccaggctggtctcgaactcctgaccccatgatcacctctcttggcctcccaaagtgctgggattacaggtgtgagccaccacacccggccaggaatccttctttggagataactgttgaaattttttctggttcttaagattatgtacctctcggccaggcgccctgactcacacctgtaatcccagcactttgggagtccaagatcggcagattacctgaggttaggagttcaagaccagcctgatcaacatggtgaaaccctgtctgtactaaaaatacaaaaattagctgggcctggtggcagacgcctgtaatcctagctactcaggaggctcgaggagggagaatcgcttgaacctgggaggcagaggttgcagtgaaccgaagtcgcccactgcactccagcctgggtgacagagtgagactccatttcaaaaaaaaaaaaagattatgcacctctcaactatacaatggaaagggagggattctgtaaatttttccagcgacagtggggaaacctttggtagattgggaatcaaactttttttttcatgtctctcccaaccctctcttaccatattttgagctcctttagggcaggagcctgggattcattgtattcctagcaccagacttgacacaattcaatgctgaatgagaaaaaaaaaatagtagtatagaatctttgtttccaattaggaaataatttgagctggcacagttgactttttaaaaatatttttttttctaaaaataataggaagtgaaaatgaagttaaatgtgtattgtacgtgttatagatcatgcatcatgctaggcactagtgaaatgacagctttagaatctgaattcagttgtacaggttttagaacctcagtaaaaatgttgcaaaaaggagacaaagcaaataaatcaagaaaaacatacaagagcaaaaataaaatgaaaagcaaaaataaatgtaatgatacttaaaccagtctgtccgttattcaccaaattgcacatattttattaatgcgttagaaaagtatggtgagatatgagaagcttaattggatgtgcactggagaagttttaagtggcagtgtttgtctctaattagggtcattcagatagccagatgaatctttttgtttttgtttttgtttttttgagacgatgtctcactctgtcacccaggttggagtgcagtggcaccatctcggctcactgcaaactctgcctccggattcaagtgatttccagctaatttttgtacttttagtagagatggtgttttaccatattgttcaggctggtcatgaactcctgacctcaagggatctgcccacttcggcctcccaaagtgctaggattataggcgtgagcccccacgcccacatgaatcttcatgtctttaccttcaaaaagaggtgataagaatgtaaacatcaggttatctcctattcctgagttataaaaaaaactgaaagatttttctatttttcaaacccaggctttttcaactacctccagccatggaggagaggtgagggctgggatgtgcggttaaaccctaaacctgataagagtgaaagtgggatacaatctgatgagatcgagtgcattcagggtggtatggctgtagataggatacaacctgtaattctctttcttctctgtctttgtgttaagtgagctgtttcacctcatccctgggggaagcagatagaacgtggtaaagtagcaaggtctttcctagcttggagaccttgcactgtatcttaatttctgaggggctcctattcaaacctcacttttttctctcagtatgtggctcccccttctgagctcaagatctgaagatccattcagtcaggttggaacaataataggtcagtgttaggttctagtttctctctttagaaatgtattcttgtctcaagggtagcttgtatgtttgagacctagaagtccacttttgactgtgcccttgcaacttttaatattcttgaaattcttttgggcgggattcttgtgacccattgccacggagtatgcaccttttaccaaacattgagatgctgtgggtggcatgttaacataaagcaaaaatacatacaatcttaggtattccattatataactaacttaatattcatttatatcacttttctaatgccatttcaattttgcagcaacatataagaatccggaacttgatcgaatagccactgaagatgatctggtagaaatgcaaggatataaagacaagctttccatcattggtgaggtgctatctcggagacacatgaaggtggcattttttggcaggtaattatttattattacttctaagattagtttccaggaatcagctttgtgtctgatgtttcaacaagtaatatttctcccatcctcccccagccccgcaagtttctgcctgtgttgaatgttaaagctgttagcatgtgaaagaatttgtgcattttacctcctggtataaaatgaagctttatgaaagtcaatcatatttttaccttttaatgattctcatctctaagaattggcttgtagacagttttaagaatggaaatatagataaatgataagcatactttgtgttttactcttttaagtttacttgattatgtgaaagtttcagaagctaggatgaaatcacttttgtcatacctagacaggcctagaaggaaagaggctcttgtctgagataactatttccaaggactttctagaaattctttcaaatctcctgctttgataagacttatcaataaacatactttaggactgccttaattcagataaaatgttttcaggagagttcttgcccagtaatggcatctccgccaatgaactgacaataactggcgttgaacctctggaaccaaataactcttgtttctaggcagcttatgtaaatctctttttgctaatagaaacccctcttaccctcactgaatgcactggtatgccattccatgcattccagattataatctttatttttgattcccaagtaaactcagcattttttttttccccctgagagggagtctcactctgtctcccacgctggagtgcagtggcacaatctcggctcgctgcaacctccacatcccgggttcaagcgattctcctgcctcagcctccctagtagctggaattataggcgtgtgccaccatacctggctaatttttgtatttttagtagaggtggggtttcaccatattggccaggctagtcttgaactcctgacctcaggtgatccacccgccttggcctcccaaagtgttggaattacaggcgtgagccaccgcatccagcctaaatttttttttttttttttgagacagagtctcagtccgttgccaggttggagtgcagtggcaccatctcggctcactgcaacctccgcctcccgggttcaagcaattctcctgcctcagcctccctagtagctgggactacaggcgtgtgctgccacacctggctaattttttttttttttttttgtattttagtagagatggggtttcaccatgttgcccaggctggtctcgaactactgagcccaggcaatccgcccacctcgacctcccaaagtgctgggattacaggcgtgagccaccgcgcctggccccagcataatttttatatttttattagagatagggtttcaccatgttggccaggctggtctcaaactcctgacctcaagtgaaccactcacctcggcctcccaaagtgctgggattacaggcgtgagccactgtacctggctaatttagaggtgattttctttagtgtctttcttaagtttgacaattatctggattatggcggggagaaaaaggcagtgatcaggtacgtcttccaaaattttcaactccatcattcctagagggagagtaggaggcgtacattggtgtaacagtccagagtgatagggtgatctctgccacagcttatatgcaaagacaaatgactagctccataactggttattcagctatctgtgctgtgtaccaacagaggcatttatttactaaataacttcataggccttctaagctattttcccatcgtagggcttttgcccttgcaattccctttgcctacaactcacctttccttgttgtagctacgtctagtgccttctcattcttcatatttcatcctaaatgttactaccttggacaccttctctgaccaccctatctaaattattccttctcagttattttctgttaaagcatcctcttaatgtctttcaacacttttcacaaagctcttattttatgtttttattttctgcttctcccatttgaccatattctcagggccttacacagagtctggcatgagacagctccatttaaaaagatcctacttcagattagggtggagtaggaaggaagagcctcctgggaaggtgatgactcaactgtcctactgagaatgagaaataggtatagctttggatgtgaaaaaggtccaaaagctcatttcttgcagaaagccataaatagaaaggggtagggagaccacagtgtgtttggagaactcaagtagttgaatttaaggtgttacgaaacaatagcaaaagaagagactttgtaagcaaaagtcagattgtaaaagaccttgtattaatatatcatggtaaggcgttctgcattcttttattttggaaaatagtcctgagaggattggatgttacaattataaccttagatataatggggagaatgaattgaatgagaacaggggtaggaggcagttgtgataatgttaccagaaaggggccccactcctaaccccaagagagggttcttggaccttgcgcaagaaggaattccggatgggtccataaagtgaaagcaagtttattaagaaaataaaggaataaagaatggctgctgcataggcagatcagtcccgagaactgctgctttggtatttttatggttatttcttgattgtatgccaaacaaagggtggattattcatgagttttccaggtaacgggtaggcaattcccagaactgagggttggtacctgtcccccactttttctttttttgggagacagaatttcactcttgtcacccaggctggagcgcagtggcgtgatcttggctcactgcaacctctgcctcccggcttcaagcgattctcctgcctcagcctccctatagtagctgggattacaggagtgcaccaccacacccagctaatttttgtattatttgtagagatgggatttcaccatgttggccagcctggtctcgaactcctgacctcaggccatccacccacctcggcctcccaaagtgctgggattacaggtgtgagcccccgtgcccagctggtacctcccctttttagcccatatatgcatccattctggatgttgccatggcatctaaactgtatgtattatatacatataatatatatattacaatgagcagtgaggacgaccagaggtcactttcatcgccatcttggttttggtgggatttggccacttcttttatcagcaaggtctttgtgacctgtatattgtgccaacctcctatctcattctgtgacttaaaatgcctcatctcctgggaatgcagcccagtaggtctcatcctcattttaaccagcccctgttcaagatggagttgctctgcttcaaacacctctgacagtagtataggcaggaaattgtgtgtgtttaatacaactatatatattcaagtatagttaccaaaaaggcagttggaaatatgagacttggactagggagaattctaggaaatttaggaattattggcttatgttggtgattgagatcacaggagttgatgagatgatccagggagagtgtgtaatgaaaaacaatgacagcactggggagaggaagagggactatccatggaaatgccagccaggggccaggcgtggtggctcacacctataatcccagcactttgggaggccgaggcaggtggatcacctgaggtcaggagtttgagaccaggctggccaacatggtgaatccctgtctctaccaaaaatagaaaaattaactgggtgtggtggtgcactcctgtaatcccagctacttgggaggccttggcaggagaatcacttgaactcaggaggtgcaggttgcagtgagcttacatcgcaccactgcactccagcctgggccacagaaggagactccatctcaaacaagaaaaaaaaatgccagccaggtaaaaggaaaattagaaagcattggtatggtataaaaagaaatatatttgatctttgtcccattcttgtcacagagcttctaaaaccataggaattccctgagtgattggagtatcttgttttcataatgagccctttttaatgacaactgaatttatgctaatgagtggtttagggtggggtgcctagataacctcagagggtgaccagtcacctgaaaggttaagtgatcaggggattagaggactggaactttccttcccacccacccatttccaggaagggtgggggaggacaggctgaaaattaggctttatgaaaactcttgaacatgattggacttccaggtaactaaactcatggttacgctgggagagtggcatgctgagagggcatgaatgctcaggcatctcatctgtgtcacttacaatatcctttataatgaaccagtaaatgtaagtatagtgcttccctgagttctgtgagctattctgacattgaaccaagatgggaagaggtagaaatgaatgataggacacccagttggtgtttgctggagaaccacttcatgcatgtggaaaaatccccatatatctagttatgaagtgttctgtgttgattttgatagtagaggagaaaaagtttctatttccacagttgttttttttgttcgttttgggaaggcagggtgacagtgtgtctcactttagtatgcataagaatcatcccaagagcatccccagagtcttgattctttaggttcacagttcacttgaggaatctgcatcattaatgggctccccagatgattcttatatggggtggagggacccaaactgtaactataggaggtccatcacccaatgtatgcagcaagttgatatgctgagacaccaggttgcagcagagaagaggtttaatcgtagggtcaccaaatgaggagatgggggggaaccttaatccatctccccaaggaatttgaggttagggtttttaaggtttttggagtacccaaagtgtagaggtcgttgattggttgcaacttgcagagtgaagtcatgggacagggagataataaggctaggctgtattcgcatgctgatccatatcattcctctgtggggggtcttcaaactggttgctggatctgggggcccaaaaaacatcttaagctatccttaaaagtgttacgattctaatgtcagagctcctgtctatagaaagaatgggggtgcaaatggtcagtatctggtgttacatgacatttagcaacaaggaagtgggccaaagtgcagcctgattattaatgagctacagccatatttctgtccagaccccggcatgtaattcttgttaaccctatggggatggtttcagaactactcttgaggatcactgcaaggcttcatgaaatgtccagaaagataaatcttaagagagatcctaggcatccttgcaggatgtggtatattggcaatagaagccaatgttgagctaatgaaggcaagaaggttccctgggaagggagttgggaatgatatccataacataaagaaaagttctttccctcttatgctaaaggaaagaggtaaaacatatgccgaaaagataggatgcttttgcagtgaaccaaaaggctcccagtgatatctgggacttgggttgacttaatggaaagcaagtccctgaagtgagtgtgagttctttgcatttcagagccatcaaaagtgtcctttttcctatgactgcataacagattacccaaaacttagcaacttaacagccattttattatgttcactgattctgtgagtcaagaatacagatagggcacagcggggatgtcttgtctttgctccatggactctggagccttaactgagaagatgtgaagattggggtggctcaacaactgatggttgaaatgatcttaaatcttcactcacatgtctgggacctgggctggaatgattcaaagactaggactgttgagtagagcactactcagagctctccatttagcttgacttccttgcagcacagcagactcggggtaagtggactttttacatggcaaggctccaagtgcatatattccagggaacaagatagaagaacctgcattgtcttttatgacctagtcttggaagtcacccagtgtcactcattttgttttttttttttttttttgagactcagtctggctctgtcgcccaggctggagtgcagtggcgcgatcttggctcactgcaacctccacctcctgggtgcaagcgattcttctgcctcagtctcctgagtagctgggattacaggggcccccccaccacacctggctaattttttgtatttttagtagagatggggtttcaccatgttggtcaggctggtcccgaactcctgacctcaagtgatccacccaccttggcttcccaaagtgctgggattacaggcgtgagccactgcgcctggccacccactgtcacttctgatgtgcattatttgttgaagcagtcacaaaccagcccagatttaaggagatgggatattagaccccatcttgtgataggagtagtgttgcagaattttgacctgtgatttcgaattgccacaaaaagcaagaaagaaaagttgaggatactactgtgagaaaggtgggatttgtcttcttgcactttattttttctgaaatgtacattgctagtatttgtgtaagccaagtggttaatcttttcataaaaatgcagtcttaagaaatcttaacaaaatttggattttaaaaaagttgatattagacccagtgaaagaactactttttttactgttatgttttgtttttcatgattttgtatattcttcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaaggtatgatctttaacctttagcagaataatatacctgaaacaatgtcctgaacttattctttaataacatttttataagatgtctgcatcgctgacatcttataaaaagaactgttaatatttttctttttttttttagacggaatttcgctcttgtcgcccaggctggagtgcaatggcacaatctcggctcaccgcaacctctgcctcccgggttcaagcgattctcctgcctcagcctcccaagtagctgggactacaggcgtgcgccaccacacccggctaatttttgtatttttagtagagatgggggtttcaccatcttggccaggctggtctcaaactcctgacctcatgatccacccacctcggcctcccaaagtgctgggattataggcgtgagccactgcacccggcctttttttttttttttttttgacactgagtctcactctgtcacccgggctagagtacagtggcgtgatcttggctcgctgcaacctctgcctcttgggttcaaatgattctcctgcctcagcctcctgagtagctgggattacaggtgcgcaccatcatgcccagctaattttcgtactttttttttttttttttttttttattagagacagggtttcaccatgttggccaggctggtcttgaactcttgacctcaggtgatccatccgcctcagcctcccaaagtgctaggattataggcatgcgccaccacacccggccaaaaagcactgttaatatttctaactttgaaagccatcactaagtattttgagtactctaaatttttttttcacttcataactaaattagtgaaaaaataaaacttgtccttaatttaaaggtatattagaattaacaagttttttaaatctacccttccagtgagactaacattattttagttatttatttgtttttagatggaatcttgctctgttgcccaggctggagtgcaatggcacgatattggctagcaacctccacctcctgggctcaagtgattctcctccctcagcctcccgagtagctgggattacaggcatgcaccaccacacctgcctaatttttgtaattttagtagagactgggtttcaccatattgcccaggctggtcttgaactcctgacctcaggtgatccacctgccttggcctcccaaagtgctgagattacaggcgtgaaccaccacgcccggctgagactaacattattgaagtgtatcattgctgtttaatcgtgtatcattgctgtttaatctcaaatttgtcccaccttggcctcccaaagtgttgtggttacagacttgtgccaccatgcctggcctccgatttgtctttttgaaacagaattgcttaagaaattgggccctggcatctgtttttgatatgtatctgtgtttttagaaactgtcttacctcaggattatgtagtaagtatatttatgaataaatattttaactttatcagatgagggccaatggcaattccctacctttcataaatttctcaattcagtgccactccttcagccaaaaaaaaaaaaaaataaaaggaaaaacaaattaggatgcaaaatgttgactctggactgaaagcagttagttaaggcactgtttctcattgtggttactttctcttgagtctaaagatctcttccacaaacacaaaagttcagtgcttgatgatccatgctattttatttcttggtaaagtcatgggtggttcttctttgtgaatttgctctttgatgtaaatcaggtaactcaatctgtaagttttagaataagcatacccttcagattagttattagaaaaatgagatgatgtttatgaaaatactattcaaggccgggcacagtggctcacgcttgcaatcctagcacttgagctggtcggattgcttgagaccagcctgagcaatatagtgagaccccatctctacaaaaaatacaaaaattagccaagcatagtggcgcatacctgtagtcccagctacccgagtggctgaggtgggaggattggttgaatctgggaggttgaggcttcagtgagccgtgatcactcagcctgggaaatggagcaagacactgtctcgaaaagaaaagaaaatactaatcaagcttttaattcatataaatgaaggaatcactgttgttttgtgattaagatttttagcaaatcaaaattcaaacttctcgtgacttcagagtctcaaagtatgctgttattttaaagaaatcatctctcattttcctgatccatgctcttccagtcctcttcacactcttttcctcctccttattttagattcaggggttggttacatgtacaggtttatcacatggatgcattgtgtgatggataggtctgggcttcaactgagcccgtcacccaaatagtgaatgtagcattcagtagtttttcagctcttgtcaccttccacctttacccctgtagtagctcccagtgtttattgttcccatctttatttctgtgtgtacccaaatgtttatctctcactttttttttttttttggagacagagtcttgctctgttgcccaggctggggtgcagtggcgtgatcttggctcactgcaaccttcacctcctgggttcaagcaattctcctgtctccgcctcccgagtagctgaaattagaggcacgtgccaccatgcccagctaatttttgtattttttgtagagacagggtttcatgatgttgtccaggctggtctcaaaactcctgacctcagttgatccacctgcctcggcctcccaaagtgctggaattactggcatgagccaccgcccccggcctagctctcacttttaagcaagaagatgcagtatttggttttctgtttctgcattaattgacttaggataatggcctccagctccatccatgttcctgcaaaagacttgatttcattcctttctatggggtgttaaaagctatgtaattttaacctgttttaataatgacatttcttctaatgacatttcttccatatgactaagtgatacacatttatttcagtagaatcagaaaatacaaataggcaaaaagaacagagactccagaacttatatacttcacaaaatcagtatcaggagttgcttagaattctgttgctggagttctttttgagggaaccattttttttctacttggaaatttaaaaattcaggttctcaagattgctcagaaggttttatttcagagttttaccttttatatacctgttttgctaaaataaatgtaccacaatgtttttaatttttattgaattttattacaagtggagtttatttttttcttttcctcctgctttagacagttaatcaactggcccatgcccttcacatggacaaagatttgaaagctggctgtcttgtacgtgtgttttggccaaaagcaaaatgtgccctcttgagagatgacctggtgttagtagacaggtaaaattacatgtggattgcattttctctggaagtttatttaatagtataatactgcttactttagcatatggtataaaaaattacaacattcagttgccattttgttctcattagctagattaaggaagagatatggtattggttttattttataagttacataaaagcaccaattcatcactctgattccatttcaagaaattttaaggatggccactttttttggccagagtgcagtgccgcagtgccacgatcttggctcactgcaaccttcgcctgccgggtacaagtgattctcccacctcagtctcctgggtagctgggattacagacacacaccagccacctcacctggctccattttgtttttgataatggattttccttttaaatggaaatgagtgtttcaagtaatccatagaaacagaggagagagaagatgttcatgacaccaagatatttggtttaaatacaatgttaactagtttagctttatttcatagccagattgtatctatgacccagtcagtcaagattgacagttggatagatacaagaaaatatgaatgagatctagtatttggtaccaaaatgggtaacggtagtgaaaaataattgatttttatttatttttttgagacagagtctcactctgtcacctaggctggagtacagtggcgcagtgtcagcttgctgcaacctccccctccggggttcaagccattcttgtgcctcagcctcctgagtagccaccacgcctggctaatctttgtattttttggtagagacggggattcaccatgttggccaggctggtctcaaactcctggcttcaagtaatccccccatctcagcctcccaaagtgctgaaatgacaggtgtgagctgccgtacctggctgaataacaatttaattgtacatttaaaaataactaaaagaatataattgtattgtttgtaatacaaagaataaatgcttgaggtgatagatacctcgtttaccacgtgatttttttttttttcggaggcagggtcttgctgtgttgcccagtctggagtgcagtggtgggatcatggcttattgcaaactccgcttcccagtcttaagcaacccttccacctcagccaccagagtagctggggctacaggggcatgccaccaagcctagctaattttttttttgtgtatgtggagtcagggttttgtcatgttgctcaggctggtctcaaagtcctggactcaaactcccgccttggcatcccaaaatgctaggattataggaatatgccactgcactcagcccctgatgtgattattacacattgtatgcttgtatcaaaatacttcatatacctcataaatatgtatacttaattaatatatacccataaaaattttaaatgaataaattttttaactttttacaaatatttattgttggcaaattcttcactgcagctcctagtacagttggtatattaaatttatatttttttatttgtgtttataagtgcttaaatcatctctgagccatactggatatagctgcttgaaccctcattgtttagtatctattagcctagttttatatttcagccatctaaagcataaacattaaaaagattgaaatattgagcatgttatttgctttgtcaaagatcactaagttaaaatttcctagacttcttacagatgacagctggaaatcctggtttttaaacttcaaattatatataaaagctgaaaaaattctgtaacccaaattttctttttaagaaatataatacaatttttatttcactctcattagtccaggcacagatgtcactacagagctggatagctggattgataagttttgcctagatgctgatgtctttgttttggtcgcaaactctgaatcaacactaatgaatacggtaggatttaatcatattattgtgtttcgatggtaggaaatgaaatggtatctgttttaattctgaaaagcaagggaaatccatatcgtggattagaaaaaacttctaaaaacaggcatgaatgaaggggtttgtgttttcatagaaccagaagggctgtttctagtctttctatagtgtgtagttccctggatttctctagcagtatagggcttgatggttctagcttctggttatttgtcagtctcagggaaaatgagtgccagaaattttaggatgcttatttaagtctcttgaataaagtataaaccactccttccttctgccatctatcaggcaaggctttttatattttcagtattgtcagctatttccagcttcaccagaatatactccaggtttcagcttaactgtgtacactttaagctgctgtcagacttagaagattatttagccagatgtctggagccagactcatctgaaataaactttccagagtttaggtaatctaatattcaaaattataacatgattttttaaagttatcagtttttttcatctttgaaagtttaatgctcatagagtgctttgggatcctttgtcagtggtgttaattactgtttaaatggttcagactttctcattaaaataaaatttcaattataaatgtaaattatagtgaatgtactgtggggttttttttgtttttcaggaaaaacacttttttcacaaggtgaatgagcggctttccaagcctaatattttcattctcaataatcgttgggatgcctctgcatcagagccagaatatatggaagacgtaagttgttatttttttttttgtaggttttgaaatacagtcacatacattgttatttgagaaaacaatattgcttatagaatagaaaattataagagctattccatgaaaagaagatagttagagaaaacctgaagtaggtatgtgataaagaccaaagtctgaagttactttgagggaaaattgtgttatactatctagttatttcaaagcttgaaagttcttttttgtttaagttgttattgaaatgtacataacagaaaagtacataaatcgtaagtgatccttccagtttggcttcctaaagtgctgggatgacaggcctgagccaccatgcctggccaaattttacaaatttaacacacctgtttcaaaatccagatcaaaaagcagaccattctgaacaccccagaaccttcctcttacctacctccttctaacttcccttctgtcctacttcccaaggagaaattatccatttatcatgacttctgaccccctaaattaatctttctggttgttcaactttatataacagaattatataatacctgctcttgcatctgtttttgtttttatttaacgtgtttgtcatatgtgtccatattattgtgcgtagcatagttgtattgcattcccattgctgtatagtattccatctgtgactatactacaattgatttattcacagtgatgggcatttgggttaatttactgtattcagttatgaatgctactgtgcatatgcttgtatatgtccttctggtatgcatatgtatgcatttttgttaggtagttctcagtgtggaggatggacagttttgacctcaatgggatatttggcagcatctgaagatactttttttttgttacaattggggttttgtgctactggcatctaatgagtagaggttagagatgctgttacacatgctctgacacagaacaggcccccaagcaaacactggccaatccaaaacgtcagtaatgcagacgtcagtaaaccatgggtatatgtacttagaggtaaaactgctagattacaagttaagaatatgttcgattttagtaaatatatagcaccagagttctccaaagtgcttggtgtcgatttatactcctgccagcagattgagtttcataagatttgcatcctcaacttttttttttttttggcattttagtcacaccaattgtagaaacttaaaaagaagtatctggaatttgaactataaataatatttatttaatttgcttgagactatttctgattttaatagtagtacgagattattatatgtagaggacaagataaaaataacttaaactatcccatcactgttcacatgataaaattatttgctttcatttttccccaattggaattttgcataacatcatgttttatatcctcctgtcattaactgttgtcttacagtcttgctctttcaaattggggtctcagaattaggaagcatcactcataaattatttttccttaaatatttcagcattcctatttagatttatttttgcaagtcttaatatagagatctctcatcatagccataatactaaagactagtactaaatcctaacttctaacccttaatcttcacttcagtgcccaagtggtaatcttgaacccaacattgcaattctaatgcctggttaatgcattctacccaaccttaactccccaaccttaactttgttttttgagacggagtcttgctctgtcacccaggctggagtacaggggcacgatcttggctcactgcagcctccacctcctgggctcaagcgactctcctgcctcagcctgcccagtagctgggattaccggcacctgccaccacacccagctaatttttgtgtttttaataaagacgaggtttcaccatgttgtccaggctgttctcaaactcctgacctcgtgatctgcccgccttggcctcccaaagtgctgggattgcaggcgtgagccactgtgcccagcagaattttaaatagatgttcaaaagacagaatcgttaagagaaagatttcctgtcatcaagtatcaaacttcatttattagaatttcttaaattcattagttatatggtaacttttattatatcactgtgaataaagtaagtattggtctatagtcgttggttattatatttgtttaaattattagaattcttttaataccgttttctctgtaggtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtatgcattacctatagatttcctgtttaaatataaaaatatttaaaattggctgggtgcggtggctcacgcctgtaatcccagcactttggaaggctgaggcgggcggatcatgaggtcaggagtttgagaccagcctggccaacatggtgaaaccccatctctactaaaaatacaaaaattagctgggcatggtggtgcacacctgtaatcccagcttcttggggggctgaggccagaaaattgcttgaacccaggaggcggaggttgcagcgagccaagattgcgccattgcactccagctctgggcaacagagcaagactctgtctcgggggaaaaagtatatatatatatatatatttaaaattataaaatcagtagcctaccagaaaacatatcttgctacatactaggtttttaaatctttgcctgtacgttacaggtgtggcacttgctgaaggatttcatgcaagattacaggaatttcagaattttgaacaaatctttgaggtaggaattttgtgattgtattgcctaatacaaaactctttctttggttggagaaagcataatcttctatttttatcctttgtctttgtcaataacttttgctgttatttagtttagttactgacacagccagtaaaatgtggaaagtgaagaaaaggagcccctgcaaaatgatttgtaagaattgagaattaaagattgtaatttattccttattcttatttttatgtattttatataaataagaaactgtgtttcaatattgctgtgttgtgcaatgaatgaaattccctgtattcaataatttggaacaagagtaaacaagcgtaattgctgttggaatggataatagagcaaagtaagcattatccttttttactttgtgccgcatgactaatagaagtatacaaaacatgattaatgccatttgacaaaattttattatatttatatactgtgttaccacatgtccattctccatattttgtgccaaacattctaaatgaataattgagtagaaaagagcttcagcgttttcagaaacttctaggaaactattgaagtgcctgagtggtagatggggagggaggctagtttcttatgttgcattgtaagtgtttttattcagagacattaaaactcaccctacatttgactgaatagttctttagatattaaccttctgaacccctattttgccctgtataattcatatcaccttcccacttaggaatgaacacagtgacttcagcattgaagaaacctcagtctgtaattattcttataagtagtaactgctttaatgtaaaggggacatgaatgttgagtatacttggcaggatttttaaaataaaaaatgtgcttactatctctcatctttaatttggtgagagaaaaaaggttattagacagatgaagacaaactggaagaaagcaaatccactgccagctatctcgataagatctaattgttcagaggctactggattatcagtagatgtcctctcaagccaagctataggatacgtgaagtccccgttactcaaagactattgtttgttttttttcttttccttttgctttcaccaaagggttgatgctctcctcacctcttttttctcttaaagaaatgggatctccctctgttatccaggctggagtgcagttgggcaatcatagcgcattgcagcctcgaactcctgggctcaaatgatcctcccacctcagcctcctctcctcactgttatcagttatttcatccatggggaaaatatgtagggagaggatctattctacttccttgtctttatttactgaccttagtatatatgtgttttatgtatgtttatcattgatttcttctaaattatacatttatataatgtataattgtgtaatgttctgttacacatttatactgcttccatattggttcatggtatagcttgtgcttcccaagaatatctcgttgaggaggtgggaatgagaagaataagatatgctgtagggaattggttcataagcctagctgatcatcagaatcacatgacgtgctttagagaaccacaggctcctgacctatcctatccccaaccccagatccagggggttggggttggtctaggaatctatatacatatatattcaaagttccccaagtgattgcaataatcagacagacttaggaactattctttttaaatgtttttagaggaaacttggcagtttatgttttattctaatggtccatttgggattctaaaatttatgtatggaaaaaattgcttatgagcagtagctttttgtttttacttaaagtcatggaatgtccagctttagagtttgaaaattttaagtctgaaatatctaaaatgagaatcagttaaaaattatttgaatttttccaaacaatcagctgggcaaaaaatattatgtctgaatgtattaaaaagagacaaaacattttttgttaattaattacattgaaagttttagtcagctttattccaaaactggtatttgttacttcttaagtcagttttggtaatttctgatttcttagaaattggtgtatttctgaacatttataatttagtagcataaaattgtttgttttgaatctcttgtttctcacttctatatttaaatataaatatatatctacatatacatacacacacagacccttaatgggtttgccaatgatttatcatccaaagacacagccccagctcttatgtaatttatcacttaataaatatcatttttggggtttcattcactaagttctttttttttttttttttttttttgagacagagtctcgctctgtcgccgccaggctggaatgagggagtgagtgcagcggcgcgatgtcagctcactacaacctccggctcctgggttcaagggactcttctgcctcagcttccctagtagctgggactacaggggcacaccactacatccggctaatttttgtatttttagtagagacggggttacacagtgttggccaggatggtctcgatctcctgacctcatgatccacccgccttggcctcccaaagtgctgggactacaggcgtgagccaccgtgcctggcctgtgttcgtctttaacattgtttacgttgaagatgcattggtttttgcttattcttaaagaaaagattcaggattgtgaatttgtgactgcagctttaggcgtatcccaaggttttcagtactagtttagtttttgttgtttttgtttctaattatccttttggcatttccttatcaatataagactttttaaaattcaagtgttttgattcattttatccaatttttggttactaatttcttggtttctttgtgttgtggtcacatcatgtggcttttacacacattttctctgttttggggatttgcttacttttttttgtagtcgtgcaagattttttgtgaaaagaaaaactgtatcaagttcatcacctttatcaatttgacctgtgccgtgaacttctttagattcatttgattcaaatggatctaagtattttaaacatttagaatactaatttaagcaaggcttgaaaattaaatggagtaaaagcaataaaaaaaatcaatattagcctgggcattggtggctcatgccagtaatgccagtactttgggatgccaaagcaggaagatctcttgagcttaggagattgagatcaggttgggcaaaaacatgaaaagactaaatcacatctctagcaggaaaaaaaaaaatccagatatgatagctcatgactatagtcacagctaccccagaggctgaggtagaaggccaagaagtttgaggctgtggtgatggtgagctatggaggtaccactgtgctccaacctgtgtgacagagtgagactctcttttctttcaaaaaaaaggaagaaaggaaaatcaatgttagtctgtcaatacattttcttattgttttaaaactgtatttggaaagtttcaaaatgcatttggactgcattgttctaaaggcaagttagaaatccaaatatcttttgcacagttatttcaccattaattcttactagttttggttgtatgatgggagatagacgtataaaaataacttatttaaaatgtcagtggatttttttgtaatggacattcctggatgataggtgaaatttgaacatgaactgtttgttagataatagtattgtctcaatggtaaatattctgaatacaattgttttgtgattgtgcaaatgttttctttcttagaagacaagtattgatgtgttaggtaacaagcttgtgatgtagtaatgacctgtcaaaatgttcaggaaggaaaataatacataagtatatataaaaatatatgcctctctttatatatatgggggtcatacattttatatattcattgcaagacatgtattatatatattatatatatttattatatattatatattatataatacatatataaatattatatataatgttatatataaatattatatatatatgccctcacacaggagagagagtatcgagcgcgagtatggagggaggggagaagtaaacaaaaggggctgaatgttaatatttgatatatctagatgaaaggtctatttcttgcactttctattgaaagtatatcaaaataagttggcagtgatgagtagcatgttaggtgtttgtagggtctgttttcaagggaaattgacaagtttgttggttttatgttttaattacatatataaatttatattattaatgtatgattagagttcctgataaaataaatctgggaactgctgcatattatatatgttccccatagagattaattagcatattagtgtagtaaggatgctgagaaataacttagaaggggaactttatttaaattaacacttcccatacttatttggagtaaaatgttcttttttcaaggtacctcttaaatatcctacagatcagtgggaacaccaatgtgggattactttttaattgattattttcttctctatacttactcatcattatatatttttgaatcagacagtaacttatattgcctaataacttttggagatcttttctgtctcgtctagctctaacactgtgctgttatctacaaatttggatcttcattgctgatatctagatctgcttcatcgaggaatatagactttattttaatctttttccttttaaaaatatttttgtttttataattttgcagaagttaatttgacacatttatgaggcatttatttaaaataaagtcaatgcattattttagttattaaaaaataagtagtttacaaatgttcactattatgtaattattggtgattttaaagaagaaaacatccgggtatgttttatctttaggtgtgtacagaacaggaatgctataacttcctacattaattttttcaaaatcagtgaaaataagtgatgcataaatgagcttcaccatgggaaaaaatgaagctaggcaatgcaagaaagtaatggcttcagagttaaatattgactaaattaattaccctcatgtgctctatagctaaataatctgttttgttttctctacctcaaacgaaatgctgaagaggggagctaaaatggcagtagagattatagtctttctgagtgctcaaataatttcagagacatgaaggctaagcataggtcgtaaataggacattgaatgcacgtgtagcatcctgatgatttcaggataagaaatgtagcactagagtattaagtaaatgccttttgaagcctaaaagccatttattaaaggaaggatagtaatgaacttcaggaagcaattaccacaatttgtattagctaaatatatagaggttcgagaagatgaattcattggagtatcagagaattaatatatccctaatttttaaaaaatttatcatagaaaataaacatgtctcttataaaacatctatagtacttactgtgctatatttcagtgcagaatttgactttctgtgaagtaaaaatgaaataagacaaattgtaatataaaaattttataaatttttatttatttattttttgagacagagtctcgctctgtcgcccaggctggagtgcagtggcgctatctcagctcactgcaagctccaccttccgggttctcgccattctcctgcctcagcctcccgagtagctgggactacaagcgcgtgccaccatacccagctaattttttgtatttttagtagagatggggtttcaccatgttagcctggatggtctcaatctcctgacctcgtgatctgcccgcctcggcctcacaaagtgctgggattacaggagtgagccaccacgcccggcccaattttataaattttaaatgataaatcatagtaaatatatatttataggatgggcgtggtggctcactcttgtaatcctagcactttgtgagactgagacaggcagatgacttgaggtcaggagttgaagaccggcctggccaacactgcaaaaccctaactctactaaaaatgtaaaaattagccaggcatagtggtgcatgcctgtaattacagctacttgggaggctaaagtaggagaatcacttgaacctaggcggtggaggttgcagtgagtcgagatcatgccattgcactccagccttggtgacagtgcaagactgtcaaaaatatatatataacatatataacatatatatgtaatatatatataacatatataacatatatatgtaatatatatataacatatataacatatatatgtaatatatatatataagataacaagtattctatatattgaaaattgaaacaaatgtgaaatgtatccattgataaatgtgatgcattgtgacgtattttttatttaaataaacactggttataaaacactgatttataacaactattttaaatgggttgttagcttgaagataaatgagatagggcatgattcaggtttctgtgtacacactatattctaatgaaagtaattacaattatcttctaaacagctgcagatattttttctataaacaattttagatgttacattgttaaatgttagctttcaaattcttcacattttaactcaatgaagtcctttttagcaaacttacaggaatcattgtatcattcagctattaaataaggaattgttctaattcacatcttaattaagaactttactaggttatatcttttgcaagtatgagaataatctagatagaaggactagaattggattaaaggtgatccagataaaaatagtaattctaatgaggaaattttttaacattgaaaatagtaccctgtttattttttttaatgttagagtcaaaccattgcacattactgtgtaaaaatacacaaagatggtaacttgctgctaaagccctttttacttttgaatctttgtatttttttcacctttgtaattttaagttgtgcttttatcactcatttgttttctatctttatttctgtttgggttaaagttacaaacagcaagtttttgtgtttaaattcctgaaaatgttgcgatggaattacagtaatgtgttacggcttgggcccctcgcaggagtgtatctcgcagtcagcagtgaaaacaaagttcgaacagcacactatcagagctaaacagatactagctactgtgaaaaacataatggattcagtaaacctggcagctgaagataaaaggtatgagttcattttgttgcaacataaaaatgttagtttttttgtcagacttttgttaagatgaggttttaaattgttgtactataaatactttttacactgaaatcaaccttgtgggtttaactgatgcctacttctatatttttaagtgcgtatttgaaagtgtcgatatttattctgcaaccttgcacacatcatttatatcccctggacctcactattcctgtgtatgaattgtgatttttaaaatgttttgtggctttaaaatatctttgaagcagtggaagaaccatttcttcaagcagatttttatgaagaagtccaaaacaggtgatcctctttctgcattcaacccacgacccattttttaatatggtcatacattggtattttgaaatcactattttatactagttgtgtttgtttattgcctggtgaacaaacaaggcgatgctacctgccaaccagaaagttgatttggtaagcagtaccctttatgttatactgtacggcattattttatactatttgttaccttgtaaaggtggcaatgaatacatgaaaataccagcattatcgatacaaagtataattttcacaaacttggtatgcttgaaacacagatcgggatgttattagatgtgacaaaagtaatgatgttaagcctcgataggaccttcagtggacttaagccagttgaaggaaacataaacgcatcaaagcttaagtccaagatgacataacattggaattttaaatgtatttgctctttcagggaacaaagaccccttcatgtccctgtctgttgctttataatggtactttcttaggaatgaattaagttcaaatgcagagaattgccagcatataaaacgcaaggatcagaaccctgagtttgaactcagcccctgtgtacagcctccgtgtggcctctgtttaattagatcgtgctgctatagcagttccttctagctcagttgctttgatgtagtacccaaattttggcctaaaagtgatttaattagtaataatttttaaagatataggatgttgaacaaagtatagcacaaagaagatgtgatttgaggattgtataatcataatgtcctgggaacttcttaagtaaaagatcttcttaaatggatctcaggtctttattttcctgtatcagccagagttgaacaaacttttgtttaaaaaaagagccagatagtaaatattctaggctttatgggccataaagtctcttggagctactcatttctacagttttagagcaaaagcagccatagatagataataggtaaatgaatgggtgtggctgtgtttcaagaaaactttaacaaaagctggcagctggctagatttggcttgtaaggtgctatatgctgacccctgcttattaactaaagtcagtattgcattctgttttgcctgttcatatctatgaagacttagaattcttattcatcctttctgggattcaggtgccacatgggcagagaaacgtggtttctatcaaatcatctatataaaatactttataagtgaaatattacttgaatcctttgagatgttacaagttttttttttccttgagtcatgctaatagatggttcaatacatgaatgagtcccttgctgaaatgctttaggacttcagactaccctgaacgttgattactctttatactgaaataggcattattcagtggaagagagggaagaccaaattgatagactggactttattcgaaaccagatgaaccttttaacactggatgttaagaaaaaaatcaaggaggttaccgaggaggtggcaaacaaagtgggtaacagtagcttcatgattaaaataacctggatggaaattatttttgataatgctaaaaatgttattcctgttactttaaaagaatgttttcagatttttcaatttaatttttttgaataattgataatcttgtttaattattttaactccaaaattttcatattttcaggtttcatgtgcaatgacagatgaaatttgtcgactgtctgttttggttgatgaattttgttcagagtttcatcctaatccagatgtattaaaaatatataaaagtgtaagttaaagtatagataaaattattcagagacagtttcttattattctataccctcatttatttcatggtttggcatttcagtgtatcagtacaaaatgaaactgttagatctcttgtgccctcttgtaataaatgtaaactgtcttgtataaaaagtaaatagaaaatttatacttagaatgagataaagatcattttaggacgaggcacagtggctcatgcctgtaatctcaacactttgggaggccgaggtgggaggatcagttgggccccagagttcgagaccagcctgggcaacacagtgagaactctaatctacaaaaaacagttaggctggttgcggtggctcccgcctttaatcccagcactttgggaggctgaggcggacggatcacgaggtcaggagttcgagaccagcctgaccaacatggtgaaaccctgtctactaaaaatacaaaaaaaaaattagccggtggcaggcgcctgtaataccagctactctggaggctgaggcgggagaatcgcttgaaaccggaaggcagaagtggcagtgagccaagatcacaccactgcactccaacctgggcaacaagagcaaaactctatctcaaaaaaaataaaaaatagccaagcatggcgacacgcttctatagtcccagttactcaggagtctgaggcaggaggatcgcgtgagcctaggaggtcaaggctacagtgagtcaagatcaaagcactccagcctaggcaacaaagcaagaccctgtctcaaaaaaaaaaaaaaagtcaaattaaaaagaccattttggcatttactgaatattttatgtctttataaaaactacatactttctggagaaaaaataatatggatatttaccattgttaacaggaattaaataagcacatagaggatggtatgggaagaaatttggctgatcgatgcaccgatgaagtaaacgccttagtgcttcagacccagcaagaaattattggtaatatttatgtctacaaggtcatgtctggtttgttttttcattcatgactggtgaagagcttattttcctttaggcattccattgaaggtaaaacatttaccattcttatcttaagtgttgtaattttgttctttctagaaaatttgaagccattacttccagctggtatacaggataaactacatacactgatcccttgcaagaaatttgatctcagttataatctaaattaccacaagttatgttcagattttcaagaggatattgtatttcctttttccctgggctggtcttcccttgtacatcgatttttgggccctagaaatgctcaaagggtgctcctaggattatcagagcctatctttcaggtatgtatctttgaatctaccaattaagactctcctttattattttgtttatgtggtttttctataataaaactagctttacaaaatctgcacatttaaaagctagtatctatctcttagagccatttctgaggtagatatttagtttgagcatctccaatctgaaaatccttaaaggtccaaaatgaaaaactttttgagtacggtgacaccacaggtggaaaattccacaccagacctcaatgaggtcatagtaaaaacgcaggcacacaacacacagtttattcagtgtcctcaagggaaaaaagactcagcctcttctagctgcaatatatcttttccacgtatgcccaaattcccccacacaagcacacctatgaagggtactaaaatggcacatgtgcaggtccagtgcaccaacagcattttccccatgatgccccacaaggggccaagacctttgtgcattacccagtatgggcttctttacttcctgtcttttctctggtgtaaagatactgtttaaaaaaaatttttttttgagtggggatgcgtttgagacagagacctgcgctgtggctcaggctggagtgcagtggtgcaatcttggctcactgcaacctccacctcccgggttcatgcgattctcctgcctcagcctcctgagcagctgggattatacgcacccaccaccacacccagctaatttttgtatttttagtagacatggggtttcaccgtgttggccagactggtctcgaactcctgacctcaagtgatccacctgcctcagcctcccaaagtgttgggattacaggcgtgagccacagcacccaggctgtttaaaatgtttaaaaggcctacagatacccttgtgggtgacattgataagaaaaagaagaggcatttatttttatttataacacataaatttaagctgttggaaaaactggacaataatgtaagtgagaaacttcttacagaagaatgatgttggaatgaacaccatatatgacctaaaagaaagaacaactttcctaaagttgttctttaggactaaactgttgaagttccatgctaaaaatgatgacagaagttaatgaaaaaaacaaaaacactgcagaaagttaaaaacgaagatcttgatcatgcattgaaagagtggatccatcagcattgcagtgaacacgtgccacttaaggacatgctgatcatgaaataaacatctattaaaatgaactgaaaatcgaagggaactgtgagtattcaataggctggttagagaaatttaaggtaagatagcattaacttttctaaaggtttgtggtgttaaagcatcttgatcacaaaacagcagagaaattcattgatgaatttgccaagattgtctctgatgaaaatctgactccagaacaagtctataatgctgatgaaacatcactgttttgccattattgacccagaaagacactgactacagctgaggagacagcccctacaagaataaaggatgcaaagaacagaataactgtgctgggatgtgctaatgcagcaggcataaatgtgaacttactgtgataggcaaaagcttgcatcctcactgttttcaaggaatgcattttttttactagtccattattgtactaacaaaaaggcatggatccctagggacatcttttctgattggtttcacaaacattttataccagcttgtgtgcacttgcagggaagctaggccggatgatgactgcaagattttgttattccttgacaactattctgctcatcgtctagctgaaattcttattaaaaaaagtgtttcattatttcaaccttgtgaccagggtattctacgatcaatgaagagtaaatacaaaaaccttttttgggcagcatgctagcagcagtgaactgaggcctgggtgtggaaggttttcagaaggagtttagaatgaaagatgccatagatgcttttgccagcacaaggagtttaggatgaaggatgccatatatgccagcacttggaagacagtgactcagttgtgtatgcctgcagcctctgcctgtcactacatttattgatgatgaggagcaaattggtgactttgaagtatgtcaagtgagctccttatgcaaaaaataatatcttcagagtccatccgtaagctggaagaaggatatatcaaagaagtgtttgacattgataatgaggtttcagttgttcattcattaactgatggcaaaatagctaaaatgcttctaaatcaaggtgattatgataatggtgataatgaagatgatttcattgacctcgcagaacaactgcctataggcagcatggtgatgggcttattgaagcactagagcagcatgtattcataacagaacaagaaataggtttataaaatcaaggagagacttcaacaaaaaccattgttaaagaggcaagtaggtggtactgcaggaaacattttaaaaggccattcagcacaatgtcttattatgccgagaggacccacttcttggtccctcaactgcttctgatgtttcttctcacctaacaaagtactgtgtaccggaactttttaatcaaaacataacattgtaggtagagactgaaagcctgccattgttgctgtttaacagctgatacaggtgttctggtgatgccactgtgctgcttagtttgaatacgttatttttcactgttattaatggtgtgtcttatatttttactattaagttcctttgtgtgaatccgtgtaagaaaatgattgcttgtcagtagtatgtaaattcaatcaagaatgatggtgatgccaaacaaccatagagtgttcacatgggtggctgacatagcaacacctgtgttttctgataagtcagtgtacacaacctttgtttcatgcacaaaattatttaaatattggataaaattaccttcaggctatgcatataaggtatatgaagcataaatgaattttgtgtttggacttgggtcccatcctcaagatagctcattatatctatgaaatattcaaaaatcctaaaaaatctgaaatctgaaacacttctggtcccaagcattttggataagggacactcaacctgtagtatgcttaagggaaagcttatcctaaagctttcgtccaatactgttgcaggtggtgctacattcatttttgaaacatttctgttttcttaaaagatttggttttcacatttcaaataaactagcataaatacaagcatttttttaatttttttttattatacttttaagttctagggtacatgtacacaacgtgcaggtttgttacatatgtatacatgtgccatgttagtgtgctgcacccattaactcatcatttacattaggtatatctcctaatgctatccctcctccttcctcccatcccacaacaggccccggggtgtgatgttccccttcctgtgtccaagtgttctcattgttcaattcccacctatgagtgagaacatgcagtgtttggttttttgtccttgcaatagtttgctgagaatgatggtttccagcttcatcgatgtccctacaaaggacatgaactcatcattttttatggctgcatagtattccatggtgtatatgtgccacattttcttaatccagtctatcattgttggacatttgggttggttccaagtctttgctattatgagtagtgctgcagtaaacatatgtgtgcatgtgtctttatagcaccatgatttatattcctttgggtatatacccagtaatgggatggctgggtcagatagtatttctagttctagatccctgaggaatcaccacactgtcttccacaatggttgaactagtttacagtcccaccaacagtgtaaaagtgttcctatttctccacatcctctccagcacctgttgtttcctgactttgtaatgattgccattctaactggtgtgagatgatatctcattgtggttttgatttgcatttctctgatggccagtgatgatgaacattttttcacgtgtctattggctgcataaatgtcttcttttgagaagtgtctgttcatatccttcgcccactttttgatggggttgtttttttcttgtaaatttgtttgagttctctgtagattctcgatattacccctttgtcagatgagtagattgcaaaaattttctcccattctgtaggttgcctgttcactctgatggtagtttcttttgctgtgcagaagctctttagtttaatgagatcccatttgtcaattttggcttttgttgccattgcctttggtgttttagacatgaagtccttgcccatgcctgtgtcctgaatgatattgcctaggttttcttctagggtttttatggttttaggtctaacatttaagtctttaatgcatcttgaattaatttttgtataaggtgtaaggaagggatccagtttcagctttgtacatatagctagccagttttcccagcaccatttgttaaatagggaatcctttccccatttcttgtttttgtcaggtttgtcaaagatcagatagttgtagatgtgtggtattatttctgagggctctgttctgttccattggtctatatctctgttttggtaccagtaccatgctgttttggttagtgtttggtagtgtagtatagtttgaagtcaggtagcgtgatgcctccagctttgttcttttggcttaggattgacttggcaatgcgggctcttttttggttccatatgaactttaaagtagtttttttccaattctgtgaagaaagtcattggtagcttgatggggatggcattgaatctataaattaccttgggcagtatggccattttcatgatattgattcctcctatccatgagcatggaatgttcttccatttcacccattcacaattgcttcgaagagagtaaaatacctaggaatccaacttacaaaggatgtgaaggacctcttcaaggagaactacaaaccactgctcatcgaaataaaagagaatacaagcattttaaaagaaaaactttaaaaaatttatcaattcagtaattttttaggaaatttgtgaaattgtaaaaccatcaccacaatttagttttagtttttgtcacctcaaagctgttttactcatttgtagtcaattatgatttccacctccagcctcaccactaatctgccttctgtttatggatttgccctttctggaggtttcctataaatgcaatcatatagaatgtggccttatatgactggtttctttcacttagtataatgttttcaaggtttatcatcatggtatcagtgttgtaggatgtatcagtacttcatttcttattacggctgaggaatattccattatagatacaacactatccattcaccagttgatggacattagggtagtttgtagtttttggccattatgaatactgctataaatattcatgtacatgttttttatgtggacgtgcgttttcatttctcttgagtatatacgtaggttctaatgggtatagagtagtattcgttgtaggtttgatttgcatttccctaatgaccaatgattttaaacatcttttttgtgtgctcactagccatttgtgtatcttcttttgtgaaatgtctattcaaagcttttacctatttttaaattatttgggtcctatagagttgcaggatttctttgcatattctggatcaaatcctttctcacatatatgatttccaaatatgtttctttattttttgagacaaggacttgctatgcccaagctggagtatggtggtgtgatcacagttcactgccacctctgcttccaaggagctgggaccacaggcatgtgccaccacacctagctaatttaaaagaaatttttgtagacacaaggtctcactgtgctgtgctggctggtttcaaactcctggtctcaagctatcctcctgccatggcctcccagagtgctgggactacaggcataagtcactgcacccagccccaaatatatttctcttgcctgtggctgtgtgttttgaagtttaagaggtttttattttgaagtcctttttttttttttttttttttttgagactgagtttcactctgttgtccagactggagtgcagtggtgcaatctcggctcactgcaagctctgcctcctgggttcacgccattctcctgcctcagcctcccaagtagttgggactacaggcatccaccacctcgctgggctaattttttttttttatgtatttttattagagacagggtttcactgtgttagccaggatggtctcgatctcctgacctcgagatccatccacctcggcctcccaaagtgctgggattacaggcgtgagccaccgcgcccggccgaagtccttttttttttttttagtttatcattttttgttgttgtttgtttcaaggattgtgcttttgttgttagtttttttaaaaacacactttgttcctcttgagagttgagggcctactgttacatttagaccccattgtatattatgaaaatttattgttcatgatatcattggtccatattgtagataagaatttccaaattatttttattttctacatatatttgtggtgtactcatcatttagggtaatttttccctcatagatgtgctactataattttagagttttataaagataactttatagttgtttaagtgtaatcttttttcctttctctttttttttggcagctccctagatctttagcttctactcccactgctcctaccactccagcaacgccagataatgcatcacaggaagaactcatgattacattagtaacaggattggcgtccgttacatctagaacttctatgggcatcattattgttggaggagtggtaagaaacattacttttagtataattaaaatcgaaatgtttgcaaggctgcctgttagctcacaaaagaaaaggtatacagtatttacttctatttataggatctgtaaaatagtatgaaaatttgcaggttaaaagtagtgaattaaatatcacaagtttcatcttaaatttttaaaaaacatacatctttaggaatgaactatcaccacctagctggtctttaatacttcctaagcattttcacatcacagcacacaaagaaatatttgtacgttgaggtaataagaaaaccccaggtgccctatctagccttctctgaatatcaaggggatctgtcttaagtattaaatgttatttttagtagtagttcttatttgtttctttaaaaaatgtatatcattaacagcatggatatgcttgttttggtttttgaaaggtctgacctacaatatttaacattgttttatttttgagatacattgaatcaggataagtctggcagcttataaagctctccctcatttgtgtgctgatcccttttaagcctgattgatttctggtaacttcaggttttctcatggagaaggaatatacatttttagaaaatgtatctaactcaaagatccatagggaactaaaatgcttttaaatgtactctccaaagtggtgtttttccttctcagactaagctatgactttatcttacagatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacagtaagttggaaggtgcatctttcctttaaaaaaaagttactgaaatatgacatacatgcagaaaaagcacaaaataagtgtattgctcaaagaattatcacaaaatgaacatgtttcgtgatggccataaatgagaaaaaatagaacaatactaaacctcactgctgccctttctccctcctaatcactattcttctttccattctcctgatagattaggtttgaacattagaaaattggtagataggaactctcaagaactctggaggggtttaaaaagatagttcttaattttttttcttttttttcagagatagggtctctgtcgcccaggctggagggcagtggcacaatctggctcactgcagcctcgaatcttgggctcaagtgatcttactgcctcagcctcccacgtagctgggaccacaggtgtgtgccaccacaccaggataattttttaattttttttttttctttgagacagggactcaatatgttgcccgggttggtcttgaccacctgggctcaagtaatcctccctcctcaagcctcctgagtagctgagattataggcatgagccaccatgcccaactcaaaagatcttcagcagacctattctaaatttatgtacctggctgggcaaggtggctcacgcctataatcccagcacattgggaggctgaggcaggcggatcacttgaggtcgggagttcgagaacagcctggccaacatggtgaaaccccatctctactaaaaacacaaaaattagccgggcatggtagcacatgcctgtaatctcagctagttgggaggctgaggcacaagaatcgcttgaccctggaaggcagaggttgtagtgagccgagatcacatcactgaactccagcctgggcgacagagtgagagactatgtctcaaaaataaataattgcccttaagatatttgtggtttctttttttttttttttttttttttttttttctgagatggagtctcagttgcccaggctggagtgcaatggcacaatctcggctcactgcaacctccaccttcctcattcaagtgagtagctggcgtgtgccaccgcacccagctaatttttttttttttttttgagatggagtctcactctgtcacccaggctggagtgcagtagcacgatctcggctcaccacaacctccgcctcccaggttcaagcaattctcctgcttcagcctcccaagtagctgggactacaggtgcatgccactacacctggctaattttgttttgtatttttagtagagatggggttttcaccatgttggccaggatggtctcaatctcctgacctcatgatccactcgcctcggcctcccaaagtgctgggattacaggtgtgagcctccatgcccagccccttgcccagctaattttttttgtattttttttttttagtagagccaaggtttcaccatgttggccaggctgatcttgaactcctgacctcaagtgatccacctgccttggcctcccaaagtgttgggatcacaggcgtgagccaccgcgcccagccagatctttgtggtttcttaataaagaaaactgaatgaatagaggtagcctggccaagcagtctaagaaagctgaatgaattcttagcatttaacaaatgaacttaatggtaggtagactcctgatttcatggtgaatgtaatgtatatttgctctcgcagttcaaatgtatacgttaaatgctattttatttttagatctcaggagaattttattataacatatacctaagtccacccggtttctgcttttatacaacttaaatatttgtttcattcatgtggtaaaaatatatagaactccagtcaagtcagggtacaatattctgtatttggatgcctctgagagcagaatttaaaaattctttgagttcaagataacttcagtttaatggaagaaactaacatttacataattataatacaaagtgagagtgataagaaatataagagaaagagaaaccattatcataaggcaaggctgtacaagttacttaaatcatgaaggatagtagatcaataaaggtttcctaggggagatgtgtagcatatgagatttgaacatgctgtatcggaagatcagatggagacaacaacccaaatcaaaaacaagaaggtaaggggaaaagactgcattcaaagacatgaagagaaatattcaatgtggcacatgtgtatctaagctgtgtacatacattcaggtgtagacttcatagcaggatgtggccttgtctgtatgtgtagattggggtttggataattaggaattccgagagtgatgtcaacacttagttctagaacagataactttgcagtagtatttgaaattgtttagactcaagagacaggaattgcaggaacggtaaactgttgcagatacaaaatcaaagtctgaactaacagttaataattgtagagaatggttaccaggagactgcaaatttgaggaatttgttcatttattcattcattcattgaccaagttttttgagcctctattttatctgatagttttaatttatattaaggatgagttttcatctagttaagatacttggacatccaaagaatcagctgaaattcatataaataaaaacaaagttaatgtagctttccctgcattgattatcaaacatttattaattgcctcccacgcagcagttcatgctaggggttatgggaaataaaaactcgacttgatcctctttcttagaagactttgcacattaatggaggcaacctcaaataatttctcagttaaaataaactaagtaaatatttaatatttaacaaaatattaaaagaatgacacatgcttcatctgtctgagatttggtggaatgggaagaggtatgctcccatttaaaaatataatgtttgccaaagttaatatatgaattagccctcaaatataaccctttgattctagaaatattgttaaattttgctataaagtatttttgcctatgtcacaaaagtgcatggaattttttttctgttcttgataatttcttactttgcgcagggccccaagcatgagtaaagtttattgtgcttctgaagaaacacacccatcttttgtctttatgtagcttattcatgttcacagccatatagcagaggtaatatcgtctcttgagccaggataaaatgcagcccactagtgccatatcttccctcttatcattcttagtgttctgattccctatagtttagaagttttttaaaacttgtgttcttctttttatgtgagctttaaattaaagcttattcatttttgaagacatttatgactgcttctaaatttttattttaagacaaatagctaccacttttgctcgcctgtgccaacaagttgatattactcaaaaacagctggaagaagaaattgctagattacccaaagaaatagatcagttggagaaaatacaaaacaattcaaagctcttaaggtatttaaacctttcttctcaataatttgaacatttactggtctcattacaaaatatgtaaaattattaatgaatttgtattcattcctaatagctttttgtgttggtttaaatgaaaatcttccatatttaattccatgtggtttgcagtttcaccgaaggtttaaatgaaaatcttccatatttaattccatgtggtttgcagtttcactgaaggctaattgcaacaagaaaacaaatctgaattgaaagggactttatagatcgaaatttactcttcattaggctatattattcccttttcagaacagaagttgtataattaaaagtgaatttttagttgtgtatgtccaagacccataacttctgttttcatgggggactattgattatgtatacttaaatcataaaagtaagatgtcctgataaaatgtggatttctggtttgatatgattcattatatattatttagggtctaataaaatttgcttttggggacaagactgaaagtgtcaccattcggtctgtagttggaaattcttactcagtgcttaagaacttaactttcagctttcttacttttgcttacccattagctggcttgtcagaatgtcttggaagaaccattaaacctcatttagtccctgctgttacttctaggacacatgctacacaaaattgcctgtgtaagaacagcttagtagtcaatgtttacaaattggagggactgtctttgtgacctggattttggggcatgtacttaaaacatccatagtagtgattatccatccatagtgtcttcatctgaccaacaacacgtgttcattgtaccttagtttcaaaatctctggaaaagatgactgcctatcacttagatatttccaacctcacccacccatgtgaattgtatgtattagattgctcctattttaagtcagctcatcccatatatacctttcaaatgtggtgaaactgtgcagtagaaattggttttttgtcttaacctaggtaagtttttatggttttttggttttgatttattcagcttttgaaagaggaatactaggtaagtttttaaatagtatttcattttgttataataaatgataaaatagattattggcattagtcatgtagctttctgatttgggcaagactggcttgaataagtatgaatatttttggtctgctaatcatttttctaatagaaaaaagttaaaaaaaacaaataccataatatttggaatttccattttttactagattaggctcagccatttggatagaatttaatgtgctaacgctgcaggagagctacctcaagaaatatatacagtagagttcagagctgatgtatacttgtatgacctgaagcatatgcacacaggaataaagtaaaacaagaccctccccgtccataatggagagagagagcccactcaatgaatatgtgccctggcatagtgtgagagtgggaaacaaatctgtttttctgtcagttttagttccagttttcctctcttgtgggcatttggctgcatcaaggatgaatctagtgtttaaaggaaatatttttggtatgccattgccgctgtaacatctgctactttccttgtatgtccataagaaacactgtgtactttgtgcattatttaaagggaatttgcaagcataatcatgactctaggtaacttaggatatcccgtgtaaggtatgattccactgtctgttatgctcttcattgtttattattaaagtttttgtcttttaataatggatggaatgcatttttctccttgacctttatagtaattagattggtgttttatttttttaattagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccaccaaggagtgtggaatgtccttgagtgtattatttatgcaagtcacagtcacgttgccatcatggcagctatgtgaaacactaataaatgtgtttttactttttattcccgttaaaactgatgtaaaacaggataaaggcttgttatagtcacttataagtatctgggtctaagtaatttccttagatgtttctaaagaaacattttcagctttgctcccattatgattccaataaggaacgctttcctagtgcaattttaggagtaaagtttgaagagataaaaatagccaaagataggagacgtctgaattttgaatgataaacagtgatgttttaaaaaagctgttgttcttcaggaggcatttgcctaggatattgctggattataccccattggaggcttttaattttatttgtatgaattttccaggatttcattaaaaattattattgtattttttaccttaatgaaagattttgggttcaaatatctttctatattaaaagctgattgagtctgtacatatgtaaattatgcctagtggaggttctgttgactttcttccccactgtggaagaggccagttttgcctccatttgcacattcatttcagttatttctgatccataaatataacatttacaaaattcttccttgagctggtggaaatgcctcaccagtttcctctttaatgaatcaaataaaatctttaactgatgttaaaaaaaattgattgaaactcagatggaatggaaatgtacaaaaatgacaccattctaggaatttgctagacaaaatgtaggactaccagatcagtatctcctagacacttgttagaaatgcacaatcccggggaacgcagtacatttggccacatgtagtttatgtttccttttcatgggagggataaaatttaaagctttttttttctttgaatacagtccttccttttctatgccttttaaggcttctagatgctattcagcctttttacagcaggtgcaactctatttttcaaggtatcttagaagataacactaggccattgaagcctttcaaaaatatatttttatgcaaattgacacgagtgcagtatactaatgcaaattaattttggtgtttagcttttattgctcatttataacccaagaaatggtacagaccacagtaagtgggattaggtaacaactacaacatggaaaaacagtgtctaagatcacgtactgctaatttaggttacaaaactcaaggctgtaacctttatatgaaagtacttaagcttgaaagttcataatagtttggtatcacctcattagtatagtacagtggttctcaaagtttggtcctgggtcatcgacattacttctttttctttctgagacagggtctcagtctgtcacccaggatggagtgcagtggcgtgatcatggctcactgcagcctcaacctctcgggttcaggtgatcctcccacatcagcctcctgggtggctgggactacaggcacacgccaccatgcctggctagtttttgtaaagacgaggtttccccatgttgtgcaggctggtcttgaactcacagactcaagtgatccttttacctcagcctcccaaactgttgggataacaggtgtaagccaccacacacagctataatcaaccttcaaacttataaaaagtgtggatccttgggtctgaacccagacctatggagtcagacagtaggtttgaggcccagcaatctatggtttaacaagccatccaggtgtttctgatgcacagtgaaattggggtaccactggtattaggtttggtatggcaactttttcatcacttgttttatgtagttgtctgatcaattgtgaaaacataatgaatgttggaaatggaacagtaaaataacgaaagccaactttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccacccgcctcggcctcccaaagtgctgggattacaggcgtgagccaccgcgcccggccgaaagccaactcttatgcctagaaatatgtgcacctatgaccaagcccatgaattatacaggaattatgtaattatgagtgatgtacttcaaagttattgcacatacacttgtttactttgtatgtttgcaggattaaactttgtataatctttttacaaaaattttttttcagtatgcaagcttgcaagatgaaaataaaacctgtttgcctgata

SEQ ID NO: 685 - DNA, 109735 bp, Homo sapiens
caggcaacaaggaactaatactcggggtttacaggaaccaggggatgggccagatatggagaaagagacgcctctggccttgggggctcgttcttgagggaatcagcgtgatggggatgagaagggcatctttggaacgggggccttctccataggaagaggaggcgagtcccctggccatatttaaaccacagttctccacgccacctgtgcgactcgggatccaacctccccgcaccagccccagtccaggtacctggaacttagtccgatcggtaaccggcgactacgtggggtacaggtacccgagcgcgcccccgacagacgcaccgacctgcgcgcgcgccgcgggcaggatgcgtgcgcactccccggacgtcccgccccgccccctctgcggccccgaagctgggcggcgtgcgcgcccccgcgccgcgccgagccgggcgctcggaaaggcgtccccgcggtgcctgacagttccttcctcagcgcctgccccgtgagtgacgaggagcgcggagtctcgccatatcaggagggccctgttacgtgaggctgtgcaccgagactattccaggaagaagaggggacacttggtgggcggggtgatttcgggcagtcaggtgggcgacccgcgtaggcgtctgaaaggcccgcgtcgttagggagggcaggagtggcgtctctggttacggggtcgggcaaagggcagaggtcaccgtccaggttggacagcagcacctttgagcgatggcggcgtctggggaaccccagaggcagtggcaagaggaggtggcggcggtggtagtggtgggctcctgcatgaccgacctggtcaggttagtccggggccagttactcagtctgcggctcgggggaggaggcgtgccgtgcgctatgcgcccagtggagcttttgggcgctgggtctccagggatagacagtgctagctttgggtatgagctgcaggttttcgaagccttcagcctaccttcctggcatgaaagaacttgagtatataaaggtaaatctcaggggaggggacgtaataggccagggtttagtgaaagctctaatattactcaaagcgctccccaaagacctgccctccaaagacttgcgcccccaaagacctttcttggcccggctgctgagcctttccccaaacgagccagggaactttgcccacgtcattttacctccgagaatgtgcctacctcacagggttgttgtgaggactaaatgaagtaaagtgttttgtcaagcgtaacattatccaaattgggtattattcgtctgagcttattgtataaaataatgagttgagcagaaatcaaaaagactgtcacctttcaccatgttgattgtcggcattactgcagtattttatatttacagcgtatttttcagcaagccaagtatgaatcaaaataaaaacataaacacagtatttacaacctctgaaaacgatgatcaaattatgatagaaaatatgccaaatgaaaattgttgagttaggtcagtaagattgagtagacagatccttctgatttttcttttttttaaattaaggtagcttttctgattacaaaagtaatgtatgttcactgtaaaattagtaataaattcagatattccaagaaaatcctaccactccaattactgcagttcagtcttttgatgaatatcttttcagttgtaatgctactttgtgttataaaaatgatcaggtatgctacagtaacacctcattcgtcctgaaatgttgcttttccaaagggtaatagagaacgtggaactaaacaaaaaggctttgggacaatcaaaataagtcaccaaattgctgcaccaaaccacctgtattctactcagaaaataggtctagggtcttcatgtaaccaatttaaccttaccttaaaatatttataagctgtgttaccaaatttccactgagattagaaaggtgggagttagagaagagactgctagaggcagttatagtgactgacgaaaacttgaggatgagtaggagactgtgtaacgagaagaagcaacaaaagaattttaaataccaatgacctttatttttccacaaatattagaactattctgtcagacactgtgccaagataaaaatactttcctttggtgacagagcataaaattgaatctagttggagacatttgttgaagaggcctgtacatctttttctagagcaagagtaagtaaacttttctgtaaagggccagatagtaaatattttaggctttgcaagccgtatgtggtcaaggtcacatttttttttaacaacattttttaaatgtaaaaaccattcttacctcccaagccttacaagaacatcctgcaggccatagtttgcagacatctgtgtagaaagaacattactgtgtttacaacacaatatagcaattgattttactggtgatgactcttttcaagaaaaggttatatggtacttactaaattttgtataaaaatagagcatgtatttcactttagaaaaagtttcatcaaaaattcataaagttgagttacataaaggaataaaccttcatctaaaatgattcattccatgggaaatccaccaagctaaatgtttaccatgattttatgtgtgaagtggcagaagagtaagaaaactaaagtggaccgggcgcagtggctcatacctgtaatcccagcactttgggaggccaaggtgggcagatcacctgagtgaggagtttcagaccagcccagcgaacatggtgaaaccccatctctactaaaaatacaaaaattagctgggcatggtagctggcgcctgtgattccagctactcaggaggctgaggcaggagaattgcttgaacctgggaggtggaggtagcagtgagctgagatcgcgccattgcactccagcttgggtgacaagagcaaaactccatctcaaaaaaaaaaagaaaagaaaagaaaattttctcatacatcctacctgaataaaagtgtcagggttaaaattcagagctacttccttgttaccaaactgagagctttctgtgaagcttgaccatcagatactaaaaataactatagtactttgtggggtggggtaggggagtggtgtcaaaggcccattttagcatccgtcagggttttaaagtcttatttcagagctagaaaaatttggaaattatttattctagtccttcagtttttagataaataaactgaagcccagagaagaatttctcctcttggccatattctttccttcataaaatatccaagtttcttctcttcacatgaatcagtaaaaattttactgatgattagcaaaatcactagtaaaaattttactgatgattagcaaaatcactagtaaaaattttactgatgattagcaaaatcattagtaaaatcatcagtaaaaaatcattagtaaaaactgtattcccatatagactctctctgctaattcccacagcttttcaacaaacttttcatgatctctcgttacttatgacactgaagatctttacaaaaatctgcgtataggattttcatttaaaaccctgcatctgtgataaacttgggtgcaacttttctagttacagttagtatcatgattatattagttatctactgctgctgtaacaaattaccaaatttaataattaacgcaagtttatttttttactgttctggaggtcagaagtctgatacaggtctcactgggctaaaatcaaggtgtcagcagggctgggctccattctggagactctagaggaggatctgttttctttccttttccaccttccagaggctgcccacatccttggctcatcgtggccccttcctccatcttcagagccagcaatggttgttcaggtctttctcacattacatcactctgatccccagtcttctggctccctcttctacattataagaactcttgtgattacattaggcacaaccagataattcagaataatctctttattttatggtgacttattaggaaccttaatttccccttgccacgtaacaacatattcacaaattctggggatttggatgtggacatactttgggagaggggagcagagagtatgttatttttgctaccacagtggttaagcttgaagtaaaaaatcctacaatatttagttctcagagactctttgaagcctatcattctatcctcacattttacaagtgagataaggaagagagcttcaatgacttactccaaatcacacagccagtaagtggttacttactggctagtaagtggctagtaaaggctactacccaggtctcccaatccttaacctttcttttttatttttttaaatatatattttctattttttattttgttaaagatgggctctcgctatattgcccaggctggtcttgaacccctgggctcaagcgatcctcctacttggtgtcccaaagtgctggggttacaggcgtgagccaccgtgcctggccccaattcgtacctttccattatatcattctacctctaactctgactagtgtttattgcccttttcatctacagtacatttgatagcttgtagtctgtacattcattgttaactttataaactgataaggaataacaactaaggatttataattttcaagtctaaagatagtatctttattactgtgccttattcctaaatttaactgtaactagcctggacacgcatgcctattctttagtatcacttcagaaataaaactgcttcaataactaagcccttttagatggcatccaagcccaacttactttatatattacattactgtgtgccagacactgctaattcaatcaatgaataaccttttttttcatttctaatttcagtcagctatgaatagtaagtcgtatgtagtaataatttttaaaaatcattagctcatacagcatggcaaacaattgaaattatttaatactcacttatatttttctcatcatcctcttccttcttgaacactcatctctaaagttacacattacaaagatacaaggaatcaaccctggtcttatgggatataaagtcaaagattttccaaagacagatttccacaacaaaacaacaatgtgtgaatatttttagacgttaggctcataggcctttgttaatcatgttttcattagtaaaccttattttttatgacctgtatcacccatttttttaattattcattcaagaaatatttattgaatttatactatgtgccaggcacttcctgatgtgcagaggatacagcagtgaaaacacagacaaaaatccctgcctcatgaagtttacattctagtaagacagtatcagtagaaataagttaattacatagtaagttaggtaaaagctaaggagaaaaattaaacatgtaaggagggatgggaataggaagtttagattactggcttcagaaagcctcactgaaaaggttatttagagtaaagacctaaaggaggaaagaaaacaagtcataatctgagggaagagcattccaggcagaaggaatagtgtactcaaaggccgtattcagtgaagaacatggagtccagtatggatgaagaagaaaaaaagagtcaggagacagcaatcagtgattaaaggacattgagtcatactttggatgagatgaaaagctagtggaggatttgagcaggggagtgacataatcttattttgattataataggatctctccaagggctatatgagaataaatagcatgaaggggaaggcaaatacagaagcagggacacaaattcagagtcaatcccaacaatctaggcaagaaatgatggtagcttgaaagcagtgaagtggagagaaagcatctttctattatatttttggggtagagttgacaggattagtggaagttgacctctatgaaaacgcagaagattgtatgcagagaaagttgggtgggagagggctgtatcaggagcacagagtggaattgggagggttgaggtacctactagatatcaaattgaggaggtgaagaaaatagatacaagagtttggatctcaaaggagaggtccaacccggagatataaatttcagagtcatcagtgtatcaatggtatttaaagccatgaggctggatgagatcactgagggtctgacctcctagggcactacaacatttaaaggataaatttttaataaaattgacttcctgtctctcttcaagtctctctgcagtcctaaaacttgctttgagacgtgcttaatacaaacctatgtttatatttccatagcaatagactctgatgtcaactaaaactctgtgttatctttttacatgctgccaattaaaagtgatggcttgagagataagactcgtgttcacccaagcatctaagcttaatcctgccaaatcaggaaatgagtgcctaattttcaaaaggtttaattggatagtggaataagtgaatttagaagcttttagatccaaagcggatgaagcattggacctagattacttaaaaaaaaaaagttatggccaggcatagtggtggctcaagcctataatcccagcactttgggaagccaagcgggtggatcgcttgagctcaggagttaagactagcctgggcaacatggcaaaacccggtctccgcaaaaaatacacaaattagctgggcgtagtggtgtgagcctgtagtcccagctactggggggctgaggtgggaggatcgctggagacccagaggttgaggctacagtgagcctcgattgtacactgtacttcagcctggacaacagagtgagaccctgttaaacataaaaaaataaaagagagttatactgtacctatcaaagtttgtatttgtttgacataatagagtactttgtaactgggacacaggttacagagtcaagaagcctcttggcttgtcatatttagaacagagaaatctcttttacagtcacattttcaaaaactaaaaaaggaatattgatccaaaaagtatcatgctttcccagtattcgaggaatataatatccttcattattctttctgcttcttaaattggtctgaaaagttgcttatcagttaccaatcatttattaaattagtattttgttaaacatagttgtgtcaactgtattccctaatatcaaaagtaatcattcatgggaaatttggtatgtccctttaatgaaaatatacattaaaaaattatggctgggtgcagtggctcatgcctgtaatcccagcactttgggaggccgatgtgggaggattgtttgaacccaggagtttaagaccagcctaggtaacagggtgatgagactctgtctcttaaaaaaaaaaaaaattgcatatgacaaagaaagagcacctactgtgtactattacaaagcagtccctttagcaatccattcctttgccagctctctgtgccttaggcttttcatgtctgtaacctaaggagaacaaagtaaggtggactttgtgatgagttttgctctagtattttgatgacttgtttataatgctgaaatacttatagtgtgctaaacactaagaatactgcagttaggaggctgggcgtggtgtctcacgcctgtaatcccagcactttgggaggccgaggcgggcagatcacgaggtcaggagatcgagaccatcctggctaatacggtgaaaccccatctctactaaaaatgcaaacaactagctgggcgtggtggcagacgcctgtagtcccagctactcgggaggctgaggcaggagaatggtgtgaaccagggaggcggagcttgcagtgagctgagatcgtgccactgcactccagcctgggtgacagagcgagactccgtctcaaaaaaaaaaaaaaaaagaatactgcagttaggaaaacatggttactgcttgtcttgtcttagtcccttttgtgctgccataacagaatacctaagactgggtgatttatcttttttcacttttattttaagttcagaggtacatgtgcaggtttgttatataggtaaactcatgtcacacgggtttgttgtacccaggcattattattttttttttgtcacccaggtattaagcctagttctcattagttatttttcctgatcctcttccctcctttcaccctccaccctcaggtagaccccagtgtgtgttgttcacttctgtgtgtccaggtgttctcatcatttagctcccacttataagtaagaacatgcagtatttagctttctgtacctgtgttagtgtgctaaggataatggcctccagctccatcatgttctggcaaagtacatgatgtcgttctttttaacaactgtgtagtattccatagtgtatatgtaccacattttctttatccagtctaccattgatgggcatttaggttgattccatgtctttgctattgtgaatagtgctgtaatgaacatacacatgcatgtgtctttgttacagaatgatttatattcctgtgagtatatacccagtaatgggattgctgggtcaaatggtaattctgtttttagcttctgaaggaattgcaaccctgatttccacaatggttgaactaatttacactcccaccaacagtgtataagcattcctttttctccgcagccttgccagcatctgttaatttttgactgtttagtaatagtcattctgactggtatgagatggtatctcattgtggttttgatttgtatttcgctaatgatcagtgatgttgagctttttttgatatgcttattgcaaataaaataaaatgtatgtcttctttagaaaagtgtttgttcatgttctttgcccactttttaatggggttgtttttttttcttgtagatttgtttaagttccttttaggtgctgaatattagacctttgtcagatgcatagtttgcaaaaattttctcccattctgtaggttgtctgtttactcaatagtttcttttactgtacagaagcttttagttttctttagtttaattagatctcatttgtcaatttttgcttttgttgcaattgcttttggcattttgccatgaaatttttgcctgtgctatgtccagagtggtattgcctaggttgtcttccagggtttttatagttttaggttttacatttgtctttaattcatcttcagtcgatttttgtatatggtgtaagaaaggggtccagtttcagtcttctgcacgtgcctagccagttattccagcactatctgttgaatagggagtcctttctccattgcttgtttttatctgttttgtcaaagatcagatggttgtaggtatgtggccttattttgggggctctttattctgttccattggtttatatgtctgtttttgtaccagtaccatgctgttttggttactgtagccctgaagtatagtttgaagtcaggtagtgtgatgcctccagctttctttttccttaggattgccttggctattcaggctcttttttggttccatatgaatttttattttattttattttatttatttatttattttgagacagagtctcactctgtcacccaggctggagtgtagtggcacaatcttggctcactgcagcctctgcctcccagattcaagcaattctcctgcctcagcctcccgagtaactgggactacaggcccacaccactacggctggctaatttttgtatttttagtagagacggggtttcgccatgttgaccaggctggtctcaatctcctgacctcgggtgatttgccagtctcaacctcccaaagtgctgggattacagaggtgagccactgtgcctggccttatttttcttgagacaggatcttgctctttcccccaggctggagtgcagcagtgtgaaagtggcttactgcagcctcaacttccaggctccagcaatcccccgacattaacctcccaaatagctggaaccgcaggcacacaccagcatgcccagctaatttctgtttttttgtttgtttgtttgtttgtttgttggttggttggtttgcagagatggggttttgccatgttgctcaggctagtctcgaactcctgggctgaagcaacccacccacctcagcctcccaaagtgctgggattacaggtgtgagccatcgtgtgcagccccatttgaattttaaaatacttttttctagttctgtgatgaatgtcatggtagcttaataagaatagcattgaatctgtaaattgctttgggcaatatggccattttaatgatattgattcttcctgtccatgagcatggaatgttttttctatttgtttgtgtcatctctgatttcttcaatcaatattttgtagttttcattgtagagatttttcatctccctggatagctgtatttctaggtattttattttgtgtatgtggtaattgtggatgggattatgttcttaattaggctttggcttgactcttggtgtataggaatgctggtgattttttgtatcttgattttgtatcctgagactttgctgaagttgtttatcagcttaaggagcttttgggccaagattatggggtttcctaggtatagaatcatgcaaatagggatagtttgacttcctctcttcctacttggatgccttttatttctttctcttgcctggttactctggcaaggacttccaatactatattgaataggagtggtgagaggaggcatcctcgtcttgtgctggttttcaaaggaaatgcttccagctttttcccattcagtatgatgttggctgtgggtttgtcatagatggttcttattattttgagatatggtccttcaatacctagtttattgagagtttttaacatgaagcagtgttcattttatggaaagccttttctacaactattgagataatcgtgtggcttttgcctttagttctgtttatgtgatgaatcacagttactgatttgcatatgtcaaaccaaccttgcatcccagggaaaagtctacttgatcatggtggattcgctttttgatgtgctgctggattcaattttctttttttcttttgccaggttttggtatcaagatgatgctggcctcatagaatgagttagggaggagtccctcctcctcagttttttggaatagtttcagtaggaatggtactagctcttctttgtacatctgatagaatttggctgtgaattcatctgctcctggcctattttttagttggtaggctatttattactgattcagtttcggagctcattgttggtctgttcaaggattcagtttcttcctggttctgtcttgggagggtgtatgtgtccaggaatttatccatttcttctgacttttctagtttgtgtgcatagaggtgtttataatattctctgatggttatttgtatttctgtggggtcagtggtaatatcccctttaagactggataatttgcaacgaacagaaatgtgttggctcgtggttctctccacaatggagagtccaagatcaagggcatctggtgagattgctatatcattccatggtagaagaataaagcaggttgaggggaagagagagaggtaaaagggggctaaacttgtccttttattaggaactcactcccttgataacaaacccactcccatgataatggcattaatccattcatgagaacagagctctcatgacctaaactccacttaaaagtctcacctcccagtgccatttcactggcaattaaatttcaacaggagtttaggagggaacaaacatttgaaccatagcactgctcttggggaatttacagtccagagaagaaggcagactcaaaaagagattattatagtatgacatggtaagtgcctgcaggttatgcgagagaacagggaaaacttcctagaagagatgcccccgagccaaattttcaaaaataagcaggtggtaacccagaaaaaaaggggaaggaagacattccaccacttggggttacacacagaagcaaaatcatggatgtgcttgtgtggtatgtgctgaggcacatatggcttgcatggtatctgctgaggcagcaacccttgggtcttagaacatcaggatatacagtggtgatgaaaggcctaatcagccatgctgaggtgcttaggttttattctttaggccctggaaaccagtgaagggctcaaagtacaagaatgacagccagaacaaccccatcaaaaagtgggcaaaggatatgaacagacacttctcaaaagaagacatttatgcagccaaaagacacatgaaaaaatgctcatcatcactggccatcagagaaatgcaaatcaaaaccataatgagataccatctcacaccagttagaatggcaatcattaaaaagtcaggaaacaacaggtgctggagaggatgtggagaaatagaaacacttttacactgttggtgggactgtaaactagttcaaccattgtggaagtcagtgtggcgattcctcagggatctagaactagaaataccatttgacccagccatcccattactgggtatatatccaaaggactataaatcatgctgctataaagacacatgcacacttatgtttattgcggtactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaagcaaacaccacatattctcactcataggtgggaactgaacaatgagaacacatggacacaggaaggggaacatcacactctggggactgttgtggggtgggggcaggggggagggatagcattaggagatatacctaatgctaaatgacgagttaatgggtgcagcacaccagcatggcacatgtatacatatgtaactaacctgcacattgtgcacatgtaccgtaaaacttaaagtataataataattaaaaaaaataaaaaataaaaataaactgattaaaggcaaaaaaaaagaatgacagccagatttatatttcacgtagttcacttagtgctaaagtcagatttaaaagaagccaatgttttaaaggcatcaaaggcattcttcttgaagacaggaagacctatttgaaaggtaaaacagtagtattcacaaatgttgatgatggtgcgaactaggacagtagtgctgggaatcaaaaagaggaaaaagcttaaagaaatatttaggggctaaaatagttggaaacaactgtttagtaaagtgggcatgaatcaagcattcactctctgatcttttataaggaaacactaatgttgaaactttattttcccacattgacaagacctagaaggtagagtccttggaaagaatcccatcttatggaacaaaagcattccatgcttactacttttattgggggggcaggggcggttatattccttaaaaatcaaaataaatggtatcaaataattaagagatagtcaaattctctctaagggaaaaaatcctaattttgttttgagatttaagaaaaaatacaggtattctttcataattgtaatggagacgctaatgacaaatttagctcaaaaaatttacaaatattaactggaggcaatgaaatgacagaagatataaacataaaaaagaatgttaaaatacaaaatagaatcttccatataccaatacagcattcttaggggaaaaaaaaaaactacacaaagctcaaccacccatgtaacaaagatatttataatgtgtaaagtgttgtcggggacttagagactgtggaactagagaatatcagagtagcaaagaaacttgagttcatttttgtgttgaaatgaccaccctgttcatgttaaatataggaagcacaagtctagaaagaattaactgattttcccccagctaatacctaattaagattggagccaggattaaagtttttaccttttggctctcaagtactaacacattgtgttattgtgaagttttgagtagcatttcagaagtttgacatgtactggatttgcaagagacaaagtgttcaaaagtgctagtaaggaccgatttccttgaaaaagaaaacaaagctaatattgcaattatcaatatcagagtacttagtattattgtcctttagaatttttttcagacctgcaatttttattatatatgcataatataacatttaccatttttaatttacaattcattggcattaagtacatccacatttttttacaaacatcaccactaatcatttccaaaacttttttcatcttcctaaatggaaatgatgttcttattaaacaataactccctatcccctcctcccctcagcccctggcaactactattctactttctatccctatgaatttgactactttaggtacattatataagtggaattatgcagtgtttgccgttatgtgacttacttatttcacttagcataacgtcctcaagaaagggtaagtgaacttgaagacatagtaatagagattatctaaatttaagcataaagaaaaaatgcacagagcctctgtaacctgtggaacagtctaccatatgtataattggagtcaaagtatctcatataggtggagtctttgtaactggcttacttcacttagcataatattttcaaagtttatccatgttgtagcatgtttcagaattttcttccttttaaggctgaaaaatactccatttatgtacattacacattttgtttattcatctatcagtggacatttgggttgcttctacctttgggtattgtgaacaatgctgctattaacatgggaatacaaatacctgtttgagcccctgttttcagttcttttgagtatatacccaaaagtgggattgctggatcatatggtaattctatgtttaatttttttgaggacccaccatattgttttccataacagcaacactgcttttccttttagtttcttgcatcttctttgtaaagtccctattctgcatcttactcaccaagcctccttttcttatttcagtttagcctattttttttgtttcgtctcccatttgtaatccctcttttatgtcctcttatgcaattttgcatccccatatgtatgtatatctgtcatgtctaagtatacgtttgtgcaagaggaaaaatgtgtctgtacaggcaaggagctcagtaaacctcataccttctctgccaccctcaatctcagccccagcatttttgtggccatttaatactctgttacgtagagatacaaaaatttgttgattcagtgccctaaataaatacttttaagttggttctgtttgctatgatgaacttctttgaacacttatcttttggactcatgtctgtttccttaggtaaattcctagagctggaatttctaggccaaaggaaataacattcttgtttttgttttgttttattttgagtcaaggtctagttctgtcacccaggccggaatgcagtgttgcgatcgcagctcactgcagccttgaccttccaggctcaatcaatcctcccacctcagccttctgagtagctgggactacaggtgcataccaccatgcccaactaatttttatattttatttttggttgagacaaggtctcgccatgttgcccaggctgctctcgaactcctaacctaaagctatctgcccaccttggcctcccaaagtgcagtgattacagacgtgagacaccatacctggctggaaataacattttttaaacttttgaaatatattgcctatttgccttcataaaagttcttctgaaatacactcctactcacagtgtatgaaaaaggcctatttcctggatttttaacgaacacattactagttgagagatgttaaatgttttcatgtttgattacaagaggagatgttgaatgttttccagatgtttgttagttatttgtgtttcttttgtgagttgccagccatgggtcctttgtccatttttctgttggacactccttaagattttaaacaagacagttcaaagaaaagaaaatgtaaagatgctggttaagagttctgcagcaaagaagctaatagtataagagtgaaaggagaattttaagactctggctagcataaaatattgtggaaatatggatgagagagattctcaaccctggttgccctttagagtcagttaaaccagcctctccagggagggaatccaggcatcaatttttgttttttaaactccccataaattttaatgttccacaggggtagacaaaaagtgacttactgataaaagcaggaactatgaagtagagtgaatgtgacaaaatactgtagcaatttggagaaattaacctttaagagaaaggggttggagttattcctgatcaaggggagtcatgattggcacagataaacacatcagcgtataagtggcatcatacctggttatccagtctctctgctgtggtaatacagagtcttcactcttgacgacgtgttgtgtcacatgatgctgtccagtgatatcagttcttgaatgatgtgagttccgcccaggacagttgcctcctagttgagtggctgcaccttcctccattctgacagtgattgtacaatgttaaaactaagctgtaagctaagtgaggacagggtctgaatatctccagaacttcacacagagtctggaatgtagtaattgtaacaaatatatgcggagaatggactgagtatcataaaaaggatctgagattattccaatttcttccatagttatcatactaaatcaagattttcttcattgaatacaattttaatcactttttagtactttctacacagtgatgaacaacttttttgtcatatgatcttcaaggacaagttttctttgaattgtagaaggttcctcttatgacaactgattgaagacacgtttgaggccttaaattcttcatatgagcatttaaaatatttctatctgccttgccttaccttctttatgatttttatatcactagtttgacttggagtgtttcttgtatacatacagaaggctgctataaattatctctgtttgtatatggttgatgtgttttctaaataaaagctgagagttttgtttttgctttgggtttggggttttttgtttcagggtgttttgttttttttttgtttgtttcccagatacatcacatattaggtactggcttgtctctcatggtcaaaaatacgttcaaatgcaattcttctgtatcattgcagaaaataatttgtgcaacagttttttaagtaccctttaaaaattatattttacatctggatttttaccaccagtttaaaaaattacaattcatacactgttatagcaacaatattggttttttctgagttagaggtcttcattttgaagtgagaaatacaaacctacatttttagttacctaaattttcaaccaaatactctgccaaaagtcttttagaaactcaattttaaagtccttcaggctgtctcaatgaaaatcataagcagttctttggtattctgtcaagaccataaagaaaatagagtattatctaaaatgtttcttttaagccatttgaaattatcacagtaccttgctcaaagtagttactcagtgaacatttgtggagggaaggagggaatgcttgcatgccacagttgcccaagaatagcagctgtgtagaatgtctgtgtggggaccccgattccagcagaactttaaccctattgacagctgcaacaaggaaactgcattatttaactggttagttatttgggttgtaatgagcagaggatcatttcagttacttcaagaatggatacttgtttgcaaggtgacccagaattagcttaacagccaggtctcaggaagagcaggaaccagggaaggttcctaggaaatggattgttctttaatttttaccccagtgctccatcattaccctggccccactgccctcctcatgtgtgttccataccctcactcctctccccatttgcaggctttctctgcgagtatagcacctgctcattcccaaccctgccagtgttttgcctttactggcctcctttacccctctgcatccattcaagcttctgcttccaccacaaattgcttccttcttgccatgtttcttatttgatgggtgttcagctgtggtgtttcatatacattcattaagctaggctgactttctgtctgcttgacgttttgcttacctagggaattgcattaacatcacctaccgtgatggtggatttgacaatttcttgttgttgttatatatttttttggttttatgtattttacggctaatttattggttatacttagacttgaattattacattttcctgccgagtttaaccttttttctccctttcctgtggtgctgatgaatttaaccttttgattaaagtgagttaccatattttatctgtctttgccttaagcttttttattttttaatttttggctgatattgataaagctatccaggtttgttttagttgctatttgccttgtatatcttttcctgtctttttttcttttcacccttcaatgtgtctcataaacagcgcatacctgaattttagtcttttgttggcttgttttatttattaattttttttataactgcactacttttttctttttactagagaatgtaatccagtcacatttgttgggagttctgatttatttgaatttattttaaatgtgttacgttacaataaacggctctttagaacactatttttcaagctcattaagcctgtagagcaggggtccccaacccctgggccacagaccagtactgatctgtggtgtgttaagaaccaggctgcaaagcaggaggtgagtggcaggcaagtgagcaaagcttcatctgtatttacagccactccccattgctcacattacctcctaagctccacctcctgtcagatcagcagtagcattagtttctcatagtagcgtgaaccctatcgtgaactgcacatgcaagggatctaggctgtgcactggttttgagaatctaacgcctgatgatctaaggtggagctgaggcactgatgctagcattgaggagcagctgcaaatacagattaacattagcagagaggtttgactgcacagagaccatcataaatcaactgcttgcagacttatatcaaaaccctatcagtgagtggcaaatgacaattaagctgtatctggtggcaggcttaactttatagtggcaagtgagttgatgtacttcagttgtacagctgcatctggtagcaggccttaagtcagaatccaacagttattttagcccacacatggcccacccattattttatttaccatgcctctttctcacactgcacacttgtctcagtcacagttttggtaagcccatgagctaatcctagccaaattagtaaaaaataaacgtcactggagagcttctttgaaaaggggggaaagacccaatgatgagacagcagaagacttttaagactggcaacaaaatgaaagctgcatttaaaagaaaataccaagagtcctatttaaattacgggtgcattgaacctgctttgtataatatgtggtaactagctatccaacgaagccatgaaaccttcaaaactgctttgctacatggagaccaagcacctcgcattaaaaaacaagcttttgggtttttttgtttgtttgtttgtttgttttagtgaacacgaagaacagaagcaatcattgaaggccacagcttcatcaaatgtgtctgtactgagagtatcattgttagtggctaaatgcattgctaaagctaagaagtcctttactgttggtgaagagttgaccctgcctgctgctaaggacatttgtcttgaacttttaggagatcttgcagttaaaaaggtggcacaagttcctcattcagctggcaccataactagacaaattgatgaaatagcagaggacattgaggcacaattgttagagtggattaatgagtcactgtgatacgcagtccaggttgatgagtctaccgatgttgacaaggcaacaatgcttgttttgtgtaatgtatttttcaggaggatgtgcatgaggatatgttatgtgcacttttgttgccagcccacaccacagctgcagaactgttcaagtctttgcgtgattacatgtcaggaaaactgaactggtcattttgtgtgagtatatgcatggacagagtggctgccatggctggacagcttctggtttcactactcacatcaaagaggttgcttctgaatgtgagtctacacaccatgtcatccatagagaaatgctggctagccaaaaaatgtcacctgaacttaacagcattttgcaggatgtgattaaaattatcaaccacgttaaagtacatgcccttaactcacgtctcttcgcacagctctgtgaggaggtgggtgcagtgcacacatgtcttctctcacacacacaagtgagatggctttctaaaggtagatcactgatcagagtttttgagttacaagagccactccggagatttcttttagaaaaacagtcaccactggcagcacatttcagtgacacagaatgggttgcaaacctggcttccttgtgtgacatattcaacctgctcaacgaactcgatctgtcacttcaggggagaatgacaactgtgttcaaattgtcagataaaggggctgcattcaaagccaaactggaattatgggggtgacaagtgaacatggggatttctgacatgtttcaaacattagcagatattttgaaagagactgaaccagggccttctttcccccagctggtgcatgatcacctatctcagcttttaaaggagtttgagcattacttcccaaccacaaaagaccccccagactgggaaggaatggatctgcaacccatttgtggataagccaaggtgaatcgactttgtccgtgctggaaaaggaccaactgcttgagatcgcaaatgacggtggccttaaaagtatgttgaaacagcttcaaatcttcacacagtccggattgaagtcaaggcataatatccagagactgccccaaaagcactgaaaagcttgcttccatttccaacaccctatctttgtgaagcagagttttctgcagtaacagcaaccaaaacgagattatggagtagactggacataaacaacacacttcaggtatcactgtctcccgtcacccccagataggaccgtctagttgcaggaaaacaagctcagggctcctactgattcaacattatgatgagttgtataattattccattatatattacactgtaataataatagaaataaagtgcacaataaatggaatgtgcttggatcatcccaaaaccatttcctccccctggtccctggaaaaattgtcttccacaaaaccagtccctggtgccaaaaaggctggggaccactgctgtagagcacaggtaagtcacactttttgtggaataccacagaacattaagcttaagttaactatattcatacttcccatgaaattgtatgctctcttctgctagactataggttacataaagaatactgcactcgggtttaagaagaaaagttaaatttgataacatagtgtccattcacttaatgccttctgaattaagtaggaaaggagcaccattatttggccttgctgtctcagcatcttggttcagcttgaagaacaccagtgttcttcagaagtataattactattaaataaaaattacacaataaattataaaatcctaaaatataaataggtccaaggagctttaggtacatttctggataatattttgtaagttttggagtcagatcaaccttgctttgaatcctggccctgccatcttctactgggtgaacatggatatgttttgtaatctctctgattttcattctccttatctgtgaaataggatcaaaataataataactttctcatggggttattgtaatgattaagtgaattgatagttataaagtgtttagtgcagtatttatcatataataagtcctctagaaatatctgccattattaatgtattagttatttcaattggacttactatattaggactcccaaaggagatgattgtctgagttgaattttaaaggatttgaatggattagctcagctgagaagcaaaggaaagaactttcaggcataaagaataggctatgcaaagatatttgaaatacaagtaagattttaagaatgaacagtgtcaagagaccacgaggaaagccaccattctttcctgtgtaacatcacctagtgacacactcaaaacaagaagtggtggaaagggatgaaatataggttgtttttagtatagaattattgtttcttatgctcttatataaatgactgttaagtaaatatttgtgtgttttatgtattgaatatccaacattatagtcaaaattgaaagaataccaattgtcaaagaaagtagcatattgtggttaaaaactatagcaatggagtcagaagagctgaattaaaaattagctcaacccctaacagctatgtgtttttttgataagccaataccttttgaactctcactttttccctaaaacagatgatgataatgcctaccctagatcatcttacaaatatattgttaagctcaaaataacataatgagttcttgattatatatgatcaccaaaaatagtagataaattaaaatttaataattgattccagattacattattttgtcttatgctgatttatccttctaattatattttgcttaggataaaattaaaatctgtttttatttctttaaactacaccagcagatggcaaaaagatgtaacccagataattataatgtagtgacagaagtcattctggaatttaaaatttactataattaattggcaaaatagaaaataaaatattggttttgtagttatttgtcactgtcatttttattattttacaaatgcatacttttcttgtcttcagtgaatttaaaagcagttcatcaggaacttttgacaaatgactttgttccaccaaaccctttctgctctgtttttcagcattctgattttcccactttccagttcttgtacacatacctttgccatccaaaatagttgtccaatccccacttcctaatcccctatacatacatatacattttgcctgcccttgcctcttgcaatctctaattccaaaattagctcattccccacctccctatccaaccttttttcttcctctaggactgagctcagctggaaggaagtatatatatataattatccaaaaagatttgctgagcttaggtagtattttaatttttatgtgtatgtttaatattttgagtgataagcctctcctgacaccttgtatactcagccctccatgccatactggaagaataaaaaggatgtgccccttttcgtccccatttttctgaccatattcccaactaagtttataaagactcccgtcacataacttcattttcaattcggaaatttcataactggcttactttttcccttgggcctctgtcatacatagcacttttgccctgttctcaccccattgtattatttattatgtacctaggcatctgtcttctcaactttctataatataatttcttttaagctgtagaccgttcattcaaaaatatttacttctgcccatgttggagtaactagtgagcatccagagatcactagacatgcaaagaatcaggaaaatgtgatctataaccaagagtggggagaaaaccactcagtcaaaataaacacagaaaaacagggatggtggaattagcaaaaaggcattttttttttttttgagacagggtcttactctgtcactcaggctggagtgcagtggtgcaatcagagctcactgcagcctcaacctcctaggcacaagcaatcctcctgccccagcctcccaagtagctgcgaccacaggtgcacgccaccatacccagctaatttttaaattatttgtagagacaaggtctcactatgttgcccaggctggtctcaaactcttgagctcaaacaatcctcccacctcagccttttaaaatgttgggattacaggcatgagcaaccatgcccagccagaaagggattttaaaagacctgttacaaatatgctcagtgatttaaagaaaaagatgaacagaagaaaaatggaagatctatagatgaaccaaattccaggtctaaaaaatgaaaaatgcaatatctgaaataaaaaatccactggatgagcctaatagcagagtgaacatgacagaagaaaggataagtgaacttgaaaaactagtaaaagagattatctaaactgaagcacagagaaaaaaaatgcacagtgtctgtgacctgtggaacagcctaccatatatgtcactggagtctaagaataaaaggagagagaagcagagaggcactaaaagcgtttgaaaaaataatggctgaaattttttaaacttgatgcaaactatgcaaacaatgaacatccagcaggatgagcatgatataaactacatcagagcacattgtgatcaaattcctgcaaatcagttataaacagagactcttaaaagcatccagaggttaagaaaaaaaaggtacacattacatatagaggaacaaagattgattgcagacttcctgtcagaaacaagatgcaagtcagaagaaaataaaatctttaaagtgcttgaaaactaaactgtcaacatggaattctatatctttccaatataaaggggaaagataaagacttcctaaagactttttaggaaaataaaagaatttatcaccagaaaactcacactataataaatgttaaaggaagttcctttaggtggaaccaaaatgattccagatggaaacccagatccacccaaaggaatgaagacccccagaaatggtaaatatatgggtaaatacaaagactttttcttcacttctcaatttctttaaaaggcaattgacatttaaaattaataaagtaataacagtattgtgacgtttacatcatgtggaagtaaaatgtatgacaatagcacaaaggttaggaaggggaaatggaagaatatgtaaagtagattacatttttaagtaaagtggtatggtactgtttgaaaataaagtgtgatcagtttaagatgcatattgtaaaccctagatcaaccacttttaaaatactaggggaaaaaatcagccaggcatggtgacttatgcctgtaatcccaacactttgagaggccaaggtaggaggctcactttaggccaggagttcaagaccagccctgggcaacttactgagatttgtctctaccaaaaaaaaaaaaaaaaaaaaaaggaggaggagaagggaaggtagaatataacacacaaacagggaacgtaaaatggaatacagttaatccaaaagaaagcaggaaaagaaggaaatgagtattgtaatgtcatgtagtgatattgctatgaagaaaattgttgggaagcaatgcttcatgaatgttttcatgtttctgcatgatcaggactttctgagcaaagatttctggcaccggattaaagaattttgtttgtttgtttgtttgtttgtttgagaaggagtctcgctctgtcgcccaggctgcagttcagtggcgcgatctcggctcactgcaacctccgcctcctgggttcacgccattctcctgcctcagcctcccgagtaactgggactacaggtgcctgccaccacgcctggctaattttttgtatttttagtagagatgaggtttcaccgtgttagccaggatggtcttgatctcctgacctcgtgatctgcccacctcagcctcccaaagtgctgggattacaggcgtgagccgtcgcgcccggcctaaagaatgtttgaatggcaaacaagccttggaagttaaagacctgtggagagattcagagacttctccccaagataatttgttttccttctgaaggttgtaaacctagagaccctccccttctctccctgagaggatttgtttacaaagcaaaggtcagtaggtcatgtgcaggtgatgcatgctgcttcttcccccaccccagaggggagaaggagcagcagctgtgtgtgaaatgtcctatataggctccaaaatttactattagggagttattcttatcatgtaaccttgtgggggactggagaactaaagtataagtatttaaatgctgtctctgattcaaaaacctggtttttttttttctcagaatgaatgagtcaatacttaaaaattatattaagaagggagtgtctcctataaggtggtctgggaagtcctctctaaagaggtaacatttgagcagagatgtgaatgaagtcagccctgtaagactgtaacatgggagaagaccatatgtactaatctttattgtctctctcattgcctggtacactttttcacacataagtaagttttaaataaatagggctcaaggatatgacattgtgaaaggctggtcacttctggctagagtgttgtttgtccactctacaaattccagagtagctgcatcttcagacaaaatgacattttagtcgcagacattttagctaggaaaagatatgagtttcacgcctgtaatatcagtgctttgggaggccaaggtgggaggattgcttgaggccaggagttcaagagtagcctgggcaacatagcgagaccccatttctacaaaaaaaaaattagttgggcatggttgtgtgcccccgtagtcctagctaatcagaaggccaaggcaggaggattgcttgagcccaggagttcgaggttacagtgagctgtggttgtaccactgcactccagcctgggcaacagagcaagaccctgtctcttaaaaaaaaaagatatgggttagtaatcaaaatcagttaaaaactgcataaagcataatttatgtttcattaccttaaataaataacatatacgtctgcaaatgaagggttagggaacatagaatgaatttttagttgggagatttttttacagaggtagaaatagatgtcactcacttgattttgaaattactctcagccttttaaatgtggcatatacaaatgctgagaagaataaatatggttgaagaatacaggcagtaagaataataaattagtgtaatgaattttaattgggtaataattaatagtacaatctcctgttatagaggcttctgttgtcagaagcttgcagccaaaaggagaaaagatcagtgcaaaagccaaaaagcaacacatttggtgacttttggctgaagccaatattagcatgacctctttggttgaaagacttttcatccccctattaccgggtcattccttcctttggttcgaataatctctgagaatctgtaaaaaccacatcattgtcaagaagttaaaagcaattgataagttgttctggtaacacctgtcagtgaattaactcagagcacaaaacccaggcatttaaggagttgacaagtattattaaacctgttttgcaagagaagaagctggttcaaagagggaaaagctgtcaaaagtaatacaatcagtaagtggctcaggcctcctgcctggcacacccaggctctaaccacgtggcctctcatggcagggaagactggggccatgtatgaacatttatcactgttcctttcagtccaacctgaagacattgtggcattttaaaagctatgaatttgttttaaattcaaatatatttcttaggcatggttttctctgttcaggttttctccctcattcagaaatttacactatttttacctttaaatggtagtaacaatgtatttctactaatactgtttccttttctttttaatttgagcaatttaatttttctgtctttgacactctgttaaacctctttttttttttaattagaacaaatcatagtaatgctttcatcccaggagacggtgctttgtgcagatgctttcttgaacctgaacataatttcatgatttcaataaggaagaaagataggaaagtctcattcaaattaaattaggatttataattcagaaatgcttctgcctgtttgtaactaacttcctagttgctctctccactcttcagtttatttactttataaaaaattaaatccgccataaactgtcttagtctgggtttaacagaaaccagagcctaagacagaggcttaagtgcacatagtcagttagcactataacccccgagtcaagagcaggggacagggaagaaggaagagcgtatacaaaggtatttgacatttgcaagttgaccactggctgctcagtccttcaggacagtctgaagagacagaagcccaggggtggaatgagagcagcattcagtaaggctctgttaggtgacacctgcgagaagccagctggtgcccaccaagaactggtggctagtaaatgaggcagaggccacgtgaatctgatgtagtgacaagtggtatcgtataatacactaaaatattcttgtcgtatgtatttatgtgcataagaatataaaataacacacaaacttttagtccccacctttctttgtgaatacctgtcatttaacttttcactttttatgcatgtacatatcatgggagaacatatacctatatctttttccttttaaataacataaatcagccaggcacggtggctcacgcatgcaatccctacactttgggaggccgaggcaggaggatcgcctgagtccaaaagtttgagaccagcctgagcaacatggcaaaaccccgtctctataaaaaaatacaaaaaattaaccaggagtggtggtgtgcacctgtggtcccagctctctgggaggctaaggtgggaggatcatctgagcccaggaagttgaggctccagtgagccatttttgtgttccactccagcctcagcaactgagcagactctgtctcaaaaaaaaaaaaaaaaaaaaaatcaggccaggcgccatggatcacacctgtaatcccagctctttgggaggctgaagcagggggatcaggagttcaagaccagcttggacaataaaatgaaaccctatctctactaaaaatacaaaaaaaattagctgggcatggtggtgcatgcctgtaatttcagctactcgggaggctgaggcaggggaatcatttgaacccaggaggcagaggtaacagtgagccgagataacaccactgcattccagcctgggagacaaagtgagactccaccccccccccaaaaagaaatggaacatactaatctccttattccgtgaattattttcttcactcgtgtattacttgcatcagggttaggtttaatgccattgtcaacaagttgattttgccttgtaggagatacatcaggacacagtgatgaacatttgttgaattagtgcatgaatgaaggaatatatgacttctagttacagttcttgcttgtggaagaggaatgctgctgatactgggagtgcagtgggcaagatctggtaaaatatggagttgttattgtcggacagttgcccagtcatccctgccagtctccccctgcttccctaatcaacacctccacatcctcatttcagaacaggaatagatgctatacgggggagacacagaaaagagacaaagggaggctgggcgcggtggctcatgcctgtaaccccagcactttgggaggctaaggcaggcggatcacttaaggccaaaagttcgagaccagcctggccaacatgatgaaaccccctctctaccaaaaatacaaaaattagccttgcctggtggcgcacccctgtaatcccagctacttgggaggctgaggcaggagaatcacttgaatcaaggaggtggaggttgcagtgagccgagatcgtgccactgtactccagccttggtgacagagagagactctgtttaaaaaaaaaaagagagaaagagagacagagacagagacaaagggagactcttacaaaaatctgttcaatcagcaaatatctgttaacctcgtgtcaagtgacagacacattgcataaaatggagaacatgacagacttggtccctgtcctcatgcagggaaagtctacagttaagggaagaaagagacaagagtaggggaaggatgcagaagaaaaagaggagaaattagtaaaataccaaaagagtgaagaatttcagtgatcactgaattaatacaatgcttgtgttaatagaagttgtttagaaatgagtttaaatcccagccatctgctcccacatcaaacacacctactgtacccatgattttgcccttcccccacatatatatatacatcccagtaataatctggtgatttttaaatgaattctcacagttagtaataaaaattacacttgattcaaaccagtgaattgtaacccagatctaagtatagatgtagtggaaatcataagtttctttagtgacagtcttactaatcaagttatttggcctgtttttagccacatggtatattttttctttttcaggttgctctgagtgttgtttgtagcagcatcagtaagccaagaattcacatagttactcaatcacacagattactcatcattgcctgttcataacagaatcctaagatgtttaagatttctaatgcaaatcaaaatctcatcatcacttgtcattgctaaattaaatgacaggataataacattacattaaaaccatttttctcttgattgagtacctttttcagaagtgaaccttctagatgtatattttttttcatcagtactataaatgcatttagaatccaagataaaaatagaatttaaaggggaggagtgggatgttttcaaattattgatgaggctcttttgaatctcaaccatatttgacagtgtactgcaagggaatggagtagttcagctcaatttattgacacttttagagctatataaaggaggttaacaggttgagcttggtctttattgaagcaatcgtgtgttcttagcatcagttatatgtcatcccgttgcaaactggctgttaggacttgtcattgctctgttctaatataagatactgacttcagatagatcacaacctatgtggaaaattaatataaatttctaacctgtaaaagcagtgtaggttctcagtggccttaccattgtgaacttacctctttacctttctttcctatctaaagctagttaaccttttttggtcacacctaccctctttttatctgctccctctggcccttggcccacttctctgtggccagctagccagtgttcgtgccacctgagcccatcttcttcacttgccctagaactccccagaatgcctctttcattttaaagtcaatcatttccttccatccttcaaatattttatttcctcacaccttccatctttaataatatgaaatataaaaatcttaccctggatcaaaccttttattctttttgcctcacttaatactatcatcattaggcaataatagcattatggtaaaaattcttacctcttagagaagctgatgaaggtattgactcaaacaagattggctatgaaacaataagtattaaattattaaatctggatgataggtgaatgagggaaagggaagccagtatgctgttttctctacttttataggtttgtaatcttccataataaaaatttaaaaataacttagctctttagtgttccttttttaaaatagacaccctttttgagtgagcacgtgaaatgatgtggtatgcaggatggactaagactaaaacctgatcctgctctctgaacaccccactcttactctaccccttagtaaacaaaaaagattctttagcacctggaattgtaacttccctcttctccttaggtcctgtacttgattatcagaatcctggtctggtttaacacttcctgcttcttggtttaacacttcctgcttcttgttaaagtgaccagataaacccatatagaaatatacattaatttcatcccatttattaaatcccactgtgaataaagttctgtgctggcattaagaaagagaatatgaaggaaaagtattcatgaataaccctgatgcagtacaacactagccacagtagtggtctctaggagagagagaggaattctgtcaaggagactcattcttgataatgatgcaaactactaaatgtcatcctaaaggaagagataatcttcgttgcttctgcttatagttctaattgttaagactatttagagctctaccatatagccttccctctcttctaaagaacttaaattgattacagttaccaatatgcttttttcttctctttttaaattacaatagtcttacttctcgtttgccaaaaactggagaaaccatccatggacataagttttttattggctttggagggaaaggtgccaaccagtgtgtccaagctgctcggcttggagcaatgacgtccatggtgtgtaaggtaagtacaaagtatagtggagaggactctagaggtaagaatctggttttaagactggagttcattgtttttaattttttcaaccattttagagtgaacagttcagtggcatgtaatacatagagtggcatttaatacattcaaccaccacttctgtcttgttccagaactttaccatcattccaaaacaaaatcccttaccccttaagcagttcctcctcattctgtcttccctttaaagccctgggaaccaccagtcttcattctatctctatggatttatctattcgggacatttcatataaatggaatatatattatgtgacattttgtacctggcttctttcacttagcatactgtttttgaggtacaacattgtagcatatatcagtatttccttcctttttgtggttgaataatattccattgtatggatataccacaatttttttattcatcaatgaatggattgatggacacttgggctgtttccaccttttggctgttatgaatagcagtgctactaacatgcatatacatctacttgagtacctgctttcaattcttgtggaagtttattgtttttaaagatctaaataacagagaatagtctcccttgtcctttatactaatttctacctcattgaatcctctgggaagtagcagttctcaaataacttaatgctgcattccctgaatgtaatgagtttgtaactggggtgtgagaagtgagggaaattagcgtactccaatgggtttctgtcatccagcttctaaacaacagcatgagtcaccttgtttttagcaggtttcaccgcagcaacacagcttttggaaacttcttgtaataaccggtgatttactcatctctaagtcattttcttctaatgctgtatcttagatctgaaaagaatctgggccttaatgagctacatataactgagcttttggcatagttttgttttcatgtatgtagagatatgatattgtaacatacagtattcctatttttatccatgctaccgaaataatttgaaaataaatgggctgccaaaagttttcacttttcatttttcatgaaattttaaggcgctagcattatagcattagtataacaggaaaggtagatgattgtgtttctttgatttttagggaaagccagcctgtgtctgcacattattaaagggcaagaaaaatacaaggaacttaaaagaatgagctttctcctgtgaactatgtagattttaccaaaaattctcgaaatgtcatttttcattgcagtcagcacttttctctccacaggagttttaaatgatgtataaactatacaattatcactccatctgctagtaaactgtaattttatttctaacctatgattaacataattttcacatggctatttggtcaaaaacatcacgtgaagcatcagattcaaagcaagaaaccctcttttgctaagattgagctcttgatagatttaaaatatcagtgtaattaatcagcaattaattatgttccaggaattatgggtctgtgagaggtggctgattaaaaacttaggcctgacccatctcatacctgattagctatggagcgtttggagagtaatcagatggtgctgacttaattaagaggacctgggaactggaaagaggatgatataatttcctgtgtaggaaaacttggacatagaattggcgttggaagctatgcacccaaaatggcttcgctgggaagaggggagttcctagagctggagacattaaaggagagattagagaacccctctcttggatgttttatggaagctatttatgtagccattaaagtcaagattggatgtcccctgggatctcttccaaccctaagattatgaaattgattttattttaggtctgttgaatttgaggcaaagaaagaaatgacaaagagaaatatttgagttatggaactgaacgtgggaaatgaatcctaaaaccatatgagtggataggagaggaatagaagcagggggctgtattttgggaaatgttccagttaggaggttgattaaagcaaaggtaccatttgtgtgtgatggtttatgttagcatctgtacaattttgaaagttctatacatctaccatgcccctgatttagtcacctaatgcttagcaccacagtggattttagcctgtgtgtctgcctagcagaggatcaaaaaacatgactgcagctaaaacctatccagggtaactttggttagataacttggaacctttagacatggaattatttaaaagcttaagcaaattgcataatattctcagacttcttaaaaagaaaatcatatatttttgtaaaagaagttattatctgtccattaatcatattttatccattgtgagatacatttttattaagcaaattagccaaacttgctttatagcagttttttaaagatgacaagttctaagtagaaaccaaaaccatgaaatttatcaagataaaaatgaacagaaggagcaaaagaaaaacaggtaaaaattttctatggctttctcagcaagatttatttacctcttgctacctataacaaactaaaattcaaactcttatgaagtaagattgatggcccaaacaaacttatattgagctagggagaaatatttgttaagatattgtgacaaagaatattaaatgagttacctcattatttatacagtgatacatgtataatgaaacacttcaagtacttaagagttagtcagtatttagctgagtcatggaccaaagctacagtctagtgataactggagatggtattttcagatttaaaatcctggcagatattgtataaaatgaaagtcttcctcccagggcaaagagcctattaggacatctttcttaaatcttcacctgagttaagtgtttcctgctccattccattgaagccaaatgttaagaagaggaagttattcctaaacatcaaaagttggcagttcaggagaggaccatggtcaagtaaggaactcaagatgcactggcccagtatgagcacagaaaccatgagcaggtatgaacccaaatgacccaggtcaggaatcagcaaactggaaacaccttcaagaaattaccctgtcttgcttccttcaaatgtgagactatcaaactatccttcaaatatgagactatccttcatatatgagactatcaaactctctaatacaggtagctatctgttttcccttcagaaccatcaagcatgaagttttgtgacagaggtgatactgatgcaggctgccctgaggggcttagccaaggagggttcttggctttgcccaggcaagaatttaagagtgagccaaggataagaaaaagcaactttgtgtggtgggggggcggggggtagtaagaacacttaacttgagatctaccttcttaagagcattttaagcatacaataaagtattatgaactataggcacgatgtggtacagcagatctctggatcttattttatcttgccaaatgggcaggaggaaacttggaggtgatggatgtttattacactgattgtggtaatggttccacagatgtatgcatgtattcaaacccatcaaaatgtatacattaaatatatgcagggtttttattataattatatctcagtaaagctgttaaatattaaaaaaaaaaaaaaagaaaaagcaactttgattgaaccagtgctgcagggctaactgataggctatgtgcccagagggtagtgtatgggctgttagcaactatatttacatgtactttaaattatatgctaattaagaggcaggttattcagaactttttggaaaaagggtggggaatttccagaactataaaaggtaacttctgggccattgccatggcatttgtaaactatcttgggtccagtaggagtgtcttgtgctaatgagcagtgagagcaactagaggtcactttcctcttttcagccagcgtcttcattgcaccatgttttgaccagatcctgcttccaccagcagggtccaactggaaaataagacctgctggcctcctaactcggtacattaaggtggtgctgttcaaagtccagtcctcaggctggtgccaggctgcatgcagattgtcaccggtccaaacagcacaggaattgagagtaagcagttaggatcatttatagcaatttgacagaataactttacaaccgttgaatataatagtaataataaattaggccttgtagtttgtatgactcttttttgttttcatctccttgttattgtattttataaaattgttagtccacaatggattgaaaacaagaaaaggaaaacaaggccagtgcttctccacggatagcttgaaaagcagtgcattagagtatccatcaccttaaccaaaaagtaccttctgtgctagattactgtgggagaatcatctgatcatgcattgagattttcattttcagagatcaaaaattagtcaccaggtctttccaggtaatatataatgaggtgaaatctgtcctttcctgaactctgttgaaagacagctagatataattagttggctatgttgattggaatgcttagccatatgttcaaacaaatgatcctataaccaagcaaataatataaaccttgtataggaagaaatggtagaaatgagagaaaataactggattatctcaaacctatcaccactctcagataatcaggcctaataatggtgattgcagcattaactttgtatattaaaggtctttatttttttctgagacaggatctcactctgttgcccaggctagagtgcagtggtgcaatctgggctcactgcagcctcaacctccccgggctcaggtgatcttcctgcctcagcctcccaagtagctgtgactacaggcatattccaccatacccagctaatttttgtattttttgtagacaaggttttgccatgttgcccaggctggtctcaaactcctgagctcaagcaatctgcctgccttggcctcccaaagtgctgggattacaggtgtgcaccaccagcccaaaggcctttttttttttttttttttttcagagacaggttgcctgggctgtagtactacggtgctacagctcactgcagcctcaaactcctgggctcaagcaatcctcccacctcagcctccagagtagctgagactacaggcatgcagcaccacacccagctaattttttaattttttgtagagatggggtcttgctgtgttgctgaggctggtctcgaactcctgtcctcgagcagtcttaccacctcagcctcccaaaatgctaggattacggcataagccaccatgcctagcctaaaggccattattaaggtaaacacccctttatctaggatttaaacaaccagcaagctttaataactgagattttatatattcttcttatgtattttgttataaggccacaaatgacaagttaaaagttaatatgaaggatttattcaaaaaagcaacagctgggttttgtatgacaacaaatgcaacttagtctcctcaaccagctgttcactataaccctcaggcactgaaaagtgacaaaatgtcttcagttgcaaggattaaattatattcatcttagttttagtgttaaacatattttctgtattctaatgctttgaaatcggtaacctgttttaatatatgtgataacttcttgagcagaatattcaatttcatgtggccttgggtaggatgttttgatatcctgtgttttatttaccccaaatgtatgttgaggagtagaattactagatggtttctgccatttgaggattccaagcagcctaaacaaccattcctcagtcattttgcaaaatagaagttatgatgctgactgaagttgccctccttagcttcaggtcatagttctggactctggaagccctcccaaagctcttcttcaatgcagaaagatccctcccagtgataagagtgaaggaagcacctcagtccccttagctgaagaaatgctcttgttcctcatacacccagcccttttgctttccatgacccttgctgcattgtcaaatacagaagccactagccacatgtggatatttagatttaaatgtaatcaaagttaaaaaattgaattcctgtcacacagtctgtatttcgagtgtctgtattgggcagaacaaatagaaaacattttctgtattggacagcacagatatagaacatttcatcattgcagaaagttctattggatggcactactctacaatattcagggcggaactgagcctgggatttccaaagagcatgttgagttctgagagttcccttttggcttatgtgcaggtgcttgtccatagttgctcttgacctggcttccttcacgtggaacaagttaacacagacaggttatctcagactatgcgggtttccaagaatctttctacccaaaagtatttcactgctgtagtcaaaagagtgtgagggtgccttcaaggaggctgttggaaacaaaaccttgtatggaaccattctagaatagtttgggtgcttgtagtcatgttccttcaagaatggaacatgacagccgggtgtggtggctcacgcctgtaatcccagcactttgggaggctgagatgggcagatcacctgaggtcaggagttcgagaccaccctggctaacatggtgaaaccccatttctactaaaagtacaaaaattagccaggtgtgatggtgcacacctgtaatcccagctactcgggaggctgaggcaggagaatcacctgaacccaagaggcagaggttgcagtgagcggagatcgcaccattgcactccagcttgggcaacaagagcgaaactccgtctcaaaaataaaaaaataaaaaatttaaaaaaaaaagaatggaacatgactacaagatgggtccaaggaaaatgaacagaaggacaactaatgtgatcaaatcctaaagaatctccagtaagcttttaagaagactagactaacaaatatgaaatcgccaacaatataagatggtattgaactatgggcttgattaggaatgtcataggaggtgtggagatgagaggattaacaagggccagagtagggaaggtagaccttaagctgatacttgaaaaacaggtgaggtttgatttagtggaggagagagggcaaaggacttctaagttctcagaaatgatggtaaggaaacagacaggtttctttctattgatatatccagaaaggaacaattttctgtggaagaatagaacacaccaggagtgactgaaacctggattgagacatagtccattgaagtaatgctcacctgcaggacagaaaaatagaagttcagttcagaagtatagttcagaggtagcaagactaaaggcctacaggagccaagcaggtaacagaaattgcagtaggctaggtgaagccaagagtctatgagcactttaaggcactcacctctcagttccaggtggtttgccttgcaggaatgtggacccagtgttaccagaacctctgaattttcagaaccccctggacatctgtctgtttttgtgaagtcttctaatatttaagtattgagaactgataaaaatagcagggcatttacaccaaaacctgcacacagatatttatagcagctttattcataatttcccaaacttggaagacatcctttagtagataaatggataaataaactctggtacatcgagacaatggaatatcattcagccctaaaaagaaattagctatcaaggcataaaaagacacagaggaactttagttgcatattactaagtaaaagaagtcaatctgaaaaggctgcatactgtgtaattacaactgtatgatattctggaaaaggcaaaactatggagacaaaagattagtggttgccagaggctagtggggagagaaggatgaatatacaaagcatagaggatttttagggtagtgaaactattgtgtatagtactataatggtgggtatatgacattttacatttgttaaaccctatagaatatccgacaccaagggtgaaccctaatgtaaactatggagtttgagtgataatgatatgtcatgtaggtttatcagttgtaacaaagtaccacttagttgcaggatgttaatagtgggggatactagttgccggaggagacagagagtatatgggaactctgtactttctactctcttaggctgagaacctaaaactgtttttaaaataaagtctagtttttagaaaacagtagtagggcaaacaaaacatatctagcagtcagattgaactttcagcccaccaatttacaacctctgctgtagattcaactgtagagttcaagccaaggtccagccaaggtagcagtcagacaaatggttagcattagaggggtatgggagaagataacaagggtgtcctgactagcacagtgattgcagcaccacggaggccagaaacggacagtagggagatgtcgataagatgccagcattagtatcaaaggccttgcaatcatagttttctggttttgagccacagacctaaaggcctggcccctgcaaatggctggccaggcagagaagagtgcctgttctgaaagagctagagggctaaccagatgattaggatacacactcatgctgacaaaaacaggggagatccagttaccaaagtggaccacaaagcaagaatgtggtcacaggatccagtcacagacaaagctacttaaattatagttcagtggttcagggttacactaggcactaggctaactagctttttcttttcttttttttctttttttctttttctttttttttttttttttttttttttttgagacagagtcttgctctgtcgcccaggctggagtgcagtggcacaatctcagcttactgcaacctccgcctcctgggtttaagcagttctacctcagcctctcaagtaactgggactacaggcgtgcgccaccacacccggctgatttttgtattttcagtagagatggggttttaccatgttgaccaggctggcctcgaactcctgacctcaggtgatccatccgccttgacctcccaaagtgttgggattacaggcatgagccaccgcacccagcctgaagctagtcaggactttgttaataacagacaatagacacccaattcaaaatagcttaagcaaaaaaaaataaaataaaatttttaaaaagaatgtattgcctcatgtaactgaaaagcccagtggtagagctggcttcagatgacttagggttccattaggctattaggagtctgtgtctgtttgtgtctgtcaccctcctgctttctgttatgtttctctcttttctttctagctgtctccacatggtgagccccagtggctgcaggcttacattctcttatagccagcaatcttactgggaagaaaacttgtcttccctggtagtttcagtaaaagtcccaggactgagtcttattggactagtttaggtcacatgctcattcatgaacccatcactgtgactaggatggtggaacacacttttttttttttttttttgagacagtctcactctgtcacccagactatagtgcagtggtgtgacctcggctcactgcaacctccacctccgggttcaagcaattctcctgcttcagcctcccgagtagctgggactacaaggaacatgctttttaatcaggcctgggtcccttggccaacctaatcttgttgtctatagaatgggacagaaataggtgtccaaaggaaaaactgaaatacctttaacagaatagatgctaggatgcaaaaacacaattccattataccaagttacccaagttagctagggcctttaaaatttccttctctttgcctctatgtgtcagtgtcaagggagaagataaaaagattctggaacatcaggcaagtcatgacaaagatacccatatttacagtgaagtacaaacagctgagattcttcataaatattgaggattgatgatggtagataactctatctcagtgggaattatcacatgaacagctcaaaatgagaatgacttaatgagtgatgttcattaaatacttcacattttaagtaggatataagtgaaacattatataacaattctttgggctgcaatcaagtctagcatcttatattaagaagattaattagttaatgtttataaagtactgtgcagatatgcccttttaaaatgctaagtattctaaaaactacattgtagcattttactaactctaaaagatctaatattcattatttctttggtacaggttggcaaagattcttttggcaatgattatatagaaaacttaaaacagaatgatatttctacaggtaaaattcccaccttttttaaagttagtgtttatagcttttttctgtgattttgttatgagaaaaattgaatctagaggaggattattagaccttcccctggtggccagagaatttctatgcacagctttgtccattcttgcttaaatgtccttgggttgattcttccctgtacattcctccagatgggaataaaatgataggaggttacaaaccttcatctcatgaacatgtgacaaatgacaaggagaaaaaggtgctgcattcacaaaagatgttttaagaatgttatagctggcaacaatcattagaagccatacaggctgaaaccattatttcacagaagagaaaaccgaaggtcagagatgttctgtgatttctgcaagagcacacagttggttggagctagagccaggactagaatgaagatcttctgattccagttcagggctctttgctgctaccaaaggctgcctggtcaacatttctgtttatatgccagaccttggttcttggtgaaataacaagcttatgagaatgaaaataatcaaacaagttcattttatagatttgacctttactttttatctcaactctgacattcctttcaatgaagaacataagtgtgttggtctagaaaaatgcatatgtatacaattatgaataattggggggaatcgaaagtaggagcagtttggtgggttgttactaatgcagagaaaaggtgcaactacatgtaaagctgtctatttttcttgttgtatagatgatgggtataaattagcactaattacttatttttttttatcattccagatggttaaaggttaaaaaggttttccaaggattagtgttgtattgaaattgttaaaataaattatccatgccagcctgtatacatgtgattgtaattttcttttttctttcagaatttacatatcagactaaagatgctgctacaggaactgcttctataattgtcaataatgaaggtaagtgttttgcatattggagtgtcatttcataagacagtgtatttccagagttagatcagaagcatcaatttttaccataatcctatggacctcttactatacccatcactccaaggcctaaaacatagtttttccaatccaaatataaatgtgtttccctttatttatacttctcacatggatcgttcagataaatttttggacaattttcaaaattgtcaatccaatatatatgaagttgcctcaaaataatatgtatatgctgtaatgtccccattacccttcatgtgaacttataattgacatttgtctctaaaagcagtcaagcattcatctgtcatttcagttacactaggtaagtatatgtaaataggtgcaaagaaaagtttgatgagtcatatttatagaatatgttctgagcaaatggcagcaactaattacatccaacttatcgttagtgttcaattttgtctttcaacagcaatcaaatctcaaaagtctatatatacaactaagtctgccacaaggctttgccatagctgatacatttatcttttaaaatagtaattgggcctggcacagtggctcacacctgtaatgccaatgctttcagaggctaaagtgggaggatcacttgaggccaggaattcaaggctgcagtgagccacagtcccaccactgcacttcagcctgcgtgacagagtgagactctgactctaaataaataaatgcatgagtgaatgaatgaatgaatgaatgaattaaaacagaggctgagcgtagtggctcatgcctataatctcagcattttgggaggccaaggcaggtggatcatttgaggtcaggagttcaagaccagcctgaccaacatagtaaaaccccatctctactgaaaatgcaaaaacaattagccaggcctggtggcaaatgcctgtaatctcagctactcaggaggctgaggcaggagaatcgcttgaactcacaaggcggaggttgcagtgagccaagattgggtgactacactccagcctgggcgacgacggagcaagactctgtctcaaaaaaaaaaaaatggtaacaaccttcaagtcaagttttcataatttctgccaactgttttaattataaaaacgcctacataagtttttttaaatcagaatcaatattcagaaggaccaagcatttcctggggcacctaggacagaacctcatgtgttgtggacagcgtgcttgtgttaaatgaggatttgtcacaatgtgtcttttatttataatgcagctttgcagcatcatttctcacagaaaatatggtatttttaactcggctttagtgattccaagtagcaataataacgatatatttcacctaaaggtggtagataaaagtttgcattctaactatagaaagcctgtgttcatttaagctacattttaagtaactattcctgccaacagcagctcattccttgtcttaaacctcttttgttgttgttgttgttgttgttgttgttctaggactatcctcaagttctctttcttatctatgaacaaaatctgcattttccatgcaaagatataatgtcatagtgtgtgtcaagtgcctatttggtagaccttgcctggtttacagtgtacggtaatgccctcaagactataggtggtaatagaagaattaggacaaatacacagagatgggacaatcagctcctttaaatgaaggagtgagtttgcaagataaagtaatgagtttagttttgactagttaaatttgaggcatgaataagctagccatatggcattatccatcagacagctatagtcttgggcttgctgcttagcagctaaggccaggccaaaaatttggatctgggagacagcaacatggaagcagcagctgactccaacagagaaaatgaggtcactgaagaaaaggaaggagagatgctgtctttcagcaagtgggaactttgaatttttctaggactgaggttaggtttatgctgaaccatccccactttattaagtcttcctcgtggccaacaaacacatctgtggtaagatgataggatagaatttgttctgtgttgagaggtgattttaggtcatgtctgtacaagatcagcacgagcagcccggagcacagaaaatgcctgctacaactcattcctccagatcagtgttgtccaataaaaataaaatgcaagcctcgtgtggaattttaaattgtctagtagccacattttaaaaagtaaaaaggaacaggtaaatttaacttaggccatatatttaacccaatatgtccaaaatattatcattacagtgtgtaatcaaaaatttatcttggctgggtacggtagcccacacctgtaatccccgcactttgggaggccaaggcgggtagatcacatgaggtcaggagttcgagactagcctggccaacatagtgaaaccccatctctactaaaaatgcaaaaaaaaattagccaggcgtggcggcacacccctgcaataccagctacttgggaggcttaggtgggagagttgattgaacccaggaggtggaggctgcagtgagccaagatcgcacgactgcactccagcctgggcaacagagtgagaccccaaaatttatcttaatttttttttaatttttaaaatggtaagaataaatggatattttaccttatttcctttgtactatctttgaaatccgcttgtattttacttgaagcacacctcagtggactagccacatttctttttttttttttttttctgagacagagtctcactcactcttgcccaggctggaatgcaatgacacaatctcaggtcactgctacctccgcctcccaggtttaagcgactctcacgcctcaggctcctaagtagctgcgactgcaggcacataccaccacgcccagctaatttttgtaattttagtagagatgggttttcaccatttgaccaggctggtcttcaactcctgacctcaagtgatctgcccacctcggcctcccaaagtgctagaaattataggtatgagccactctgcccagccaggactagccacatttcaaatgttcaatggccatgtgtggctcgtgctcatgactaccatgttggacagcacagctcttaagggttcaccttacagatgaaatgcaccaccacccctgcctcattcaggtgggattatagacagcaggtccaagtaataagaatatatcagattccttagttctgtttctgtttgatccattatagtataagccaggtatccctctctcctctatatctgatacaattttctatctgttagatatttaaaatgtgttttgattgacagaatcactttttagaataccatagggtacacacatgaactgcttgcatactacagtgtcatacaagtttattcctatttatattcatctctatggcatctgtcatttaggattcagaacctttaccgcatacatatactagctattttctataaaagaaatgtttaaagtatgttatatgtcatttctcaactaatattctttatatataagaatattgggaaaatctttttaagattttgcttaaggtgatcagaataatgtgcatcttacagagatattataaaagatacatttggaactcaaagttcaagctgaataacctagaaatgctaaaattaatacttaataacacattttgtataatgactttacaagggcgattgtattcataacactgcagaatatcatttgcttggctttgtttagttttaatataataggtggaatttctttataggccagaatatcattgtcatagtggctggagcaaatttacttttgaatacggaggatctgagggcagcagccaatgtcattagcagagccaaagtcatggtctgccagctcgaaataactccagcaacttctttggaagccctaacaatggcccgcaggagtggaggtaattatacatatttgtcattctttctataaaagcttttatcgctgtcttaattaaagttaaccttttaagttaagcaaagcaatactctttctgtcgtaaaatattctttcttccatctgtgagattcacagtcttgtggttcttgataatgttagaaaaccttgcaaacagggtaaaaaaaaaaacatgagtagcatttccgatatcccgcaatataaatcttcaatgtagctggcagaaatggtacaagtagaattagaattcctgtaattccagctactcaggaggctgaggcaggagaatcgcttgaaccctagaggtggaggttgcagtgagccgagatcgctctgctgcactctagcctgggtgacaagagtgagactccgtctcaaaaaaaaaaaaaagaattcctgaatcagccccttgtccaaggtacactctaggtggtgaaatgttttctactctgagaagcagaggttaagctgcatgtcatacatacaaatacatgcatacatacaaaagtaactggggcagcccagttactttttgacaaacatctctaggaattgaagattaggttttttctcctttttgtaaaactttatcatctttcaataaacaacaaaagattatttatatgtaatattttctatgttatcaatgtccattgacattgcctcttttgtttttgattttggaaattttcaaacctacaaaagcagcagaattgtacagtgaaatccatcacccagcttccagttatcaacctgtagctaatcttgattcatcttttctcccactcactcctcttttctcacctccagcaaataacaaactttttaaaaatccagatgatttatttgtttgcttccttttcaccactgactagtggggaaagcatcttctgaattagaatcccatttctgtcccttgtcagcttcgtggtcctagcagaattacctgatttgtctgagccttttcagtaaaatgcatatagaaatactccatctgcagaattgttctcaggatggaataaaataaaataggatgccaagcatggtgtagtacatggtggtaaatcccaattttttcctcttcaatccacttctctctttaaagttaggataatatcctgatcaagcatcatttggtgaaaaaaatcaaaataaatagtagccactctaacatgatgacttcttgatattgtggcaatagttctgtgatttttttaaagaataaaatagagaaccacactgactatttctcaagatacaaaactaaaaagaaaaaagaaaaagaacagtgtgtgtgtgtgtgtgtgtgtgtgtgtgtgtttatataagtgatttctcccaaagtgtgtagtgttctacatagaaataaatggaaaataagtcactgaaatgattttgtggagaattttaaaatgttcgtcctgatttaacaaattttcctcttggcaaaacaacatgctgtggtaaattttccctgacatttagtgtatttttaatggacatgaagctgtcagaaagaattctaagccaaaacccatttggttccattttcttggagtgtcacagtaaagtctaatgcttatggttacgcattctctgcaccgtgcccatctcagcagagtgatgtgaatacagggtgccaccctgctcctgctcttgtctttctttgtatagatcaaagcacattctcgtgtaacttctctttttttcctactatcccttactgctcagagatcactgttccctctgtcctagtctagttgcctgttacctaccctgcttgtgaaggagagaaagatacagcagccacagttgaggagctaacctttcacaggtgagaatagagtaatccggatgggcaggcagcctaccctggggctgtcattgggtggggtccagaaaggcttcctccatcaccttccgtgtagctcttccagttgggagctggaggacccaggacagcaggaagcggggtaggtgacagtgggccacagaccacttggcctacttcacacttttattaagagccagcatgccttggtattaattctgcatgaacttccttatataataatagcagaaatagtaataccatgcatttatatgtactttacatcttataaagtactttcgtacacattttaccctcagaaaaaccttatgacaaagatatggcaggcattgttctctcagattaaaggtgagaagactgagactgagaggttaagtcatttgttcaaacagtgtcgcactttaagttgaagaaaccatgatttcagactctaagacccaagttctgtctcctagtttaaaccacactttaaagtgccacaacccattgattccaacaaactgagcctttatgaagagtatctctagaaaagtcaagtccataaattttaacactgtccagcacgtggcctaagctttatgtgtttttgctgctcaagaaacagagaagaggctctacagtgttttcagcactgtaaccccaatagaacttacacacacacacacgaacacacatgcacacaagcacacacactcatgtgtccattactcctccagtccggtggctttctctggccaagtcagctggtccctatttggtagataccggccagatgcagcttagattctattccatgaggagggtgtgtgtgtgtgtgtgtgtgtgtgtgtgtgcgcgcgcgcgtgtgtgtgtgtgtgtgtgtgtgtgtgtaatgcatcatcattctcatatgcaagaagagtggtatcccagcactttgggaggccgaggtgggtggatcatgaggtcaagagatcgagaccatcctggctaacacggtgaaaccccatctctactcaaaatacaaaaaaattagccgggcatggtggtgggtgcctgtagtcccagctactcgggaggctgaggcaggagaatggtgtgaacccaggaggcggaacttgcagtgagctgagatcgcgccactccactccagcctgggtgacagagcgagactccatctcaaaaaaaaaaaaaaaaagaagaagagtggtataatgaaaggagaccattggtttgggaattgtgaaatatggctttaaattcataatcaatcagcaaatgggggatctcagtcaagtaagtcagttcctcactctggacgtcattttcttcttctgtgaaaccagaattgggctgacagctctcacagttctttcatgtcactttggactgatcccagagcagagtgggcttaatgatctcttgagcactgagcaccctacccactgccccaggaagctgcctatgtgctgaacagcattattccgtcttcaagaacgatgataaagtcttcatcgtcatcatcatctatgggttttcttatcacagttccattatctttactgcttacaggtagtgaattttgaattaagcacattgcataactagattatgctaatatatcagttatgaaaatccagaggaaaagatccctacatctttgaatatactgtctcaaaactctctgtcgctatcaaaatgaaagcattgatttttaaagacatagtagctacaacaccaaaaatcggtagccctgtatagccacccccatccccaccaggccatgaagctatgaggtaggcccactgaagagccagtgctgcagctgcttgtgatgaaattatgcatgttggttctggtctttatatccatttccaagcaaatggaacagtacataaacaattataaataattgagattgtaaaattgccaaagttaaattatcagtatgatacaaagtatcttttaatgccacttcagtccttttgcctttggcaaacaaaacttcttatctggccatccagactttcacaatgacattgtccagcacatagcccaagctttgagtgtttttgctgctcaagtcacagaaaagagcctctagagtaatggacagcaaagccagtattttgagtgtcccaacatgctcacagtgtcttcactcagggtgattttcttccccggtttctctgagctaataattagggccttcctaactgtccagcccctgccctccgtgacaacaccataaagagtttctgcctcattttcctgccttttagcctatacaactgctcctccaggcctcaccagttccttattgacattattgtgctatccattaacatgcagttaagataactaggagtttagttcatctgacactgtaattaataataattactgttgggtgctaccagtcacctctgcaactccaagttactccatggtacagtctgtgttctctagctctgcctggtcccaggatgacatcatggcttccaccttgtctattacagatttgcattcttctttgattaactgcatctactaatttatgtttctttcatcatggtggagtatgctcatttgtggtagcacaagctgagaagaatgctttctttatggcatttacacttttcccctaaatttagttaccagtcagactctaagcctatgtatccagttactattgaagaatgctgtccctcagtaaagtacaggcaaataaggttgatttttatacagtatttacagtaaaattatggaattccttattctagcaattggtacctaaattttaatgtaattttttccttaaaatttgcttttattgtggaaaatttcaaatatatatagacatacagagaatagtatggtaaacctatatatactatcatttagcttcaacagttaccaacatgtggccagtctttttttctacttttaaattccatcttttattttagacacgggggtacatgtgcagacttgtttttgttttgtttttgtttgtttgagatagagtctcattctgcccgcccaggctggagtgcagtggcatgatctcagctcactgcagcctccacctcccatattcaagtgattcttatgcctcagcctcccaagtagctgggattacaggcaggcaccaccacacccagctaatttttgtatttttaatagagatggggcttcaccatgttggccaggcttgtcttgaacttcttacctcaggtgatccacctgcctcaacctcccaaagtactgggattacaggcatgaaccaccgcaccaggccttcatatgcagatttgttacatgggagtattgcgcccaggtagggagcacggtactcaataggtagcttttcaacctgtgcccctccctgctccagtactctgtagtgtctgttgttcccatctttctgtccatgcgtactcaatatttagcccccacttataagtgaatacatgtggtatttggttttctgttcttattttaatttgattaggattatggcctccagctccatctatgttgctgccaaggacatgatttcattcctttttacggctacatagtattccatggtatatatgtaccacattttctttatccagtccaccattgatgggcacctaggttgattccatgtctttgctattgtgactagcatggtgatgaacatacaagtacatgtttcctttaggtataatgatctgttttcctttgggtgtgtaccaggcataggattgctgggtcaaatggtaggtctattttaagttctttgagaatcaatctccaaactgctttctacatgactgaactaagttacattcctgccaacagtgtataagtgtttccttctctctgcagcctcaccagcatctgttgtgttttgactttttgttttttgtttcgttttgttttgttttgttttttgagatggagtctcgctctatcgcccaggctggagtgcagtggcacgatctcggctcactgcaagctccacctcccagattcacgccattctcctgcctcagcctcccgagtagctgggactacaggcacctgccaccatgcccggctaatatttttgtatttttagtagagacagggtttcaccgtgttagccaggatgatcttaatctcccgatcctcgtgatctgcctgcctcggccgcccaaagtgctgggattacaggtgtgagccacctcggctggcccttgactttttaataatagctgttttgactggtgtgagatggtatctcattatagtttgatttgcatttctctgatgatgagtgaaacgatgagtagtttttcatatgttttttggcccactcgtgtatcttcttttgagaaatgtctgttcatgtcctttgcccattttttaacagagttgttttttgcttgtcgatttatgtaagttccttatagattctgcatattagacctttgtcagatgcatagtttgcaaatattttctcccattctataggttttctgtttactctattgaccatttcttttgctatgcagaagctatttagtttaattaagtcccacttgtcaatttttgtttttgttacagttgctttgggggacttagccaaaaattctttgccaatgccagtgtcaaaaagggtattttctaagctttcttctaggatttttatagtttgaggtcttacatttaaaatatttaatccatcttgagttaatttttgtatatggtgaaagataagggtctagtttcattcttctgcatatggctagccaggtattccagcatcatttattgaatagggagtcttttccccattgcttgtttttgtcgcacatggccaatcttgttttatctgtatcctgcctcatggctccctaccccgcactgccaccttgaattatgttgaagcaaaacccagatgttatatcatttcgtttatagtatacctgttttttgatgtaagatactattattagtagtagtattttttgagacagaatctcactctgtcaccaggctggagtgcagtggcatgatctcggctcaccacaccctccgcctcccaggttcaagcgattgtcctgcctcagcctcccaagtagctgggactaacaagcgcatgccaccacgcctggcaaatttttgtatttttagtagagacggggtttcagcatgttggccaggatggcctcgatctcttgactttttgatctacccccctcagcctcccaaagtgctaggattacaggcatgagccactgtgcccggccagatactatgtgttttaagagtaatgtctttacctcatacagcacttaacctgtagtcaaatttagtcctatcagctttttataactaatggctcattagtttggtgagaaacctctccgacattttttccttctatgtaagtgtataaatgtaaatacacatatagttatgtgtgcttgttatttgttcttattaaaaaggggaggtaggccgggcacggtggctcacacctgtaatcttagcattttgggaggccaaggtgtgaggatcgcttgagcccaggaattcaagaacagcctaggcaacatggcaaaacctcatctctaccaaaaaaaaaaaaaaaaaaaattgcccaagcatggtgataggcccattagtcccagctacttgggaggctgaggtgggaggatcacttgagtctgggaggtggaggttgcagtgagccaagattgcgccactatactccagcctgggtgacagagccatctcagaaaagggggggtggggtgggtgggtagtacaaaacttccttgttcacttataaataaattatagaaatctttcttgataaacggagatctactttactctttttaacagctgtagtgatctacatcagacgtgtcataattcttttttttcttttttttttttttgagacagagtttcgctcttgttgcccaggctggagtgcaatgacgcgatctcagctcactgtagcctccacctcccgggttcaagcgattctcctgccccagcctctggagtagctgggattacaggcacgcaccaccatgcctggctaatttttatacttttagtgaagacagagtttcaccatgttggtcaggctggtctcaaactcctgacctcagttgatccacccgcctcagcttcccaaattgctgggattacaggcatgagccaccacgcccagcctatgtcataattttttaaaccaatcccctttagtaaaagtttctttttgtgttttctattgcaaacagagctgtacaaacaacattgtatatcatctttgcatgcttatggatttctgtaggatgggtttagaaaaggaattacaggatcatgcatctttgagggaaaaaattgatcttttaagaatggctctaccatgttgttccacacttgtagctttgctctaatctgtgctcaaatgctgatgaatgtagatttgtggattacactaggtgagcagttgtttccatttaatgcttgaggaaaactgggaacagtatattgttctgaaaacctaaaaagtttaagtgagtgtgttagaatactggacaatgagagcctttatgtgtaattgacatctctaagacctctcagaagtgagagaaccaatgagagagactgttgccaggctacaaactccagcagaaggcagaagagatgggtagacaggcgggggtgttgggctatctgtaaaggacaatataataacagtaataatcctttacatttgtacagcaggttagattttacactgggcttttacatccattttctaatttaagctgcacaataactctatacaaaaatctgagcagccaaaaatataccatagaatttctgtgggtggacattctggattctgaaataacaaaaatgtgggaatagtgttagcctatactggacaagacccactgactgaatcaaaatgctaggtaagaccaaggaaggtgcagaagtagactagatgtcctcaccaggctgaagcagtagacagtttccattagccacgtgctgattagcatctccccaagaatgtggaatgcattagtgccaagctggctatgtgagagcctcatggagaacttgtgaatatgcagattccctgatcttacccccagagattctgattcagtgggtttgaggtcagtcctagaaattatgcattttaacaagctttcctagtgatgctgataggcaaccaagtttgcaaagcactgttattgaagtctctgagaactgcagctagagatttttacactatgggtctatagtcaaatgagactacttaacacgcaagtcagtggacctgggttgagaaaaagaagactaaccaatctagtactcaagtgaattagtgctttgacaaagaaggagcttcctatgaatgtaatttctaaagacttgaaatatatatatatctacatttacgaagtcccaaaccaaagggtgttttaaaatattgtgaattggcattgaggtatgtgttggtgtggacagagtcctggcctagagaggcccctttttctagagtggaccaaaccgtgaacttaaagccagaggaccctgagtaggggtccatcttaattgtgtcccaatgtatgaactgagacataggacctcatctttctgagcttcactttcctccctctgaaaaatggccatgatattctcatttccctgtgtctgctattcccatctatccttctcttgtagcctctccgtctgagctagcaccagcctctgactgaattcctcctcctttctcaatcttttttttaatattcccagattgctcacagaagccaagaatgtaagcttttgtgtaagtgcatatgtttgcaggagtaattgtgatatatttgggaggcatacataggtgtacaaaatatgcatacgcacatgagcttcccgcttactgttcccaccgggagaattctgaacctttcattgtttattttctatcgtctctttttcttccctggaaaatgggtttatgaactagccttgaaaccaagcacttaaagtaacccacaaaaatgtccaccagcctgttcacattcacacatgccctttcatgccacagcatttttacttttctctaatgttcctgttgcctttgccttaactctataatcacgttgactgttatattgctcttttccctggaagctgaaatgttgtaaagtacaaagtaaagaaaatggaaatagggaattggtacccagctgtcgtgaagattgagatttcagacttttctctacatccgtaactaagtggatatttaaccagatgaagacaaaaacgaactcggggattttccctactgaatgttgtctgtaaatgcaccatgttaaaaatgaaaactaataataacccccttttccattcctttgtagtgaaaaccttgttcaatccagcccctgccattgctgacctggatccccagttctacaccctctcagatgtgttctgctgcaatgaaagtgaggtaagggtgaattgctttgctcattctatgagaaaccaaaagtttgtacaagtggataaagcaaaggggcagaactaaccacatcaatttgatgacgtgaattctcaggcatggtgaaaacagattttttcagtttaccggggtgtggagaaaaggaaattagtaaatcctaggggggaaaaaaggattctctgagtcacttccatattctggcacttatcaaacctcagttaattttagtcccttccttgccctcacactgttggtgttttgttttcttttctaattatttcatgttctgaggactatattaaagttgccaggtttagcaagtaaaaatgcaggatgcccagttaaatttgaatttcagatagataataaataacatacctaacaaatttatactgtaaaattacctgtcatttatcttaaattcaaatttaactgagcttcctgtagtttgtctgccaaacgctaattagtatacaactcctggaagatctgctacattctgtagtgaagaccctgtgtcatgatgtatcatctgaacagactatctatcaactggtacaataagaaaggatattgtaccaccctttcttaaatattgttgggaagaaaatttcaatatttctccctttttataagccagacagcattagaacagagctctcgcccatcaatgggatgcaggtatacacgttagtaaaggcaacatggagagaaagaaattaatgaaccataatagttaaatttctactttttgtttttgagacaggaactcactgtttcacccaggttggaatgcagtggtgtcatcatggctcactgcagcctctacctcccaggtttaagcaatcctcccacctcaacctcccaagtagctgggaccaccacgcttggctaatttttttattttgtgtagagacgggatttcgccatgttgcctaggctaatctcgaactcctgggctaaatcaagcctcccaaagtactgggattacaagtgtgagccactgtacccagcctaattttccatttggtttaaagtctatatgaaggcttttaggatttcttgacctgctttcttgataatttcatctctcaaaacatagaggaaacaagaaagaagactgctacaaagaaactaattttaacaaaccacaataggttatgcaatatttttgagcaaccaccatgctaggaagaaggaattgtgggaaatagcgatcatttcacaataagaggttagagtaccctcaactgccaaactggcctaaattttcctgctagatacttgaagagcactctatttattcctcaaatgttcatcacagctcaaattacttattcaattcttctgtcttctccattaaattacaagttccatgaggtcagagacatctgtcttattcactgttgtatccctgatggctatccctgtgtatatagttatctattgctgcataataaaatacctccaaaatgtactggcttacaacagcaataattatttattgtcactctcagtttttgcatgtcaggaattcacacaggggatagcatggtttgactctcccacgcgatgcctggggcttcagttggaagacgcaaaggctgagagctggaacttttcttcattcacctgcttgacagttgatgctggctttcagctgggggcataatgaggttgttggccagaacatgtaaacatggcctctacgtgtgacttgggcttcctcataatatggtagctgggtttcaagatccagcttcccgtgagaaggagacacagaagccatgttggcttttatgagttagcttcggaagtaacacggcatcacttctgactcattctattgatttaagcaggaaggtccaccctagtaccccaccccttactagaagattgtcattggcacagtgtaaaaccaggatgtgtgatatgatataggttaatacagttatctttggaaaataacatctgctacactgtacctgcacatagctggcacttagtaaatgcttatgaaataaataaatgaaagaactctggtctttaaggaaactggtctcagaaacttaatggaagaaagaaaaacattaaaagcttaatgttctggagccaggcgcggtggctaacgcctgtaatcccagcactttgggaggccaaggtgggcagatcatgaggtcaggagttcaagaccagcctggccaacatggtgaaaccccgtctctactaaaaatacaaaaattagctgggcatggtggcacgtgcctgtaagcccagctactcaggaggctgaggcaggagaattgcttgaaccaggacctgggaggtggaggttgcagtgagccaagatcaggcggctgcactccagcctgggctacagggagactctgtctcaaaaaaaaaaagcttaatgttcttatagatgaactctaatcacagcaataatgtaaattcatgcttatgatactcactctgctccaaacacaaaccactgatatgtaaatactaatggacacaatgaaaagatacttacaagctctaaaacaagataaataactccacagatcagaaatggaacagcctcacagagcattcagcccttgatatgctggctgtacactagccccagaaacaggcagaagtggcaggaagttcacccgctgtgggtcatggatactaaaagtgtgccatttatagcggactggagccgagcccacagatggaaaccatacatgctaggctgtggctcccctgctaacagtgaaagggggaggaacctgctacccctgctgcctgaagcatatttaaggcccccaaactgaggagttagcaggacagagacacagcctctgaccaagaagtaaaccaagccaaccactgacttagtgactggactggcagtagccccagaaacagcagagcaagaactccctattgccaatataatacctggttttggtttagagactcttgtgtacctgggggaagctactgtaaaaccactgagggctgggcgtggtggctcacgcctgtaatcccagcactttgggaggccaaggcaggtggatcacgaggtcaggagatcgagaccatcctggtcaacatggtgaaaacccatctctactaaaaatacaaaaattagccaggtgtggtggcatgcacctgtagtcccagctactcaggaggctgaagcaggagaatcgtgtgaacctgggaggcacaggttgcagtgagccgagatctccccactgcacttcagcctgggtgacagagcaagactcttgtctcaaaaaaaaaaaaaaaaaaaaaacactgaaaagcagggatcaaccaggtgggaactgatgtgtgacagctttccaactcacagtaagtaaagtgagcctgcaaatgaaaaacataatgctacaaaattcacccagcacaatcaacaacctacagatgaatttgcccaagatgaaattcatataataaaattcagccaggcgtggtggctcatacctgtaatcccagtgctttgggaggccaaagcagttgaatcacatgaacccaggagtttgagaccagcctgcggaacataatgagacttcatcctgtctctacaaaaataaaagattagctgtgtgtggtggtgcatgcctggagtcccagtatttgggaggctgaggcaaaaggattgcttgagcttaagagtttgaggctgtagtgagctatgatcatgccacagcactccagctggagtaatagagcaagatactatctctaaataaataaacaatgcaaaaaatactttaaatagtataattaagattaacattcattatgaaagaagaaaaaattttgtgaaagaaaaacagaatcaaagcaacaacatgtgaatatgaaaaacaaccaattagaagtcttgaaaacctaaaaagtcatggaaatgtttttaaatcactcagtagaaaaataaacattagaatggaatgaaaaattagtatattgaaagagaaattgggagaaaaatatggatcttgttgaaagccccctgattttacagattgtaattggtgtggggaaggtcacagactgaatgagtaggagaggcctcctgaatgccagggcattgcgttttctgctacctgtcattacctctcctaatctgcttccatcttctctggcaaaaacaaacaaaagaaataagtagtctgcaaacatggaaagcaaaaactggaaatttgagaagaggcattatggcccaagagaggcttggaagaattatgtccttaggtgccaaacttacaggtgcaatttatgctaaaattcttggcagtggccctttcctttctcctttcctgcctcccctccaaccttcctttttcttttttttttggtagacttctctttgttgccccaactctttgttaaaattattatatgtgcagaaaagctgaatgaacactctacatttcacctaaacatttgctaacattttgctgtatttgcttttcctcttccctgtatgtatttagttttgtttttgttgaaaagtaagtggaaaaaaaagtattttgttgttgagaataagttgcagacaacatgatgcctcaccccaaatacttcggcatacatctcctaagaggaaacacaataccattatcacacctaggaagattgtcagtaattccatgctatcatctaatatccaagccacattcaaatttccccagttgtccccagaatgtctttcattgatggtttttgtcatcactgttattgctttatttattttcctgtaccagtatctatcaaggttcccattgcattggttgttataaaaaagaagggagacattttctagaaaaacgcatctggaagtggattcaggttacttattttcaccactgtttctgttgacttttgtgtattctaggctgagattttaactggcctcacggtgggcagcgctgcagatgctggggaggctgcattagtgctcttgaaaaggggctgccaggtggtaatcattaccttaggggctgaaggatgtgtggtgctgtcacagacagaacctgagccaaagcacattcccacagagaaagtcaaggctgtggataccacggtaagttttaaaatttaagaatcatgtttagcctttgaaaattgttacttagtaactaattagatgctgtacctgaatttttggataatgaaacaaagccctagtaagtgatatggtaaaagagaagaacaaccaggcaggggaactgtattttaatccctctctaactctctgtgggactttatgcaagcagcttgacctctctgagacgtagtttcctcattcataaaatcagaatagcagtaaaattatacctgtgttacctgtattcattcatttatccagtcattcatcaacaaatagggatttgtggaatacctatcatgtcccagtcatatgatagttgctggggatatagcaataaataaggcaaagtctctgcccttgtcgggcttagattctaggcagtgaacaagtagctgtgtcttacaagcttctccagtgaaatgaacagcaaggagcactggttagcagagatcattcttttaaccaacaaattctagcagctaacatttactgcatgcttgctgtgtctcttttgcatacatctcatttaatcttttttttcatttaatctttaaacaattctgtgagacaagtattatttccattttacagaagaagaaatttgtacaggatcacattgctggtaggtaacagagctggagattcgaaactaggcatatggactccacacagacattttttatgtaaggtactgtgctgaggacaagtgtgctaagtgaacaagccatggctacagagtaggaatgaaaaggaaacaagttagaaaaaagactcatggttcccctaaagctggggaaacacaaattgtttgtttattgttagaattcagaagagcttgccaggcgccacttcacacttgtagtcccagcactttgggaggctgaggtgggcggatcatgaggtcaagagatcgagaacatcctggccaacatggtgaaaccccattctactaaagatacaaaacttagctgggcatggtggtgcacacctgtagtctcagctacttggggggctgaggcaggaaaatcacttgaacctgggaggcagaggttgcagtgagccaagattgcaccactgcactctagcctggcaatagagcgagagtccgtctcaaaaaaaaaaaaaagaaaagaaaaacagattcaggagagctgactagaaaagtaagtaaactagacttgaggaagaataaacattttagagtttttatttagaagaaacagataattattcataaaatatgttttggtttgtttttatgcttagaagcgactttaaaatgtgggtcattatgaaaaaagaaggctgaggggatctgatgaagttttggatgtgaatatactttgaaaaatattcaagtgcaagaaatggttatgtgacatgaaattaacatcctggttgcctttcaaaatgtgctttaccaggtatttgataaagtgtgcttggtgttgctattctcttcatatttagtcatttctgaaactattagtttattttctgttttgtcaaggacaagaacctgaatttgaggggatccttagttctgaaatcaatccgccattagactaacactactttcactaaagtgaaaagactctatgcatctcctgctaaaagtaaaatgaggattcctcaaagacctacatggatgcacagaagtggcttagcccctattctcagtgtccatgttagttactatccctttgggttgtaagcaccagaagcacaactcaggcttatgcaggaaaaaggatttatttggtgcacataattgcaaagtgtaaagatatggcagaatgcagaggctgaacagtgtcatccaggcaagtcaggtcacttgctcactggctccctccctgtcagctctgccttcctcatagtgggctatgagctcaggtgggtccactccctacccacgctgtgtctcatgtcatgtccctgtccctggtttcagatacaaatcactcttatcagaggatagggaagtggatgctgacaagaaaacagtagaatgtccagtgtgttttaatatatctagagatttttcattttcttgcagaatttgaagatgaactattaattggtacataggaaactgaggaaaatgtttaagtaaagcaaattttcccttctaggtcatctagaacctaaggggaaaaagtatgattaagtgaatataatctttgtacatgacgtggctataaatgctataaatgcatagtcataacaatgtaaatgctaattctagatttaaccagaaatggagattagaataatattgtgaagatgggaggataaagtgagtgtgcatttgcacatggggggacataagaaaactaaatgcttattttccataattggaactcaagagataatatctaaaattgacttttttttttttttgagacaggttctcactctgttgcctaggctggagtgcagtggctccatcttggctcactgcaacctctgcctcccaggctcaggtgatcctcctgcctcagtctcccaagtgtttggaactacaggtacacgccaccatgcctggctaatttttatatttttagtagagacagggttttgccatgttgcccaagatggtctcaaacttctgggctcaagcaatccacccacttcagcctcctagagtgctgggattataggcaatgagccaccatgcccaaccctaaaactggttttctaaaagcagtataagtgtattgccagaaacatcagataattaccagaagaaaccactaaaagaatttaaagtatttgcctcatgaaaatgggaatggagagggattgggcatttatacttaagccttacatgtgtccacaaaaacttgtatgtgaatgttcatagcagcattattcataatagccaaaaattggaaagaacccagtgtttatcagcagatgatggataaacaaattgtggtatatccatacgatggaatattattcagccattaaaaagaatactgatacatacaacaacatggatgaacctccaaagcattatgctaagtgaaagaagccagacacaaagtgttaacatattatatgattccatttaaatgaaatattcagaatagatcaatccatagatacagagcatagatgggtggttgctagggactagggggaggaggaatggggagaaactgcctaatgggtaaggagttttactttagagtaatggaaatgttttgaaactagataagaggtcggtgattgtacaacattgtgacaatactaaatgcactgagttatttatgttaaaataggtgaattattaaataattcttttttaaaaggaatgaagtactgattcatgctatgacatggatgcaccttgaaaacatactactaagtaaaagaagccaggcataagaggtcatatattatgattttatttctatgaaatatccagaataggtattataaatccatagagacaggaagtcaactgatggttgctggaaggggatggagagtgactactaatgagtatggagttcctctttggggtgatgaaaatgttctggaatcagtggtaatggtcggacaagcttgtgggtaatactaaagaacactaaagcatacccctttaaagagtgaattttatgatgcatgaattatatttcaaacaacaacaaaaaagctccacctaagcaattcacttatgaatggatattcgtgataaagactctccactgaattgccctgctgaatatgcgtgaatggactctcagcatcccccaggtggagcagcagtgacactgacaggaaccagggtagtgattttctgggtctagaatcttcctcatcttttttatgctgtcttcgtcctctcatccagcactttcattattaaaattcttacctgttctgcacacagctgtgcagcctcttcataaatctgataaagagaaggtaattcacgtggcgagtgaggagctcccagggaggcattttcttctgaacaaatgggctccttcacttttctgtcaggagggtattacttgctctcagtcggtttgtaaccttctcgcttttctcttcctcctaatcccttattaaaaagtcagggatgacatgggtgctggaaacatctttagttggcatgttgtccactcaaggcagacagcctgcctagaagaagccatttcccgttctacgtcagtgcttctgcagactgctatattcagttttgcctcactgttaatagttgaatatatcacttctatttttacatctgtttttcccgttgtactagagtgagatggtggcagtagctgcagatgtcctcagctcagtttggaagacatgacagatgtgtctcttctcccatttctatatgttatctgaatctcagcctccaaatgacagagagtgcatgtccgccctctcttcttccaacctgaatgttagggggtttgcctgcttgcatttgggattgcactgagtaagcactccatagtcagagacacacacctaagcatggtatattttaggattattgtgctactgtgatatattataacattagttatccctgctttataagcactgaaattcttgacatataaattgcttttctttatgtaaatggttaagtcctggaatctacaataacactctcaagaatttagtccgtaggctaaatctgtcttctcaagaatcactcactctgtaataacgcatgggtatgtaagtaagctgagaacaaacaaaagccaggggcacagggaatttatctttcctattctttattctcctttctttctatccttcacatttgagtcctatagtgttcagagttgctgatgaggcactaggcagcagcagccagctgcatgggtgtcccataactactcagagcttgagagttaactctaaattaggattgcaccagtaagaagtagagataatttctgttaaagtttgcacggaagcactttcttaggatgaggtgattgctggggctggcaggttacttgcaggtttcccaggtggcctcttgtattcctctcatcctggggtctggcccgcggccatcccggctgtctcaaggatggggttaatggacccaccttttaggccctatccagactgacagttcaatctttgaaaacctagcatctgaggggccatcattcccaacttggtgtgacctttcctccaccctacattctcctctccccacccttgtcactgccaccagtagaaagtcaaactaatattgcaaaatgtactcagaactaatgaattgaggtgatctcaagaggtgtttctcaacccaggcaacatgaggccctgttccctgcttagccatagtcctgctgggaagactgaatactcagcagttcttgcatgggtactgccagtactagtctccgtgactttccttgaactgtgtttccccagcagactcttcttcttcttctcatctccttctttctgatcaacatatactttctttgcatgtagtaattagttgagtttctgaggggatttatggctcaaaagccattttgtccttgaatagagcctttgcacatttctgtccagaagcttctgttatagccaagatgtttcggtgtcccttactgtttactggcaacacttgagaaagggctgggtgggtaaaataatatggtttaaaaaatggtcgaatcttgggtgctgaagaggtaaagtaataaggctaattttgaactgcactgtcaatttttcttatccaagaagtgactgttgtttccttcaaaccctgactttaggagacttactctattgacacagctactactcaaagtgcctttggaaatcctctgttagaattgccttgagagccttcattatcacctttattccactaatcactttattggggcttttcctacttgtgaaattaatacatactttagtgttcaaggagggaaggagagcagcaacacagaaaggtataaagaagaaagtcaagtatccatgacccatccacttaaaagtaattgttaaccttttggtgtaaatctttccagatttttttctatgcatagtcatacacttttgaatatctacttacagctaatttgaatatttgcaatattataggattaatatgtgtaattgcacatattacaacaaaaaattacaactaaaaaatagtgtaattacaactaaaaaaatcaagtatttccctagaataatataaataggcaagtcactgaataagaaatacgaaaaaaataaagaaatgagacaatgcttaacctcattagaagtcaggattatacacattaaaataacagtgaggtcctctttattacccataagtttggccaaaattaaaatttgagaatgtttaagtccaaatagatcacaaaacaaatattatacaatcatgtaattctggtgggaatgtaaatttgtacagtgtttccagaggggaaatttgacagtactaatcttttttttttttttttttttttttgagatggagttttgctctgggtgcctaggctggagtgcagtggcgcagtctcggctcaccgcaacctctgcctccccggttcaagcgattctcctgcctcagcctcccaagtagctgggattacaggcatgcgccaccactcccagctaattttttgtatttaatagagacagggtttcaccatgttggtcaggctggtcttgaactgacctcagatgatccacccgccttggcctcccaaagtgctggaattataggcgtgagccaccatgcccagctgacagtactaatctttaaaatatactttccctttgaaaatagtaaatcttggctgatcatgctggctcacacctgtaatccaagcactttgggaggccgaggcaggaggattgcttgaggcccagagttcaagagcagcctgggcaacatagcaagaccctgtctcaagaaaaagaaagaaagagagagagagagagagagagagagagagaatagtaaatctccttctaagagtctatcctacaaaaatgctcacatacacaaatatttgtacaagaatgtttaattcaactttgtttgcaataaccaaaaattgagaaggtgtgtcctcctaatcatcaataggagaagggcaaatatgaataataatgtagtgccatttacttgaaagtaactctctagctatctctaagtaaatgcatattttaaaatctggaaaaaacctcaccagctgttatgatcattattcctgggaaggggtataggctggggagaaggtgttataaagggggacttctgtctactccatactctactgaattatttgagtttttccataagcctgtatttttcatgtattactttgtaatttgaaataaatgtgactttgggcatgaccaaaagctatttggagccacatctagcaaataagatcggtgatatcatttctctgagggtgtactgggcattatcctcacaaagaacctctcaagcagttcataatcttcatgtaactgggccgaggagccccttgacgtaggataaactctgaatggatggactcctagtgccaaaaacttagatctccattaccttcctattgagggcacttgaggctccttctgtctggtagtttgttatatactttgacaggtttttttccttaatctttttaaagaaaccattcctcagaaaacatgttattttatacagttcttcttggaaataccagaataaatgtcaaagcatcactgtttctgttcgtcattcaaatgtacagcagatcttcagacaaattttcctcacgttcaggttttctgaatgaatgaatctgcttatagatttccatttaactcttcaaccctcagtctcacaattaatcatagcttgagtgatattaactctggcttttgccacattgcttggtcttcagttgatggattatctggagttgtaaaagggatcggccaataggtgatgcctcatgtttaggtatttggtagttcacgtacttcatctcccatttgaaacagtcctggatggaatggttcatgaaagatggaggaacatgtaacaccatgctgtggactgaattgcgttcccaccaaaattcatatgttgaagccttaacccccaatgtgactgtatttggagataggaaaagaaagtaattatggttaaatgaggtcataaggggtagggtcctggttcgatgggagagagctctctcgctctctccctttttctctctctctctgtgtgcacacaaagagtcatgtgagcacacagcaagatggtggccacctacaagccaagagaagaggcctcagaatgaaacctactttgccagtaccttgatcttggacttcccagcctccagaactgtgagaaataaatttctattatttaagctattcagtccatggtattttgtcacagcagccctagcagcctaatacacacaaggaatcaagtgaatgtgcttcagaagtgacctgaagtgaatgctagaaaattggctgttctgtaaggagaaagtaatccaaagcaaactaagaggactggcctaaatcatctttttggtgaaatatctcaggggtttttgcatatggtttagctgtagtcatcagtcccagtggcctgagttctaaccctgatttagccattaactagcggtgctgctttgggcaaatgatgtcttatgtttggggctcaggttgttcatctaagcatgatgtgtctggtgtggctgatctctgaggcacctctgacctctgaaattccttggttcattagcctctgaaattagattctttgggggcatgaggattctttaggctaataataaaagctgggcaccacactgtgccaggcatcatgctggactctatgcattacttcacattctcagaacaacctgcaggatgggtttttgactgtttgagggaggaggcaactatggttctcaaaggttacatgacctgcccaggggcctacagctggtaagttggcagagccaggattgatttttaagttggtcggtctgcctatctgtctgtctgtctgtctccaacacccatgtacttgctacctcagtcaccaccctgcctcttgatttggtgacagtctgcctagtcttcactctctcttatttgacattccagcactgactttccttgtcacttgtcatgatacaggctccttgtctatagatcttcagaagcggccagatcttgaaaaggccttgcttactttgtacagtacactgcagcctcgtttaaatgaaataatccacgtataccctgagaacagtgcctggcacatgtaagcccttagtatgtgttagttcttactagtacatccctatatacctgattgttcactttaccactttatggatcatttaggtaccaggtagcgtagaccaggagcttgtatcacccaccattaagcagaatggatattctcttggctctgtatattagtataatgcaccatgatgcaactccagcttcttcctaccatggtaaggagcaggaccacgtggtgatatagtttggctctgtgtccccacccaaatctcatctcgaattgtaatccccaggtgttgagggagggacctggtgggaggtgattagattatgggggcacttttcgccatgctattcttgtgatagtgagttctcacgagatctgatgattttataaggggctcttctcccttcccttcacatgctctatctcacctgcagccatggaagatgggcctacttgtgacttgtcatgatacaggcgtctataattactccttttctgtagaccttcagaagctgccagatcttgaaaaggccttgcttaccttgtacagtatactgcagcctcagttaaatgaaataatccatgtataccctgggacagtgcttccttccaccatgattgtaagtttcctgaggcctccacagccatgcggaactgtgagtcagttaaacctcctttctttataaattacccagtcttgggtatttctttatagcagtgtgaaaatggactaatacacatggacagtgatgttgcaggatcatgcccattccagacagcaaaggttctggaacaactcatgttcattcattctcatcagtgaatgatcaaacctggaggagaggtgcaccactctcagacactataaccaaatcatttttttattacatttctttaagtagaagctaaactataaactgctaaactataaaggtagtgaaaatgtgattcttcttttttaacattcacaaaccagctttttagttgaggcaaactcctgcccatccttaaggtccatctcagaggttctcttggggcaaccccactgcttaatacaatgcttggcatataataacaggccctctgcaaataataaaagagttctggttccttctgggaaagtaactagtttgagtgttaagagtcgcttaccctccctaagccttagttttctcaggggactaggggatcaactggatttcttacattccttaagttctacatttaagatgcccagggaaacaataaatcttagatataaatgctccttataaatgatttgaaaacagaataattgcccagttttccattttaaaacatatccttaggccgggcgcggtggctcacgcctgttatcccagcactttgggaggccaaggcgggtggatcacgaggtcaggagatcgagaccatcctggctaacatagtgaaaccctgtctctactaaaaatacaaaaaattagctgggcgtggtggcaggcacctgtagtcccagctactcgggaggctgaggcaggagaatggctgaacccaggaggcggagcttgcagtgagccgagaccagcctgggtgacagagggagactcctcaaaaacaaaaaaacaaaaaaacaaaaaaacacatatccttagattgttttacctacagtcatacaaagaccaggccaaaaaaaactaagttacagagagtgcacaacatctctgaaatcagcatcatagaataaagaaaacccaaatgaggttccgaaacagccctcttaaccttagaaatgatgttagtaaaactctgcacactctggtggctggaaaaaatgaagaagacaaaaagttgttcactgactgtaaggaaaggacagaggacaaggtaattgcagaagagatggatagacaaggcacaagacatctgtcatgcccagggggccatattagctctattacattacttccacatcaacagatcacctcatttattagctaatcaggcagaattcaatattttaaattatctttcttaatcctgcgtgtgatcagttgaatacccagggctctagaaatctaattgtaactgcttaccagaaatgtcatcttcactttgaggaattgaaccagggccaaatctaaggctgttttttccattttcccaaggtactgtcccacagacctggacatgcgtgtacatgtgactaccgcctgacagcttaggggctccctgaggggatctgggcccctggccctgcttcagaactcaaatacggccagggactgaaagaggaatatggtagtagaagtggggtatggaagtggatgtacagtacagaaaaggaaccattgtttcagccttggaaaaagtcaagagagaaagaactaaatctagatttagaatgttctgtggacctagacatgaaatagtccctctgcccagtgagagggcattgtataaggttatgggagcttgcttacccatctacgattaggatttcgcttcctcttagcttcctacgtctaagccccacctgtccaccctccttaagcttctaagacattgatgtgataatatggcagtgagcctgtggtctactcctcgcccatcttcctagggtgttgtaatggtgttctcaggagcaaaactgccaggacaacacaaaagattttcttagtggtttccattgagtgacaatgtttctagggtagacctgaaattatgaggaggtgaaagaaaaccacctagagctaggcgcaatggtgcaagcctgtaatcccagcactttgggaggcagatgtgggcagattgagctcaggagtacaagaccagcctgggcaacatggcgaaaccccatttcgacaaaaaaagttagccagcatggtggcacacgtctgtagtccccactacttcggaggctgaggcaagaggatcacttgagcctgggagaccaaggctgcagtgagctgagatcatgccactatattccagcctgggcaacagagtgagaccctgtctcaaaaagaggggggaaaaaaaaccacctagagccaaaccatagagcccatggcagtgggagccatgcccactgccctcaatgcccattgctgctgatggagttggacaaggaaatagaaaaagaggtgtgtggttcatagcttgctgaactctgccctttgtataaaagtgtgtgcatgtgtgtttgtgttgtaggttaatggtgtgtatactttgcatgtctatgttgatggcatgtactgtgaataaacagttaattgcatgaatgtcatgtgcttatgtgtacgtgtgtgtgtgaacagaatgtactgcagtgggacagagttcagctataaagcaattcattcttgctttcctcttcctatttcagttcctttaagaacaaatacagaagtgttctatactgtggtacaacctctgaaaaagctatggatttggagatcaaagggatccagaggttaggtgaagtacatctcccctaagagatgctctaaaaactgaaaatgttacattgttttctttccttggtcaagcaaacaaaaattagaaaaagattatagtgacatctgctaggtgccttccgcatgactgtcctgttcccaattaggaaaatctttttccttcatttagtattctctttaacttttagttttaatatgtaggaatctaattgtttagatcaagttgtatgtgactataatttgcattaaatacatacatttatttcgcccctcactagtccaaggcaaatcagattgcctctctttccttccttcctttcctccttttatcctttcttccttcaaatgaaatatttcaaccacactaaacagtatagagaataatatcatgaacatccattgactcaccacctagctttattgatttttaacattttgctatttttgcttctgatagttttaagaaataaaatattacaaacacactatgacacctgtgtttaagatgcttaatgttatgaagaggttagctttttttcttttaagagatcgggtctcactctgccacccatgctggagtgcagtggcaccatcatagttcactgtagcctcaaactcctgggctcaagccatcctcccaccttagcctcctgagtagctgggaccacaggcatacaccattatgcccagctgatttttttttttctagagctggcgtctcactttgttgcacagccttgtcttatactccttcctggcttcaagcaatcctcccacctcagcctcccaaagtgctggaattataggcatgagccaccacactgaaccagaacttagctattaataatacatttgaagacagtattagcttattaaaatgtctcgttctttgtcattctgcagttttactacagggaatctagatctgaatttatttatactgctcgtgactcttcttcctgaatctcagtatttatgtttttcatcaattctgaaaaactcacaaccattttctcttattgttgcctttcccctattttctctgggaaccctattagatattcgctctctctctctctccatacatatatatatatagatatatagatatagatctatgtagaccttctctttctattcttcatgtcttttaaattttgtctctttcataatttctatatcctggactctcagtactatattctgggttatttcttcaggtcttttgcccagttcattaattgtcttcttagccatgcctaatttgtttagaaacctgtttttgtgtttagaaaccgtatttttcatttctaaaatttccatttgattctatctcaaacctgtccattctttcatatggtagattcttattttaaaatttcttattttgtctttaatcattttaaacatgtgtctgtagtttcttttagctgactctattatctgaaattgctgaggactaatttcatgtctaactgcttactcttcatggtagattgttttgtcacatgttttataattgcgggctgtgagcttatcttcagtggtacttgatctgtgagaatcctatgtagtctaggttgaaggtatttcttgccagagaaatttgcctttgcttctgcctgctgccccaggagtatccctagctgaggaatacttttattttgatctcttggcttgtgaatttctggccacacaggtagtataaatttctttttttttttttaatggcttctttttgtctgtttatttctgctttatattatgaaacctttgttaaaatgtactacagcatataaaactacatattttagatgatctgttcttcaggtctatctctataccttaatcctaactttaacccttttttttttctaagcacttttctaagtactttattttttattttattatactttaagttctaggttacatgtgcacaatgtgcaggtttgttacgtatgtatacatgtgccatgttggtgtgctgcacccattaactcatcatttacattagatatatctcctaatgctgtccctccccgcttcccccaccccacaacaggccctggtgtgtgatgttccccttcctgtgtccaagtgttctcattgttcaattcccacctatgaatgagaacatgcggtgtttggttttttgtccttgcgatagtttgctgagaatgatggtttccagcttcatccatgtccctacaaaagacatgaactcatccttttatggctgcatagtattccatggtatatatgtgccacattttcttaatccagtttatcattgatggacatttgggttggttccaagtctttgctgttgtgaatagtaccacaataaacatacgtgtgcatgtgtctttatagcagcatgatttataatcctttgggtatgtacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaactggtgtgagatggtatctcattatggttttgatttgcatttctctggtggccagtgatgatgagcattttttcctgtgtctgttggctgcataaatttcttacaaatttacaagaaaaaaacagccccatcaaaaagtgggcaaaggatatgaacaaacacttctcaaaaggtagtataaatttcacaacccaaactgcttaggaagaggatcacattacaaagtctcagtgacaggatttgttgctgtttctctgagccagtggtggaatttttttttcctggttcatcttttctgtaggagtcttagttccagcactccactttgcttgaaacccaccttttgtccaaacatggccattaaaacccaagccccatgattacccggaccagcaaactgcttggatggccatagtttatgctcttgccgtgctagtttttagaactctctttgtttttggactctgggaaaatcttatttctattttttagatatattaatagtaataaggcttctgttttatcccagagttctgagtatcttgtagaaggagagttttcagatctctaggctacaacattgctacaaagagaagcctaaattgggtttcttcacaggcagtgatcacagtcaaggtcctcaggctgcctttcatcttattctcagagcatcgtgggagttccaagactaatgatacaaaagcagcctctagaactgaaaacagttccttaagaaataggaaatattctattggaaagaatggcaaaatggaatgaggcacatcccactgtacactttcttattcagcacactctgaattttccacatgccacacagtggatatacactggtatgccagggacacactggcataataagacagtccctggccacaaagagcttggaatctagaagagtgcatagtccatacagctagaatgagaagtcccatggtgatgcagtggagggggcccacctagcctgaggagcccagggaagctgtttgagagggtaagggaaggagctgagctgaaggataaggcagaggcagcttggtaaagtggcactcaggcagaggcagcagctcatgaagcagctaaagggagcatggcatatttgtgctgcttcaaatagttccatttggaaagacctgagtacaaaggagagttaaggatgaagtggagaggtggcagggttgggttgtaaagggcttcctttgccacttctgagaattcacacttctgagggcaatggggagccatttaagcaagggatacatttgatcagatttatactttataaaaagattaatatggctgctgtgtgaagaataaattggagtttacaagactggagtcagggagaacagtccagagactgtcgtattgatctgggtgagagatggtggcagcctggactagggaagtggaaatggggatgctgagaagtgggtttgagagctcatgggaattcagatgacataaagatagttcatttccttaaaaaaagtgggggcagtggggcgataactaagatggttatttcatagttgaaacaaacagatcattctgtcagtctgagtggttttcagcatattttttactccgactcacataaaggctaaaacctactcccactagaaagagttcctgtcatcagtgattctctgcagatagcacagaaagatgcctgtataacttacaaaaaataaaattaaaatctcaggtgatccataaatgcccttccatccggtaaatgcccttccatccagtatgcctgccttctagggaatgaatgatctgtgtaacaggcaagcatttggagcagaaatcaatccttcatttaaagtaactgacatttgaaggtaactcttttgcaacataatgctagttcagatacttgccctaccacctgtgccttagacactagcttattcctggtagaaacacagccttcacgtaactatgcatccttccctgataaagtgacaaatcagccagtatatgacgaatttgggttgtgtagacaaatataccaggtgcaccagccaagacatacacagttggttgtgaatcatccacaccagctttcaatgcagttagattcacagaacaattgctcagttccttccttcattttcacagtgtagacctggctcaagacccaagagtgaagcagcaagtgtgaagaagcagaaacattataaataacccagagaatccttttataacagcaactgcctactgattttgtggcctaacagctcgagcaaaaatgaatataaatacaacattgtgcaatgactaattactcaaaattttgtgcatcagcagaagtggaacctgtggttggtgctaatattatgaaatgcctttgctgtttaataatctggtagctctgtattatttagcatgcatttttcttggagaacaatgattttatttcaagtacctctcactgaaataaaaaagcagctgttagaagatgaacatttagcagaaaatattttagcgagtcttttgtaagatactaagtcctattggattaactgttttctgtctagaatagtggggtcacaaaaaaaaggggattgctgaccacaaaaggcaaaaggccaacctttagaactcagtgaatcactaacagacattttagttttaattgcgatttactcaccaatatatatacaaagctctcattaatattgcctgaagaatgggccctttttaattccatttttagctcgctctcaggattccacttctctttcattaacatggaattctttaaattatagaataaattaacccaccgcaaacattttgggcagaatggggttttcagcaattttcagcctccacaggccattcttctcagcagcttgccagccagcagagcggtgagggccatggctgggagcagcacctgcccctgaacttgaagagaggctagagcagcccaatgggctcctggcccaagcccactctcagggtgacagtgtccttcacatgttcctcaggctggccaaacaaggggtgtgccagtgcgtaagccacatcaccataaggctgctgggcacagccagtttcagccaaagaacattatggttgagctgcattaatgtgcccatattgactcagggacaatttttacattattataagcaaaacagaaaatgttctcttttaaattatcaagaaatgtgaaaaaacaaagagtttcattttatctccagttcccattcctggggtgaagtgggtgataggtaaagattaaaaatggaagagttttcagagatggctgaagattacctagagggtgaggctcaggcttgggccgagggtggaatgaggtatagaaaagggaaaggatcaggcatgtctgttctgtatattatttggcaatacaagacagtatatctacattttttacaaatgttatctcaaaacaccttcgtcaaaatgctccacttcagtcctggtctgaccagccagcccagagcccatcacaaactaacaaagctgagaatggaccctgagacacggtcaggccccagatggagccagccagtggcctctgtcaatatgaactaatggctgacttggactgggagccatttgtcaacaatagtggggccagatctgtccatggcaccaacctgtgaggtaggttgagcaccacaaccaagcacctcaacctgtgtgaagactgagatggctgagacacactgcatcaggcaggggatttcttttgtctttgactcaattttagatggaatccaagtgatgcagttactatgattatctgtactctttcttaaaaatggttactaaatacttgtagggtaccaataaaggaagaatctggcagttctgggatgaaagttaatagagtttttcttgttttatagtagttgaaatataatcaatgtattgaaattcagaagatcagtgtcattcgtaataccacttatggtcactttgggcagtgaagtgctgccctgagcatatcttagccccaccttactttgattttgcactcaaccgcttattgatccttctctgttctcacctatcttaatgaaagaaggctttagcctcataaacctcattccagatagaaatacataattcaagagaaacactgatgtcaaagaagagaaggcataccaatttgtgtcagcatttgctgtaaattagagaggagtacagggagagtttaatgtaatgtagaattggaattaaaatagaaccaatatttaggcagtcctccacctctttttttccctgctgtgacatgaaggattgactttctcccagcttaagtacctaatgtagttcattttttttcctttctgctgggattcccccccacaaaatactacatatttatttctggcatccaaaattaaatattttcaccttttccattccaatcacaaccaaaaactcagggtatgaagagttggagtttccccctcatcttccacacctttgcagcatagaaaggacctctggtggccgggcacagtacctcattcctggaatcccagtactttgtgaggccaagacaagaggatcgcttgagcccaggagttgctgggcaacaatagagagacctcatctctacaaaaaaattttttatagccaggcgtggtggcaaatgcctgtagtcccagctactcaggaggctgagttgggaggatcgtttgagtccggggaggtcaaagctgcagtgagccgtgattgcaccactgcactccagcctgggtgacagagcaagaccctgtctcaaaaaaagaaaaaaaagacctctgccatgccagtgtaatcagttcagctgttgtaaatcactattaatccctccttaatacagtactaatgtgggtgttacctccatggtttcttttttcctaagctgagaataaaaggttgatagtgaacatctcacaatgtaaatttgtgcaaggtgttcctgtacacttgtgagaattctttagcacacatgcaagagtgttcttccttttaaagtggtcacattgggaagcttcacattcagaccacatgttgttttcagaacctttttggagctctttatttgaatttctgccagagccgatcttgttctttacagttgcccattggttttggccaatggtggagttccctagcttgatccctcaccttaatcattagacttggctttaaacaattcactctttccagaaataaattccttaggatatggttctcaaaatatggccctaaagccagcagtatcggcatcacctgggaagtcatttgaaacacaaatcccaggccccaccttagatttaatggatcagaaactttggggatggagcccagcagtcggtgttttaacaaaccctccaggcgattccagtgcatgctcaagtttaagaatcactgactgagatgaaatgtgcctccattgaggatattcaaagatatgctacagattttgaaggtactgaaagagaagtttcaaaatatttttgagcaaagttagaatacatttatggcctccccagaggactgctttaatggggactgggatttaaccaaggtgttccagttctatcacctagccatttgaccttgagcaagttcttacacttggtttctcatccggaaaatcaaagacccaccctacctacctcacggcattgcaatgaaattcaaatttaatcacatctgcaaacatgccctgtaaaccagaaagtgctgtggaaaactgaaagtcatgtcacactctgcaggcagaattctggtagcctgaacattatgtcagggaaatgagtggggcaaaggcttatatttatcatttccctggccagatatacctttttgtctatataatggccttatggatgtgtctcagattctgccatttcagcctaccaattcatctggtattaagagaggaaaaccattgcctgactagtagctacaaaatgctagaaaaatattaatatatccattttcaggtcggtcctggtggctcacgcctttaatcccagcactttgggaggccgaggcgggcgaatcgtttgagcccagatgtttgagaccagcgtgggcaacgtggcaaaaccctgactctacaaaaaaataccaaaaaaattaaccacccacctgtagtcccagctacctgggaggctgagataggaggatcacttgagcccaggaggttgagcctacagtgagctgagatcatgccattgcactccagcctgggaaacagagtgaaaccctgtctcaaaaaaaaaagaaaagaaaaatatatccattttttggccgggcaaggtggctcatgcctgtaatcccagcactttgagaggccagtgtgggtggattacttgaggtcaggagtttgagactagcctgacctgtatggtgaaaccccgtctctactaaaaatacaaaaatttcccaggcatggtggtgcacgcttgtaatcccagctactcgggaggctgaggcaggagaatcgcttgaacccggaaggtagaggttgcagtgagctgagatcgcgccactgcactccagcctgggcgacagagtgagactcagtctcaaaaaaatgaaaataaaaaatacaaaagaaaaatatatcagttttcaaacttgctgtttcctacaaggacccgggaaagctgggaaatgagccatcagggccaactatgttgtgtggatactgaagctcttatgcctggaacatggcacacaccagcagtgcaagggtctgtcctaaaaatatcattttatgcctgtgcaggggtgtctggaccttcaaggaggaagctcagtgctcattgccacacattaatcactgcagagagaccgaaaagaaaagccctcaagaaaatcaggtctatggaaaccaagatttacagaccaaaccagttaatgcaagtttgtccaacacaaatttgtaaactttcttaaaacattatgagaatttttctgcgattttttaaacctcatcagctatcgttagtgtattttatggcccaagacaattcttccagtgtggcccagggaagccaaaagattagacacccctgaatgtatctgtgtttgagaagaatgtggatggatttttaccttagagattagcctttacaaacaacatcataggatttttttttttttttaagacaaggtctcactgtcacccaggctagagtgcacagctcactgcagcctcgacttcctgggcttcaacaatcctcccacctcaacctccagagtacctgggaccacaggtgtgcaccaccacacctggctaaagttttgcatttttttgtagagacgaggttttgccatcttcctgagctcaagcaatccgccggccttggcctcccaaagtgctgagtttacaggcttgagccaccgtgcctggccaggaattcttaaacagcaagctcctggtacatttataatttaatttgaaaactttacaaactctttaatgaacacttctggccaggaaggaagctaaacctgttgcctcagtgcttattgggaatgaagtttcaataacacagaaccacctggccaacaccaacttcacttttcgcacaaagtgccagctaaaatcgagattaggtgtgaatatattaataattggtttattatggttacattattggataattatggaacaataagctattgtttaattatagaattagaatatgaaatgattttgctcaaaaatgtggccccacttaacaaatctctagagacaaagcagataagtggttcctaggcctgtggatggttgggaggaatggggagtgactgttaatgagtatgaggtttctttcaagggagatgaagatttctaaaattagattgtggtgatggttgctcaactctgtaactatactgaagaacattggattgtacactttaaatgggtgtattatatgtatattaattatatctcaaagttgtttttttaaatccaatagctaatgaattgtagagccaagacaaaaaaattgtacctatttaaaagacagaagcaaaaataatatcaaaactttgctgcatgcagtttcagacttgattcatatgaaagtggtcatttgaaatacattaagccagaaaatatttgctcttttgagagtattgctctgtcgcccaggctgaagtgcagtggtgtgatctcagcttacaacaacctccacctcccgggttcaagtgcctcagcctcccaagtagctgggattacaggtgcgcaccaccatgcccagctaatttttgtactttttttatgtgtagatggggttttgccatgtcagtcaggctggtctcaaactcctgacctcaagtgatctgcccaccttggcttcccaaagtgctgggattacaggcgtgagtcaccgcacctggcccctgctctgtcttttaattgcagagtaattaaaaaatggattatctcagacttttttttttttttgagacagagtcttgctctgtcacccaggatggagtggcacaatccaacaggggcacaatcttgtctcactgtgacttccaccccctgactcaataaatcctcccacctctgcctcccaagcaggcgggactataagtacatgccaccaaacccagctaatttttgtattttctgtagacacagggtctcaccatgttgcccaggcttgtcttggcctcaactgatccttccgcctcagcctcccaaagcgctgggattacaggcatgagccaccacacctggctaataattgaaatttaaatgtcaaaaatcaaggtggctggtagtagaaggcaaagtcatggacatttgcgacataatggtttgtcatgttccctacagatttctttagaaaaaaagtcagcacttacacaataatgataagaaaactgaactctcactgtccatcatgatgctcataaactgacctggttagggaaggctgcaaggttgaggttcaggaaaggatgtgatctcatccttatgatagaaatatgcactgataagagaagttagaaaaattcagattttggccaggtacagtggcacgtgcttgtaatgccaacactctgggaggccaaggcaggaggatcacttgaggccaggagtttgagaccagcctgggcaacaaagagagactctgtctctataaaaatattttttaaagagaaaagaaagaaaaagaaaaattcagatttgagctgtggaactaggctcttgtgtaagcggcactgtgcctaatggcatgttcacaaacagaccgctcagtcctgtctgcataggggagaacctttccactttcccactttgggaaagataggccatgccacgcgggttctcatcttcttgttaaattcctcactccaggggttgagtgtccctaggactcactggtggccatggagactgtaaatggaggtaaacaggagaggaactggctgacagagctagggatttctggctcagtgaggaaagcagggaggtattagcgtgcattgaacttagagttgctgcgcagggcttcttaactcactagaagtccctgactgggccactggtagttctttgggacaagaggtcctgcttcattttttctcaaactttgtttttcatcatcatcccatgccaaggaaacttttttgagactttttttcctaatcaccctccctcttcccccgtgaaatttttataccacgtacacacatacacacacacacacacacacacacaaacatatgttccttgacctacaatgggattacattcagataaaccaaccgtaaactgaaaatataattaatagaaaatgcatttaatacagctaacctactgctatacttgagatgctgtccctgctaaatctcatgttgaattgtaatccccagtgttggagctggggtcttgtgggaggtgactggatcatgggggtggatttctcatgaatggtgtagcaccatccccttgccactctcctcaaaatagtgagtgagttctctcaagatctggttgtttaaaagtatggtggtggggcacagtggctcacacctataatcccaacactttgggaggcaaaggcaggtggattgcctgagttcaggagttcaagaccagcatgggcaacatagcaagactctctctctaaaaaaaaaaaaaaaaaaaaaaaaaaaatatatatatatatatatatatatatatattttttttttttttccccagctactcgggaaactgagacaggaggctggcttgtgctccagaggttggggctgcagtaagccatgggtgacagagtgagaccctgtgtcaaaaacaaaagtgcgtggcatcttccccgtcactctcttttgctcctgctctccccatgtgccatgcctgctcctgcttcgtcctccaccatgagtgaaagctccctgaggcctccccagaaaccacgcaggtgccagcaccatgcttgtacacctgcaaaaccatgagccagttaaatctcttttctttataaattagccagcctcaggtatttctttatagcaatgcaagaactgcctaacacacctaccaaacattatattacagtttgtactgaatatgtatcactttcacactgtcataaacttgaaaaattataagtcgaaccatcataagttgggaccgcttgtgtgtgtgtgtgtgtgtgtgtgtgtgtgtgtgtgtgtgtgtatactgtggccctttggagagcatttgtgtaatatctaagatttttttcacgcactgccaccaagaatggattttgacccctttcggggagatatagccccagttgggaatgcatgccctggatgaaatgaaggctgtaggcagggcccttctgttcactctgagtggcgaggttgatgacatggagtaagtaggtcaggtggccctatatccatcattaatcaggataggccctgacctcaggttccagcactgccctgctagagacgtcctccaaaatcacactgttcctgcaccatctgttcagcctgcctgccccgtcctccagcctctgctacatctcctctccatgggtggcagccctctgcccagtggccggctagctgtggtagacagtggaatgctccatcaagttggcattactgaggaagtgcaggctgtccctgccagcagtaaccctgttcccatcctgtcctgcagccttacccgccccagctctaggcctctgtccagacgcctctctcagtgttctccctctgcacgtcctccccaaatgaaagcatggggaatggatttcagagaccccagcacacaatgttgaccatggctggaactctctggagcctggcatccctcataaacaagggccacaggacactggccttcacctcttcctggctccaagtgcattcctggatgcctttatccttctactgtgagctggaaacataaagccagtcacagcataaaccccttgtctcacaatcctatggattgtgccctaggatggtgacctactttgtttcttagaagccttgtctggccccctctgacctaggtcatgggctttctctgccaaaaacttgagcaacttaaggggccactgagataataccatctttgtctgcctcacctttgttgaacacctgctctgtgccaagcactgtgctaagccttttcacatacattacttaattcagtcttcacaatggccctatgaggtaagttcccattgtacagataaataaacccacagaaaagctgagtgacttgccagaggtcacacagctagtaagtggtgaaattaggacttaaacccaggtctgtctgaaatccaaaccatttactgcattgtcccagttgaaaaaaacattttccagttgtatgaatagaaataaaaatgacacaagacctttattgccagtgaaaagacagtgaatttaccattcttaaaagatgacagagctggccaggagtggtggcttgcacctgtagtcccagctactcaggaggctgaagtgggaggattgcttgggcccaggaggttgaggctgcagtgagccgtgatcgcgccactgtaacccaacctgggtgacagagcaagagccgatctcaaaaaaaaaaaaaaaaaaaaagacacctaacaacaaggggcagaggcaggacttaaaaccaggtacatatgacacccatatctcctgcctgtcagtgattaacccttggaggacaaagaatgacttttacgttcccaggcccagtcagctagatactcacgcctcagcctcctgcaggcaagaacaaggcagaagccccatttttagaacttggaagagagcgcagagcaagcctggcccctgggccagcctaagtatgagccatctcagcagctggcgcagccctccttgaaacactctcccttgaagaaattctgacctaaacccagtgtagccagcaaggctgaccctgttggtggaatctggtggccccagtatggtggtgggaggtaacagagaccctggtggtttacatttgccctctctccctttcctgaacccctggcaatattcttttttaagaaataatgcattgacttatgatttagtcatgtttcatcccatttgcttttccctggcttctaaaaccacaagcatggctgaggaattcatgtccacagtgtaggctctgaatagctttgtgtagggagaggttttgaaaagagaagaaagtggcatctacttgtgagatggaatgcatgaagacatcggggaggaatgcacgcgctgtaactgttagggtccctcggcagtttgggtagtgactcattcagcgtgggtacggattcctaacaagtgaagcttggtagtgacgtcattcttgcaagattgtctggaatctgttagagctgcctgacaagatcttaccttggagactttcatcacttgggggtttttcccagctacacttcatacccatcatttcctccaacttgtccccttttctatcaactggaatttggcaaaccagaactttcatgcatctgttccattgtcatcctcctacagggcgttcctgggacagtgtgtgctcctcacctcatcgctcagcacccatcctcctgacagttcttggttcggtcagtgcctacctcagctatggtccaggccttgcactaggtctcaggacagggaggtgatgaagacaggcgtgctaccctcaaggggagggcagggggcagccagagggcctgagactggtggtttccgggacagcacagtgctttgaacatagtgctaggcaataaatatgtgatggccaagttaatacccaagctgagtctccaaaaatgagtataggagttagtctagggaaaagtccaagccgaggtgtctccatgtactgagacccgtaagtgaataggaagaagtaagttccttaagtgaataggaggaagtaagagatgaaactggaaaagtggtttagggaacctcgtgtgccatgttaagaagttgatgccacgggggccacgtggacagatttgcagtagtgtagaggatgggctggaagggtccagaccggaggcagggagactggcttggaagttaatgtgaccctgtgaggtgatgtgaacattactggggcagtgggggtaggagtggagacaagaggacagatttgagaaacatttaggatttaaactcgacaactggtgattgatgaagtatatgggaaggagatgcccaggagacccccaggttttcagtgtggaggtgccacaagctgaaaagataagaagaggtccatgttaaggcagagttttgagttcatttcggccgtgttgagttagagttgcctgcaagagacatgagccaggttaagcaggctcacgggtggttagatacacaaatccaaagacagaggagagtctgggctaaagatactgatttaggacccattatattcatagcagctgaaactgtatggctacataccccccaacttcctttcctgctccatgtctgtttatctaggacttgggcgcctacatgaccatttttctctctgtcccaatgctgtcatgatgtgggatgacttcagtgccatgaggatgaaccattaccaagtctcatagctcctagatgccctctattctggtgactcttcacctccactccactgcagcctcccactcccatgacaacctccaggacattgctagtacctccttggaaccacttcagttctccggtaaaacctcacatcctcctctctgagcagcccctggctttcaactcttctacgccgttcccagttgtcttagttccctgtactttctccttgcctgttgaccccctcctgacctctcttctttcctgatccaggtcagactctccgactgttcatctgaaatattctttcctgaaacctttgattcctttgtacccctgctcctctcccacacctgcccaggacaacgctagttcatgttctctgctcctgccacaagcacacagaggaaaatggaccccccatgcagtggagcctcactggagcttcatggccttccctcttccatccctgtatttcttcatcactatggaaaacataagccttcccatggggaaatgggaaaatgtgggcagtctctttcccccaaaatagcttctccatctgctctgctgctgaattcctgcacagatgaccttggtacaaatctcaactgccatttaccaccttttctttacactgggcaagagatttaacctccttgaatcccagtttcctcagcgtaaaataaagatggcccagggttgctgctggcgtctgtgacaccctgtgcaaattattatagaagaagctgcccctcttgctaggcacacagcttggtgagctggccgtggcccacagcccactctcagccctcagctgggcacccttgcgcaatgccactttgcctaatcgcacaccgcagccccaaataagcctacctcccctgggttctgatgaaaacaaaggccataacctggaaagcactcagcagagagcctgactctgagcagagcctcaaaacaaaagctatcgcagaccagcagactcagattaacatggaagtgtgctctgctggggatgtcacacatttatgccagctccacagcgtttattagagagcagagccttaagaagcagggacatgagtcaggtaccttcagtgaaggaactaacccatggccatagtcaagggcccaggcaggcaagggacaatgggagggagagaggagtgaggcagctatggacagacaggattgtctgaaacggaggggaagggaaataagaaaccagcctccctatggcaacattgcctcgagccctagcagcagaggctgcccacccagacccatacccagctccaggcgctgcctcaggggctcctgcctctcagattctccccttggggtcatctcgccagctgctcatgagtgtcatctctcaccagccctgctaaatcctcaaccctccccaccggcacccctcccacccccattagaaggctcaggtattccatggggccagttttcctgtccttgcgcttccctgattccccagcttcctcaatgggcaccactagaactcagaacccagaagtgtcaaggacctcaggaaggcaggggtttcagatgccacacccactctataagagcagctcttccttaagaggaaatcactgtgagaaggcaaagggtagtagccacatgggtattatattgaaggaagatgaattatgccatcaccccttttggcacaaaaataattttcagtaaaaggttaaaaccatcatgttgtatcaatgagaactatttcattattccaagaatgattgactggaaagtacttgacttacaggaaaatcacagtgatacaatacagctcctacttttaaagcactttccgtttaaaaaaaaaatcataccagtgtataaaaatagttataccgaagatgtgaatcaacagccaagtaatttattggcacttgaaagctttgtggtataaatagattcaacaatgagaatgtcaagtaactctgggccatggcaacctaaccttcattttcactaacacaaaagaaagtcacgtgtagttcagcaagggccatctggtcaccttagaagagatcatgggaagagaagaacatgatagaaccaggaccaataagtcaggtcaactcaaagcaagggacaaggcagcaggagaaacagaggggacagaaaagtagtccctgccctaaagagagttcagattgtcccagagcgaaggcttgtacagaaaacgttcagcacaatgaactcagagtcctaagagaaatacaaagggattacaggatgtcaaaagggagggagactcttttcagcttgatttccttcctttttccctccctctttgcctgcttgccccaaaccttcactgggtggtgaaacaggatgggagcggaatcactgggtctgggtacaaagtgcagctctgccatttaccagctctgtgactctggacaaatgactggatgtttctgagactcaattccctcaagtttcagtggcgggggagtgcagggtcagtgtgaagatgaaatgaggtcaatgttgtgtgtgtgtgtatataaatacccggctttgctgcctcttgatgaggagcaaacagtaaaagttcactctcttccttacccttccactcctctgtaaagagtacaaggccttttctgccccttttatgtttaaatttcaaagagtttttccactgttggatgtaatgtgacttttcagatcagccttcttgtctttgacccgaaggcccctgtcagccaggagcctccctgcttctttgtggtttggggctcagtagtccaactgctgccctctttgtgcagaaaaacacagaacccctgcatctcacatctggtgagaaggtggagactggggcaactgagagacggtccatcagcaagcattaattgaacacacaggacttttaagggattgtaaaactctaaggagtcagcagggaaagacatggacgagatttccgacctctcgtaagagtttaacacatggagattgcctctgtcatggttcttggttgaaaacagaagaaaccagtggtggtcttggcacagggcgctggataccatcacaacaggactgccactaacatcccagtcctcaattttttgtttttgggcaatcaatgtcacagctaaaaagtgttcctcctgggctgggcatagtggctcacacctgtaatcccagcactttgggaggccgaggcaggcggatcacccaaggtcaggagtttgagaccagcctggccaacatgttgaaaccctgtctctactaaaaatacaaaaattagccgggcgtggtgacacacgcttgtaatcccagctacttgggaggctgaggcaggagaattgcttgaacccgggaggcagaggttgcagtgagccgagatcgtgctattgcactccagcctgggcaacaagagcgaaaactccagctcaaaaaaaaaaaaaaagaaaaaaaaacgaaagtgttcctcccagtcctctcattgtttcatgggggtgtcattgtctagttcatggttacaacggaaactgcctcaatgaggtgggtattcccaagtgtgggaaagagcttcacttcagtctaccccgatttgtagcagatgtccacttaattaaaaagaaagagagaaatcattcaggggtagaaattggcccatttgcaaattcacaaagagtgactgatattgatttctttctcacacttgggatttttaaaatttctttattattattattattattattattattattattattattattttgtgggggggatggagtttcgctcttgttgcccaggctggagtgcagtggcacaatctcagctcaccacaacctccacctcccaggttcaagcgattctcctgcctcggcctcccaagtagctgttattacaggcatgcaccaccacgcccggctaattttgtatttggtagagatggggtttctccatgttagtcaggatggtcttgaactcccaacctcaggtgatccgccagccttggcctcccaaagtgctgggattacaggcatgagccaccgcgcccagcccccaaaacttctttaataaaattttttatttttaaaaagtaaaacttacagaaaatttgcagtagccccatatactcttcacctagtttccccaatattagcattttgccacatttgttttattgctttctctcaaaatacatcaatatcatccttttttctatttgagagtaagtcacagacatcatgattctacctcttaatacttcaggatatgtctcctgaaaaaaaggacataacaaaaatacaatataattatcaaattcaagaagttttacatggagataatcttatatgtacagtcctgtaatgtcccaatagtggttttttatcatttttggttcaggatccaatccaagactacgtgttactttagtctccttgaatatggaacaggttcttaaactatgttgtctttcatgacactgatattttttgaacagcacaagctcattgttttgtagaatgtatgtcaatttaggtctgtcttacgcatttgaggcaggaatactacatccgtgaccttgtgtccttctccaggccccacatcagggagcagtggtgtcagtttgtcttcttattggtgatgctactgttggtcacttggttaaggtggtgcctagcaggtttctcaagtgtacagttactctttttgcctctgtaattaatacataatctgtggggggattatttataacttgtaaatatcctaccctcatcctacctttacccagcagtgttaatgcctccattgatgattccttcctgaatcagacagcactatgattgttgcagaatagtgactttttaaaggtttttactagctggcattctactgtaaggaagaatttttctttctccagtatatttatttattttatatcagtatagacttgtggattcttaataacatttaatgtgactgttaacagtttatctattttcagaatcctttaagtaaattgcttttgcattttgtggatgagtcaacctaattgcagccagagctctttcctgatgtgggtttggccatttaatctatgctccactctatagcaaggccaacaggaaatagaatgctgaccttttataggaattgttgggttaagcacataggttgttgaagtgttttgagtaactctggcaaaatgaggtactctgggaagatatcataaaggagcagggccttaaagacagcaaagggttttgaatgaaggcccaaaaaggtaaagaagactggcaggatcaatggcttccaaactagacacagagaaagggggacttggcagggcaagaaggagtgggagaaggtcagagtgtgaaccagcagtgaagtgaacgtgcccagtctgcgtggagggtgtgcaaaagagcaagggaggtcaagggaggaagtggaaaaataaatgaagaaacgacatgtgttaagagttctgttcattgattttaggtaaaaagattgagcaccaagggatgatagattcagtggaagcaaagccatcaacttttaattagggaaaagactagaaatgcttttggtcagaaaggaaagaactaacagttgcttagcttttattttttaatttctctcttctattgaaagttgagctgttttttaatgttcacaaaatccttatgagagagatgttaataacttcattttatatataagaaaacaaagtcacagagaatttacattaatttccccaatgtcataaagctagtaagtggtgaggccaagattcacatacaggtctatcttactccaaagcccacgctgccagaagaaagaaatctttagactggaagagcagaggtggaattggagctctcaatataaggacaagtaacttcccatatgccaatcaaaacacttaagcatggcccacagtaaatctcagtaattatctcaaccacacgctttggagtaaatcaatagtaaacccaggaagtaactgtcaaggttttcaaacctgacattcctgtataactcaatacacatacccacccctctgccttcttaaaaaataagttgtattagatataatttttatacaataagattttacccattttcagtacatgattcaatgagttttgatgaatgtatacagtcatttaatcaccactataatcataacctagagtattttcatcaccccagaaagttgctgtgcagttcctttgcagtcagtactccccagcccctggcctgctttctgttgccacatttttaccttttctaggatttcatataaatgaattgatattagttggggttcaccagagaaatcagaccaagaagagagatgtatacgtatatgtatatgtatatgtatatgtatatgtatatgtatatgtatatgtatatttagtgtgtgtgtgtgtgtgtgtgtgtgtgtgtagatttattatgggaattgacacatgcagttatggaagccatgaaggcccacgatctgcaagatggagaactaggaaagccaggggtacaatttagtctgaggtcaaaggcctgagatcccagttagtgtgctgagggagaggggagaacatagatgtgctagctcaaggagagagagaaagaatttgcccttctgccttttagttccatccacgccctcaacagattagaagatgcctgcccacattggtgaggatcaatcttctttactcagtctacaaattaaaatgacagtctcttccagaaacactgtcacagacacagaaacattatttctattaaacagaaataatgtttaaccagctatgtgggcatcattcaacctagtcaagttaacacgtaaaattcaccatcacaaaactcatacaatatgatatgtagtcttttgtgcctggcttctcccacttagcataattcttttgagattcatccatgctgttttatcagcagttccttccattttattgctaagtagtattgccttgtctggatgtgccacagtttgtttatccattcttcagttctacaacatctggattgtttccaatttggagtgattataaataatgctgctgtaaacattcacatgtaggtctttatgtggacatatactttcatttcttttggataaatagctaggaatagaattgctgggttttataaatatatgtttaacattattaggaaactgccaaactattttccaaagtgtctgtatcattttgcattcccacaagcaatgaataagacttctcgtatctccacatttacaccaaccattggtactttcagctttaaacattttagtctttgtactaggtatataatgccatctcactgtgttttgaatttgcatttccctagtgtctgatgatattgagcatcttttcatatacttatttggcatatgcatgatgaagcttctttgatgaagcttctgttcaaatctcttgcccatttttattgtgttgttggtcttattggattgtattattgagttataacagtactttactagatacatgttttgcaaatattttatcccagtccatggcttatcttttgatattcttttgaagggcagaggctttaaatttggataaatttcagtttatcaggttttttaatctttgtgcttttggtgtcctaagaaatctgcctagcacaaggttacagcttttctcctgtcttcttctagaagtttgttgtttcaactcttacatttaggtttgtgacccattttgagttaattgttgtctatggtgtgaggtaagggtttgtgttcttacatatggatatccatttgtcccagaaccatttgtttaaaagactgccctttcctccattgaattactgggtacaggttgcgtttccctaatccaaaatctgcaatccaaaatgcttcaaaatcatgggccaggtgcagtgtcatccctgtaatcacacttgtaatctcagcacttcaagaggccaaggcaggtagatcccttgagcctaggagttcaagaccagcctgggcaacatggtgaaaccacatctctctctctctctctctctctctctctctacatatatatatacatatatatatatatatatatatacacatatacatatatatatatatacacacacaaacacacacacacacactctatacacacacacacacacacacacacacatcagctggccaggcatggtggttcacgcctgtaatcccagcactttgggagggcgtggcgggtggatcacgaggtcaggagctcgagatcaggctggccaatatggtgaaatctcatctctactaaaaatacaaaaattagccaggcgtggtggcagatgcctgtaatcccagctacttgggaggctaaggcaggagaattgcttgaacctaggaggcggaagttacagtgagtcaagacagcaccattgcactccaaactgggctacagagtgagactctgactcaaaaaaaattttttaaaaaggccaggtgtggtggcacacatctatactcccagctacttgggaggctgaagtgggaggattgcttgaacccaggaggcggaggttacagtgagccaagatcatgccaccacactccagcctgggcaacagagtgagacctatctcaaaaaaaaaaaaaaaaagcttcaaaatctgaaatttttttagtgccgacctgatcctcaaaagaaatgttcattggagtatattggatttcaaatttgtggataagagatattcaaccagtgagtataatgcaaatattccaaaaatccaaaaaaaaagatctgaaatccaaaacatctctggtcccatgtatttcagataagggatactcaacctatacctttgttggaaataagttgaccatatatttgtgggtctgtatctggactcttctatcaagttatcaagtgagctacgtgtctatccttatgtcagtatctctctgtctaattactgtagcttatggtaagcctggaaactttgttctttttcaaaactgttttggctattctaggtcatttccatttacatatacattttaaaatcagtttattaatttacaatagttggcagctgggatttttattggaattgcattaatctatagatcaatttggggagaatttatatcttaagaatattgagttttccagtccttgaaactctcaccatttgtttttctttaatttttcttttactttccatagcaagagtggatagatcttacacatattcagttaaatttagccttaaatacttcatttttaaaatgctgttgcaaatgttttgataactttgagttcttgttcattgctaacatatagaaatagaattggtttttttcgctctgttacccaggctggagtgcagtgatgcgatcttggctcactgcaagcttcacctcccaggttcacaccattcacctgcctcagcctcccgagtagctgggactacaggtgcctgccaccatgcccagctaatttttcttgtatttttagtagagacggggtttcaccatgttagccaggatggtctcgatctcctgaccttgttatccacccgtctcggcctccgaaagtgctgggattacaggcgtgagccaccgcgcctggctgcagttggttttttatagtgaccttgtgtcccgttaccttgctaaacctactatttctagtagctttttggctggacttcttaggattttctacgtaggtcattatgtcatctacaaagaaaaagtgttttacttcttccttttcaatctgtatgccttttctttcttttttttcccctgtccttttgcactggctaggcaatccagtacaatgttgagtagaagtagtgagaacagacatctttgattgttcccaatattagggaggaagcattcagtctttctggttgagtatgatgttagctgtagatttttcataaatgctctttatcaagaagatcaagttacaccttatttctaaatttgctgaacttttatcatgaatgaatgtagaattttgtcatatgctttttcagctcctgttgatataatcataaggtttttaatattactgaattacactgattttttaaaatgttaaaccaatcttgcattcctgggataaattctacttggtcatgatgcattatcagatattttatatatatatatacacacacatatatttatttaatttgctttaaaaagttaaggtttttacatctatattcacaaagggtattgatcttgttttcttgcaatgtcattgtctggttttggtatcatggtgacactagcattatagtgtttccttggctctgctattttcttaaagaatttgtgtagaattaggattacttctcacttaaatgtttgcaaggattatccagcgaagccatctagtctagagttttctttgttgggaaccccttatttttaatataggaaggacttatcttctattccctatcaacacagtgtgtaggccaggcacagtggctcgtacctgtaatcccagcactttgggaggccaaggcgggaggatcccttgagcccaggagtttgagaccatgggaagaccctggctatttatttgttttatttgtttgtttggacaggatctcactctttcgcccaggctggagtgcagtgacatgatcacggctcactgcgggcttgacatccctgggctcaggtgatcctcctgcctcagcctcccaggtagctaggactacaagcacacaccacagtgcccagctaatttttatgttttttgtagagacagggcttcacgacgttgcccaggctggtcttgctcccagtgtgctgggattacagacgtgagccgccgtgcctggccaacctcatctctacaaaatataaaaagattagctgggtgtggtggtgcacacctgtggtcccagctactcaggaggctgaggtggaaggattgcttgagtctgggagacaaaggcatcagtgagctatgattatactactgcgctccatcctgggtgacagagcaagaccgtatctcaaaagaaagaaagaaaaaagcaacacatgttgtagccctgagaatgaagggtaatcaagttgtgagaatcgttgctgcctaaataatgcttccagcacacacagttccaccaagccctgtgtttccctggccttggctgtagtggaagggaatttaagtgattttaagagtgttttcaggtgtgggtacaatattttttaaactttctttctttttttttttttttttgagacagtctcactctgtcgcccaggcgagagtgcagtggcacggtcttggctcactgcaacctccacctcccgggttcaagcagttctctgcctcagcctcccgagtagctgggattacaggcacccaccaccacgcccggctaattttttgtatttttcgtagagacggggtttcaccctcttggccaggctggtcttgaactcctgaactcatgatgtacctgcctcggcctcccaaagtgctggtattataggcatgagccaccgcgcccagccatatttttaaaactttctaaaaaaccttgtctgcagccaaaaaataccctgctagctaacagagggttaggtagacctgatttctatcggcaatgccagaatgtctcctttccaccttgtgcctccactctggtcagggtgcaaggtagggaggcacagaggcgtggctaacctattcatactcttattatctgaaacttttttggaaaaatattataagcttatagcaaatcaaacaatataaaagtatataaagaagaaaagaccactgtccctgtaccttgcacataagaaaaccaaatattcacaatttgatacatatccttcatttttctctatattctttaaaaaaatacacatatgctcatatagataggtatttgtctttctcattcttttatttcttttcccccaaatgggatcatggatgctgaaacctcattttttcacttaactaatggacatttctccaagtatgtgcttctgttgctagacttttctcattaatagctgcatacttttccataataagaatgtaccagtttattcatcctatttgatagacaatcagatggtttccagcgttttgcctttgaaaataatgcagcaataagcatctttgtacctatattcctatattacaggagcttttccttctgtaggagattcccaggagcaggattgaaattgttgaatcaaagagcgttacacattttctttctttcttttttttttttttgagatggagtctcgctctgtcacccaggctgaagtgcagtggtgtgatctcggctcactgcaacctccatctcccaggtttaagcagttctctgcctcagcctcccaagtggctgggattacaggcacctgccactacgcccggctagtttttgtatttttagtagagacagggtttcaccatcttggccaggctggtcttgaactcctgacctcgtgatccacctgcctcagcctcccaaagtgctgggattacaagcatgagccatcgcacccatccgagcgttacacattttctagtcattaccatcttttcgtgtgtttattacctaccatatacatttccttttctgaaattgcaggcctatatctttattcatttttatcctacatttgtctttttcctagcagtctgaagatattctttgaatactgaggatatgttacatgtattgcaaggattttcaccaaatctgtactttttcacttggctttatttatagtatctttggacatataatttttaaaatatgtttataaaattaaaaacctgttatttttttcatgtctttttgtgtttactgacttgcttatgttttccgtctggggttatacaaaaatattcatcaaaattttcatcttattattttactgttttgttttttacattcaagactttagctagaatttaattttgtatgtaatgtaaggaggagtcaagacttggcatctgggagtttgccgtaactcttcatatcttgtggcattttccatgttttcataataaccctccagtcagctcatagttcctcaggtttcaggcctttcccatgttggctgctgtgctgcaaactgagagtgggaaggaaccatgtctgtctctttctccattgcatccttcaggaaggaccagtaaatgttgcaaagcacctagcatagggcctaacacattttaggcactcagacaacattcatggggggaatgaaagttgcattcacaccgcattactatcaccccttggcaagtttaatattgatggctttgtctgtgtaaacaaggggaaatgtcattctccttaacgccactcatggtctcatgagctcactctggtccttcctccttctgtgtctttattctttgaggtctgccttctctttataaatctggctcattctataaggactcccttctggcagaggcaaggtggggggcgctttcttcaaaccccttcttaaaatctaacagtacttataaattctgcaatactatttagcatttaatccacaatggattttagtccttttctagcacccatcactgtgctgggcacatagcccattaaatacatcaactgtgactgaaacaatcttgcatgccaaggttctttaaaaagcctgaggtatagcctcaagatttgttatgaaagcccttaggtctaaggaacaacaaactgggaagaggtagaaaatgaccctgagaggccgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaagaaaatgaccctgagagctgttgaatacaagaatggtttttctttttttttttttctttttttttttctgagacagagtctcgctctgtcgcccaggctggagtgcagtggcacaatctcagctcactgcaagctccacctcccgggttcaggccattctcctgcctcagcctcccaagtagctgggactacaggcgtccaccacctcgcccggctaattttttgtatttttagtagagacggggtttcaccgtgttagccgggatggtctcgatctcctgacctcgtgatccgcccgcctcggcctcccgaagtgctgggattacaggcgtgagccactgcgcccggcctaagaatggtttttcaagtgagactgtgtagtcacatttaaattgtcctgaacacaattgttagacaaacacgagcaggtattgctctgtccaaaggcacaggtccacagactttctcaggacgttttctgtttccatggccttcaccagcttggatctttggagcttcagagaaaatggaaagaaacttgatgtgtccctatatttggtttagaaataatatcaaatggctctcagctctttctgcgtgcatttttaatgaagaaacggctaattctagggctagggcagggactatacaagatgaccctggagcatcttgggggattttgtttgttttgtttttgtagaggcgaggttttgccatgttgcccagtctggtctcaaactcctgggctcaagccatctgcccacctcatcctcccaaagtgctgggattacaggtgtgagccaccacgcccggccccctggggcatcttgtaatgccagaaagtactcaaaaccaaaaggatgggcgtatgtcaaagggacacaggagccaactggaaaagctcccaatggccaaagctggaacaattcgaacaacaaaataatatagcattgaattatagcccaaagaataaaacaaccatgagttcatactgatataaatgactgaataaataaatggaagagaccaatctcccatgcagaagaactcccaataatttatgtagaaactccacccttaaggagatagagcatagaaaccccacccttaaggagatagagcataacttcagggaataattccccaacccttaagagtggaatacatgtaatgccttgctttccaacatgaaaaaaaaaattaaaattaaagaaacaaagagtacaacatgaaaaaagggagcaaagtaactttacagtggagaaacttggcaaagactaccttagccaggtgaccagggttaacaccatcagtaagaagtcatgttgatcatatgtgcccttaatatgatgtgatgaaaatgacatttcacctctgtggtcttccaaaaaccataaccacagcctgtaagaaaaacggacatatcccaattaaggtatgtgctacaaaatacataaccagttctcctcaaaactatcaaagtcatcaacaacagccaagtgcagtggctcacacctgtaatcccaccatttgggatgctgaggcaggaggattgcttgaggccagcagttcaagaccaggcaggccaacataatgagacccttttttttttaattaaaatttttaaaaattagctaagtgttgcacatgcctgtagtcctggctacttgggatgctgaagcaggaggattgcttgtgcccagccaggggttcactcaggagttgagcccaggctgcagtgagctatgattgtgccactgcacttcagcccaggcaacagagcgagaccatgtctctttaaaaaaaagaaaaaaaaaatcatcaaaaacaaagaatgtctaagaaactatcacagcctacaggagtctatggaaatatgacgattaaatgtaatatggtatgatggatgggatcctggaacagaaaaaggacattaagcaaaactagtaaactctgaaaaaagtatgaagttcacttaataatatattatttctttagtggtgataaatgtaccacagtaaggtgttaacagaactgggtctgagtacgtggaaactctgtattatccttgtaccttttctgtaaatctaaaactaaaattaagtttacttaaatatctttaaaatatgcagtttgggcaacagattgactacatgcttatcttcaaaactgtgctttcaattacagggtgctggtgacagctttgtgggagctctggccttctacctggcttactatccaaatctgtccttggaagacatgctcaacagatccaatttcattgcagcagtcagtgtccaggctgcaggaacacagtcatcttacccttacaaaaaagaccttccgcttactctgttttgattgctattagtcccaaaataaatatacctgggaataaaatgtacttgggggtggctgctcctggctaatgcttattagaaaatgtcctcgtcccctttctttgcaaatattagttcttttacgaagtcatcctcaagcttcaatttatttataacgatgattcttttgctttccatgcatttgcacaaaacaaccagaattaaagattccacaaccaagatctgtacaaacataaagacaagtaacctcaa

SEQ ID NO: 686 - DNA, 41073 bp, Homo sapiens
tatctcatttccaggcattgctggttcgtttttttcgaaaatcattccaaattatattccaattcgactttcttcaagttcatcccagaaaagcaaaggccgggcacttgaacaagaacagctgtcagcctggggcgagggggcagtgttggtgggggctggagcggggccggactctaattggtccacggcctcggcccgactatcaaatcagcagagcctgcgtcatcacgtcgttgcctgggctgccgtccgcggaaatttgaaatggctgacgggtcgctgacgggcggcggtctggaggcagcggccatggcgccggagcgcatgggctgggcggtggagcaggagctggcgtctctggagaaaggtgagctctccatgccggggccgaggagccgcctctgagcggaggcctggggcgtcgggaccctaggagggcgcctgggtcgcgggccttccggacccgtctgtccagggtggcgggaacggcggtgcgcggccgggacccagtgacgggacctcaaagtcgggcggtacccaggggtgggggactccctctcttccctatccgcatctcccactctccctgcactctctggcctccgcccgccccgaggttggagggagctggattgggccaggaattccctatctggatgggttttgcgggaactgtgcatttactgttgctcaaggggccattttttcatctgcatctcaaaggagatcacgaaccacacttcccttttccgaagaagagaaaagcttgaacccttggcttagatggctgtcctgtgcacggagggtagtgacgtgtccaaagtgaggagcgccaacttgggccggagtccagaaatagaaccggggtcttctagttctctgccctttcttcctcctcatagagtttcattactattttttttttctgatattttaagctggttcatgtttttacgttaacactttcggttgtattgtgtagcagagagtcccaacaaagtgagaaaacataagtgtgacaattccactattaacccacctatccaactggcaaaagtcacttggcttcagttttcccatctggaagactatgccaatggttgtacttgtggtgaagttgaagtgaaataaagtttttaaagtggctgcaaaaataaatactgcatggcatcgcttatattgggaatctaaaaaagaggaagtttcagaaagagagtagagtggtagttgccagtgggttgggggaatggggagatgctgggcaaagggtccaaagtttcagttatgcagtgtgaatagttctggggatctgatgtacatacagcatggtgactatagttaataatactgtattattattacagtattaataggcaatgacgtgatggtgcaatgcgacacaaattttgtacttgaaatttgctaacagagtagatcataagtgttcacaccacacacacacaaaaggtaactatgcgaggtgatggaaatattaattcactttactgtggtaatcatttcataatgtataggtatatcaaaacatcatgttacacactttattttttattttattttattttttttgaggcagagtctcactctgttgcccaggctggagtgcagtggcacacaatgtcagctcactgcaacctctgcctcccgggttcaaatgattctcctgcctcagcctcccaagtagctgggattataggcgcccgccaccacacccagctaatttttgtatttttagtagagacggggtttcaccctgttggccaggctggtgtcgagctcctaacctcaggtgatccgcccatctcggcctcccaaagtgctgagattacaggtgtgagccaccgtgcctggccatcaggttatacactttaaatgtatataacttctatatgttaattatacctccataaagctataaagaatggtgctggaaaaaaaaagaatggtgctgaagtactactatttctttaacaaacatatacattatgtaataggcactgttgtaaattattaacaattaatcttcttaattgaagtggatgtactattatcttccctttataggtgaggaagctgaggcattgtcacataaccagtaaggtactgatgccttctaaggttcatgtgcatcagtgtttgtgagcagtagacccttgagtacactttggtcatctgtgggtcaagtacttctggtggcctgaacagggacaaagaaatggaaggaagggggaaagggaaggagaaaatcaagggggagggagaaaaaaggtatctgctaacagctcagataccttccctgaaaccacttctggagactactctacattctaaatgctaccctttttagcattgcttatttagtagttgtttcatttattaaaaacattacatagaattagatatgccactggctgaatcataccttatgaaacattatatacagcccaaacctaatgtgatttgcattttctgatcttttccttagacacagtcattgaaattagtgaggaggaatctaataaccttactgaagtaaaccttatggattattaagactctcgtccctgtttattgaggggcgattgacagactgatattgtaggaaataaagggagggcttaacccatctgagaggaagtcagctccctttcttaaaggagctttatggaattgctttggaaaataaataactaagatacttgattattatcactggctaactgtagtataaatcacaggctgtatgctttgtaggagatcttgagtgatttccactgaattaaaaatcaactgtcttccagctggatgtggtggtgcatgtctgtagtcctagttactcaggaggctgagacaggagggtagcttgagtccaggagtttgaggttgcggtgagctatgatcgcaccactgcactccagcctaggtgacagagtgagaccgtttctaaaacaaaaacaaaaacagccttctacttctccccaaaacctcacagaacaacaacaaaaatctaactgtgaaagatcttaagcgcttattgttttgaagtagaatttggattttgaaatatttttaagtttggaaaactagtttcttctcacaatggtagaggtaagtagactattcatattcaaattcttgtttgtattttgtttgggatttctatgcaaggatatgaaaatagaagcattcaaataaggcactggagcttgcttatttttgctttttttttttaggtttgttccaagatgaagattcatgcagtgattgtagctaccgtgataaaccaggttctagtttacaaagttttatgccagaaggaaaaacctttttcccagaaattttccaaacaaatcaacttttgttctatgagcgattcagagcctatcaagattacattttaggtgagtaggttttttgctttttttttttgagatggagtttcgctcttgttgtccaggctggagtgcgatggtgcgatctcggctcaccgcaacctccgcctcccaggttcaggtgattctcctgcctcagcctccctagtagctgggattacaggcatgcgccataccaccagataattttgtgtttttactagagacggggtttctccattttcgtcaggctggtcttgaactcccgacctcaggtgatccccctgcctcggcctcccaaagtgctgggattataggcatgagccactgcctggctggttttttgcatcttttatctttttagtttgcaagtagattatctatttcagtccctcagattgccagttgtttctgagaaagtggatttattaacttccctctgctttatgcattctcaattcttcctgtgtttaatttgtttgtagctgactgcaaggcctctgaggtacaggaattcacagctgagttcttggagaaggtccttgagccatctggatggcgggcagtctggcacactaatgtgttcaaggtgctggttgaggtaaggttaattttgttattagacctttgtctctagctttaagcactttacttcagactgttatatccaaagtgcttatttttaattaaagtttatgagctgattcaaatagcatgtttttcacatctaattgccatgttgtaggaagtgttctgcaaattttaaaggcaactgaggagttgttaccagggaattaaactggttcaaattaattaaaagaaggtatttgagatcacttaaaaaattaggcctaattatgaagttaatggtttcaaaaaagtgtttaacttcttaattgtaattcgttaagcagctcaaacctaagaggcatttttatttatttattttttttaagatgaagtctcactgtgttgctcaggctggagtgcagtgggacgatctcggctcactgcaacctctgctaagaggcatttttaaactagcccagtttttgcctagcaaatttgtttatatgtggttaatctcttgacagtgtgtcccattgcagaatgtaaaaacagtcttattcttcttctcactaggccttttagattacatttgcattctaattacagctttgaatttttctcagtgtttgttaactgaccacaaaaagccctagtaaactaaaatgtcaaaccagggagtgtgaatacaagttgttgctgcagctcccttagaaaatggcatcacatactacagtgattatgtacaaggcagtggattgcagctattgcttgtgagttttaaaattttggattgtgctaatattttttggttgaagttcaggcctattcatttggttatgataagtgcccccccgccaatcagttctccgaaaacaatgaaagtcattgttttaaaacagaagcatgccatttctctgcttaaaactcctaagatattgtctttaccaagggcttagtgttggctttatggcttctcattgtatagaaaacacttaaaatccaagctccttcagatgtccttcatgtcctggtctcgttgcctctctttctcacctcatatcttgctgctccactgcacaccgcccccctcctccatttcctccctttggctccagcaagaaggactgcctttccgctcctccagctgccaagcctgtctctgccacaggccttctgtgctttcccagctcttcagatggccgcttccttctcatcctcctcagcctggctcagagctgacttccttgcccatctcagcagaacaagatccccacccctgctagttattctctgtcacctactggttatcattgtgtttgttgatctccctgattacagtgtaagctccatgagggtaagaggcagcctgtcttgttcatcctttatattatgggtaaagcctccccacccatgttgtatgcttttaaaaaaatcaggttgtcagtagtgtcttataggtgtatcttcattttgatttccatgtgttaagtcacattattttaaatttcagatcacagatgtggactttgcagccttgaaggcagtggtgaggcttgctgaaccatacctctgtgactctcaagtgagcacttttaccatggagtgcatgaaggagctccttgatctgaaggagcatcggttgcccctgcaggagctgtgggtggtgtttgatgattcaggagtgtttgaccagacagcccttgcaattgagcatgtcaggtaggaaaagaagttgagaaaaataaccttgtggccagaaactttggatgaaatgaagtaattctggtctgtgttagacccagatttaaaactcaactgtaaacttggtcattgcaatatttaaaaatatccaaagataggataatcttttttaaattaaaaaaaattaaaaatgttttaaatctttttttttattttttaattttgagacatagtcttgctctgttgtccaggctggagtgcagtggcatgatctcggctcactgcaacctccgcctcctgggttcaagcaattctcctgcctcagcctctcgagtagctgggattacaggtgtgcaccaccatgtcctgctaatttttgtatttttagtagagatgaggtttcactatgttggccaggtcagtctcgaactcttgacctcaggtgatccacctgccttggcctcccaaagtgctgggattacaggtgtgacccaccgtgcacctggtctaaaaatgttttaaatcattttatgataatttcaaacttatagaaaagctgacaaaactagtatagttgactcttgaatgatgtgggggttaggggtgcctatctccccccacccctacatagtcaaaaatctgagtataacatttgactcccccaaaacttaactactaataacttactgttgaccagaaaagaagccttaccattaacataaatagttgattaggacatattttctatgttatgtgtattatcttataataaagtgctagaaaaaaggaaatgttaagaaattcataaggaagagaaaatgtatttactactcattaagtggaagtggatcatcataaaggtctttatcctcatcatcttcaccagaggaggaagaggaagaagagggattggtcttgctgcctcaggggcggcagaggcaaaacaggtggaggagaggtggaaagggaggcaggagatgctggcacactcagtgtaaattatcagtggaccccacaaaattcagacctgtgttcttcaagggtcaagtgtataaagaattcctgtttatcttttacttggttttcacaaatgttaacaaaagtaggggattcttaattgggtttgtatatatttataaactgacttaaaagttgtggatgttaaggcttatggtcggtatatttcaatacaagagtacagaaagtagaagaagagaaagacagtgaagaaggttatatactatggtgtgtgtactgctaaaagacgaatacacatttttttcaagcatatgtctggtcaaagcaagtgttttcttaggctgcttctaggatccttaggggatgtattcctgcctgtgagtcttttttgccatagttatttccactgcacaagtggaccccttgtcccttccttgggaaagaaagcccatacctggatcagtgggtatgatttcaacaatttttcagatcaatcttttattggatagttcctgatatagatagttattttgtatcttcgccaaagaaggcttacttgtagctatttaaaaatagacccatattccttcaggaactagaagactgagcaatatataatgaccataatgtaaataacattgcttggtgttttgtagtataaaaagtactttctattttctataccattagtgagttaacgtggttttgctgagcttaactcgaatgctctgcaaagaagcagagtgtttcaggccctgctgccaacatcttacggacagtttctaattgtatgcaagaacatttaaccctagatgttcagtattgggccaagcagaatgaatctaaagaaccggtttctgtccagaaccaaaataactcccttctatttttctcattaaaaaaaatctgtcaattgaagcatttgaagataaagtgataactgataagtttaggaaattaggaatcagggagctaatctctatgggcatagaagttcgtggaaaaataagtatctggaatgttatttggtagtattatttgaggaggagcctggttaaatttacacttcatttggagggctgagatttggatcagtgcccagtgaaggtcaaattatgagggatttcatttgttcgttgattcaatgaatatttgagtgccaggtccttagtcaaggatggggtatgtctggtgcatgagacacaccatcatcagggagctgtcagtctaaaggtgggagatgagccttgatgaaataatcacgcacagatgtctgcatgattggaaatagcagtgagtgctgtgatgaattacagagtgtcctaaaattaggtcaagttgctgttctagggttatttactggaataatgacatttgaacttgggttagctgtgtgaaaggggaggcaggggtggggaagggaaaagatttgggagctcagtgtgtttaaggagctgaaaggccagcatggctggaacacagacagtgctgagagagacctaggaaatgagattagagaggctggcaggggccagacagtgcggggatttgttagctggttagtcatttttgtctttaagagcagtgggaagccactgaaggatttttattcttgggtgaatatgactagttttgtgttttgtgtttttgtttttttggaaacacggtattattctgttgcctaggctggagtacagtggtgcaatcatgtgattcaatgcaggctcgaactgtggggctcaaggcatcctcttgcctcagcctctggatcagctgggattataggcatgtgccaccactagccagctagttttttaacaacatttttctgtagagatgggggtctcgttgtgttgcccaagctggtctcgaactcctgggctcaagcagtcctcccacctcagtcccctaaagtgctgctttgtgttttcaggggttcattgtggcttctgtgtagaaaacaaatggtgggagatggaattggtagaccagttaagacgcaagagagaggactagagtggggatatagagaggacggatggaggcttactgagaaagtacaatggctggacttggtggtcgagtggatatcagagatgagaagatgtaagtgaggtgagagaagtcaaggctgacttccacatttctggcttgaaagaatcaacactgcgggaggtacagaagggaatgatgtgtaaatgcttggcatggtactggtgaggatgatattggagccgagtcatggaatagaactataagcttaccaggtggaaaaggtggaaggcacttctggcagcttgactaacaagttacatggaggtttgaaagagcttgtgaaattgagagtttaggtacaacggctctgaggcaggagaggcgcaatagggccagattatgaatctatttatagtaccacgttcaggacttctttttgagggctaaaagggagccagcagaggttttttcaatcgagtagaggcatgcttaagttcattacaacaacaacaacaacaacaacaaaagactccactagagggtgaagggactaacagcccaatctacaataattaggagatggctggtttcattttcagtgcttccttttcacagcagaacttcttgaaagagttatatataatcacagtctatacttcctggtgtctcagtaactcttctaccctgacctcatctctgaaattatgctcaaagacttccatgttcttgtattcagtcaacgtttcactgatctcatcctgcctctgatctcatcttgcttaacgtcttgacattctaggtatttgatcattcccatcttcttcacaccctctcctctcagcttctgggacaccactgttcagctggtgtcttactggcttgctttctcagtcatcttggccagcttttcctctcatgctcaaactttagaatgtcagagttacccagggatcagtcctaggccatctactgttttttccctaatcaaccttggaaccactttggaatcacctgaggaatttctttataaaagtattccaaccaatacatgaagaaagtgatagaatatcagtattttgtaaccactaatgaaataaaggttctagacagtgaacatcgatgactgctgcaaccattagggaaagagaactttatagagggtggatcaggttgacaacctgtatctgttgatcaatctgaacctcacaaaaagacatggccaggcattgtaataaagtcctcagttactgttgttggtaggttcttagaaactgtgatgttaatgaaaccaattttaccataggctgactgatataaacaaaagttaaagtttctacagcatatttctggtcatgaaaacatcatcaaacttctaaataaagaccccaaacaattctaatcttaaacattgaaataaatgtgaactatatatacattaagaaatattaatgcaaacaagataattattgacccaatttccaatttttggtgaaacagtgagtgacagtggtcattgtggtgacgagtaaatcaaggaataaatgtttgcaaagcggaaattataaggagcacctcctgccatcacccacttcaaaacaatgacaaacatagtgggctcactgagcgatttcatgccacagcattcattgttgtgcatttgtatgattattgtatactttatgaatttttgtttgacagtaatttgtattcattcactttccaacctgcttattccagttcagggttgcaggtggccaaagcctattcccgtagttcagggtgcaaggcaggaaccagctgtggacaggagcccatttcatcacagagtgcactcacacacccacactcagactgggacaaggtagacacagaattcacctcatgtgcgcatctttgggatgtgggaggaaatcagagtacctggagaaaacccatgcggacatgggaaaaatgtacatactccacacagacagtggctttggccaggaatgaggctctgctcttcctgcttcttgactgaagtacattacacctcccttgaagtattcttgcaaaaaatccttcctgaaggcctgcaggtctgtagatcttactgtcagtttactagaaataacataaagtacatgttaaatgacccatggggactgggtgcacctgtaattgtagcactctgggaggccaaggtgggcggatcattttagcccaggagttcgagaccagcctagacaacatggcgaaaccccatctctactgaaaatacaaaaaatagcagggcgtggtagcgcgtgcctgtaatcccagctactcgggaggctgaggcaggagaatcgcttgaacccaggaggcggaggctgcagtgagccgaggtcatgctactactgcactccatcctgggcaacagagcaccacactgtctcaaaaaaaaaaaaaaaaaaaaaaaaaaaaattgaccccatggggatgtaatcaccaaaatttagagtgggggaaattagtcaataaattgcaagggaaaaaagagggagaggtaatgtgtaggctaacagcgatttaagaaatgtgtcagtcaaagggcagaagcggaccctcatttggtgcctgattggaacaagtcaactgtgaaagagcagcaggagacaattaggggaatttgaacactggatatttggtaatattaaggaattaaaacttttggtataaagatttattttagagatacatactaaaaatttgtgaatgatttgatgtgtgtgagattggttcaaaataatccagtatatttgggagactgaagtgggtgggttgcctgaggtcagtttgagaccagcctggccaacatagtgaaaccctatctctacgaaaaatacaaaaaattagctgggcgtggtggcgggtgcctgtaatctgagctactagggaggctgaggcaggagaattacttgaacccaggagctggaggttccagtgagacgagatcgcaccgttgcactccagcctgggcaacaagagcaaaactccatctgaaaaaaaaaaaaatccaatatcaagatggtgggggaggagagcagagggtgcctgggtgaggcagagatgaaataagactgtgagttggtaattgttgaagctgcctcatgatacatggtattcatcatactattttctctgttgttgtatatgtttaggattttccataataaatttgttaaatcacttggagagctttaaaaaaatatggatacaactgggcacggtggctcatgcctgtaatcccagcactttgggagaccgaggcaggggggatcacctaaggtcaggagttcaagaccagcctggccaacatggcaaaatgcctctctactaaaagtacaaaaataagccaggcgtggtggcggttgcctgtaatcccagctgctcaggaggctgaggcaggagaattgctcgaacccaggaggcagaggttgcagtgagccaagatggcgccactgcactccagcctgggccacaagagcgagactccatctcaaaaaaaaaaaaaaaaaaaaaaaaaagaaaagaaaagtgtggatgctgatgattcccttgcaccttccccaccccaccagattctgattgcttggtctgggagagggaactaattgttcttgtttttaaatttatttattttgagaaagaatctcactgtgttgcccaggctggagtgcagtggtgcgatctcgcttcactgcagccccggcctcccagttcaagcgattcttgtgccttggcttcttgagtagctggaattgcaggggaatcaatttttaaaagtgtcccagggaactccaatgtacaatgagggttgagaaccactgccttatgattatgtccttacgtgatcttatacattgctttaacaccatcaatgtgttgatagctaccaggtttatgtttccagccctgacctttccctggagctttgggctgtatattcctctgttattttcaatcccaaacctgtttctctctcagtgttttttgtctcaacaaatggcactaccatccagccaggtactggtggtcaataaataattcttccaataaaaagaaagtcctggctgggcgcggtggctcatgcctgtaatcccagcactttgggagtccgaggcgggtgaatcatgaggtcaggagtttgagaccagcctggccaacatggtgaatccccatctctactaaaaatacaaaaaattagctgggtgtggtggtgggtgccatctcagctactcgggaggctgaggcaggagaatcacttgaacccaggaggcggaggttgcagtgagccaagatcacgccattgcactccagccccagagacagagtgagactgtgtctcaaaaaaaaaaaaaaaaaagtcctaacaaaaccagtgtggagaaacttctcttctttagctgatccaaaaaaggtctctatgttgtgtgactcatgactatcaaccatagcaaatatgcagcattctctaagatatgagaattgttttgatttactctttagctctcacccctccaaaatcctaatgttttgagccagtgatagaatttgaatgatactaagttccatttcagatttttctaccaaaacatttggaggagttgggatgaagaagaggaggatgaatacgattattttgtcagatgtgttgaacctcgattaagattgtaagtatttattgctgaccttgttgtacatgttggaaaaatagttacccatggtttaattttgcctgtgtgagatacacacacacacacacacccacactcactcactcactctctctctctgattttctttccaggatctcatagacagaaataaactgatgtacaaattgtaccaccccttgacaagtcattaaatgaaacttgtacaagtgcagagaaacttgcttttagtgtttataaattgagtctaaaagcaggaagttcaagaacatctaaattagtagctcactgttttgttaatttgaataaaattcaattgaacattgaactagtgggttaagaagccctttgttaaattcgattgtttgaaaaacagtgacattatttgaattatagaagactttttggctttaattttgtaaagaatactttaaaggtatatggctttactctaagtttctgcagtgaaacacagcaggctgaactagcagatctaccttaggatattttgtcagcctcctgccttaaatcttaatgaccttattaaatgtggcatttatctccccactagatggtgctttaagaccagtaattttttcttgtattcataagcagtaacttcataggcaatgctgcaataataataaaattataaattgcactccaaaaaaataattgtagaaggtaattttttccctgggtgaaagatgatttttttccccccgtttgaaagatgatttttttcccctgtgtgaaagatgagatgagaagataaggcagtaagcctttacatttttgtggaactcaagtcgatttagtgagtttctcttggcttaaatagtaaataataataaaataaaaaatgtgtgaggcccggcatggtgactcacacctgtaatcccagtaatttgggaggctgaaggaggaagacaacttttttgagacaagctctcactctgttgcccaggctggagtgcagcagtgtgatgtcactcactgcagcctcaatctcctgggctcaagtgtccctcccacctcagcctcctgactagctgtgaatacaggtgcatgccaccacaccgagctaatttttgtatttttagtagagacagggtttcaccatgttggccaggctggtctcgaactcctgacctcaagtgatttgcctgcctccgcctcccaaagtgctgggattacaggactgcgccaccgtgcccagcccgggaagacctcttgaccttaggagtttgagaccagcctgggcaacatagtgagaccccacctctacgaaacctaaaaaaaaaaattagctgggtgtgttagggcatgcctctagtcccagctgctggggaggctgaggcaggaagattgcttgagtccaggagtttgaagctgcaatgagctgtgattgaaccactgcactccagcctaggtgacagagcaagactttgtctcaaaaaaaaaaaaaaagtttgaaagtctgattaatagttctacctggtttagaattatgtatgtgtgattttagctcttcgtaaatgggctatgatttctatttaggctttccagtttttccattgtgcatttcctatttttccatagcatattcaataaaatcccaaaatttcaataagcttgagtattttctaggtttgatacctttgctcttaaaaagaaatgattgattttgattgacatgaaatatgataagggaacataacgtatatcggacaaattcaatctttacttggaaaaaaattgtattctgatttgatagccttgcatgtgctaacgacaagcaatgacttacatgcatagcttgtacatcactggcagatgggatggcataagggaggaatcgtgtgtagttttgcagaagacacggtggtacttgatggagagactggaatgttatcaaatgtaggcagacttaaaaaaggtctctgggctaagataggagtggggctatcaacaggcaagatcaaaccagagtgtctggattttgtactgtgcagtaaatttttcctttctgcttcaaaacacactgcttatatgtgactaaaggaggtctgaaaaaaaccaacactgcttcagaacttcgggatctgtgacacaaatgttacttcattgcttttagactatgaagtatcaatataatgaaaagaaatgaaaagaaataagctaacgggcatggatactggaagtgctaagagacttattttaaaatttgagtcttaatcttcacaacttagtagaacatggtttcatcctcaatttcttttttttatttttaaaatttttaaatttttttgtttttccctttttttttcacagctgttcactcagtttctttcggattaaccaaagtagacaaaatccttgcttttcaagcttcacctaattcacttacttgaaaagcgggaaaagtttcttttttattcattcaaaatgtttaagtgttcatagtctgatgtaaatttgtttaagatatggttctatcttgcatttgtttttccctatcttatttagagcatgactaaattaaaaaaaaacaacatcatttaaggcaatcgttctcactcttggctacacattagcatccccagggaacttaaaaaaatacccttgtatgtccagagacccatttaattggtctggatggggccctgagcatctgtttgtttgtttgtttgttttttgagacagggtcttgctctgttgcccaggctggagtacggagtacagtggcataattagatctcacagcagccttgacccctggggctcaagccatcctcccacctcagcctcccaagtagctgagactacaagtgcatgccatcacaccaggctcatttttgtatttttgtagtgacagggttttgccatgttgcccaggctggcctcaaactcctgggctcaagtgatctgcctgccttggcctcccaaagtgctgggattacaggtgtgagccactgtgcctggcctattttactttatttttaaacccattaattttatatctgttaacttgattgtgcatttacaaattattttattgcatctagaaatactctgtattctgtttttatatttgagaaagtttataaattaatacatttgaagtgccagtatggttgtccagtacaaggtcattttgtttcagtcactctctagattagtaatggcacctttttttccccctcggaatctcaagggcttattttttgaaattctttaataatcttccttagggaatattcagcataattttgtgccatagtgctttaaatggaaggagggactagattgtttgagtcatttctactttttgatcctataaatatgataaccttaaaaaaatttttaaagtcgtattcagatccatgaaaaatatagtaatcttaaacattgttgtgaaacaatttgagaaactgctctccctacccctactcccaaattgccccctgccaccttcttattaagcttttgaatctaatatatgagaagaaaataatttcttattaaataataaaattgtgtaacctgaactttcagtgtttctaaagcacaaatgcttggatccaagaaagaaagtaaaaactcctcaagagcagaaaaattagtgaccttaaggaagtggtgctttaaattttcaacagcttccacttattattattattattacagtgctattcagaaagacttaacatgcacctgagttatatactgtaaaactcttactgggtctttgagggctaagtgggctgttttaatgataggaaaatgtgcctgaaaggcagtggatttcactttgcttttaaactttcaggcattatgacattcttgaagaccgagttccatcaggacttattgttgactaccacaatctgttgtctcaatgtgaggagagttacaggaaatttttaaatctgagaagcagtttgtcaaattgtaactctgattccgagcaggaaaatatctccatggtggaagggttaaaattgtattcggagatggaacagttgaaacaaaagctgaaactcattgagaatcctttgttgaggtatgtgtgtctttgtaattcttagttagtcagcatcttttcttacttgctgtcttactgataggcctgtttcgtttctttaaggtatgtgtttggttatcagaagaattctaacatccaagcaaagggtgtccgttccagcggtcagaagatcactcatgtggtctcctccaccatgatggctggtctcctgcggtccctgcttacggacaggctttgccaggagcctggtgaggaagaaagagaaattcaggtaaacggagagtttctcactccaggtggctttttttccttctgattcaccacaggttttcacaaatcccacaaagtatttacaggagctttcccaagacggttttctgtgcatgggaagtagtgagagccctgcctttcatcagcagtagtcacttaccaggcatgtgttaggtcagtgcgctatcaaaggagatgcttcaatatgcagtttttggcttccattttcaaagtaagacatgaagtcacctagagtaatactcaaattacttttttgggagtgtatatttacaaatgtgttcttattgttttctagttccatagtgatccattgtctgctataaatgcctgcttcgaaggtgacactgttattgtttgtcctggccattatgtggtacatggcactttctccattgctgactccattgagttggaaggtgagtatggaagacacacaaccaaactctcacacgtgatatgtttaagtaaacaataaatcaccaatcttgttgaaactccaagaatgtgatttgaacccatttgatttctagtgagctgccttgaaacattaaggacatggaaagctgaaaagaggttgacccagtgtttcagcaatttgagttgtggttctttgtagcagtgtgtatgttggggagatgttcacaggctcatatagaaaaaagaccattaggaagaagcatactttccagattgtaggtggtttatggaaaggaaatctaatttctagaattaaaaaaaaattcctagcaatatttttaaaaattttagtattttaaaaatttgttgcttgctcttatctcatagatgttgcagatatgttagtgcatggctttttgttttttgtttcacacttagcttattttcgtgagaggtataatgaagggcatttaacttgaaattggtaccaattatcttaattctctaaatgcttgccgaatgtcacaaatgctacactttgtgtcttgaccaaagtatactttagaaaagattaatgttgaaagattctattaaaaataactttttgggctgggtgtggtggcttacgcctgtaatcccagcactttgggaggccgaggtgggcagatcacttgaggccaggagtttgagaccagtctggctaacatggtgaaaccccgtcggtactaaaaatacaaaaattagccgggcatgttgttgcacgcctgtaatcccagctacttgggaggctgaggcagaacaatcgcttgaacctgggaggtggaggttgcaatgagccaagatcatactactatgcttcagcctgggtgacagagcaagactctgtctaaaaaaaataactttttcacagttataatcttattgttcatttagagtgatttctaaatttaggttactttacaattgttcatcttggtcctgtatattttcataacatgtcaaatttagttacacctgttcaactatttatcaaaatagcttcaagttagcagtgaagcttgtaatgcaaaaaatcatatatcattttgggacttgtgcagctgttcagaaactgcttaagctatgctctttatcttgtcagtacttctaaatggaactgaagctggaagtttagttttctcctgttcctagtacatcatctcacccccttttttattttatgtgtgtaatttttgttcttttctactctccaatttttgatgtataatagatgtgtgtatataaataacacatctgcaagataaatcactgtgataaaaacactttattttttggcatagtggaaataacactgatattatagtttgtatggtagataagagttcttcctagattggtgaggaaattttaatgtaattgccagagtgtcataaatggacatatagaatgctgatagttaagtataaaaatggctgtatattgactaacagtatgggtctgagaattggggaatcacaaggtatctctagtgtgcatatatggagtgttcatgagtaagattcaagctcatctgatagtgatctatagctaaccaatataacaagagatatatattgagtacctactatgtgcagggtgtcaatagtacttacaatagggtttttctttcttgttttgaaaatccattcatttaggtaatggttttatgttttaagtggaaagaaatacataattatataaaaatttgtgtaaaaatcttttctcaatatgcaattctttttgtacttttaatttttctgatgataaaaagcaatggttattgtagaaaatatgccaagtacagtcagatacatacaacaatcagaaacaaaatcactcataattcaggcatccagagtccacccctggtagcattccagtgtgtggagtccccttgcattctctagggcccccaaagccttgtttgtcctcttccagtgtagatacattgagcggctttgcttgttaaaaacagttactgctttcatttactcaaagattcgtctttagtcaatgagagttatttcttacagctttgtctatgtggttctgttttataatggaagtcaagcgaattctttagttttctgatactctagttttttgtaagcccactcaggtgtttggcttgcattaatggtttgagtaagatttatacagatctgatggtttttttgtttttgtttttttgaggtggagtcttgctctgtcgcccaggctggagtgcagtggtgtgatctcagttcactgcagcctctgtctcctgggttcaagcgattctcctggctcagcctcctgagttgctgggattactggtgcctgccaccatgcctggctaatttttgtagttttagtagagacagggtttctccatgttggccaggctggtctcgaactcctgacctcaagtgatccacctgccctggcctcccaaagtgctaggattataggcgtgagccactgcacctcactgagatctgatgctttttttttgagacagagtcactgtcacccaggctggagtgcagtggcacgatctcctctcactgcaatctccgcctcccaggttcaagcaattctcccacctcggcctcctgagaagctgggattacaggcacatgccacactcggctaatttttatatttttagtagaggcaggatttctgtatgttggccaggctgctcttgaactcctgacctcaagtgatccacctgcctcagcctcccaaagtgctgggattacaggcgtgcgccaccgtacccagccttgatctgatgctttttatttgttaatgaggtagactgtttttttcctgtaactgtaactagtcagtttgtcagattttaagccaactgtttaagagaatattaaaattagatcatcttgagaactgtttaggtttattcaaatgtaatttatattagaatcatagaatgttagagttagaaacaaacttctaagggtgagtgctttaaagttctttgactcagctgtaagtccttattattattattatcattttttgagatggggtctcattctgtcacccagaatgaaggctggagtgcaatggcatgatcatagcttactgcagccttaaaattctgggatcaagtgaccctcccaccttagcctccttgagtagtgagtaattggtgcatgccaccatgcctgactaatttttttggtttttgtagagatggaatctcactgtgttgcctaggctggtcttgaacattatttattttttatagcacttttgaaagtgaatttagtactgagctgatgtgggatagttgatagggtagtcttcctgatacgggactagtcagagagttgttattgttaaaaattggataccctgatttaaattaaacaggatatgtggggagatagattttatttaaatgcaacatggttgactggtctcattatcatctgcagtcatttaaactagagaaacttgttctacagtgttcacgtttagatgtttttcctcacccatcttgagtgttgttgctctctcttccttaggatatggcctaccagatgacattgtgatagaaaagaggggcaaaggcgacacttttgtggactgcactggtgctgatattaaaatctcaggcataaaatttgttcagcatgatgctgtagagggaatcttaagtaagtatctgaatgtttggtatatcatttgttctaagatttgaaggtaaacggttctctctatggaagatagaatttaatgaaatgccactcttgagtacaggcataccttgttttattgcacttcacgatgctgagtttttttttttttttttttttttacaaattgaaggttgtggcaaccctgtttcaagccagtctgtcggcaccattttcccaagagcatatgctcaccttgtgtttctgtgtcacattttggtaactctcacaatatagataatatgctgatctgtgaacagtgatcttgatgttactactgtaattgttttggggtgccatgaaccacatccataaaagatggtgaacttaactgataattgtgtgggttttgactgttccaccgatcagccattcccctatctctctccttctctttgggctaccctattccttgagacacagcaatattgaaattaggccagttaataaccctacaatggcatctatgtgttcaagtgaaaggaagagtcacatgtctctcatgttaaatttaaaaattagaaatgtttaacatagtgaggaaggcatgtcgaaagctgagataggctgacacctaggtctcttgtgtcagttggtgaagttttgaatgtaaaggaaaagttcataaaggaaattaaaagcactactctagtgaacacatgaatgataagaaagtgaaacagtcttattgctaatatggagaaagtttctgtagtctggatggaagatcaaatcagccaccacattccttaaatcagagcgtattgcagagcagaaccctaacttccttcaattctgtgaagactgaaggaggtgaggaagctgtagaagaagagtttgaaactagcagctgttggttcatgaggtttaaggaaagcagccatttctgtaacataaaagtgcaaggtgaagcagcaagtgctgatgcaagctacagaaagttaaccagaagatctagctaaggtaatcgatgaaggtggatacactaaacaacacattttcagtgtagatgaaataaccttctattggaagaagattccatctagtacttttcatagttagagaggagaagtcagtgcttggcttcacagcttcaaaggacaggctgactctcttgttatgagtgaatgtaactggtgactttaagttgaagccagtgctcatttaccattctgaaaatcctagagcccttaagaattatgccagatctactctgcctgtgccctagaaatggaacaacaaagcctgaatggtagcacatctgtttataatgtggtttactgaatattttaggcccattattgagatttactactgaaaaaaaaaattcctttaaaaatatgattgcttattgacaatgtacctggtcatctgagagctatgatggaggtgtactgggagattaatgttgttttcatgcctgctaataatatccattctgcagcccatggatcaaggagtaatttcgactttcaaatcttactatttgagaaatacacttcctaaggctataccagctattgatagtgattcctccgatgggtctgggcaaagtcaattgaaaagtttctgggaaggagtcatcattctagatgtcattaagaacatttgtgattcatgggaggaggttaaaatctcaacattaacaggggttctggagaagttgattccagccctcatggatgattgaggggttcaagacttgaatggaggaagtaactgcagatgtggtggaaatagcaagagaactagagcctgatgatagcaagtagaacctcaagacgtgactgaattgctacaatcttataacaaaattggaacagatgaggaattgcttcttatggatgagcgaagaaggtggtttcctgagatagaatttcctggggaggatgctgtgaacatggttgaatgacaacaaatgatttagagtattaggtaaacttggtaaagcagaggcagactttgatgggattgactccaattttgaaaaaccttctactgtgtgtaaagtgctatcaaacaagatcacatgctacagagaaatcctttcatgaaaggaagagtcaatcaatgtggcaaacttcattgttgtcttatttttaaaaattgccatagccaccttaaccttcagcaaacaccattctgatcagtaagcagccatcaacattgaggtaagaccctccaccagcaaaaagattatgtcttgctgaaggctcagaggattgttagcatgttttagcaaaacaaagtatcttaaattaagatgtatatattgttaaaaaacataatgcctttgtacacttaatagatgcattataaacatagtactcattagtataaactcatatgctcattagtataaacacaacttttatttttttttgtttttagagacagtctcactgtcatctaggctagagtgcaatagcatgatcatagctctctgtagcctcaaactcctgggctcaagcaattctgcctttgccccccaagtagctgggactacaggcgtgtgccatcacgtcttgctaatttttgtattttttagagatggggtttcacgatgttgcccaggctggtctcagactcctggccttaagtgatccacccaccccagactcccataaacatttgtatgcactgggaaaccaaaaaaattgtgtgactcactttaattgtgatatttcctttattgtggtggtttggaactcaacctgcaatatctctggagtatgagtgtgtatggaagactgattatttatgaagctgggcgtggtggctcacgcctgcaatcccagcactttgggcagccgaggagggtggatcacctgaggtcaggagtttgagaccagcctggcgaacatggtggaaccctgtctctactaaaaatacaaaaactagccaggtgtggtgatacacgcctatgatgccatctactctggaggctgaagcaggagaattccttgaacctgggaagcagaggttgcagtgagccaagatcgcaccactgcactccagcccaggcaacagagcaaggctccgtctccaaaaaaaaaaaaaagtttactcatttaggctgggcgcagtggcttatgcctgtaatcccaacactttgggaggctgaggcgggtgaatcacctgaggtcaggagttcgagactagcctggccaacatgatgaaaccctgtctctactaaaaaatacaaaaattagctgggtgtggtggcaggcgcctgtaatcccagctactcaggaggctgaggcaggagaatcacttgaaaccaagaggcagaggtctcactctgtcacccaggctggagtgcagtggtgtgatctctgctcactgcaagctccgccttttgggttcaagcaattctcctgcctcaacctcccaagtagctgggattacaggtgcccaccaccacgctcggctaatttttgtgttttttagtagagacgggttttcaccatgttggccaggttggtcttgaactcctgaccttgggtgttctgcccccctcggcctcccaaagtgctaggattacaggtgtgagctaccgcatgcggcctagaaaattatttttttatgtacatagtgtgatgacttagcaatcttaacccttcagtaaaaaatagcctattcatgataatttgttgtttaatattagtttcttttctgtgtggtgatttttttcttttaaaactttccagtgttgtggtctgttttctctgtattcaaggtagcactagactgaagttatctccacatgggagtaatgtttgtttcctggaatctttgtatcccctttcttgaatcaaagtctttttcttccgagatactcagcaaaattgctctctgatgctttttttttctggtaatggaaagtgcttttgtatctgaggtcaagtcattctttttaaagaatgttgcttttagattgtagaaaataactcaaaatagtcattgttttatattttatgaatttgtaatttaggtaagaaaatttaaatgatagccattgagaaatatttagaccatagctaatgtcagcgcgaggctatctctaacattggaaaaggcacattacttcttaaaacagtcagcgtgtattttcatcccagttgttcaccgtggtaagactacgctggaaaactgtgtgctgcagtgtgagacgaccggagtcacagtgcggacatcagcagagtttctaatgaagaactcggatttatatggcgccaaggtagaagctcttgtcctcttggggaagtagtttgtgtttaagttgtaaatgaatatatgaaatatgggaccaagatgtatgtgtgtactcccactctcttcagacagtcatctctaccaagtcagtcaaactcaactgtgcaagggtcttctcatgtagcattttcaaatgataggaagaaaagtaatacatctcacaatgactttatgtagctttaagagaggtttagacccttaaaattataactttgtagattcacacagtgttgtaagaagtaacagggagaggtcctgcattatgcccttcaccagtgtcccctaatggtaacatcttgtgaaactgtcgtgcaacatcacaaccagaatactgacatcgatcctgtcagtagaagaatattcccatcaccacagggacccctcatgctgccctcctagagccaaactcacctgcctctcccaccaacctcttccttaactgcaggcacaccttaagctgtttttcatttctatttatttcatcatttcaaaaatgtagaaatggaatcacacagtatgtggctctttgggattggcttttctcacttagtgtggttctgtggagcttcacctaggtcgttgtatgtaccaatagcttgctcctttttactgtggaggaatagtccaatgtgtggttgttccacggtttgttttgtcacttgtggaaggatgtctagattgtctccagtttttgcctattgtcagtaaagctgctataaacgttcgggtacaggtttttgtgtgaacacagttttcattttttaaggagtaagtgacaatggatgcaattgtaggtcatatagtagttgcatgtttaggttttttttttttaaagaaaccgctaaaatgttttcagagtagttgtaccatcctactagcaatgtttgagtggtctagtttctccatgtcctcaagagcatttggtgttttgactattttttgttttagccattctgataagtgtgtagtgatatctcattgtggttttaattgtcatttccccagttgttaatgatgttgagcattttctcatatgcttatttgccacccttatatcctctttagtgaaatatctgtgacttttgccccattttctaattggattgtttgttcttctttactgtagaggtttgagagttctctgtatattctagatactagtccgttgtcaggtatgtggtttggagacattttttgccactctgtagcttgtcttttcaccttcttcatatggccttttatggagcaaagtatttaattttgatgaagtccactgtatcagtttttccttttatgagttgaggttttggtgataagaactctgcctagccatagatcctgattttctcctattttttttctaaaatttttatagcgttatattttacataaggttgtgatccattttctagttaattttggtataaggtgtgaggtttaggtcatggttcatttcttttcctattctgtttcactaatctgtgtagccatccctccaccaatacctgtagctatacattaagtcttaaaatcaggtagagtgatttctcctactttgtttttttcaaaattgtttcagctaccctggttcctttgcttttcaatacaaatgttaaaataattttgtctatatccacgaaagatcatgctgagattttgataggaactttaataaacccatatgtcaatttgggaaggattaacgccttccaatctttgaaaacaatgtatttctccatttatttaaaatctctgatttctttttttttttgagatagggactagggacttgttctgtcactcaggctggaatgcggtggcatgaacacggcttatggcatagcttcagtctcctgggctcaagccatcttcccaactctgcctctcaagtagctgggactaaaggtgcatggcacaacactgagctaacattttttactttattttttgtagagatggggtcttgccatgttgcctaggctgttctccaactcctaggctcaagcagtcctcctgcttcagtctcccgaagtgctgggattataaacatgagcccccacacccagccaaatctttgttttctttcatcagcattgtgtactcttcagcatacaaatgttgtatgtgttttgttagatttgtacctaattatttcacttttttgagtgattatggtattaatttcagtgtccatacattcattgctagtatatagaaatataatttatttttatatgtttatgctatatcctatgactttgttgaaccacacttataggaatgtttttgtagattccttgggattttctatatagagagtaatgttatctgcaaataagtgcaggttcttttttttcttttctaatctttatgcctttttccccccttgccttattgcactggctagaatttccagcactatgaaagcagacatccttaccttggttttgatattagagagaatatatttagtattccatcaaaaagaataaggttgaccaggtttttagatattcgttattaagttgaagaatttctgctttttttttttttttttttttttttgagaatttttatcataagtggatgttgacttctttttttctgagttcctttctcaggactaggctgacttttaatgttttttctggatagattgatatgatcgcatgatttttcttactggaaaacagaaaatggtgggttacattggttgattttcaaattttgagccagccttgcctctgtggcataaaacccacttggtcatggtatataattatttttatatattgctgaattatatttgctaatcttttgttaggaaattttgcatctatattcatgaatattggactctagttttggttttctgtgccactgtctttgtctggttctattatcgataataatagcttcataaaatgaatactgaagtgttcccttctcttgtattttgtaaacgagattgtgtagaattgctgtttattcttcagatgtttgatggatttctccaatgcaatcacctgggcccggagatttctcttttggaatttttaaaattatgaattcaatttcattaatagttaaaaggatattcaaatgacctatttcatattgagtatattttggtagtttgtgctttttgtggtattggactactacttctaagttgtcagatttatatgcatagaattgtttgtagtatttccttattcttctgatatctgcagggtatatagtaatgatccctgtttcatgcttgatgttggtagtttgtgtcttctctcttttgagaaccaactctttgtttcattgttctgtgttttttttctttttgataattgttctgttttcaatttcacttatgttctttttttagatttaattttaatttttagttttacttttttatgttctttttatgatttcattccttctgcttgttttggatttattttacttgttttgggttttccacctgagagattagattattgatttgagactttttctcttttctaatgtaagcatttaatgctataaacttgtctctcagcattgctctagctgttttgtaaattttgatatttatttttattcgttggtttgtgcagaatttagaagtgtgttgtttagtttctaaatatttggagttttactattatctttctgttgttgaattccagtttcattccattgtggtcggaaaacacactatatgattttaattcttttatatttctagaggtttcttttatggctcaggatatggtctatctggatacatattctgtgagcaaatgaaaagaatgtgtattccgctgtcattgggtggtatattctataaaatgtcaactagatcaagttggttggtggtgttgagttcttttgtattctttctgattttttttttctgccaattgttgagagaggggtgttgaagtctctaactataactgaatttgtttgtttgccttttcagtactattagtttttgcttcacatattttgcagttctgtttggtgtatgctcacttaggattgctgtgtctttttggtgagtcagcatgtttatgattatgtctgtctctggtaattttttttgctccaaagtctactttatctgatgtgaatatagccacacctgctttcctttgattattgtttgcatgatatgtctttttctattttttttaaattatactttaagttctagggtacatgtgcacaacgtgcaggtttgttacatatgtatacatgtgccatgttggtgtgctgcacccattaactcgtcatttacattaggtatatctcctaatgctatccctccccgctcccctcaccccacaacaggccccagtgtgtgatgttccccaccctgtgtacaagtgttctcattgttcaattcccacctatgagtgacaacatgcggtgtttggttttctgtccttgcgatagtttgctcagaatgatggtttccagcttcatccatgtccctacaaaggacgtgaactcatccttttttatggctgcatagtattccatggtgtatatgtgccacattttcttaatccagtctatttttgatggacatttttgttggttccaagtctttgctattgtgaatagtgcctcaataaagatacatgtgcatgtgtctttatagcagcatgattcataatcctttgggtatatacccagtaatgggatggctggatcaaatggtatttctagttctagatccttgaggaattgccacactgtcttccacaatggttgaactaatatacactcccaccaacagtgtaaaagtgttcctatttctccacatcctctccagctcctgttgcttcctgactttttaatgatcaccattctaactggtgtgaaatggtatctcattgtgtttttgatttgcatttctctgatggccggtgatggcgagcattttttcatgtgtctgttggctgcataaatgtcttcttttgagaagtgtctgttcatatcctttgcccactttttgatggggttgtttgattttttcttgtaaatttgtttaagttctttgtagattctggatattagccctctgtcagatgggtagattgtaaaaattttcttgcattctgtaggttgcctgttcactctgatggtagtttgttctgctgtgcagaagctctttagtttaactagatcccatttgtcaattttggcttttgttgccattgcttttggtgttttagtcatgaagtcctgccatgcgtatgtcctgaatggtattgcctagattttcttctagggttttaatggttttaggtctaacatttaagtctttaatccatcttgaattaatttttgtaaggtgtaaggaagggatccagtttcagctttctacatatgactagccagttttcccagcaccatttattaaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactgtagtcttgtagtatagtttgaagtcaggtagcgtgatgcctccagctttgttcttttggcttaggattgtcttggcgatgtgggctcttttttggttccatatgaactttaaagtagtttttccaattctgtgaagaaagtccttggtagcttgatggggatggcattgaatctataaattaccttgggcagtatggccattttcatgatattgattcttcctatccatgagcatggaatgttcttccatttgtgtcctcttttatttcattgagcagtggtttgtagttctccttgaagaggtccttcacatcccttataagttggattcctaagtattttattctctttgaagcaattttgaatgggagttcacttatgatttgactctctgtttatctgttattggtgtataggaatgcttgtgatttttgcacattgattttgtatcctgagactttgctgaagttgcttatcagcttaaggagatattgggctgagacgatggggttttctagatatgcaatcatgtcatctgcaaacagggacaatttgacttcctcttttcctaattcaataccctttatttctttctcctgcctgattgccctggccagaacttccaacactatgttgaataggagtggtgagagagggcatccctgtcttgtgtgacagttttcaaagggaatgcttccagtttttgcccattgattatgatattggctgtgggtttgtcataaacagctcttattattttgagatacatcccatcaatacctagtttattgagagtttttagcatgagacgctgttgaattttgttgaaggccttttctgcatctattgagataatcatgtggtttttgtctttggttctgtttatatgatggattacgtttattgatttgcatatgttgaaccagccttgcatcccagggatgaagccaacttgatcatggtggataagctttttgatgtgctgctggattcggtttgccagtattttattgaggatttttgcatcgatgttcatcaggcatattggtctaaattctctttttttgttgtgtctctgccaggctttggtatcaggatgatgctggcctcataaaatgagttagggaggattccctctttttctattgattggaatagtttcagaaggaatggtaccagctcctctttgtacctctggtagaattcggctgtgaatccgtctggtcctagactttttttgattggtaggctattaaatattgcctcaatttccgaacctgttactggtctattcagagattcaacttcttcctggtttagtcttgggagggtgtatgtgttgaggaatttatccatttcttctagattttctagtttatttgcatagaggtgtttatagtgttctctgatggtagtttgtatttctgtgggattggtggtgatatcccctttattagtttttattgcatctatttgattcttctctcttttttcttctttattagtcttgctagtggtctgtcaattttgttaatcttttcagaaaaccaactcctggattcattgattttttgaagggttttttgtgtctctatttccttcagttcttctctgatcttagtgatttcttgccttctgctagctttggaatgtgctttctcttgcttctctagttcttttaattgtgatgttagggtgtcaattttagatctttcctgctttctcttgtgggcatttagtgctataaatttccttctacacactgctttaaatgtgtcccagagattctggtatgttgtgtctttgttctcgttggtttcaaagaacatctttgtttgtgccttcatttcgttatgtacccagttgtcattcaggagcaggttgttcagtgtccatgtagtggagcagttttgttttgagtgagtttcttaatcctcagttctagtttgattgcactgtggtctgagagacagtttgttataatttctgttcttttatatttgctgaggagtgctttacttccaactatgtggtcaattttggaataagtgtgatgtggtgctgtgaagaatgtatattttgttgatttggggtggagagttctgtagatgtctattaggtccgcttggtgcagagctgagttcaattcctgggtatccttgttaactttctgtcttgttgatctgtctaatgttgacagtggggtgttaaagtctcccattattattgtgtgggagtctaagtctctttgtaggtctctaagggcatgctttatgaatccggtgctcctgtattgggtgcatatatatttaggatagttatatgcacccatatatatttaggatagttagctcttgttgaatagtctttttctattgttttaatttcaacttgcctatattctgtttgaagtgagttgtagacagcatatagttgagtcatgtttttaatccactttggcaatctttgtcttttaattgtatttagaccacttacatttaattattgatattaaatctttagtttatttcgtgttttctgtttgttatgcttttcatttcttgatttgctttttttctgccatcctgtggatagctgaacatttttcagaatttcatttgtttttgagaatatctcttcatataacttttttagtggtcgccctaggttgtatattatatgtacataacagtttactggtgtcaccagttcaagtaaagtatagaaaccttgcctccttttattattctctaccatctcctttttataattgtcttaaacatttgccttatgtacgtacatctagaaccatattagagaattttatgatttttgtttcaaatgtcaaacataatttagaacactcaagagaaggaaagcttattgtatttacctatatctttgcttactgtgttctttttttttctttttgatgttccaggatcttctcttttatcatttcttttttgtttagataacttcctttagtcattctatgaagatacgtctgctggtgacaaattttcctatttttccttcttcttagaatatcttgatttcctcctcattcctgaagaatattttcactggttataggattctgggttgacaattttttttcttttagcccttgaacaatactgtgtgtctttcatctgacgtccatggtttctgatgctgtcaatcacattttctctcctataggtaaggcataaaattttaattgatgctttcaagatttttgttttaagcttacactagtttaattatgatgtatgttggcgtggatttctttgagtttatcctgtttggtgtctgctcagcttcttgaacctgtaggcttattatccaaatcctgccaaatttgggagcttttagtcactatttcttgaagtatgtttttagcctcaccctctttctttccaggactctgatgacatgaatattggatcttttgttatattccagcagacccctggagctctgtttacttttctttttcactgttttctctgctattgggtaaattttactgttctgtcttccagttcactgattctttcctctgttgttttcattctgctgttgagcacatccattgagctttctatttcagttattgtatttttcaattctaaaatttccatttggttctttatatcatctacttctttgctgagacttcatttttcattggttttatgtgtgttcataattgcttattgaagcatttttatcatggctgctttaaaatcactgtcagttaattctatcatctctgacatcttggttttggcatctgttaattgtcttattcattttgacattttcctgattcttggtatgacaagggattttcaaatgaaagttggatatttttatattatgttgtgagaatctggatcttctgttttaacttggcttctctgatactactacaagaagggacagggttggcggtagatgggtatcatcttgttactggtggaggtagaagtcatggttcccacttggcgttcattgatacccaagttgggtgggggagctccttcttactgctatgtaggggtgggaggtctagcttcctacatggtctccactggcactgtgatatatgggagtggtcttgttaccagtgggcaatggtgaaagtctggaatctccactaggcctgctctgacactgccccagtagggagggagtggttgtcttggcactgccaggtgggggtacaagtccaggctcctcatatagttttcactgacactgctgcagggagggccttgcaactgtggttggtggggatgaaagtcctggctctgtggtgtttacctggaatagagctattattatctaaaagttttcctctttctaggttgcctagtcctttcgttagagcagcttttttttgggtgtatgtctgttggtgtactggattgctggcttcttcagctccaagtctagggattatgaagcaaaaagaaaggaacttaccactgtgttggtgttgtttcttgggtcctgaggtccctagctggtctgccttcttctctccatttttcagtcttatgcttgttttatatataatgcccatggtttttggtcgtacctagcaggaggaatagggacatctactccatcatcccagaagtggcaggctcctcagttactttttaattgccaaattatctgttccttttcataacatattttgaatatgactttcacttgctacatgactgctggtttaaattgttctcctttacaaattttatgtgattcctgacagtttgatatttaattttaaccatcttgctatagatatttttaaacatagtcgccccaaaatctttttttgcacataaccccaaactgaaaatctcttagaagacacaattagcacatttttaaaatcctctctacaaaagagttagattggtgtatacatatggttcaggcatatgtacagggttaagtaataataaatgttttctcatggaatactactgctactagaaaattaactgaacatacatgcattagatgtgtcatcaatggttacagcaactcttcttcatcgatgctgttgtgcattaaattattcccaaatggttgctgaaataactatagaggtttgagtgaatcatttttgttttccagagtgccttgcatagcattaggaaagaaattcttactatttttatgttttttggtgccataaggtatgagagaatagtgtcatgtttgatctttctggttactctgtttgaatgacacttgaactggctgctgatgttaacgtgtgtggtagggaaagccattgttggactcatagaaatgatttttaagttgggttggggtattttaaaactgacacgttttggaaaatgtggggtcttgtttctatcctcaaattacaatattttactaaattcaaatacttatctccaactaattgagtatctgagagaatggtcattttgaataagtgtgtctttcaacaaaattgttaaatgactttttttttttcttggcagaatcagaaaacatttatctagaatgaaagagagtagagcaagaatcaagtgttggcactcttagcgtgtgtgtgtgtgtgtgtgtgtgtgtgtgtggttttgaaaatgataaattgtcaacaacttgctagaaatggaacaaatggaaatgttgattaaaaatggctggtaaaacttatctgtaaagtactttatctttgtgctgtacatttgtactgtgttaaaggctaagaagtaattgtaataaactcttatagtcttgccttttaaaaactgattgtcattatctcaaactgtgactcacagggtgctggtatagaaatctaccctgggagtcagtgcaccctgagtgacaatgggatccatcactgcaaggaagggatcctcattaaggtgagcatcagccaaaacacccacttttcaatggatagaatggttttacctacaaattatgctttattaaattgttgggttctattttctggttttgaaaagcataaacagtgtacacattttgataatatcagtgattggaatctcttgtgagaatgctgttacctatagatctgcagaaatgacagaggaaagctgtgtcactaagggtgcagactgtgctacaacatgggactaaacatagctttttccttttatttttagaatagtgtgaataaagaagatttttaaggcaggaaatgttgaatatgacagttcctaaaacatttgttttcaatgtcacaggacttcttagatgaacattatgacattcccaagatatccatggtgaataatataatacataataatgaaggttatggtgttgtcttggtgaaacctacaatcttctctgacctgcaagaaaatgctgaagatggaactgaaggtatatttagtaatttttaatataaaaaccagacataatttatttcagcattaaatgctgattaaggatctgagtcttcctctcttccttaaaaaaggttgttgggatatgcttgggcatggagagagagaagcttggtaacattaagtcataacattacagactgtgaaagaaactttcaaggtcaactagttcaactgtcattcaaaatcttgatgttgtggtttctgtgcagttcccttcttatcatggttagctttcaatgagggtggatgtgtgatagcaacgatgggtgtgtgatagcaatggtgggtgtgtgatgctatggtgggtgtgtgacagcaacagtgggtgtgtgacagcaatggtggctcctactggcgtttgttaaggctggagacagtgaaatgaatgtgccaggctgaaggctgcatttcctggaggggatagtggagtttacctctgtttttattggtagaagtaaatgccttcctgtcacctgcctttcttggcagcgaaggggagctaactcagtggaaatctgtgaacttcaagctatgatgtagaccactattaagtctcagtcatagagaaggattaagctttgatgtaggtgaggaaagtttaaagcagtttatttatttaatcagctttttcaggttgaaagagtttaaagggtagtccttgtcatccttcaggatctgctccagttacatctctgcaagttctttatttcttcacaggtctcacaaaagtaaaataaaggtgtcagctgggcaggactcatctgaaagctctgggggcagactctgtctccaaacgcattcatatcattcatgggcagaattcattcctttagctcatgggtctgaagtctccattttcttgctggctgctggctgtttgctggggctggcactcagctcctagaggctgctctcaggttcttgcctcatggcccccccatctcagcaacagagaacatccctcaaggcaaatctctcatgctctgaatttctctgacttcctctttagcaaccagctggagaaaactgattagcaatcttaattacattgtaaaattacagtgcaaaattcttctgccatttaataggcatgaaagtaataccagggggtggggatcatggggcctatctagaattagctgctagattgggacttcatttagaaaagtggcactatcttatcaatctgtgcatcctatctcctaacgcagtgcttagcagatagtaactatccaggaaatgtctgttgagtaaaagtgattctgggatgaaaagggtaaaggaagagttcaaaattggtgatcctgtgtgagggtcagggaaccttggtatagaaagcaaggcagctgcttgttgagaagactgtgtagaaatatatgtttttgttgggttagcttgtatatttaactttgttattatttgtttgtttctccagaaaataaagcgcttaaaattcagacaagtggagagccagatgtggctgaaagagtggatctagaagagctgattgagtgtgcaactggtaaaatggagctttgtgcaagaactgacccttctgagcaagtcgagggaaattgtgaaattgtaaatgaactaattgctgcctccacacagaaaggccagataaagaagaaaaggttgagtgaactggggatcacgcaagctgatgacaacttaatgtcacaggagatgtttgttgggattgtggggaaccagttcaagtggaatgggaaaggtagttttggcacatttcttttctgactacagtgatgtaagtagatagcaaaatactggattttgcacatgctgccctaagaatcactgctgccattgtagtttgctgtattgtctgtattttatatttgattatttgggcttgagtgaaaggtagatttatttccatttgcaggtgttgcacataaaacactccctctttataagaaaaatcataaatgcatataaaatagaaaatatttggagattgcttatctgaaagtcttgctttcttatacacatggttctctcatattaagcctggtagtaactttttagtgtaattacctttagcacttcaaagacgaggaagtaaggaagggaatgcaagactagtgcataaaaatgcaataggtgtcatatgtacagcattcttcttagagttgccttttcatcccaattacagtgagtctgatttccatcctgtatttgcataatacttgtcttaaaataaaagcttttatgattgggaatttatctgcctaatcagacttattattgagacgtcaatgggacgcatttttctgttgagctatgcagtcgtcaaaacagcgatagacagcataggaggtttgaagcagaaatgaaatgtgttattcagagccaatgttgtacatagagcattttcactattgctgaatgggaatgattaaaaacaaggtatttttcgggccaggcggtggctcacgcttgtaatcgcagcactttgggaggctgaggcaggaggatcacttgagcccaggagttcaagactagcctaggcaacatagtgagaccctgtctctactaaaaataaatttaaaaaaaattagctgagtgtggtggtgcatgcatgtagttccagctactcaggaggctgaggctagaggatccttgagcccaggaggttgaggctgcagtgaggtgtgattgcgccactgcattccagcttgggcgacagagcgagacccagtctcaaaaaaaaaaaaaagtatttttctcttaccgttacagtattctgattatattactgacacagtcaaaatgattaactgtacaacctgtatctgctgggtgttcttgttatcatattgtaaaacagctttaaaaatatttatattttaaaaactgtatgtgacattaatatgcctaatgattaaaattatagtgatgaaataacaaaa

SEQ ID NO: 687 - DNA, 40692 bp, Homo sapiens
accataggtcacttctgagatctgggacatcaactgcccggagagtggctgggtggacatcccagggtctttttattgttttctgttgcatcccagaccctacaaccccttcctgaaagggtaagtcgcgcttcccttaagaaaaagttgttagcaggtgtctcctttctcacaggggataattacaagggttcagccagaacaaaggccgcagatggaaggtgggaagaagacttgggataaggtgtgtggaggagcccacaggctctgcccaatcccagggagtgacgggacgtctttccgattaggggacgagaactccccgatacaaacatagcagtggcatcgcccctccgcgccccccacgccatgacgaggggacgccgggggaaatcctgcagccgtgggagggacggatgtgctgggggaccgagaggccgcgggaagaggcactcgcatccagaaggcattttagagcgagggtcaggcgcagcggcggactgcgggtcccggcttcggagcccgctgtccagcagggtccaggaggacgtggcgcccactcaccgctgctgctggtgaagtagaacaccatgatcccgggagcggtgcggtgactccaccgcggagcagcagcgctcaactcacgaagctcaggataccagactcgcggcggccgcctggcccccggaactcctccgtgcacttccggcggacgtcggggcgcgtcataacgccggccgtgggcgccatttttaatcctggcgaggcgaagtgtagtggcaaggagtttggttcagtgatttgtgggttaagggaaagaggctgggcatcttgggcacgttagttaacctgtctgtgcttcactttcctcagcagcgaaatgaagatgatactagagcagctaactcacaggatattttttagggttaaataagttaatgggcgccaagggtttagaacatagcacacaaacgagttgtttctgatactcaccaggacaatatgcctcttggggattggactttgttctggcttaaatcgaaggcctgccatcccaaacctctgaacctcagaggtcctcctgctataaagtaggaataatcatattcatgtaaagctcctacagcacttggctttgccctgattatttctcttgagaaagcacttttatctgaggaatgtgagtccctttaaattactaggtctggagaggcattaagataagaccccatcatgttctaccacccccttgagctatgtattcatctactgaaactacctgcttctgccacaggtagctacctactaacctaacactgccacacaagacactatgacatgacccacaccctatagtttaacaatgtctagccaatcactgatgcttgtagtttctatacatcaatgagaatgcttgacagttgtgtatcagcccacttcctgccccccttcttcgtctttaaaaacctgcttgtagcaaaggccagacagagctcatatccaagcctgctggtggagggcggtggggggaggggggttggaatcttctgggcagctgtccccgctttaactcaagcaaactctacattctttttttttttgcctcagccttttccttttaaactgacactcttacatcactgtcactgacttcattctatgaaattgagggcgtcacttaacgaaatttatttacatgcttgctttgacagcatgtatactaaaattggaatgatacagagaactttaacatggcccctgctcaaggatgacatacaaatttgtgaaaattaaatttgaaaaaataaacataaaactctaaacttatttgaaactaaaaatgtgccagaaacactgtaccaggagctggtgacacaaagatagtaacaatagctaacaataaccgttttaggaactttctggttttccaaagtaagaatttagctctgttctgtaaatagcaattgttttgggttctccgttgtattatttgtaaaatgggaatggcaatagatattaatgccttacagattgtggtaagaagtaaatgaaacaaaacatgtaaagcatctaagaatgcctggcacatagcaggtgttaagttttatattttaatttgaaaaataaatagaaacctaaagttactaataaaaaaagtgaaactgacaatgaagcttcaaatgtgaaaaataagtgcatcgagaatcttggagaggcctttatttatttatttatttatttatttttgagacggagtcttgctctgtcgccaggctggagaggccattttacaaaaatttcttaccccgtgaccccagaatgtatctcaacttcaactggaccgagaactacaattcccagaatgcacctaaacaaggccccgggaacggagtccggcgttgctgcaggggattgtgggtggcgtggtttccctcagagatttttcacctcaccagggcgcgagaatcttggaaacagccaccagggtgggcggggcaagggctggtgctccaccaatcaccgagccagcccctggaagcgctgagccgtggccaatcggaacgcagcggcttcctcctagcctggcgcgcgattatttgaagacgctcacggagcggctggctaggctgaggagagctcgccgggctctgaggcgcaggtaacctctggagtaggccgaggcggggggctgtggaaggctgaggcgagcgggagaccctgtggaacgtgggggcgaatgtcacggggaaagagcttttgctcggcgctcggcaggtccgcaggcccgagaccgaagaagccactgactcgttctccgcgctcacaggcgccgggtttccctcttcccgacgccggcgtttccttgttttgggtttagggtttgtttgtttgtttgtttccctgaccgggttcagggtcgggacgctttcctctcctacctttcctcgcttagccccagaggggtccccccttaagccgcagctcgacctgaattcccagagaccctggcctttcagtttgttcattcattaatagctttgaaataacgcttgtgtgctgctttggggggaatttccctgatcccagggaaggggaaggaaatgaattctgacgagccacgtagccgcctgctcgtgcattctagcatttgttttcagcagccttacgacttcaagagatttttataaaaagggaagcaaacggcttgctccgggctcatcagctaggaaaatggcagaggactgtgcttcacccgttttcttgctgggctctgatgaaaagttacagacggtctctgccttcattgaaggctgttgagatggggaaacaagaaaatgtcttaaatggactattagggaaatacagggtgccatggaagcagaacaagcgcgtgtaacccttggaggggtggaaggagagcaatgtcgaggaagacctcccagaaaatagggttttaacttggtgtgaaatagactaattaaagggggtataattttgataaagcgatttttaatattttgatgaatgtggttattgtcatttcttttaggaattcaataaagaaaatggcagctcttactccaaggaagaggaagcaggattctttgaagtgtgacaggtgaatctcagcctgtgaatagaaactcttagaaaaatccaccttcttgtctctcttgttctctcctattttctaaaattttcgttcttccactagcctactccttgtggctacagtgataacctgataacctatattctaattctagcttggaaatacattaagttttcataatgaattatttagtccttttcaagggaatcaaagctgttttttagtttttgtttttttcttttgacatagaagcagcacattgaagaaagctgttttctatagctaggaaatataccaaatcagctattacctttttcctttctgttcccctataatattttacagtgttttgcatacagtagatgcttgtctggaaacaattctagaaagactgtgtactcagatattaattactctacccaggaaaagccccagggggtcagttcattacagacagttattatagggggcttgtaaacaatagagcaaaatatatgagctataatttatatatggccaacacatagaaatcgattttaaaacatacatgcatatatgtctatcatagcttctttgtatatagtatttgttttcatgaactctttgggaagatatttgaatgttttatttgataaagacagaatttgagaatcctactgttaaactaatagaaaattgtgtgtatggggggtacatgtattgtttttaatatgacctacaagtagagcttacttagcagtagatttatgtaaattttgacgcaaaataatcttatcaatggactttgtttctttttatagccttttacacttcactgaaaatctgtttccatcacctaataaaaagcactgtttttatcaaaacagtgataaaaatgaagaaaacctgcattgctctcaacaagagcattttgttttaagtgcgctcaaaacaactgaaataaatagactgccatcagcaaatcaaggctcaccatttaaatctgcgctctccactgtatctttttacaaccaaaataagtggtacctcaatccactggagagaaagctgataaaagagagtagatctacttgtctaaaaactaatgatgaagataaatcttttcccattgtgacagaaaaaatgcaaggaaaaccagtctgctccaagaagaacaacaaaaaaccacagaagagtttaactgctaagtatcaaccaaagtatagacacatcaagcctgtatcaaggaattctagaaattccaagcaaaatcgagtgatctataagccaattgtggagaaggaaaataattgtcattcagctgaaaataattccaatgctcctcgggttctgagccaaaaaataaaaccacaagttacactccagggtggagcagcattttttgttagaaaaaaatcttctcttagaaaatcgtccctggaaaatgagccgtcactgggacgcacccaaaagagtaaatcagaagtcattgaagattctgatgtagagactgtcagtgaaaaaaaaacttttgcgacaaggcaagtgccaaagtgcttggtcctagaagagaaattgaaaattggactactgagtgcaagcagtaaaaataaagagaaattaataaaggtaaagctaaatatatcactttaaaaatggctgtataacaaaacttcagtataaatgacatagttgaataaaattttattttctggactgcttttataaagccagatagcatagtgtttagttactgtaaggagtttatttatttatttattttaagacagggtctttctttatgacccaggctgtagtgcagtggcacactgctcactacagcctcaacctcctaggctcaagcaatcccacctcagcctcccaagtagctggtactatagatgcacaccacctcacccggctaattcttgcattttttgtagaggctggggtttcaccatgttgcccaggctggtctcgcactgctgggctatagtgatccacctgcctcaccctcccaaattgctgggattatgggtgtgaaccactgcacctggcccagccacattttaagttctcaatagttacatgtagctggtggctaccatattagaccatgctggtctagaacttctgttgctgacctcctgtttatatccttcatcagaaaaaaagttgagttttgtggggcagctaggggcagaaagccattgaagcaaccttaagagaggttgtctccagatcagggcttccatgtatggtggcttgtttatattcatcacaacccttgtagctggagaaatgataggcttatatgatacccagtacactcaggcttatagtcatgtctttcctaacccacctctcatcattgccttcctcactagtttctctcaaattcaaccccagtccatatctctcgtaatcacctaaatttcaaacctcagtggcaaagataataaattggtggccagtaaaccaaatctcacccataaatgttttgcttggcctacataatttaaaagttggagccaaaattatttttaaatacaagaaaaacatttctggtgtctcatgaaatattgaaagctgagccttcatttctacatggcaataatcagagctgaatatcaggctgagtatcataccatttgacaaatatgggttcttcatttctctaagtcagtgtatatctatctatttagatcagtttagttttgatcattttacttactgctgcccttgtaaggcatttaagtttttagtcctcactgtaaatgtttgttttttttcctgtttatcgagtatggccaagtagattgttaaatgagatacgttcttgctagctaagccatgacagtctaattttactaattcattttctgtttatatcaacaaaacacttctgtgtcttgatagggattttgattacaagagtaagctttatcaaaatgtattaaactgtgctttatacttatacatttgtatgaaaattaagttttttgaaagtttggggcgtaactcaagctaaaattgtctcaatccagtaaaacaaaggaagagtctgcagtttccccatgcatctcctgatgattattcttatctgtttggtacagcctggtggtgtaccaaatgaatggtgacctgatgaattctctgtaaccagtgtaacagagaattctgtaattctcttttctgtcttattttctttttcttagcttcactttacgggtttggtattgagttagttttcagtagtttgggaagctgggcttttgtgcattttaaatttgtggaacggggctatgctctttcaagattttgctaaatacccatgtctgggattcgtctctgctagctaagggcgaatctgattttctgtttttttattttgagatggagtctcactccgttgcccaggctggagtgcagtggcatgatctcaactcactgcaacctccgcctcccaggttcaagcaattctctgcctcagcctcccaagtagctggtattgtaggcaccggccaccacacctggctaatttttgtatttttagtaggaacggggtttcaccctctcagccaggctggtcttgaactcctgactttgtgatccacctgccttggccacccaaagtgctggtattacaagtgtgagccaccgcgcctggccggtgaatctgatttttgtgaggataccctttccccaactcatggagccctgaaaagtgttaaactgatgggttatcccacctctgctgggatattatggttttgagtagaagttctactttaaccaagagtttttttcctttttccccaagctatatattccctagtaattcccaaattagtatgagggaaatctgtcaggatttttttctactttgcttttcccacattcctgctactctccagtgactctagaatgttctttccttagctgctgatttttaaagtttatggcaaaaagttgtccctttccagtttggtggctgctggggaaacttttgccatttttactggcttttttgttcatttcattatggaagtgatggtctgtaatcattctgccatctctgtcaggaagtataacacatttttgagaggatgacagattacaacacgtgtactctggcttttttttcttttgagacagtcttgctctgttgccaggctggagtgcagtggcacgatcttggctcactgcaacctccgcctcctgggttcaagcaattctcctgcctcagcctcccgagtagctgggactgcaggtgccaccacgcccagctaatttttgtatttttagtagagatagggtttcaccatgttagccaggatggtctcaatcccttgacctcgcaatctacccacctcggcctcccaaagtgctggcattacaggcatgagccaccgggccctgctgtactctggctttaaaggtaatgtacgcttagtgaatacaggggaagttttcctaaaaatagtttgaaaattgattgaaaatcacattatgaaatgtaattcataataaaccaaatcttttgttttagaaatagatctgctgggattcattcactagaaaatagttaaaaattacagatgtttggttttttttttaaacctattttcaggattcatcagatgacagagtttcttcaaaggaacataaagttgataaaaatgaggctttttcttcagaggattctcttggtgagaataagacaagtaagagaaaactcgcatgaatttagctgcttaaaataatgctttattacatacattatacaataataattcttgtaatttctgggtctttcttttttcagtagcgtgcctgtggttagtatctttgtttatctctgtgacactgttttctgtagtaaagcagtgcattgcgttttgaaaaacaagaaacaaggagatcctaggttaaaattttagacaaaatattaggcttaattggtctatggctgtggccaagttacttaagctctctagagttgagtgttctcattataaaatcatacctactctatctttcacccaaaataatagaagttaaaactattatgtatatttgtgatcaaagcccaattgtgagcagaacttactaagttttataagtgacactgaaattaagcatcaagaaccatggatttttgtctaggtttactaataattagctgtatgatctaggaagatatctctaaagagttaaagttaatttttaaattcctgtcaattctgaaatcctattcctaatttatgctgtcagtgttcaattaaatagcttactaaactatgaatacataaagcttttttttatgattctgagatatgatgttaataactagtatttactgagtgctgaatataaggcagtgctaaatatttagtatacgttatgtttttcatagattgtgctcaaagcactgatacaatagaaaatataacaaaaaggcatctacttaaaatagttataaatttttcttttaaaatatattttagtacattgtctaagtcaatttaaagaaaaatagtgaataaaaataatacaaatggtataaggatatgggagaaatcataaaagtaatataaaaagaccaaaactttattacttaataactacagtttatcatttaattctccctactactctaggtcctgatatgcccatttatagatgaggaaatggacttgggttaagtaacttaccaatagcagctcagactttcacctgccttggccttgtttctagaggatgagctctaattatttttcaatgcaaagttaaagtttgtttttttagcccactctcagcttactattttcctcaaatcaattgctgttttaactttgctcttttcttttaatagactttattttgccataattttagatttacagaaaagttaaagtacagagagtagcagtgtatctcttaccctgtttcctccattcttaacatcttatgttataatacttttgtcaaaactaagaaacttgtattggtatagactttttttttttttttttgagatggagtttcactgtgttgctcaggctggagtgcagtggcaccatcttggctcactgcagcctccacctccagggttcaagcatttctcccgcctcagcctcccaagtagctgggattacaggcatccaccaccatgcccggctaatttttgttaagatggggtttcaccatgttggccatgctggtctcaaactcctgacctcaagtgatccccccacttcagcctcccagagtgctgggattacaggcataagcccttgtgcctggccctaagcactagactttatttggagttcaccaaatattggtagtggtatattactgttaactaaactctaaactttatttggaatcttctattaatgttttctttctgtcccagtatccattccaaggtactatattacgtttaattgtcatgtgtctttagtcttatctgtgacattttctgtcttatttctttgtttgcatattgccagctggacgttgatatttccaactctaatccagtactccaggatttattctatccttttttcatctgtaacttccttctcggacagtgagacacttagttcctactattcactatccatctacttatttgttctgtcccagtaaacatgtaaaacagtttcataattgttaattcatacccctgtgagaaataaccaattagagtgcaatttttttctctttgagacagaggctcactctcacccaggctggagtgcaatggcgtaatctcagctcactgcaacctctgcccccagggttctagcgattctcttacctcagcctcccaagtagctggcattacaggtgtctgccaccatgcccggctaatttttttgtatttttagtagagacggggtttcgccacgttgggcagggtggtctcaaactcctgacctcagatgatccacccgccttggcctcccttacctttcatctcatagttcatgttgaggttgagatgaatcttatctaattcagtctctttttctatatgtaattattgctgaagtaagcttttgtggaatcctatatcagctcatgccattcttctctaaatgtgatatattttcaattttttccctttgtagaattccatatatagttaaataatatatatatattaaataatatattttttaggatgacaggcgtgagccactgcactcggcctagagtgcaattttaagtgcaatctttttgtctttatccttataacttctagtcaaaacaccatttgctaaagttacttaggacagcttctctttttccccctacctccttcagtgtcgttatgctatacagttctaatatagttagattcatttctcacagtctgcattccatcttaggctacctcagtagcctggttgatatttatatgtatttttttttctcatttgatgtacattggagttcattctttgtgatttttacagttctgtgggttttatcaaatgtatagaattacgtattagccattacagtaccatacagaacagttccttcaccctaaaatttccctatgcctacattttattgttactctccttcccctcagccccctggcaacaattaatctgctttttatttctatagttttaccttttccaggaaaaacattacacatatatatcctttggggtctggcttatttcacttagtaatacatttaaggttcatccatgttgttgggtgtatcagtagtaattctcatttattgctgaactattgacataccataagcattctttatatattctggatacaagtttttgatcagatatatgattgcaaatattttctcccctcaatctgtggcttaccttttcattctctttattttttgtagagcaaaattttttaatttgataaagtccaaattaattttttataaatatattatgctttcgctgttgtatgtaaaaacttattaccaaatccaagttcatgaagatttttccctaatattttttctagacattttatagttttatgtttttcctttattattaatttttttacagagacacagtctcactaagttgcccagactggtcttgaactcctggccttaggcgatcctcccacttttggtctcctaaagtgttgggattacaagcatgagccaccacgcctggtcatagttttacatttagatctgtgatccatttgagttaattttacataaggtttgaataggtgtaatttttttgcatgtggacatttaattggtccagcaccatctgttgaggactgtttttcctccatggaattacctttgcctctttgttaaatcttgatcttgagtattattttgtcttattaacctttgaaatcttatgaattaaagctttgattttatttggtaatacacattatcatgatttttcccctaccagtttctcctaagtccactgtctatccaatcttcagtgcatcttcagtcaattcaaaaaggtgagaattgttattgttttaaagtccaagccttgtaaattatacagttcctctgggtctctttttcagtctcatgctacttaatttggggagtttttttttcttcctcactaaggggaataggagaataatattgagaatagggtgatgaaatcagtccctcatagaaacatcataagaacttaagagttgagagatggaaaagatctttatatacttgagtaataataattgctaacattattatataataccttacccataataagtagttttatatctattatcttaattttcacaacaacttagaagttagatactattattctgttttcagcctaagaaactgttagtaatttagccacagttgccacagctattaggtgctaggaccaggactagaatccatatctgaaccaaatgcccattaggttatattgccttccctgggtgatagtatagtagctacaatttaataagcatttacaacttcatgatgtaggtaccattattaccccatgttgtagatgagaaagctggctggaggagtaagtaacttgcagcagcttaatgttatcataaagtatagctgaagctaccagtacccaagctaaagactgcaatggaggaggcatggatgggtagagagcatgataggcggcagagctctgaaaaagtagtttcttatggtctaaacatcctcttcctaagcagctttgattcttctctccccatttgattataaataactccagatattaagcaaggaacttcccggctacattttccttactctcagagcacctcaccttaaattgcctcagtgattaggatgggtgcacagctttccctcttcaaaggtttgtttctagtttttctcacctttcccatttttcacctgtgttgtcatctttcatgaccttttattgaagatgggagctgtcttagttcattttgtgttgctatcacaaaataccatggactaggtaatttataatggacagaaatttatttggctcacagttatagaggctgagaagttcgagatcaagcagccacatctggtgggtgccttcttgctgcatgatcccatggcggaaggcagaacaagagagtgtgcatgagagaacaagagagcttggcttgcagcctcacatccttcaataatcaacattaatccattcatgaaggtggagccatcatgagctaaacacctcttattaggccccacctcccaaaactgttgcactagagattaagttttcacacatgaactttgggggacgtgttcaaaccatagcagaagcctaccacaattaactgataaaagtgtatactaatttagtctagcataaagagacaggccaggcgcagtggctcatgcctgtaatcccagcactttgggaggccgaggtgggtggatcacctgaggtctggagtttgagactagcctggccaacatggggaaaccgtctttccaaaaaatacagaaattagttgggcatgatggggcatgcctgtaatcccagctactcaggaagctgagacaggagactagcttgaacccaagaggcagaggttgcagtgagccaagatggtgccactgcactccagcctgggcaacagagcaagattccatctcaaaaaaaaaaaaaaagacagtgggatactatttgttaaataatatgatattgctctttttgtagactccaaaacgtcagttatcagcaatttgagatttaatctattacttcagatgattacagattctcaaagtgcttagtcgcacatttgttttttggtttttaaaattcaatgaacatttagagagtatcacatgctattgaactatactgagttctagagatgtgaagataattaatgtggtcttgctatcaaggaggttatggttagaggagggtagacatttaaacaaatatagtgttagagttgctaaaatggaagcaaagagatggctgtcacgcatgcagagtcagggagagcctagcaaaggctgcataaggtgaaaagggtcagtgacttgaacaagtgttttttcatactgtaggaagtagcccattagtagttcatcagaccagtttagggtgtcatatcttgtgacagttactatgggactgaacgaaggtggacgaacgcagaaatgaagacaaagacaaaaggatctttttaaagaaggggtcgggagctcctgctagtgagcaagggccctgagcttttacagccttttatatttattgggtagaaagagcagggaggaggaggtaaaggtcagctgcttgatttatcacaggttcacgtgattgctaacaggcttcaaatgtgcctatagataatcgcaagaaacactgtgcctgggcatgactgccctcagcattccttctgggtggcagatgcagtttgtcagtttgccaacaacctgcattcatgataacagtttgctgtttgctcatatagcctccagtggtatactgagttagtcacaaccctcattcttttggcctccaacaatagcatttatttttagtggaatagtgtatctctcacacagcaagtatatttagtgaaactttggttttatgtctgtactagtcatgtgaaatgtatttcttagcatagatttgtcaagtcagtttgaaaactacttttcagacaaatggtaagaagatagcttgacttagcttaatgcagtggagctaatgctccacctttttttttttttttttctactttgtcaggtttttttttttcctgttgtttgaacttcttacttttggtactagggttttttttttttttctttcttatttacttctactctttagggatttctactcctttggtccctggaaaaccaaggtcctttcattacaaggcaagggttacaaactcagtacctacagaaccagcaggctgggtggagactagggccagctgaagaattgcccacttaaaagggcatgtgctattccaagttcgaactcatagattctttgatggagtagaggtttagtgatcttacaatgtctcttaatattggaaatacacatttttaagtgaaatctctagattttaaaatattggtagctaatccaaagtttttaaataccatatgggccaaccaaaacatatctgctagctagatttggcctgaggggctccagtttgcaacctctataagtgaatctcaacattctttcataataggtaaaggttgtctcaactacagctatccagcctaaatatgtttttgttttttttttttccttaagaatttcacagtagtgagatgctgcttttggtatgaggaaaagcaaatttagaagcttcattgcccaggtgctgggtcataatatgatggtgactctgatttcctgtggatctgtgaagttcagtattatacttattttctccagtaccccaggaatttcttcatagctgtatggggtaaatattgtcctaagatttgataaagcaaaaaaatctttttttaaagggcaaagtcaatttccaaagtgtgcatctatgtgcatctgatattgtggaagaaagtccctaggacttggagtcagaggaccaggatttgagtgttaacactgccatttactagttactttaccttgagtaaattactgaccctctctgagtaggcctcaggtttctctttgttcctgtccttattacttcatcaagttaatgtcagatagaaagcactaaaaattgcaaggtactctgataaatggctgctttctttcccttgtaattcctccaaaattgtaaatttatatatatcaactttctgtgtcaagatctttaggtgaagaacagttttctgtgggatctgtcaacttcatgaaacagaccaatatccagaaaaatactaataccagagatacaagtaaaaaaacaaaagaccagctcatcatcgtgagtaaattccaaacaaagcttctcctatctagccctttgcagaaaagcttgccaacccctgtattagacagttcagaacttggtattttcaatgtcattaagcaatgttttatgtgacagaatgggagttgtaggtggtgacattgaatattcttgaatttatctgtgcttttcctgcactctattttttgtcaactcttgggtcaaataattttaatattgtttaaaataatttaatattcttagctgcttaaggaaaaatattgtataattaatatagaagtcctaaaatttttgccctccctgtttgaaataaggctttttcaggtctttaagggtttcattaaaaagttccgttgttcattttagctgtaatttccacaatttaatcttattctttcttagaaccatgagtctagtaaataatcttgtaaaaataaaaaaatctttggtttttacactgtccattcaaataattccctttcatcaatttattgcatttttaggtctcttgtctcttttttttccccccccaaagagatggagtctcaccatgtcgcccagactggtctctaactccttggctcaagtgatccacccacctcagcctcccaaagtgccgagattacaggcgtgagccactgtgcctggcctgatctcatttcattttgtcttgggggagggaaggaggatatggtaaccagattttcatttagtttttcacttgtgtcagcaggaaaaaaaaaattaggtgaaatttgaatgaatggttataggaacttaatttagagctatttgtgctatatttaaatgggtttctttttttaccccccaattataggacgctggtcagaaacattttggggctactgtgtgcaagtcttgtggtatgatatatactgcttccaaccctgaagatgaaatgcagcatgtacagcatcaccacaggtttctggaaggaatcaaatatgtggtgagccaaaacatagtctttcagtttgttctagaagtaaaactaaaagagacatttcttttccaccacctctaccacccagccggaaaagttaacttttaatgatgatgtttcaagcttactatctcaatttaagataaatattttgtaaacactgcattctgagcagagctgaacagtccagatatacaaaattcagagactgcagagatactctcttcccactatagtgttgtctttataggtagccttaggaaaaaaatagccttcccatgacttctccaggttttttctgagaggagaggtcccacccatttattaaacacctttcaagtccaaacacatcctatcattggccctatctttatgattgtacctgctactcagatacattcctttttccctatttttattgccacggttaatgccttcacaatatttttagcctgtttattgaaatggcttgctttctgggttcccatagtgctaccagaaataacgttttaaaacataagtctaggccgggtgcagtgactcactcctgtaatcccagcattttgggaggccgaggtgggtggatcacctgaggtcaggagtttgagaccagcctgcccaacatggcgaaaacctgtctctactaaaaatacaaaaaattagccaggcgtggtggcgggtgcctgtaatcccagctactcgggaggctgaggcaggagaatcgcctgaacccaggaggtggaggttgcagtgagccaagattgtgccactgcactctagcctgggtgacaagagcaaaactccatctcaaaaaaaaaaaaaaaaagccatagatgaaacataagtctagtatgattctacatacttctggaaagaaaaagttcccaccagaagtttggtgctctttaatctggcctcaacctttcctatatatgtgcatataaaatacatacaaaagagaaagtgtgtatgtgtgtagtttaaattcttgccctctctgatctgatctctacatcagccagaaagttctttctaaaacataggttctgacattgtctgcttcaaatttgacagctttctgttgcactaggaataaaacccagactccttaccttggctgacagatctcttcatatttggcccctgcccaccttgtcacatgacacattccctctccagctctaagctcctgccgctggaataagccacattctctgatgaagccagactataccatacgggatttctttctttaatttgtggaaacatactgggcatgttatcctttatatattttgaatatcattcctgggttacaaatacattctccctgtccctttttttaaggtttgaatttatatttttgatatagtaatactttcacatgattcaaatttcacagaatgcaaaagtatatccagtgaaaagtgtttctccataccccttccagaaacctcgttcccctatctataggcatccagcattaacagattcatctatatatctttcagagatattttctgcatatacaagcaaataccattacttggatttttttaacctttttgtggtgtatattgctacaaagaaaacatttttatttagctagtttgtgacctttggtttcttaagtcaggaacatcatctcagtcccaaaattagtaagtttttcctatatttaaaaaaatttatagctataaattttatatttagacatttaatccactggaattttttcaagacatagtgttagagatggatccttatatttttcctaaaggactgcaaagtgtgccaacattactgtttgactagtttatcttccacactgattagcaatgccacgtttaatgcataccaaattcccacatataaatgggtttgttattggacacttctgcaccatccatttgttcctgtgctagtgccatacttttataaatgtagcttcatactgtatagttaggtaagttccctttcatccttctctgtaaaaaatgtcttgactttttctgcacatttactctttcaattaaaaagcctatcacattccccccaaatgaaaaacctattcgaatttttattcaaactagtcaaactaatgccattttctctagagaaaaaaaatcttagtataacttaggaacttagtatagcacatactattatataaacttagtatatactgtagtataaacctagtgtatacttagaaacttagtatacctctgattgattcatatctttgatgtctttcaggaacattttatagttttgtcatggatcttattaaatttatttctaatatttcaacctcattttttccaatcagtcagttataccagatttttttgccattctctgcacctttgcttattcagttagttgccttagcctgaaggcaagttaaccaccttccccattatgctcactgacatcttaccaaggtttttaaacccttttcagtaccataatatttcagtatcattcaaagactagggccacatgccaaagcactatgctgggggttgagattaaaatagttgtaagactgcacccatctgtggtcttgtcaagcataagggacaaacgtataaggacttttacttagccttttcttggaatttggcttattcttctacccctcccctacctgcccactggtcttgaactcctgacctcaagtgatccacccacccgggcctcccaaagtgctaggattacaggtgtgagccaccgcacctttacctctttaccttgttttatagtcatatacatgtcttcagataggatatcagcttgttgaggccagatacctgttttaggcatcttttatttctcttcccacattacttttagttggatttcatcttcttctttttatatctattattgtttagccttttgtcttctccacatcaaattatttaatgttggttttttttcctcttcacaaattaaactgtgacccttttgttttcctttggcagggttggaagaaagaacgtgtagtagcagagttttgggatgggaaaatcgtgttggttctgccacatgatccaagctttgctatcaaaaaggtatggaacattatctttttatctcttgcctttccccacccccaagaaatcaacctatgttgaagtgcaaactgcctttgctgacagataattcacttgggtacctgcttaatgattactttcatagcaatttatacaaaactaagaattgtaggacaaaggagtaaagaaggcagataaggctccacagcttatcttttatattcatctttcccttgtgaaagataaactaagctttcaatgttgagaaattaatggcccccagggtctatttcttatattggtgttgcttgtgtttctgaggttgaatgtttagccaccgtgaataatgaataaagctaaaacaaatctgttttaatgcttcctattccttatccctcccaggtgtctcaatttctgctgaaagtgatctttaaaataggttcttaaaaccttgtttccacagtagcagctacatgcatcaatagtgaaataattttggaggtgtataaatttaagaaatagaaattaaagaggctaaagtaacagtaatcatacattctgtgtatataaatatgtatagtttctattgtactttttaaaacattcacctgtcttggtttttaaaatcattaggtagaagatgtccaagaacttgttgataatgaattgggcttccagcaagttgttcctaaatgtccaaacaaaataaaaacttttctttttatatctgatgaaaagagagtagttgggtgtttaattgcagaacccatcaaacaggtatggtatatttgttttaaattattggcataatttgcaggcaaaataaagaaaagttgggagaagtctcagcatttaagattgctaccattaatgacactcttcctactgaaatatccttgacctagtggataattgaagttatttatttccattaatatttggaattttgctttgtataaacaggataggtaagccagtcttttatgttcatgtagtcattaacacagctggattataaagtctagtgattttaagtaaacaaatctataaactgaaatttttaaacatgtggcttagtgaaggttaatatttttggcaaaatagtcattacttatcccttaattagaatctaatttaggtactaattagcaatgttctagaagacatgtagtttctccttgtgttattagaagttggagagaaaagcagcttttttgtatttttgccagtataagtgatcagtttggccttttccttccccctcagctttattaaggtataactgacaaaaattgcaaatatttacagtgtacatgtgatattttgatataggtatacattgtaaaatgactaaatcaagctaatatagctatacctcacatacttaccaacttattgtgatgagaacattaaatctactctccttgcaattttctttttctttgtttttttttttttttttctttttttgagaccaagtctcactcttttgcccaggctggagtgcagtggcacgatctcgcctcaccacaacctccacctcctgggttcaggcaattctcctgcctcagcctcccaagtagctgggactacagccgcgtgccaccatgcctggctaatttttgtatttttagtagagacggggtttcactatgttgtccaggctgatcttgaactcctgacctcctgatccacctgcctcagcctcccaaattgctgggattacaggcatgagccaccgcacccggcctttagcaattttcaagtatacattagctgcagtcatgccatacaatagatctgcagaacttactcatgcgaacttaaactttgtaccctttaccaacgtttccccatttctcccatctctcactcccccagcctctggcaaccaccattctactctgcttctatgaagtcaacttctttagattcagtatgtaagtgagatgttgcactatttttcttttttgcttgactgatttcacttagcatgatgtcctccaggttcattcatgttgttgcaaatgtcaggatttcctttttaaaggctgaatagtattccacctgtatatgtaccacattttctttattcattcatccattgatggacacttaacgttgattacatatcttggctatgaataatgctgccatgaacatgagagtacagatttctcttcaacatactgatttcagttcctttggatatacactcagaagtgggattgctgcatatggtagttgcatttttatagtaatcattctaacaggcgtgaggtgatcttgttttaatttgcatttccttgatgaattagtaatgttgaatgagcattttttcatatgtctgttcctgatttgtatgtcttcttttgaaaaatatctattctggttctttgcccattttttaatcagagtatttgttttcttggtattgggttatttatatattttggatattatcccctattgtatacacaaattttttttccaatcagtaggttggttagtttgtgtttatccactctgtactatgcagaaacttttcagtttgatgttacatttatttcttcttttattgcccacatttttggggtcatagccaaaaaattattgcccagaccgatgtcaagcttttttctcatttttttccttatagttttacagtttcaggtccctcattttaagtctttcatccattttgagttgatttttgtatgtggtttgagataagtctccaatgttattcttctgtttgtggatattcatttttcccgacaccatttattgaagagactgtgtccttgccccattgtttgttcttggcatgtttgtcagacaccagttgactctaaatgcctggatttattttatctgttttgttccattggctgctgtgttttttaatgccagtaggagtgcagtgcccctcagctttactctttggtctagattgctttggccgtttggaatctcttatggttccacaagattttaggactgttttttgtatttttgtggaaatgccattagaattttgatagggattgcattgcatttgtagattgctttgggtagtatggacattttaacgatattaattctttcaagccatgaacactggatatccttccatttatgtagatattcttcatcttctttcatcagtgttttctggtcttcagtgtatggattttcacctccttggttaaatgtattcataagtggggttttttatgctattataagtggattgtcttcttgacttctttttaagatagatcatagtttgtttttcctgtatagaaacactactgacttttgtatgttgattttgtatcctgcaccttttctgcatttgtttattctaatagtttttttggtggaggctttagggttttctgtacataagttcatgtcatttgcaaacagatgatttaacttcttcctttaaatttgaatgcctttcttttttcttcctaattgctctggcgaggaattccagaactatgtagaatagaaatgatgagagttagcatccttgtcttgttcctgattaagaggaaaagatttccacttttcattgctaagtatgatgttagttgtgggcttgtgatatatggcctttagtatattgaggtacattccttctgtacctaatttgttgagagttcttatcatgaaaggatgttggatgccttttctgtattgagatgatcatatagttttgttcttcattctgttaatatggtgtaacacattgatgtgcatgtattgagccatccttgcatccagggataaagtccactggatcatggtgtactatgcttttaatgtgctagtttgcatctgtttatcagggatattggctggtaacttctcttgtagtgtccttttctggctttggtatcagattaatctggccttgcaaaatgactttggaggtattcttcagttttttggaagagtttgaggattagtattagttctttaaatatctggtagaatttagcagtgatgtcattacagatgggctttcctatgatgcaagtttttttttttttcttaaactgattgaatctcctttttattggttagtttagattttctgtttcttcatgatttggtataggtaggttgtatgcttctaggaatttatttcttataggttacctaatttgttgatatatgattattcatagtctcttacgatcctttgtacttctgtgataatcagttgtaatgtctcctctttcatttgtgattttgtttagttgagtcttcttttttcttagtctagctaaaggtttgtcaattatctttcaaaaaaccaactcttcattttgcgaatcttttctattttttgagtccctgtttaatttatctccactgatctttattttcttccttctactaactttgggctttattcttctttttctaattatttgaggtgtaacgttaggctacttgagatctttcttctttttttatgtagaactgcttttgctgcattccataggttttggtgtgttgtgtttccattttcatttgtctcaagaaatttgtcaatttcccttttaatttctttgatccattggttgttcaggagcatgtggtttaattttcacatatttgtcagttttctacttttcctcccgtcattgatctctaattttatactgctatgaatgttctgtgtgcacttgaaaagagtgtgcattcattccgctgctattggatggaatactatatgtgtttctgttaggtccattaggtctgaagtgtaagttcagtgtttactggctgaactcagtggctcacacctgtaatcccaacactttgggaggctgaggcaggaggatagcttgaggctaagagttcaagaacagcctgggcaacatagtgagaccctgtctttacaaaaattagccaggcatggtagtgcatgcctatagtcacaggtacctaggaggctgaggcaggaagattacttgagcccaggagttcgaagctgcagtgtgctatgatcgcaccagtgcactccgctcagggcaatagtgagaccctatctcttaagaaagaaaaaaaaagttcatttccttattgattttctgtctggacgatgtatccattgttgaaagtaggatcttgaagtcccctacaattttgtattcctatctatttctcctttcagaatcctaaatatttatatatttaggtgctccaatgttagatgcatatgtatttacaactgttttatcttaatgaattgacccttttattatataattaccttctttgtctcttgatggtttttgacttaaaatctattttgtatgatgtaagtgtaggtacttcctgttctctttcggtttccatttgcatggagtcgtttttctgacccttcactttcagtctatgtgagtcttttgtaggcaatatttagttgagtcttgtgtttttatccatttagccactctgtgtgtcttgattggcaaacatattctatttacacttaaagtaattattgataaataaggatttactattgccattttgttttgttttctggttgttttatatatattcccttcttcctctcttgctgtcttccttgggatttgatgattttctgtagtggtgtgctttgatttctttatcttttatgtatctactataggttttcgctttatggtcatgaggcttacataaaatatcctataatataacagcctattttaagctgataacaatttatatcacctacaaaagctctgcactttttttcccttcaacattactaattttacagtttacatctttttatgttgtgtatttatttaagaggccttttccttcttcgatctcaaagaagtagactgttatgtcctgataataggcaagatgtagctaactaactgttctcttctactctcaggtcagaaacaatgttgtgttgttcgtaattaaaaactaaatacacacctgtcagaagggtaacagtaggtaaagaattgagacaataccaaatgctagtgaggatatggggaaaccagatctctcacaccttgttagtaggaatgtaaaatattacagccactctggaaaaagttttgaagtttctttaaaaactaaacataggccaggcgcagtggctcacacctgtaatcctagcactttgggaggccaaggcaggtggatcacctgaggtcaggttcgagatcagcctgaccaacatgctgaaaccccccgcctctactaaaaatacaaaaattagctgggcgtggtggtgcatgcctgtaatcccagctacttgggaggttgaggcaggagaatcacttgaacccaggaggtggaggttgcagtgagcgagatcgtgccactgcaatccagcctgggccacagagtgagactccgtctctttaaaaaaaaaaaaaactaaacatgtatttactatatgatccagccattgttctcctgggcatttaagtaaaacaaaggaaaactgatgtacacacaaaaacctgtacaagaatgttaatagcagctttattagtaatagccaaaacctggtaacaaccaaagtgtccttaaatgctttaggtgaatgataagctatgatacagccatatgatggaatattacttagctataaaaagtaacaaagaattgatacacttaacaacttggatgagtctcaggggcattatgctgagtgggaaaaagccaatctcaaaaggtcatatggtatatgatttcatttatataatatataacattctcatagccatggggaataaattggtggttgtcagggactgaggatgggagagggggtagtgtggatgtgactataatgaggaagaagatctttgtggtgactcaatagttctgcattttgattgtgatggtagttaaatgtatatacaggtgtgattaagtgtcatgaaactatacacaccattataccaatggtaatttcatggttttggtattataccagttatggaagatgtaatcattggggaaaactcagggaaggatacatgctcctctgtagtggtttttttcaacttcttatgaatctatttcaaaataaaaatgtttaagaaacgaaatgccaaccaaatttcatagttaatagatataaatcttctttagtgttactggtttctttaggtggtcatatatacattttaggatggagagaatgagagagttttatatactttattaaaaggaagagtctaatgtttacaattgtttaagaggaaagtctcgtaatgctatgggacacactagaatttgtgaatgtctcaacaccactagtttttttaaagcattgtgtgactaaagggataagaatttaagaaatagaaaatattttttaacatacttggagatataagttaaatttttgatacttatttaaggaatttttttttaaagcagtgtgaactcatctgtggtgttagctatagatgcttctgtatatcattgcaggcatttcgtgtcctgtctgaaccaattggtccagaatccccaagctctacggaatgtcctagggcttggcaatgttcagatgtaccagaacctgcagtctgtgggataagtagaatctgggttttcagactgaagagaagaaagcgcattgcaagacgactggttgataccctcaggtaagaaataaaatggatctagatccagaaccttagattcatagctttcccagaacctctcggcttctgagctaaagggaaggatattggtaagatacttcagtataaatactattaaagtcaggctaaggaaggtattggtactagaaaaaccatactagatgtactcagtctagggtgcaacattccaggtctgaaacatactagcccactgcttttcaaactacctgtgctaaaggactagtttaatttgtcacagaccaacactaataaaataaaaatggattgctagaaaaaaatagaaaaaacaaaactacaatctcaaattgttttagacttaacagatgtgaaattacgcttcaataaatataatctatacaaagtaaaggtttgaaaaattacagaagctgtacatggtcattgatagtgactagataatgaagacttggtataactcataagcataactaaaaaagtggatttgtgagacaatccatagaacgagagaaaatagttgcaaatcatttgtctaagggtctaatacccataaaataattcttataacacaataaaaagacaacctaatttaaaaatggacaaagaatttcagtagacatttctccaaagataaattgcaaatggttaattcaacataaaaagatgctcaacatctttatcagggaaatcacaaaacaaaaccatagtgagatcccactttatacccagtaggatgactgtaatcaaacagacaagtgttggtgaggatgtagaggaaactgaaacccttgtacattgctggtaggaatgtaaactggtgcagttggtgtggaatacaatctgatggtttctcaaagttaaactgttatgtgacctagcagtttcactcctaggtatatactcaagaaaacatgtccacacaaaaccttgcacatgaaggttcatagcaggattatttataaaagccaaaaaagtgtaaataatccaatctgtgattaatggataaatgtgatatatcgatacaataataacaatgggatgttattcagccataaaggaaattctggcacacactgcaacatggaggaaccttgaaaacattatgctaattgaaataaatcagttgcagaagatcgcacattgtatgattatatttacataaaatgtccataagaggcaggcaaatccagaggcagaaagtagatgtgtagtttccagggactgaggaaagatgaatggagagcaactaataatgagtacggggtttgggatgataaaaatgttctagaattagatagtggtggtgactggacaatatttgttaatatacacaaaaccactctgttgtacacttttaaagggtgagtcttacagtatatgagttatatctcaaccaaaaaaatgagtgtccagttttaattcccatgtacacactttgaactgacactatgtattgatgtttaaagtttccaatgtcacaaacaagcctgtttgctaatttacctaatctaggttatatggatgagtttcacaacacttgctctctcaatttctacacatatttcatcgtgtagataataggttacaaaccagtaagcacactttaaccaaaccaaagaccacactttggaatagtgttattcaagcctcttgcattctatgccacttttaaaaaataaatgccaacaccattatggggaccggatcttgggccataaatcctagtcaatcacacatacttacaaagggtatcagtaggaaaaattggtatcttaaagatttttgtttgattagttatgaaatacttttctatgttttatattagatatataaatttggtatgaggaataccagtatctaacctagttctaccatattatgtatttaattatagttaatatattagaagcttatatcttctaattgaatcaaattctaaatttttattccgaaataatttcaaacttacgaaagaacaagagtagtaggaagcctttgtcaagatctattaagttcaacatttacctcatttgctttaccattctatgtttagataaccttcctgaattattttgttacatatattatgcccctttaccccttcatgcattggtgtgtttttcttaaaaacaagaatattctcttatataaccatgatacagttatcaaatttgggaaatttaatattgatgtaatgcttttatttgacagtccatatttcacttttgtctgttgtctcaaatgtccttcatggcatttttttttttttttttttttttgcccagtatcacattcagcatttagttttcacgtctctttaatcttcatcttccctaatctggaacaatttctcagtcttttgacatggaaaaatttgaagagtgcaagtcagttattttatagaatatccctcaattttgattaattctttttttttttctttcacaaacaagctgtaggagatgttgaattcttttaaccatttccttattacttttaatcctaaggtaagcaagatcaaggagagttgtagtcaaaatgcagattagtttttcccttcttaaagctctcagtggatgtttacattgaaaaaatatatataggctggacggtcgctcttgcctgtaatccctgtactttgggaggccgaggcgggtggattacctaaggttggaagttcaagacaatcctggccaacatggagaaaccctgtctctactaaaaaaaaataaataaataccaaattagccgggtgtggtggtgcatgcctgtaatcccagctactcgggaggctgaggcaggagaatcgcttgaacccgggaggcggaggtttgtagtgagcagagatcgtgccactgcactccagcctgggcgacaaagtgagactctgtctcaaaaaaaaaaaaaaaaaaaaaaaatatatatatatatatatatatatattatatatatatatatatagttactgcttaagattgattttttttggttctaattatctttggcttttaattaacaatatgatcttttttttatttttattttttgattgagttggagtctcactctgttacccaggctggagtgcagtggcgagatatcggctcactgcaacctccgcctcctgggtttaagtgattctcctgcctcagcttcccaagtagctgggactacaggcatgcaccaccatgcccggctaatttttgtatttttagtagagacagggtttcaccgtgttaggatagtctcgacctcgtgatccgtccgccttggcctcccaaagtgctgggattacaggcgtgtgccactgcgcctggcctagcaatatgatcttatattagttgctctttaccatggatatcctagagttaggtggatggttccctttgcctctcatcagaattttttctggaccttagttttcccatctgtgaaatgatatcattagacttctgtctctaaaatataaggcattttttcacttactaaaaataaggttgatttaagtcaagagtatttacttaaattgtgctcatgttaattagaatgttaagttgcttccatcattaaatcatcttttcttctcttttaggaattgcttcatgtttggctgttttctcagcactgatgaaatagcattttctgacccaacaccagatggcaagttatttgcaaccaagtactgcaacacccctaatttcctcgtatataattttaatagttaaagctgatttcagttataaaggagttactatctggataagttcaaagagctccttattataaaatacaaactatttaatatcaaaataaaaaataccgagactcacactcatacacacacacacacacacgcacacacacatatcacagttttgttccttatgagttgaaaagtcaggaataaatttgttgaaaattatctggggattcaaaggaaaaatctttgggtgattccctgattagcactctgaatgtttaattatgaaactttgtagctataactggaaaattacctgactctttgtaagagtattaaatacaaagtgatttttctctagaaatgtgacctggtcttttataaagcccactcttagaccaggattatctaatgccacatcagaagcaaacaggcaaatttaaacttgggcaagtaatttctgtgcccaatttgtaaagggaattcctgaatttttttttttttttaatagaggcatgggtctcactgtgttgcccaggctggtctgaaacttttgggctcaagcgatcctcccaaaacgctgggattacagtcatgagccaccgtgcccagcctaattcctgacttctctatacagagtcttcacttgataggcactcgtctgtagtaactcagtttgaatatctttagaaaatgtttagaatttatttgtaacaagatggtaaggaataagattatcccatatgcatttctgtagagcagaatttgatagcttagtgttcaatctttttgaaaataaatgtttacctgtcatcagatttaattaaaattatacttagtaattgcactattacttagttaatttttgttgtatggaaatattggtagtactactttgggaacctgttactgacaattgatgtcattaacaaaatgcctagttggattagatgttttcattttctaattttttgcttgtttaaaatgcaccttacttgttctgagatacctggcaaaagtctttacaaaatgtatggtaatagaaccaaggttagtaaatatacataggctggtggatgagagaccatggaactgtgtaaatacacttaaatgttcacacatttttctagtgtaattcttggatactttaaaaagcaaaacattgttcaaattgttttgattctgaaaaatcattcaactgctaactggcaataagactctaggcaagtcgttttccagattgtaattatatgtagaaactattcatctgcattcattttatttgcctgtaagttaacatgtttccaaaatttaaaagcctgggtccccaaaagaatgtggaagtattaaaatgtatgtaattatgcaaacattttaatgctattttctgcacttatttcttttaaatattttatttaaaatttttaattaacattttgtttgcttaatgcttttgttatgaatcaattaaaattctttattttatacaactaaatctgattttaattattttattatgaaaatagtatatgttaaataaaattcagataatacagaaatagagattgccaaaagaagaggcttcccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcgagcttgcagtgagccgagattgcgccactgcagtccgcagtccggcctgggcgacagagcgagactccgtctcaaaaaaaaaaaaaaaaaaaaaaaaaaaaaagaagaggcttcccttaatcctgctttgagtttagtgcttattactttagaataactaaatacatatgcagttattttgcatcttgcctcacttcagtatgtcttagatatgttgtatttcaagaactatttctattttaaatatttagcatgatttgctattgatactgttgtcttggttgggtgttttttgtttgtttgtttgttttgtttttaagtataacacatacaagaagcaagtgcactgagatggtctcaaagcaatgataccctaatggcaatgagcacacctaccacccagatcttggttggtttctttctttttttcccccgccctgggctgaagtgcagtggtacaaacacggctcactgcagcctcgacctcccaggttcaagtgatcttcccgcctgagctccctaagtagctgggactacaggtgtgtgtcaccacgtctgcttaatttttgtattctttttttagtagagacagagtgtcaccatggtgcccagccagtccttaagctcctgaggcccttgagctcctgagctgaagtgatcctcccacttcagcctcccaaagtgctggattataggtgtgagccacggcacccagccagatcttgcttactaataccttcttccacaaaaggacctggggctctttggagaaatggctcattctagggatagggcaatgaatgtacaagatgagcctagatcaccttgtacatccccccttatctgcaatttcgcttcccacagtttgttaccaaaaatattgcatggaaatttctagaagtaaggaattcataagttttaaattgcccaccattcagagtagccacagtggggtgataagtgctcagttaagatggaaaaggcattaaatttgtgggcagaagacatgcacagaaacatattcctattgagggcaatcaggttgagtactgtccatggtttcaggcattctactgggggtctttgtcataaattgtgccaatatatgtgtatgtctatttctgcctgtgtattcttactaattttatataggttctatttatgctaataccagactgtgttaattatagtatcaatgtttgctatagtattagtacatggtcccactttttttcttcggtctattattggactttgcatttccatatacattttagaatcaatttattccacaaaaagctaccaacaacaaaaaagcctgttgggattttattggaattgtgtcagatctatagatcaatttgggaggactgatttttagacttgctcaagtattggatactttctttttttttttttttttagacggagttttgctcttgttgcccaggctggagtgcattggcactatcttggctcactgcaacctccacctcccgggttcaagctattgtctgcctcagcctccagtagctgggattccaggtgcatgccaccacgcccagctaattttgtatttttagtagagacggggttttaccatgttggccaggctggtctttaactcttgacctccaataatccacccacttcagcctcccaaagtcctgggattataggcatgagccagtatgcccagctgttacttttttttaagccattgggaaaagtgttttaagttacatcttgtttgctgatatataaactacaagttttctgttttgactttgtattcacaatctttctaaacttaattaattctaatttatctatttctatctacataatatctgtgaatgagttttcttttagaatcttacagcttttttgttcttacaatattgcatttctaagattgccagtctagtacagtgttgaataaaagcaatggtagggggcatatttgtttcattgctgataataggtaaagttttcaacattttactattaaatataaggtttatagtttctttgtagataaatttctaatattaaggaagttcctctgtctattcctaggtttctaggaagctctcaaacatcttgaacagatactcagattttataaaaagtctttcttctatctttggagatgattttgatttttctttattgttaatatggcggttacattgttctttgaatgttaaagcaatctagcctccctgaactaaataaaccaaacccaatttggtcttgatgtttttctttttaatgttattggcttcagtgaactagttttcttttggacttttcatgtgttcttgaataagattgggtatctgtaggatctgtagtaaaggttttttcattcatgacatgtcttttttctccacagatgagttttgcctaggggtttatcaattttgttagtatttttgaagattggcattgttaatcctatcataggtttgttttctatttcctgtaagttttaattttttccccccattggaagggaggtactatggtctgaatgtgttctaccaaaaattgtatgttgaaaccctgtcccccaagatgatgtaataccatcgtaagtagtgtctttaggaaggtgaatgggtcatgatggtggaaggaacccttagggattaatgcccttataaaaatagagggtcggggagctcccttgctctgtccaccatgtaaagacacagccagaaggtgccttctatgaggatgccctcaccagataccatcttgatcttggacttcctagtctctggaactatgagaaatttctgtggtttgaggcacctcgtttatggtatttttgttatagtagtctaagacgggagacttgttttgtttttcccaaattcttagctgatatatatagcatttttttatatatagtttttatatgtagcatttgtctagtttaaaatcctttctaatttttattctaatcaacagattgtagaagattaaataggtaccaggagacatgaaagaatcatcttcaacatttctcaagtagctgctgattatctccttttatggaggcataacaagctcctggaggcttctacagattctaaagggaaagatttcctgggaggtgagaaagccacttgagagaaggctattttgatttactaattaattcagtgtaaaggtagtcctgggcacggtggctcacgcctataatcccagcagtttgagaggcctagacagaggttgctcaggagttccagagcagcctgagcaacttggtaaaaccctgtctctacaaaaaataaaaaaaaaaaaattagccaggtgtggtggcacacacctgtggtcccagctactcggagtgggaggcagaggtgcaaggatcacttgtgcctgggaggttgagactgcagtgagccatgattgccccactgtactccagcctgagtgacagagcaagaccctgtctcaaaaaaaaaaaaaaaaaaagccctcagccaagtcacatgttgctcttttgagaatgaggcaaatgtccaaaaagataacatctgagacttagagcaagttctagaacaagaataaaaaaaattttcttccagttggtagcagattgtctgcaatcttgtgttgaggatttctaggacctcaccagactcaaggggcagtgcatgctgggattattttgtaatgtctaccatagacaagggctgtgaatttgctggtcttgtccttggtattagtttattcctattagatatctcaactgtaggaagtggaaataaatttctcaatgaaaagcaatggcttatgtattaaagagccaattcaagaaagatccagttcctgctttaagtcttaaagcaggaactgctattcctgctaggaaaagaatgccctggagaagctgctctgttggcttggcaaagaagagtgacacatgtcagagtgaggataagagaccctattgagtatcaggatgcaaaattatacatacgtttttctacaaattaagacaacttccaatttacttgtcacattattttgatggaatatatgcaaattaatgttgtgtcctattgcttggtacaatcttataccaaaaggccttcagtgatttctaggcatttttaaagttcagagtgcagttgttcctaatgtttctgagaacgccctgtgtcggtaatttttaaaattctgtctacacccaaatgtaggtataccacctacattggcaattcagtaatttggaaaattcccaggggactgtggcttacagaaactactgatccaaaacactttatagattagcaaaataaggccaagagagggaaagaaacctcacatttactcaagtttaatgacaacactcaaatcaatgaagtataaaataatgctgagacaccttctggtacccaaagtgtcctttattctttatcatcctatttgagttttattgtttttacacagctgggaaatgcttaaggtacaaattaataaattttaaactcagtatggaaaatacatttaataaattaaagcaaaaaccaaagatctgaggagatccaagagatcaagacaatctgtaaccagagtctgaagtatccaaggagctactctttttgaggcatattctcctcagcttccagttatcatttgataaacacatcagcaaaaggttcagtgttttaaacaaatgtagactttattttgtactgtacaaagtgctaatgtcagtagatccattaaaatatagaatatttaagaaagatcattaataaaagtaatggtcattcaatttaatgttacagtttacagcgttttactgctagtgttttaagtcagcatgagcagtatcaaagtacttatgtagctagtttctaaaactttacagaaaacccagtacaattccaagtgcttatagccaatataagcatatttcatattagaaatagttatccatatgttaacaagaaactatggtcctcaaatatgccaattttagagtctaataactactgatagtaactatgtaaatattttggaataaacagttatttacgcaagccacacttcagctgagatgatcactagacatctgtttccagagcttcaacaatgtgtgcagcagaaggacgatctttagggtcttcattagtgcatacagagaagagttcaattactttctggtatgattcatccagttcttccatattaataggtggcctagttcccaacgctgcatagtatgcttcatcatcaaaatcactttcatcaaaagttttatcttgaaggagttagagattgaaacaataaacaaaatcactttatgtcatggaaaagtttaatagctcacccttctcctgaaacaagaatttatggtccagtatgctttccattctgccacagacagaatggaaatgtcttcaattgtcctgccatcaagtagatttgctttagtcttggatttataggttatcgacccctacttttacccttcctgtgatagttttccaatcaatcattttctcaggaaaggggagtttttaagataatgttttgcttctctggatagcctcaatttttctccctattctcaatctatgtctcatttgtgtgagattaaaccttggtggtaccaaatcagtcatcagtactaatacatatcttagaaagataaaattatataatctttagtgtgaaatgaagagattgggatttatgttagaaattgtattcataccttcatcatcatcatcatttgaaagattaatgtgtggaatcgataaagtcatcatttcccacaaagtaaggccaaaggcaaatatgtctgccttgtcagtaataacaccattctcctccacagcttctttgggtttccatggctctgtgccaatgtaacaagcctcagggtcagtcactgaaacaagcaagatggttatgaaggcaggagctacaaatcacgaaaaggcaagcaacccaaagggaaacaggcgaacgatttgaacaagtagttcacaggttaatcagtgtagccagaaaatgtaaaaatacactcaacctcaataaggattactttctacctttcaggttggtaaatattcaagaagctggtcagttggcaggtatgtagagaaacagcaattctcttacaaattagtaggaatatagaatgtggatgttgagattacagactctggagccagactgccttgcttgggttggttcaaagacatgtgtgtgcaagctgcgtgaccttgagcagatcacttctagacctgaatttcttcattttgtgaacaatattaggctgagagaagtaccatttctatgcttccatgattgctatgtcaaggaaaagggaaagggaccaatcacacataggctcttttttaaagcccaagaaagaaataggtccactcacatttccatttaaacttgagtcaacttgtcaatttcaatgaaaaagccagctaaaattctcattaggattggactaaatctctggatcaatttagtaagcattaacatcttaatagtattgagtcttccaaaccgcagtcatatatttctccacttagttatatcttactgaattttctcagtgatgctttatagtattcattacagaggttttagacttttttggttatttattccgaaatattttgggttttggtacttgtaaatagattttaaacaattccattttcaattatatactgctaatacacagaaatgtaatcactaacttcactatagctgttttatagattccttgggattttctacctaaacaacatatcaactgcaaacggggacagtttcgtctcctttccaattttgccttctccattttcttgccttattttagtggctagggctataggactgctaaataaaactggcaagagcaggcatcctggtcttgttccctacttcagtatgatacctgcaggtttttcttgtagacagcctttttcaagctaagatcccttctatttctagttagctgagaggttaactagattttaaactaacttttaaatcaagaatggatgttggattttgtcaaacactttttcggtatctattgagatatgtagttttcaaatttgattaaagacttaaatgttggacctaaaaccataaaaaccctagaagaaaacctaggcaataccattcaggacataggcatgggcaacgacttcatgattaaaacaccaaaagcaatggcagcaaaagccaaaacagacaaatgggatctaattaaagagcttctgcacagcaaaagaaagtaccatcaaagtgaacaggcaacctacagaatgggagaacatttttgcaatcgacctatctgacaaagggctaatatccagaatctacaaagaactcaaacaaatttacaagaaaaaaaaaaaaaaaa
